United States Patent 10,240,205 (METHODS FOR ASSESSING RISK OF DEVELOPING A VIRAL DISEASE USING A GENETIC TEST) - sequence listing, part 8

SEQ ID NO: 245 - DNA, 1048733 bp, Homo sapiens
tgtgaaatcagaagtttaatatgacacaattaaatatatttgtatatctcacaccggaggtttctcttcaaacataaggagttagaaattacaagtaggcatatgcttcctatattcagataaattcatttcgattaattaaattccagatagagagaagtaattttggaaaagaaatgatagctatattaaagcagatattcattacaataccatgtagagacataagcaatattttggcatcattctgtccgctcagtaggccgtgttccctctggtagggcctttggagagtaccatctatctaagatggaggaatgctgtgggaagggcgggatggaggtgcgttttctacgctgaaccccacacaggaaatctgcagcccacacagctgcctctgtgccgccttccatgtgatcatcttggtcaatgaagtgaattgtcctatttctggggtagggggtgatggcgaatcggatactcaaatgttattttgtcaaatccgaatcatctctacgtgcttaggtttacatgatgtcaaaacacgtggttcattaagtgatcccgggaagaggggcagggccggtcggctggtttctcacttcccttccaggctctacgcagtgcgtgcaggtcgccctgatctcctctcccgggagggaaatgctcgcagccctctccgagttgccctgatctccttctctcccaggagggaaatgtcccctctctggggccccacaggtccgggacgtgcctggaggagccagcgggggcctggcagggttcgtgtgctcccggggaccctcatagcttgctcaatgcccagatttgttcttcctggttgtggttatctcacaggtaagcattcacgggggcatctgttttcataacgtagaaatcaatattttaacattaaaaacacatctcaatgttggggtgcatctgtaactttgcaaaggtgaggtcaggggagtgccagcctcaagtgggcactactcatggggtgcacaggtgtctgcccccggggagcccctgaatcactctgcttgggctgacaggtgtggctgacggggccgtccatggtacccggcgcagtgttgatggagacgcagcgaggagctgtgattgtctcacttgccccgaagctgcaggacgttcagttctgtccctgcggcttctcccaatgataaactctctcaaagagaaatgccaaacgtgccttgtgtgccgggcggcctcactgagtgctgccagcttccccggccactcctgcacagtggatccaccctcccgaaagtggcagatgacaagcacactcttcctggaaaccgcctcgaacgtgctggctactgcattgttaacacaacttcaaccaagaaggtgaacgggtgctttaagaaaaagtattttttttaagcaagtgaaaattgatgaaccgattcccctccacccgtaactggatttttccacaaatctctctttattattgtttgattaaacaaaaatacacttttaactgctaaactgcgctgactacgggagagctaagggccctattactatgcagttataatagaagacacacaattaaagtcagatcatgattcctgacaacatccgtggggtgggggctcccctgaggcccctgaggctgccgctcactggggaagggccttgaggatggcgttcacctcctcagccacggctgtcagcgcgaactcaaactgctcctgcagggcgagaaacgagagaagtgccaatgagagcggcgtccccccgactcctgccacagcgtcggctccctgcagatgaaagcggcgtccccccttcccaacgcagcatcagctccccgggccatttcgcagaaagaaattgtttagcaaaaaaaagcaaaaggctcagatttccttagaaaggacagtgtacccttcggtttgggagacacaacagtgacacatgtttgagcttctctcgcactagaaaagcctcatctttccccctgcggggagaagctgcccacagaagcagcgagaaggcaacggttcctgcgtactgccctgtccttctgaccctacgactccacgattcctcctcacagccacccgccttggtggacggtgtgaggggcaggtgcagacactacaaagacgtggccattaaaactcacaatgagggccatgcttgggcgtttcctgtcctcggaagtgtggtgttatcatcgcttttgaaatccacctgttactcagaccaaacccactccgttccacatgctgagaaacctccccttgtccacacccctcctggctcagggcatgcgcgtccacagccacttgggcaggcacacctgaggggcacccctccctccacggacagcctgccgagagcatccagtgggcacgagggacgggttcacgatgccaggactattcgctcctccaaagaccagggcttagcgccggagagcgtatctgcctcctctcccacagatgaggtggataaatgctcatttcctcttgctcttcagtttccacctcaaaacactgctatggaaaactccaaagcaggccagcagcactccagctacagctgagaacgcgtggacggaaacaacactgttacccagctaacaacttctggaaggaaagccctgttgacagctccaatacttgatcatttaaggaacagggcagccccaagccaaaaacgatgattaatttccagttttgaatgtttagtgcataacagaaagatggaaaatagcttgaaccgagacatcagaaagtcaaaataacgtgatgctcattctgagacaaaagacagtttctcctttcatattcttctgccctgatgctgacggaatggtctgctggactctacctgcctttggtagtgtggccacgcggcctcttagtgtacgtgttagaacctattattaaaggagtcaactgagcctggcggccacctcagggtgggacccggggagatgtgtctgcctgcgccccgtctctctcccctctgcactgccagagggcacctttctgctcctcgaaattacgtgggagctgcccctgtgggggcaggggctcaggtcgggctgtgccgggaaggtccgcaaacgttctgtctaaatgctgactcctgcccctcccacaccaagtgtgttcgatgaaggtgctgtttaggggatccaggctaaatacacaacagccattcagaccatttcttccccagtgctgggctgccagtgccctgaggctctgtgagggcttggagatgccaaaaattaagcgtggctttttgggaagcgaaatgcaagtgtcatctatctatttacatcttccgacacactggaaatctagcctgagaaatgatctttaaagggaagaatagagaagcgctgccgccccgcagccccatcatgcagtggaggctggaaagcgctccacccccagggccagtgctaatcctgcagagctgcccagcggcctctcaggcagccacttgcggcatccaacaggaaagcccaatatccatgctatgggggaggggacgggcagggggaactccaccagggtctggatcataactgtttccaacactgcacagtcaccggacagagcagcaggaagggaaccgggccacagagacaggtgctctactcactggccatgtttggcaattgttaccgcactgtttagctcaaaggagaagctccaccgggcgtgtgggctggtgtgtgccgtgcaccttactcagagcccactgggccctgtgggcgtcggctggcaggaggagggggtgcttcccggaggggtgctgtgagcctcagagctggcgtttgaggggacaggggcttgtggatcatcttgtcctttatcgtgaagtgtcagctgcatgcggcgccgggatgtagcacccaagccctgtgggtcctcgaaggtctgtggccacgttctgagcagaatccgctgagcaagtatcacctagaaccatgctctagatcccgggtaggctgggaaaaccccagcatttggataacttttatgataggagtttatttcaaaggagtaaaatacaacagcaacagatgaccagatgaccatcttagcctaaactgcatctgagtgccagcagtctgaacaggaggggtgcaaagcctcctgggtttgcaaagacaggacattcgagaggccgagtcaggacattctaagcaagaaagcatttttgaacacatactacaataaaatttgaggcctgttggagaaagatcccacggcttcttccagtagaactgcacccggtggagaagtggctgaggtgggacggccgagccaggctcaggccaggtcaggctgtctggtcaccacccctgggtccacgctggacagcgagtgggaacgccccttctcaggctgtcctgggacaaccacggggtgcccacatagttggtggagggatggaggctgcaggagctgccatggctctcggacacccgctgctggggtaagggtcagccagggctggaagccgtggagctttgtggaggctgcttggatttctatttgtgcttatgtttatatttgtaatccttcaggtgtaaacaaaggcctgggtggagatgtacaaataggaaccttaaagaggacctcagtgatcgtgtctctgagccacctgtgccctccaggaggctgcacacataactgcggggcagcttcccccagcacctctcaaaagggggtgaggatgacacaccttcctgtgtctgtcaccttcagcttctcttttcacaaaagtagacaagctccaagccacaccgtgagagttgagccctgcccaagttagggactaggcattgtgtgtgtgtacaccagggcggagggacagagacggagatggagagagatgggagacagatggagagagacagagagaggtggagagagatggagagcggtggagagagacagagagaggtggagagagacggagagaggtggagagagacggagagaggtggagagagacggagagaggtgaagagaggcggagagaggtggagagagatggagagaggcggagagaggcggagagagacggagagaggtggagagagacggagagaggtggagagagatggagagctacggaaatgaacagtttcaatggcacgggaggccttgggagaagtgggctgcgggcctggagctgatgtgtgagcgtggactgcgctacgcgtgacagaatccgtgtctgtcactccggtgctgtgctgggttgggaagataggagcatgtctgggcaacgccctgcttctgggacggaggacaacaccgggtacgtctgaggaggaggctgaggtcaggctttaggacaaggggctggtgcagaagaaaatggggaagaaactaaaatgcagatgtgagacggcaggttggggagagtgacgcacgggcagcacgtggacatgcgaggggcctcccgtccagtgaggagggggcggggcctcccgtccagtgaggagggcatggggcttcttgggtgtgggacacactcatcactggctctacttctggaactgacagatgtaaaagaggaaacaccattgtgggcaggaaagtgttaaggtccttggtgaaatgggaaactcttgagacgtgtggagggaaggaagggaagaacccatcatctaccacagaggcatggacgggagagaggggtgatttcagccttgtctggcatcccttgtgtctgctgagggtgtgtgcacacgggaatgtgtgcgggtgtgtgtgcgtgcatgcagctgtgtgtggatgtgcatcgtgtgtgggtgtgtaggtgtgtgtgggtgtgtgcagcagtgcaggtgtgcatgggtgtgtacaggtgggtgtgtggatgtgtgtgggggtgtgcacagctgtgcaggtgtgtgggtgtgcagggtccatgactgtgtgtgggtgtgcactgtgtgtacacctgtggaggtgtgtgggtgtgtgcagtgtgcatgggtgtgtgtgtgggtgtgcaccccgtgggtgggtgtgtaggtgtgtgtggggtgtatgcatgggtgtgtgcaggtgtgtgggtgtgtgcagtgtgtggctgagtggtgtttgtgggtgtctgtgggtgtgtgtgcaatgtgtgggtgtgcgcagtgtccgtggctgtgtgtaggtgtgcactgtgtgcaggtgtgtgcgtgtgagcagtgtgcacggctgtatgtgggtgtgtaccacatgcgtgggtgtgtaggtgtgtgtggggggtgtgcctgggtgtgtgcatggggatgcgcagtgtgtggctgagtgtgggtgtgcactgcgtgagtgggtgtgtaggtgtgtgtggatgtatgcatgggtgtgtgcaggtgtgtgggtgtgcagtgtccctggctgcgtgtgggtgtgcgcagtgtgcaggtgtgtgggtgtacacagtgtgtgtggctgagtgtgccgcctctctggcggctcgtgtggtgtcaaagcccgcactgccgttcagcccctgggtgcctggacttctcttctaagatgatggagtttgtggtcggggactgagttgccaaatgctcaggtgggcgctggtgaaacattttctattcgacccaaattccagggaggaaacagctctcctgaggggcatcttttttaccacaacgatgatgttttgctgtcagggcctgcggtcatcctggtcatggtctccgggtgctcaccctcgacggctcgctctttccttgtcttcagttccaaaccaggcgacgtgacttcctccgttcaaaggagctgcaggcgcctcctcttggcttcgtagaagcaagcattcagattggacagcagcattttgcccaaataatttttctatctttgtgaaactgaacttgtaggggaagtttagtctcggggcgatgttgggcagcgcagtcacggattaagatgtgatggtgactttcgcatggttccatttccttatgccttgaagttccaggagctgaatttatgtgcatgctccaagacagctcctgaacacacaccctgaggaagagggtgaactcctccggacgcccagtccaagaaggaagcagctaggaagctgactctgttatctggagtgcagaaaacggagcttcgggtcaccaagtgatctgggcaacagggctggggtgtgtatgtgttatcatcttgctatttatttatttatttatatttaagttctgggatacatgtgcaggacgggcagctttgttacataggtaaacgtatgccatggtggtttgccgcacccatgaatccatcaccgaggaattaagctccgcatgcattagctatcatcctgatgctccccatcccccttccccactgacaggccccagtgtgtgctattcccctcccagtgtccatgtgttctcattgttcagctgtcatttataagtgggaacaggcagtgtttggttttctgttcctgtgtttgtttgctgaggatgatggcttccagccccatccatgtcgctgtaaaggacatgatctcattcctttttatggctgcatagtcttccatggtgtatatgtgccacattttctttatccagtctatcattgatgggcatttgcgttggttccatgtctttgctgccatcttgccatttaaaaatggagtagaacggaagacctggcatgtaatgattgtgactgtggcttcctctttctctgatgagtcccaaagcacctcacttcacgaagggtcctgggaccaccgttgtgcacctcagccatctgtgtgccaggaagggcttgttctggcgaacaggatacatacaatgggaggcttggagggtttgctccttgtgatttttttcacttttggcaaagatatccccttgcgatgattttgcccagacccatcctaaagccagtgtgtgttctgggcaaactcacctgtctggagggaagaggctgcctgacaggcaggtgttctgggtgaactcacccgtctggagggagaggctgcctgagaggcaggcagaggtgtggggaggaaactactttgaatttagatttcctggggcttatcccagagtgggcctcactgtggagtcacgaacacacctgcctgaggtggctctcgctgaccattcctggtaatgtgtgccccgttctcccagcctccatggcctcctctgtccagttcagagccacctgaagctcacgggatgcagggccagccagaaggtggtatgtgccagccttgacaaggccacctcttttactgctaggcagccagtacaggaggatggtcagtgcggcaagatggacccttccaaggttggacccttccatggcacaaaacctggaactccttggtacagagaggccagacacacgtcaacctcacgtccagttcctgttgagccaaagctcatgagaacttttttgttttgatggctgttgctgctggaacagcagctgtcccgtgtcacctcctctctcgacagcctcgcaacacatgccgaatgctgttgtgaacaagcagaaggaaagacagacatgtgcacagtcccagcttctccccgcgggacactgagtaaccacacagggaaaaatcatcacgcagccacgcagaagcctccagacacacacgcctcagtgggtgtagatgtgccgctccctcgtgagggacagtcctgccccctgccctgaccatgggggacgtgggacacgcctagacaagagacgttccacaaagagcaaggccgctggcgctctagaagacctcacagccgtgaagcgtcccggacagcagaggaaccatgatgcccctcgcgtggccgccctgggcgtgtcctgctccaggggaagctccctgggggggcgcgtagggcatcgctgggcctgttggtcagtggtttgcatcggtgctgacttcctgggtttggtcactgcgctgtggttatgtgaggtgttcacatttggggaaacttggtggagggttggtggattatttctgcattttatttatattttttgcttgggaggctgaggcaggagaatcgctttaacctgggaggtggaggttgcagtgagctgagatcgtgccactgcactccagcctgggtgacagagtgagactctgtctcagaaagcaacaacaacaacaaacaaacaacaacaacaacaaaaaccgaataaaatatagtgtcccaagacttacaaagaactttcacaaaatcacgtgatggtcctaccagttgcacagagagggcgaaatgaaaccaaggagcagagaggccaaaggcacaccaaccccagcctcagggccagagagaccagacacacgtcaacctcacgtccagttcttgttgagccaaagctcaccagaattttttttgttttgacctctgttgctgcaaactgggcctcttcagcaagcatgagggattttgggtgctcaaggatgctgtgccctgggggcctccacaaagcgcaggccccggagaggccgggcagcgctcagagagctcagaacatcctcctgagggttctgggatttatcgtcaacctctttctacaaaaatgcagcgttctccccccacccccaaatctagtgaatggaaagagccagtggatcgagttcctaggacttgagatgtggctgcatctggaggtgttgcaggaaacgccagtggacctttgggggcccagaagtgaccccgcccatgcaaggccggcatggacgaggccggtcagagcagagcaatcggtgtgcggctcacattaaaccaggccctccccgtgctcctctcaggaacacggccgcagagaggcaccttgaatgggtctgcgtcccggaggagagactgacagtaccttcgtctggaccatgccgggtctctggtccctcaagtgctccagggtcgctgcgatatcaatctctttagcacctgcaacaaaccacaaattgggctgagttcagagcacaagataatccatgccacatctgtcaatctcctgctagccacgttccctctgggctgagaggccaattgaaaattattacgctcatccctcagccggctggcaggcggctgcaatttcagtgttcatgtagaagacgaaggcaggggcagctttcattagcattaattccagaaagctgggctgaaaaattgttataagatgcttaccaacagcaggccgtcaccgtcagaaaccaaagctgtactggttttcttttctttcttttctttttttttttttttgtgacacttcagggaatgtagtacctcatagggagccatatacgaactttaactttgattgcataggattacttttttatttaaagaaataaaaaatcagattaatttagattaatggactcaaccttaatattggcttttaactgtagagttttctgctttttaaactcaaatgttccacattttgggactgggtaaaggtgcccgtagctactcccagctcagtggttcaccaaaagctccatcctcctgtagacagcaccgatctcacggcaggtgatgctggctgcactcaaatcatgctacttaagttttaaattttaagctaataattaattcagcacatattgttatttttccattttgctaggttctttagtagacagataatgagcaagacagggtcccgacctctccagcgtgttgcagttgagaggggcagacaggacacagccgccaggatgagaaacacagagaagtgtgggatgaggagcaggaggcagctccgaagcgggtcagaatcccacagggaaacccacatgggtgccaggcacttcatgtcacctctaccgaacacggtgaactgagaactgtggtcacccgagtcgcagatgaggaaatagagacgcggccaatggcatgtccaagccacagacaggaagaagccgcagccattggaaccccaactaccgtgggcaggacagcgctggccgaagacctgaggaggcccgggtggcccagagtcaggtggtccccaggcctttctctccggccgcaacctgagtgcacaccacattcctcgcccagcgaatcaggagagaagctttaaaattcccgaggttcctcaatttcctttccctgtggttctgtggcttcatggggtggcaactgtgaagccagtgggggctcaggctccaggaggatcatcccagcagggtagcaggtgcctgcgaagcacctccaagtcacagcaggtgcctgcgaagcacctccaagtcagaactgcgggcagctaggagggaacggcaggggtggcggggaggcctggggaggacacacgttggaaccaaatgtcatgtttgcatgaagggagaacaaagcaggtggtgtggagaatctggctgtcaggacagccccacagcggctccaccagggaggccgggcgcgagatgaccaccccacctgccctgcctggctggtgggtctccccacctttgagcacagaagatggagacactggcatttcctggcaggaacagggctcgtggtgatgggagccactgtcggggctaagctggccgtccctccagctcccatcccctggttaaaggaccccattctcctgggcagggaacaccatgagggccaccaccttttaagccagagcctctgcaggcataaaaggcggctttcttttgcggcagcccgtgagctcggccaccagggaactagctggcagctcacgcgggtggaaggcggggtcaggtgcacgggtttgcttaattgctccttttgggtctccaaaggcctaaaaagtcgacaaggctacagtaaatacaatcttgttttaaaagaaatccataaatttaaaacagcctgacacaaacgggtgagtttgtgaaatggtagagaggaagggaggaagccaaaggacccctcctgcggccatgactgtggcggccaaggaagccgcttcctctcctcctcctcctcccacggacactcctgcagttggtgcctacacagcagaatcatggcagaaacgacgcaggggaactggcctctctgagacaagcttgtcttatgaaagtcaagtccctgcatggagagcgccaggttagtctcagtgtcactgcacaaacattcgtgcttgagccaaaacaactcagaaatgcccatattgtctgttgcacccgtgactgtacctttggtaggagctgtggcttctggacacattgaacccagaactgtgctgcaatttaaatgtgaaaaataccacaactgtaggcagaaggataaataagctgcaattcacagcatctttcaagcatctcaagttggtatagaggctcaagctaaacacagaccccagctggggctcacccaaaggaaggccgctggccaccatgtaccccacagacactgtgcagcccacagccagcatgcaccccacacaccccactatcacacaccccacacaccccacagccaccacacaccccacgcaccccacagccatcacacaccccacagccaccacacaacccacagccaccacgcatcccacagccaccacgcaccccacacaccccacagccatcacacaccccacgggcaccacacaccccacagccaccacacaccccacagccaccacacaccccacagccaccacacaacccacagccaccacacaacccacagccaccatgcaccccacagccagcacgcaccccacagccaccacgcaccccacagccagcacgcatcccacagccaccacacaccccacagccagcacgcaccccatgggcaccacgcaccccacagccaccacacaccccacagccagcatgcaccccatgggcaccacgcaccccacagccaccacacaacccacagccaccacgcaccccacagccaccacacaacccacggccaccacacaccccacagccagcacccaacccacagctggcacacaccccatgaccaccacacactccacagccaccacataccctacaggaaccatgcactctatggccactgcacaccctgtggtcactgaccacacaccccacagccaccgtgtaccccacggccaccacgcaccacattctgcttgattggctctttagaaatcatccagaagaaatggcaagacgtttgctgtttaattaccacgtgtaaaaaacaataacataactaaatagcttcccgataaaaataattctatgtatttttacatatttctatgtacagggaaacctgccctctcatttagaagggaagtcatcgtgcaaagcggctggccgtgtgaataatagctcagaaacggggaaatgtacaggctccatctaacactgggtctcgtaactcctcacacaccccaactgctgacctcagcgagatgctgacctggaccacgtggggaggggatgggccgaggtgcaggatgagggaggctccatgtgctggggcctcacacccacgtttagagcacgctatttgtctttggccatacgctgctgggtttggaaaccgggttctaatacacaaaatgtattacaaccagtcttgtgtaattaaaaacgtaagatgtctattggcttttaagaaattttcccaaaaccaaaaaaggtgagttaaaggcaggagtgctggggttgccgacagacgtcgagttgtgtcacatgacgtggggaagctcgggctacagtgctgaggtgtgggtttccgctccgcgtgcctatgctgggcctggccgggaagctggatgggccagcctcacctctggaggggctttcctcccgtttccagggtccagtgagggtccagtgagatgacgcatgattacgtgtaatttacaaaacacatttgatgctcaggcaacctcacagatctcgtgagcaaactcttctgggagacagtgaaatccaatcagttatgttctctgaagccttccaggcacgaggacagcagcggcttctacggggacccctcagctttctgtctcaggagtcatgaacctcaggagaagcaagtgtggtataaatagtctgactcaagagacggggagctctcagccctcctgagacatcacgttgagggttcatctgggccacagagttaaagcctctctccgttaggtggctttagggtacttgctttcagtccctgaaacttcttttttaaaacgactgtcaacagcaatgtcatctgaagggctgtgtgtatgatggtgctagtgggaatcctgggagactgtccctcactggcaaccgccctcccgaattctggccggagccatgaagccgtcaggagctgtagcaggtgtgggcgaggaaggggctctccctccgcgtgcactgatctctggagatggctgttgctggcggctgtctcccagagtggcgtcgtcgtcctcacataaaatgtgatggataaagtctctcttatttcatgacatcgtggctccctctcaggctgtggtttgtgaggaaaagtgaaaaaagggaaggagaaagacttgccgggccatccccagacaacatggggagaaccgggcggaaatacaaaatgacacgggagcgtgcctccgagtcgcgctgagcccgagaccaaaactgaagagcggaggaaacggagttaacgcttaaaaagtgtgcagcaccagcattaggtccataatgatgtagcaggaaaatcaactgtctgctgtggacggctcctgcttcttgcatgccaggattaagactaactccttacttcaagtgtggtggagacagaagctttcatagagcccatgcatgagatctttcataagggacagaccctggatagccaggctcaggctgggcgccgtatcctgcccgctctggtgccctcctgagcatgggtacggccaggccgggcgccggatcctgcccgctctcgtgccctcctgggcatgggtgcggccaggccgggcgccggatcctgcccgctcgcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgccggatcctgcccgctctcgtgccctcctgggcatgggtgcggccaggccgggcgctggatcctgcccgctcttgtgccctcctgagcatgggtgtggccaggccgggcaggggcacaacgttggcattgataaagcacctgctgggtgggtagggtgggatagggtgggcgtgtgtcccccttcacttgataaaaggcttttcttagtgtcaaaggattcatttaaagcctccactgcatagaaagctccctctagtgcatttaaaatagaattctctcttgaaaaatccaattttgctgacaaggtgaaggagcagctaacgaaagttaaattccagggaaacagaaaggcccagtggtgtgacgctgacatcgaaaagcctgcaaacagtcgaggagtcagcgcacacacaaagaaaatccagatggaaggaaagaaaggaaccttaacgatgtctaccggggacagagcgtggggtccacggagaagtcccaggcgttttccacctaagaagcatcatggtgattcaaacaccagggaaatgaatggactcagtggagccactttctgctacttgaccaggtttaattcgagttgtccatgtcgggaatctacagggaagtgacgcaggctgccatcttgctcagcaccccagtgtggcgggcgccccagtgtggcgggcgtcccagtgtggtgagcaccggccaagtcagtttgggttgggctgcaccctcgtgcctgggacacccaggaagacccacctctctcgtgttagtggaccagggaggcagccacagacaccaggctctgcgtgctccgctggcacccgaatggccactgggtaccatcccgtgccaagctcagcaaatgtaaatcgctctcattgttattttctaattcactcagggctcattgggttaaaagtttatacattggttaaatacatttgtaagacaacagagggtttttttttagctttagataaaaaatgttaaccattaaacaaaagccattaaaagaatattagtattaaagtattaaaactatctgtcacaatgaaagaatccatttgaagttaaagaaaaccaagcaaatatgccaccggtgtctctttccaaggcttgtttgatttctcctggactctggctcttggctgaccgagctgtgtgattcagctcatggccctagaccacatcctcccagtaaacagtgaacacggacggatggggtgtgccgggagggccatcgtcgccgtctcctgaccgtcattcttccgcatggcttccggcagcctgttcatggataatgactgcatgagcgcaggtaagttttattacaattttactcagaggttttgcaaactgcagggatgcaatgtattctttttttcttgaaagtaaaaacgacaatgtgtgccaagtgttcaagagagagaggcctttacttgcaggagaaaattttctcaactctaccctctggaagaactgaagaaaagcttggtcctaactaaatgcattcaaatacatgacgaatggtgattattaagaatccagataaggaacgaagtggaacagttcccgtgccccaggagcgcagagctcctcactcacccaggctgcgatgtttctgctttgtctggagctcacgctgtgggaggactgggctctgaagggcacagacaccccatctttctagctctccatgtcagccgaggtgaccccagaactggactgggtgcagaggtcaagctagagcccctcacgtctggcagagcaaaactcggctcaaggtaactgtggttggggatgctctgggtgccccacacggttcaagccctccccagacctgggtctcagggatgccacttggcactgactacacactacacgcatgcagatacatgtacatgggtacacaggcatgcacacaccacacaacactcacccacactcacatcatacatatgcacatgcacacacacagaggcatgcacacacccaaacaacacacacacccacactcacactcacgtcatacatatgcacatgtgcacacacacaggcatgcacacaccacacaacactcacccacactcacatcatacatacgcacatgcacacacacacaggcatgcacacatcacacaacactcacacccacactcatgtcatacatacacagatgcacacacatacacacacaggcatgcacacaccacacaacactcgcatccaccctcacgtcatacatatgtacatgcacacacatacacattcatgcacacatccaaacacacacaccccacacatcatacatatgcacatgcacacacacacattcacacaaacatgcacaccccacactcacatgtcacatacacacatgcccacacacatatacacatgtgtgcacatgcccacactacactcacaccccacactcatacatatgcacatgcacacacacatgcacacgcccacaacatgcacatcccacactcatgtcatacatatgcacacacaaatatacacacagccatgcacacactcacacaacatacatatccatgctcacatgtcatacatatgcatgcacacacatatacacaggaatgcacatgcccacatgacatgcacaccctacgctcatgtcatatgcacacacatgcacacacaatgtcatacatatgcacatgcatgcacacacatatatacaggcatgcacacatccacacaagatgcacaccccacactcatgtatcatacatacacacacacacacagatatacacacaggcatgcacatgctcacacaacatgcacacccacactcatatatactcacatgcatgcacacatatatacacaggcatgcacacaccacacaacacacacaccccacttacataggtcatacatatgcacacacacacacaggcatgcacacaccacacaacactcacatcctacatcacatgtgcacacaaacacccacacttcacactctcacacaatacaccccacatcacacatgcacatcctttatacctacattcaggatcacacacatacatcatacacatgcatacacacagaacactcacagctcacactgcacacaaacattccacacccatatcacacactcatacaccacacacatgcacacacctatgtgcatgcacacacaggtacacacggcatgcataggcccacacaacacccacacccatcacacacactcccacacacacacacacacacactctcctgggccttcagtgctgagtttttacttcacacctttcctggatgatcttaactaaagacttatgaaaattataagcaggtttttttttgctgaccttctagataaattatattgtctatgttgtaacatattgctgggatcaaaggaggcaaatctgcatcttattcacttgaaaatcaagtagatcagaatcataacaaactagctatttcttatgtttttttttcctttgaacaaattctaaatccttcttttggagaaactgaaatgcctccagatccttattaaaaatataagttaaagaaaatgtagaagtgtatgaatgagtactgtcattttaaagtcaccatccccaatactccaggaggacagggaattgtgcaaaatatcctggtaagtttctatcgactgctggaccatcccataatactgttgaggtgctggcagcatcaacgcggagacaccggacctctgcacccctgtgcaggcgagcacagcttcacaattcaaggggggattgttaaaagggaaagacgaatacgatggctccacaattccgagtcctatctgtgtgtgaacacgtgcacattggtgcgacgcggtgcccaccgcagtttgctgccatcccacctacctgccctgcacaaccagtgccagggcaccggggcaggaccgagatgcaaacgcagcgtctgtgctgacagaagaggtttgggagcagcacgagagccccaaggcaggggactgctgaggtacatcctggagcatccgtgtgatggggcacacgcagtcattcccagatcagtgcagagcacacacacccacatgggggcctccacgatgtggctaggtcctcaacacctatgtcagaatcaacaagcatgtgcggtcaatggcgttcaggaggccgtctgcagctgagtaacaatcacaccaaattgtgaatattgaacaggtggaggagaacaggagctgggctcacccagggcaaaccttctcatgctgcctggaacacgcacacaccacttgcaccttttacccaaaaggtgctcatgcactggtccagcggggatgcgtgaagcatgcagccagctcccctcccaggccgcactgactgctggtactgctgcttccgggggcctggcctttacgggggtctggcaggatccctcctgcaggtgcacagcccaggctctcctcccccttgctcctgtagggccggcagctgcctcggtccctctgagtctattttgggttcagaaagtgcctgggctggggacagggccagttacgcattgactcagttccgtggcttacagtgcaaacacagagaccttgtcccatgcccgtgggctcatggtcaaggacactttgcatcatttgacctcggaaacaggagaaacggaagcacaggccaaggagggagccgaggggccgcgtgacactgcacgggatcgctgcccttcccacacgcacgttctgtctcacgcagttgctgtgcatttggaagaatcttgcatgaggattactgattccacgggacagcgtgtgaccccctgcagcaccctgactccatcgggggacccccagcatcctactcaacactacgagggagccccactgccaaaaggccaggctgcatgtgcctggacttcaggcgctaggaacggacgcttgggacctgctgcctctggggacagcccctcagggtctggacggaggatgttgggcctgcgggctgggcagggatgatgctctgggaggtgcctccaggacaacagggagacccctgcagccctccacatgggcccctggaaacccaggatagggagtggcagaacacactggcgggggctggacgagcagaggaatgagggaaggacagagtgggtgggagcgagagcagaggagatggaggggggaccacagactgtgtggggagggcagctgtgccgcaggaaatggagcaaccaggctgtgagcaagatgcgcacagaggacggagaggacccagggactgagatgaaggagtgactgcccggcagcagggagcagaatcaggcaggcaagtgcgcaggccgggccagcctggaccgtggagctgtgtctccaacgggaaccttggagggcaggactttgatcccctcccgaatttccaaacaggagtttgaacagaaacatgtggactcagggaccagtgcttcgggcacatcctgacagcgacacagctgccccgacagggctgtggccccccccgccccgtctctctcctgtgttctctcccacattctcaggggccgcctgctgccagctccctcgctgtggcctcatccagctcctgctggcgtggtctgacccctaaatgtgtgccagcaaggcctgtgttggagggaggggagggcctggatgggcctggatgggctggtgccagcacccgggaccaaggagggagcttgcagaagggacagccctcggccaggtgggacctgaacgacattttgcggcatccaatgggcctgaggtgtctgcgtgaccatgaggagaagcggaggacagcccaggtgaggacatcagacccaggagtgggtgaggagcccctgcagccaggctatgtgaaccctggctcagcagggtcagcctgaccccttgaaggtgggagaccccttgaaggtgggagacctgtgagctggtacactcagtgaggacggctccatgcacagggacgaagacccccgaggagaccatcgaaggatggtgggcagtgctgcccacacggatgcccagagcgtgttccccaagaccagcgggtctcatgctgtccacacgctcccaccaggcgatcgacaccagggtccgcctgtgccctgcctgggtggggtcagccacgcccccggaccactgctccaaccagcgttcgtcgtcagccccttacacgggacagggcactgcagaccggcccgggaacctggggacacctcacgccccacatccctcactgtttctcttgcaccagaatagctcaggggaaggaaaggcacagaaaataaacaacacacagcagaggaggccctgctcctgcccgaccgaaggcaacttctcccttgaagagaaaggtgcagacaggctccctctccccttccctcctcccacctcacccaattctgggcactttttcagcctgaaacttgcctgagcgagacaagagacactgcgggcccaacgtgtctgtgaggtccctttcccactggcccttcgtgttttcatgtttcagccaaacataaaagcgagacgtctcctgctcagctttcccaattctgcccagccctcgcgtccccctaagtctcatctgcagaaggctgagcctcatgcacctgcacctccttctcttggtgcctgcgcccaaatgtgtggctctgtctggctcaaccctctcctgggccccgtggctgagctggcctgttcttcagttccagctccattccctggccctcttagtcccgcactgcctggctggtcccccagccatctggttctgcactgcccagccatgccatcccctcggcccccgggtcctgtactgcccggccagtctccccgccctctggttctgcactgcccagccatgccatcccttcggcccccgggtcctgtactgcccggccggtctccccgccctctggttctgcactgcctggctggtcctccagcacctgcctgggttctcccacttccctgcagactccaggctgtgcccagagagagctgagctcggcggcccaggcgcctcaccactggccctcagtttcctcttcctccggtagtttccatgagagccccaaaggaactccccagcgaagctgcccctctgtccctggagccctggaacacaccacgctgtgcctctgagcgccgtccctggggccgtgtgccttccaccatcctccctctgggccctgagcctttgcagactgagcagggttctgcatctgactctggctgaccggaggccttgaggcaagtcacccaacctcccagaactgcttcctcagcttgcaacagagtggtcagaacggagggccccttgggcccccttccattcagtgaaaagctttctgtgggtcctcctgagccccaggacagcccgtgagtgaagctgccatctctgcatctgggagtgtccttgtctgctctccaccaccctgcagccacagactccttacctgtctctcggcagagcaggaagatgcagcaggaggatggggcttctctgttttgctctcacaacccacgcctggcaggcagcaggtgccaaaccagcatcagcgtggatccagcatgcagtggacgctgccctgccatcagctggagccacactttcacggtttaccctggcatctgccagagaaggaatggaccagtgggactccagagaggacagagggtgggggatgcaccctggggaggggaagggtgcgccccccacgccacagaaaagaacctgcaaagccctgagtcctggagccaaaggaggcagagtggcccaccaagggggatcggcagtggccaggttgcccagggctctggggacagctcgcccagggctctggggacagctccagggccgaggcaggcacccaaggtctttctgtctaaagcatcttactgactgctgtgtgacacctaatcaggaggagaaaatggagcggggagaccagcacacgaggggtgatggggctgggcccagggagatgagaagagggtgagggtgaagtcaggagccaccgtagtgccaccttggagccgtgtggcccccaggacctgctgtgggggaaggagtgacttccagcttcaccgcctggtgtagccactgtggctttgtcatgcagctagtacaactgaagagctgacttgtaaactttatccaattttagtgactctaaggaaccacatgtggctactgtatggaacaaggcggctctggagggctgctggccttcaaagtccggggaccttcaaagtccggggagccacaaaacacgattcgacaaagacgttctgctgtcaccacacacagcagatcaggaccatgtgctcccgcgtcaccacacacagcagatcaggaccacatgctcccgcgtcaccacacacagcagatcaggaccacgtgctcccgcgtcaccacacacagcagatcaggaccatgtgctcccgcatcaccacagacagcagatcaggaccacgtgctccacgtcaccacacgcagcagatcaggaccacgtgctcccatgtcaccacacgcagatcaggaccacgtgctcccgcatcaccacacaccacagatcaggaccacgtgctcccacatcaccacacagcagatcaggaccacgtgctcccgcttcaccacacacagcagatcaggaccacatgctcccacgtcaccacacacagcagatcaggaccacatgctcccgcatcaccacacaccacagatcaggaccacgtgctcccacgtcaccacacacagcagatcaggaccacgtgctcccacgtcaccacacacagcagatcaggaccacgtgctcccacgtcaccacacacagcagatcaggaccacgtgctcccatgtcaccacacacagcagagcaggaccacgtgctcccgcgtcaccacacacagcagatcaggaccacgtgctcccacgtcaccacacacagcagatcaggaccacgtgctcccgcatcaccacaccacatgcagcagatcaggaccacgtgctcccacgtcaccacacacagcagatcaggaccacgtggtcccgcatcaccacacacagcagatcaggaccacgtgctcccacgtcaccacacacagcagatcaggaccacgtgctcccacgtcaccacacacagcagatcaggaccacgtggtcccgcatcaccacacacagcagatcaggaccacgtgctcccacgtcaccacacacagcagatcaggaccacgtgctcccgcatcaccacaccacatgcagcagatcaggaccacgtgctcccacatcaccacacaccacagatcaggaccacgtgctcccgcatcaccacagacagcagatcaggaccacgtgctcccacatcaccacacaccacagatcaggaccacgtgctcccacatcaccacacacagcagatcaggaccacgtgctcccacatcaccacacacagcagatcaggaccacgtgctcccacgtcaccacatgccacagatcaagaccacgtgctcctgcatcaccacagacagcagatcaggaccatgtgctcccacatcaccacaccacacacagcagatcaggaccacatgctcccgcacacgctcgaggcagcaggctctctgctccatggcccctctcgcttcccacaggcaactttccatctactacttgggcctgcccttaaaagttaagagaatataggaggaaatctaagaacagatagcagaaggtctttgtgaccttggatttggccaatatatcttgggtatgatactaaaagcacaagaaaaaaaaatatatttttgagatggagtttctttcttgttgcccaggctggagcgcaatggtgcgatctcaggtcactgcaacctccgcctcccgggttcaagtgattctcctgcctcagcctcctgagtagcatctgccaccacacctggctaatgtttgtatttttagtagagactgggttttgccacgttggccaggctggtctcgaactcctgacctcaggtgatccacccgccttggcctcccaaagtgctgggattacaggtgtgagtcacaagaaaaatattttttaaaaagtaaactggacttcatcaaaattgaacacttttgtgtaacaaagacactatcaaaagagtaaaaaaccccgatgtaatgggagaaaatacttgcaaattacatagctgataagggagtagtattcagaatatataaagaactcttagaattcaacaacaaaaaatacaaacagcccacttcagaaatgggcaagggacttgaaatgtctgttttgctcaagttgatatacaaatggccaataagccattaaaagatgttcaacatcactagttgttagggagatgcatgctaaaaccacattgagatccactcacatccactgggatggctgtaatcaaacagccaagagataagagaattacggtcgatgtggcgattccgccccagggacatatccagggatgtgggtggacaccctcacatccacattcacagcaggattactcacaacagcccaaagccggaaacaacggcactgtccattaatacacaaatgaatccacaaagtgcggtccatccatgccatggaatatgagtcagtcataaaatggaagttagtgctgacacacaccacgacacaggccaacctcgaaggcattatgcaaagtgacatataacagtcacggaagcgcagacgcggtatcactccacttagatgaggtgcgtagtatattcagattcgcggaaacaaagaagaacggaagtgatccatccccgtaggcaaggagatgtgtatccacacacaaaatagtaccatgtccagtcgctgagtctgagagctgggtctatgcccgtgtggacaccccaccgtccactcacattcacgccgtgagactacttaggaacgtactcctagccagctgaagtttaaaaggtcgctccagcatgggctcacaagccgtggggattcatattggaacacaaaattcccggtctgtggctcctgccagacaaaagaaatgagtcaccccagactcactctgcaccttgtcaacagccacagctgctgggggatcatacagtgtctgcttggcatggcctccatggtacctggggccacacaggcaccctcttccggcccaggcgcagaccctggtgggaatgccgtggaagtttggccacacttctcagccactgcatttctgtgctggcccctggggagtgaagcctgaccccacccagcatgctcagcccacctcatctctggggagtaccccctcagtgctggttgctcctcatccctttaaaaaattgtggggaagtagaaaaataccctcagtaagtgaagtcactgacaaaaaagtaaaaggcacaaccttggaaaatatcttgcttgaaaaaaacatgttttgctacatgtgagccaagcccttcaatgagagaggaacaggctacctaaaaacagattcctacacaatcgtctattatcggtgagttagaaacgcatctgctgccacagaaatgacacgtgtaagcgcttcccagattggtgcctactttcctgccacaaaacccattgcagaacatgagcctgttgactttcattccaaactgcatcatcgtctacttgctgctaaactggacagtagagaaagaacttcaactattctgagtttgtttttaaaggcccttcaactaggcccaaaggccttaatccctgatgggctgtgtggacaagtgctgctctgctgtctgcggccgcagctgctggagctaaaagcatgcagaggccctgcatgcaggactggagggccctaacatcagcgttggcactgcccgactgcccgggaagcttgggaagggcattctctggtcttctgtaatgcattcctttacagaaagggaaatgggaagaaaggtttcacgtccaggactctgggcctttgatcatttgagaaacgctgggtctgcagtgggggcctccagcttctcaggccagacaaagacgccccgccacacgggcagggcccagcctgcaccagaacaaaaccccagcgcctctcagtgtggaggcctgggaaaggcccacctcagccggcagaggggctgcctgccctttgatctctcctgagactgtggcctgggacccgggtcagggaatttcacaccgcacacaccccagggaaagaggagcaggtcaagaacaggaggagggtcaccaatctcagaaaaggccccaggccagccctctttggccatttccacatggctgcatgcgtattgtccaaagctgagcccactctcaaaggagaattgacatcacatgccacaatggagccagtgaacagcagctcaggtgcctggacaatatgccagccctgccccccgtaccggggtctcgaacccaggacatacttctccatgtttccttctctgtggagtgaacctgagccactcagaacccaggctccatcccatccctgtggagacgcacgctggggtcacctgcgtccggccgcctgcctgtgcttctggtccctggatgggcaggttccattggaatcacaggtgcccccagcaactcaccacatcacacgttcacaaacataggcttggtcagaaacacttacatcaaatgatctgtaacgttctgaagacattttggtttaagagaagaaaaatctttgtctgagagagggaaagaagggagggcccatgataagtggagaaatacaaattccatggatggctctgagctccaatagctgtaaatttggaaaggaaaagaaatatttgacaagacacagcagcattaatggacaaggaaaaatggacttttaaatgacaaaaagttaggattgtgtcatgtccaaaacaaacaaaaaaaggattaaaaatattatgagtgtttgcattttgtttttgtttgcacattcccaccactaaactaatcttgggtgtttaaaatgacatttggtggcacaaaaactgatttcatttctccccagcagccagcaaaggatgctggcggtgttgggtaggtgtggggtgtggggctgggctgcagccctcccctctgctgcaggacgctggagaacttgcccaggctctccagtccttctgcgtaaagccatggctgttgttttatcttcacatatttatgtctttttttttttaaccagaagaaaatgaagtaaggaaaatgcttattttaaaattgctggcattcgtggaagtgtatagaaacttgtttctataatcaatggctgctcctgtcactgggccagtgatggagaatgggatgttacggaaggcggaggtctctgtatgaacacatatacgtgtgtgtgtgttgagacaaagggaattgtttattcacagctgggaaagagaccgtaggatgctaccacctcggtgcctcccaccttccatgggacgctaacgggtatcgcaaggctaatgcagactcttctcaagtaagtgtcggaggcgccaactgaagggaagctggacacatctctctgccctggactccttgggacctctccatgcacacctgccctgtgatgcccaaggagcagactcagtgtgtgcctcctctcaagctcacctgcctggggagccttctctctggcccctatttaaagagatgaccttagaggttgggtattctggagaccaccttttgagaaatgccagagctcaatccccatgcttttgtaggagaaaattggatcccagagaggttaaaagctctgtccaaagtgataaacctcattgctggcagagccagacccgcgcacagatctgcttttccacgctgctgctggacccatcctcgcaccctgcgcctcatgtctaagactccccacgccgtctgcgcatgctgccgctctgccaaacctgtccttctcccaccacaggcctcaagtctaagactccccacaccgtctctgagaggaacgcctcccacagcacgcacagagattccctagataagaaggacattcacaaagagggctgaaaggctcatttgagagggggtgattgacatttgatggcaattactaacggatatttttagtgtgcctctagtgtgaataccgttttgacaacagtggagttacaccaaatactggagcggcattctgcactgcaacaacactgaaggacccgagggtggcttctccgtggctctgaggttaacgctgcagcgtatgcagcaaacacctgtcaaggacccactgtgtgctcggcacaccaaggcaggtaacaaaggacccagtgcatgctcggcacgcagaggcaggtaacaaaggacccactgcaggctcggcacgcagaggcaggtaacaaacgaccagcctcagaagcagatgtgcttgctgcaaaccaccttcctacggcccagcagaggcacaacaagcagcgaattttttccagggcctcccgtgaacacggcaccctacgttgccatagcgacgccatcccagctctgagccgcaacaaagcggcagtgtctgtgtctcacctttggccatcttgttgagaaccatgtcgatcaggacgtaggtgccgctccggcctgcaccgtcactgccaacagaaggagagaaatgaaagtgctgccgtccacacggaagcccgacccacaacaaagctagtgacagttcatttccttcctgcttacgggggccggcgagaggaaaggatggcggatgtgagagggggaggaaggacgcgggctgggagaatccaagtgaggggagaagggaggcccctgggggcttcgagcctctgagcagcttgtagcttgtgggatgagctgctgtgctcagatgtgactccctcttgcttgttcccccctctttggccaaagatgtggtaaattttgccagaacaaaatgaactaagcgtttgactgtgtcagagttgatggcatttgtattgaaaatatctgcaaggtgccttctctagtgttgccgggcaacctcccgagcggagaggggagggcgctgggcggctgggccccgctggctcatgcacgcagggacacttcaggcacatccccctaggctgcctgccaccccttctaaacgcaggtcctccgtctcagaaggagaaattgacataacagtcgttactaaatcttactctttaaaaagcactctcatttcatctctttctcatcccaccagctataattggaatatttaccatctgggctagagttgtaaaaatgttttgaataatacttcaacagtagcaaaggaaaaaaaatttccctttttttctggaagaagagtagcctcaggatcatccttttcttatgaggaatgtgtgaagccatttcctgcccccgtgcagacgctgtcactgggttgcatgagtttgagagaccttcttaaaagtacatagggctcgtgttcacacccatgactggcttttaaacagaggaccttttacatttataatcctagcaaaatcaattgtgactttccggaaaacgaataaatgtttccatttcaagacttcaagaaagatgtgactacccagcagatatcacactttcggttctgctttctatgccgtctgtgatcccaagaaatgactggaatcctataggtgatcttttgatggtaaagaatcagcgcattttggctttaacatgtttcctcaaacaaatggttgaaaaaagctgcagttgggatggtaaatgtttaaaaaacggcacgttcacatcctcacaccctcactgcatcaccaaggaggagaggcggtcggcctgggccgccacgtaaccctcactgctcatttcaaagggccacggtgagcattctggttgctgagtgcctttctcacttgtctcctatgcacagcatatattcacatgaatattttaagatatacttcaaaaatcttccaactaagtgttgcttgtcttgatacatttgtgggtaaaaaagatgttctactctactctgtaaggataacaaaccgtaatctattttcatcctcctctctcatagacaggaatgcacacacaaaacacacatgcttcttgattggatttgacagatttggtgtttgttctttggagacaggtttcctttttattccaggcaggaagaacattctataagacagttctagaaaaatggaatatgagttcttcaccaaaaggagttgggtatgaagtccagcagagacagtactattaggttgagttttctttgcgtaaaatctattcttactggtgtggttttaacgtacttagggatatgagtcactgaatttttacccagaggcctgaacccacatgataaactggaggtggctgtacctcctgtaatgacagatttcgtccctgtacataactggccccaagcatttctcaccatctgcagagggttctgagcctctgctggacgtcctggtggttgagacaatgcaacaggctgaaaccattgtctcgatgtttctgtgtcatgggaccacagggtttaagaacaagcaaggtggcaggacatgctcacgggtgagtagaaggcaggacactgcaccgtgggctgctagaaaatattccatgtgaggcctcgcgcggtggctcacgcctgtaatcccagcacgttgggaggccgaggtcggtggatcatttgaggtcaggagttcaagaccagcctgaccaaatggtgaaacctcgtctctactaaaaatacaaaaaaaattagccgggcgtggtggcgggcgcaatcgcttgatcccgggaggtggaggttgcagtgagcctgacgagaccacgccattgcactgcagcgtgggcaacagagttaaaaaaaaaaaaaaaaaaaagcaagccatgtgcagtttatacagacataatacaagcaacgcccaattgtatttacccaaatggcatagaaaagtaagtttatatttttggtttcctttagaagtgccagttagttatatttattaagcaattagaaagttaagcttctgtatttaattgcatagattagtttttgaggtagccaaaacttcttaatccattaaaagttgtacttgcctgcaatgaacaattattggacaagaacggcccctgtagcacttgtttacttttctgaaataaaaagagatataaaaattatcgttgtgtactaagactttgcgttatccaaaacaactattaaaacaaagcgcaaggtctgtgtgtttgaaatcattttgcaatcgcttgttttgacggagaaaataaaaatcatacgcataatatcaaacatttattcttcttctcaacatgacgttattaatcggagctttaaaaccaatgttacacctctacactgctttcttcttccaaggaggggtgccaggctttgaaccagtggactcccggcctgtcctgcccgtcccacccctgcaggctctcctctttctgtttctgcttatgttgacttgaccttttgttacactacatcttgattcttcactaaaatttttgagttttgcaatttatgctcaaaatttcttagtccagacatcatattgaaaactgttatttccatactgtctaaaaacagcatcttcaagggcatttgtgacccgtcagcttttggtaaggatatctaaattacggagaaacctctatgaagtccaagacaagtcccttccatgcttataactttgagtatacaaacaacttcattgtgcagagtttagatcagaagttgtaaaaattagaaatgagcatatatttaagatttcataaccaacccctaaatcaaaacagaggactgatttaaaattcactgtgtaaatccaggtgtttttttttaattcagtgaaacaatgaaacatgtttatgaagtccattaaagttgtcagtgaactatttctgaataagtaaaattaaaggcggaacctcgggttattggaataaagcatgtgtgaaggagagtgttctacaatgtgctgcgtgaactcctacaagaaacaaattaagaaaaatggaagtatggaccatcaatgggaaaatgtcacgtttctttgcaaagccttgcctatccagcaccaaagagtccgtggaaagtaaacattccatcaaccggtgctttgctacaaacctttgaagccaggaggggcagggtggctgtggaaggagaggggaggtgagtgtccagtgagcatgaggggagggatgcttgaatacggcggagcccaaaccacagagctttctcctcctctcttcctattccctgaggagttaccagaacaaggcccttctgatgggagtgtgaatgcccagtctggagggcaccacgggagctgaaggagcagttgcagggactggactcggcgtgcccacctgcagatgggccgcggccacagcctagccaggacgcacttgatctgtgctgccctctggtctgtgaaacacgaggctgatgcccaaaaatgggcgggctcagacacaggcacaaccagcaacggcctccagggccgtgtcaccgtttctgttagaggtgtttgttgttgtttttccggggcacacagtggtgcgaaggctttggggagaggcggggaaggcaatggtgaactccttagaggcaacagcacttgtatgccagagtgccttgaacattcttggtccctggagaataaagaggttggaaaacagacccacttatgtctacttctacaattttccattcctgactcaggctgtaaagcatcgagggctcctgatgacagaatggataccaggcctcaggggtgcaccccagcatgggggtgggaagccctccagctcagtaaagaccatgtgtgtgtgcatgagactgcacgcatgtgtgtgacgtgagcacgtatgtgcacacgtgtgcacgtgtagaatcaagcaggctcaactatcagaccaaatggtgagtggctttgctttgaaaggccttttgcctttggcagaggagtttactggccatggctcagcctctgaatcttgcaaatgggaatgacctcagttctgctcctccagcttcctgctgtgtttcacacctcgtggtccactctacgcagagactaagctcagcttctgggtccacacccaccagtcaccaggggttgctcattttttcctcatgagaccaagtacacccaaaaaagggacagtaaaacaaaccaaaccccaaaccccaaaccagataccctttaagaaagtgtgctggtttgaggaaaggccagcataagaagtcagtagacagcggtggctcatggatagctggtcagctcctgctttggcaaaatgcagtaataacccccttggctgggaaatgctcctagccagtgaatttgtggctacgatggcctcaacctgcttccccactcccgaaactcctgtctctatctcacagtatacggaagataccattttctctgacatgttgtgcctggtggccttgggaaggtttcgctgtaattttcatatccgtaccagcccccaccttgtgctcaacctatttacaaaaacccacgggcagtcaaggacatgtgcagtgtagatacagggtgtggcatggctgaggactttatttacaaaggatcatgcagttgtattattacacgcaaagcatcacaaatagagaggaaaaccacgacatattgaacacaagagttcatccggttgacccaagatgtagaccacgagttattcaggaaggtgacacagccgtctcatttgactccatcagaacaaagaatcagtgagcaaaaggtctccaacagtaagaaaagttggtatcatagaaacttccacaacaggaattcactgagaaagaacgattagtgatacaaaccaacccaggggtcaccgggcgagagcgcaccgtcatgcaaagcaccagcaagcaaggtcagaggtcgttagaggctcagaaaaggggctttccacatcgcccctgcagtacagtcacagtttccaatgatcacttttgtgactatgcaactgggctcatattactagctgcaacatcacaaaaatgacactggccaccgctaattagctggcaaggtaagggtttgtccgttttaccgtgagcagcgttagtgagcaccattgcacacagcaagaagggagagagtaataatgagagagagagagagagagagagtttttaaagcaaagccctcacatgtgatgctaattatctcttagcagtttctctttaaagtgtaaatgcgctccctctgggctccagaaatatttaatcacacatctcggtgcctggcgaacgcgccaggccagagtgagaacgcgtcgtctattgttcaaagataagaaacgctgcagcatgaagatggccggtgtcttcagaaggggtctcacctttcctgtcgctgaaatcggggtggctattttatacagaaaaccagccaccggcaatgcttgtctaagtgtgaagctttctgagaatgtgttcgctcaaacccactgtccagataacacatgaaaggtggccttggccgaaacgctgggcggtgccaggtaaggcaggcaagaaaagctttctactctgacgtggctttcaaaaccgtgtctgggggttcattagcttttgaatttaacaaaaaccttcttaggctgtatctcctcagaccctggagcaagggaaatttgggaatccaatttttcttggtgatgaatcataaacactgagggtcggtgatgtacatgttcccgtccatatatggatatggacatagcaacgtgcccatatgcatatacgtgcaaacacactggatgaacgcaaagacggggtgttaagatgaattgccgtctttgtagttacatccattttgccaggaatgactgttttttgaagactctatttcaggaaattatgtaagatttctacatagtatgtctttagaaataaatccgtattgacagaatgtacataatggccaggaaattagcgtgggtgaggaaggagccgtgtacagtagttgttttaggatgtactcaggactctggatctacgctctgcgtccccaggggaggtgacggcaggcaggggccactgagtgtgtgttgtggctgtgacaccagattcaagtgtctccttgcagaggctcttgattgatttctattgattcaaattacaaaaaactgcattttgcttttcaatgtagactaaaaggcaaaataaattgaatcataataagcttcagaatctgtaatacacaaattcaagaattccacagagaattcaaaaatcgcttctttatgacaatctttgtctcgttaacctccctccagttacataactgtagactcgagaatgagtaactgttaagaatcaagtcactttatgatagtggggcatggcattggattcaaatgcattttttcttcttattctccttgtttggatatttgtctcttttcctcaataggtagacttctgatcagttaaatgtaagacatattctatacaatttagagcttcgtcactgatgcttttgacaatttcattttccttgtggtggtttattcactaagcaccaccacctagccaatgcggaccgactgtttaccacaatcaaagctgtggtcttaaatgctgcttttttttcattgtcaatttcttcctgtaagacagagtctagcattcacttcaacagttcagtaaatacactctcaaaccagacaacgtattgggtgactggctgactggagcaatgaacaaaaaactgaattttttaaagagggtcagtttcaaaatagccctaaaaatacagacagccacgggctaagtgtctccgggcttccctgcaagatcacgcagggtggtatctgggcctgcgctcgctacctctttcatcccatgcagccagatgagaatccaactgaacatccgagctttatgcatcaatatcctgtggcacatacactttaggctctttgtcaactgaagaaccttatcaaaaataatggccctatttccacagttcgaagatgcctattccccctcacattttaatacctctgaagctagaaaatcgctcacgattaacacgtgccgttaacggagtcttcccgcctctcgcttcccttcccctcccccctgcggcgccgacacagacgcggccctcggcgccaggggcgtctcaggagcaccgaagcctcgctcccctgtgccgcgcgctcagcgcgcactgccctgccggcgggccgcgcgtcatacctgcggaagtccaggagggaccttgaggaggaagggactcctcggtcataccaactcaggaagtggaactgcgtcacggtgcgcgtctcgttggtctgcaggttcttcagatagaagctcctcaccaggaagtcctcacaccagatgtgctcggagaccaggttcacctggcagggaggagcggagggaggggacagagacaggtgtggacattgtgaaccgaacctcaggcactgaggaacccagggccacgtctgaccagagaagggggcgctgcgaagagggcacattttacagcgcaggtgggttccctcggcttcgcggccccctcccaccttcccagtgttaacgcactgaagttagctccgtgcgggtgtgtgtgcttagtgttatttaggggcttgagcgtcaaataattttttaaaaggttacaatccaaaactatcctactttctgtcttttgcatgtccatgttacataaaccctcaaaaaaaggaaccagagaaaaattacacttttcaacaaaagcagcgacacgactacatgttctgctcagtggttccactctaagtgagactccgtcgcagctgcgcacacccgggtctagagcaggaaaagcaaaaggctcacggagtcgcgctgatgtgaaccccagcgcaggcacttccgggcctaagcgtttctgcaggaaccccaaggccacagctgtgtggtttaaggttcacacttgagcctctaactcgcttcctgctgtggagctttggcattctcactcatttaatgccaaacagaatcaaagcatgcattctagtgctggcttaatcacccacgtttatttagttcattcttgatgggggcagaaaatccagccagataaataaactggtgagcaggttatcctcaaataaaaaggtcacatgatccagccacgaaactccaagcagagccacggggaggccacacggctcaggcactggcatcaaggatgggcgccaggttttcttaaaaacggaccccacttaaaggcttgttatatgggaccgggaccacgctgtgaggcgaatgttttttctactctgttatcatttggatttagaaaaatctaaaagataaaaaccacaccacactcccagggtctggttcatgagcacacagccgtgtgaaccatccacacgggcatgcggccctcgggggtgactcagcctccgtcccctgaacatggggtgcgctgagcctccctgcatgcggccctcgggggtggctcagcctccatcccctgaacatggggtgcgctgagcctccctgcatgcggccctggggggccctaacgaatcccattcggaggaggagcagggcccgtcctcgtccggctggtgggtcctgccctgggtggctctggtcggagtacctcatagatgtggtagagattggagccttcatccggccagtagtggtagcactgccggacgccgttctccgcgaggggtgtcagcatgacgatcaccacgcagccgctctcccacaccatctgcggacaaagaaggcccgtggccgcggtgtgactgtctcatcaccgcgtgacatgtgtaattactgcactcggaagcacagtccaaatttattccattcacaggacatttatttcattttcatcagacatgtttactccgcagctgcctgagcatctctgaatgcactggcccatagtttgcatgttccacgaaatattaaaaaaccccgcaaatttatcccatgccatttagagcttcctcaggtgtaggttcagctgtgtggttttccaacttctgatctgtaaaggaaactttctacaacgccacacataacagccagcacttctcgaggcggtgccgacaccctcacttgctggtggctagcatcattttgctcacctagagaaacgttttgcttcgtgaagctgctgtcctgtcagaagcagcctccgaaaggcttcttttcaaagtacttcacggaaagcagtactgcactgctgcaatttcatttgtttataccgaaatatggcaacactattcagattaaagcaaataccaaattgatttactaattcctattagccacattgaaacacaataaacaaaagcacatttaaacccacagaaattacaaagacacaaagtcctctgacctcgtttctttgcaaacacaactggctacttgtggctgtaaacccacatcttaacatttacagcctaactacccaaaaccactaatcctgtggggcacactgatgtggcatttgtagatttttattagcatatgaaattatagagtgaagaggggtctgctttttctgcaatgggttacattaacttggcagaaatgtttataagcaactgcatttagatgtaaatttggtatccaagacagtttctatttcttttaaaaacagacacaaaatccaattaagaccttgttattttaaaaaccctcatatcccaaatataaaatgctgtcatcgtagcgcatgttactgaattccacatttatattttaaaaatcagacacaaacacgacattttccttttttaatattgatttatgttctcacggggctgaaatagtcaatatcctcaaggcacctcactgtgtaacatttacatcggaagccaatggaaccaactgaagtatttacaaaacgcccacaaataaataagaattatgctcaaatttgtgcactttctctttccttagtgcccatccgacaacaagatgagaattcaaaacatgtttcttacgccaggcttttcaggctttcaaacctgctcctccaaatcggttcttccatcacataacaatttaatgtgccttcagaaggtggagaagctcatggaagccattacgaaaatgaggagaaacacagattttatgagtgtaataaaaatacaatgatctagaccataaactaatcatccggcactcggctccgtgccacccaagtgtgacattacagagccccgtcgactggggggacccggacggcctggaagccgcactcattggctctcgcgtccgcccttcattatggggcgccttcccggctctctgaagatttggttaagattaaatccaaatgaaacttaatttaaacaagcaatcccaaaggcgctctggggaataatatttctttttaggtcactgtgtataaaagcagagaggggaatttactaaatcaaacaaataggcagcccaattgggtaccaatattacaagctgttcatggaactgattacattatcttgtgttcctttgaatcggtacaaagcaactcaatcgaggaggaaaactatggcatttctccatctgtttccagccttcaacagcgcgcctgaccagataacctcagaatacatcgcaaaaagttaatttggattttggtatgaatgcagaatcagtaaaaatcccagtcgagtaaggttcaatttctaatcggggagaagtttcactattttctttctcattgacttggtctttgctgacaggtgaaatacggaagtgctaacccctggcacctgtgaatgtgacctcatttggatacaggatttttcagacttaatcaagttaacattggtttgtgtcacaaatctttgagaaatctaaaactgtctctttcaggaagtaaataatgacccaggatccttatttaatcttaatgcagttcattggaatgcgcagtttacaaaactgtatgcctgaattccagaaatgaccattactggcacttcctgtttggtgaagggtaagagaacacggcccccatggccacctgcacagccgagtacctgcacaccccagcacctgcacaccccagcacctgcacaccgcagcacctgcacaccacagcacctgcacaccgtggcacctgcacaccccagcacctgcacacccgagccgagcccctgcacatctgagcacctgcacatccgagcccctgcacaccccagcacctgcacaccccagcccctgcacaccccagcccctgcacaccccagcacctgcacacccgagcccctgaacacccgagcccctgcacaccccagcacctggacacccgagcccctccacactccagcacctggacacaccagcacctgcacaccccagcacctgcacaccccagcacctgcacacccgagcccctgcacaccccagcacctgcacaccccagcacctgcacaccccagcacctgcacacccgagcccctgcacaccccagcccctgcacaccccagcacctgcacaccccagcacctccacaccgtggcacctgcacacccgagcccctgcacaccccagcccctgcacaccccagcacctgcacaccgcagcccctgcacaccccagcacctgcacacccgagcccctgcacaccccagcacctgcacaccccagcacctgcacaccccctgcacaccccagcacctgcacacccgagcccctgcacactccagcacctgcacacccgagcacctggacacaccagcacctgcacacaccagcacctgcacacctgagcccctgcacatcccagcacttgcaccaccatccctggatcgaaccaaagtcaccaacatggactgaaaatgagccgcaagtgctggatcccgagtgtgaacggctggcaccacgctttggaggaaaactgatactccccagttttacatacttcttctccagtgcagcgtccccaggcctcagcatcccccttgaaggctctagctgtgccagctctgtgggcctggggtggggaggggagcaatgttgcgctttgctgtttatgattccagaaggaatggaagtggtcagcccagtggttctcagagaccaccaaacacaggggttaaagcctgctgccaggctctgtgaacctgagccatctcgacgcgcccggcagggacacagcagcttgctgtgaggtctcctgacagctgttcagcagcagcaagtggagaaattcagtgattcggacagtgacccaaggaacaagaagtgcagacttcggctgttatttgacccaactgagtaagtttactgactgtagatttaaaaaccatattgttgtttgttacaggttcaacgctgtcctccccacagcttatattgacgtcctaatccctggtatctatgaatgtggccttatttggaaacaggatctttgcagatgcaactgagctgagggtgggtcccaatccaacgtgactgtgtctttagaagaagagggagacacctcgagaaggcacagacacggagagcggccacgcgcagacaggcagagatggagtgttgtggccacccacgccacacccctcatggcaggcggccacgggacactgcagaggccgtgaggatcttcccccacaggcttcggagagcgtggccctgctcacacctggatctcagactaccaggctccagaactgcgaggggatgccctcctgttgttttaaaacaacgagtttgcagcaccttgtgatgtcagccctagcaagagatgcatccgctgcaacctcactctcttcttcacccatcaaatcacccacaggcgtggaacaatggccaccccgcctacgcttcctatcaacaccgatggagaggaacacagggcctcttcactctaggtcctttttgagtgctaagtatttaattagcaaacaaacaaaaaaacaaatgacccaactaaaaatgggcaagggatctgagcacacatttctccaaagaagacagacaaatggcccgcacgtatgtgaaaaggggctgaatgtcatcagccatcagggaaatgcaaatcaaaaccacagcgcactggcacctcgtgcctgttgggatggctgccaccgaaaagagggggatggcaagtgttggagaggatgtggaagagacggaaccttacacactatacggtagcaatgtgagtgagggcagcctttacagaaaacagtatggagggccaggcacggtggctcacacctgtaatcccagcactttgggaggccgaggcaggtggatcacgaggtcaggagttcgagaccagcctgaccaacatggtgaaacaccatctctactaaaaatacaaaaattagccgggtatcgtggcatgcacctgtaatcccagctactcaggaggctgaggcaggagaacctcttgaacctaggaggcggaggttgcagtgagccgagaccgtgtcattgcactccagcctgggtaacaagagcaaaactccacctcaaaaaaaaaaaacaaaacaaaaaaaacaataaaaccagtatggagagcctcaaacaattacacagaaccactgtgtgatccagcaatcccacttctgggtatagacccaaaggaaataaaatcagtgtgtggaagggacatcagcacccctttgtttattgcagaactattcacaataaacaagatttggaacaacccacatgtctgtcaatggataatggctaaagaaaatgtggtatatacacaatgaaatattattcagccttaagaaagaatgaactcctgtcatttttgacaacatggatgaacctggaggacacgacgttaaattgaaataagccggacacagaaggacaggcaccccatgatctcactcacatgtggcacctaaaaaggacgaactcagggacagagtagaaggggggctgccagggcctggggctgagggtggaatggggagcaattgatccaaaggtagtaacttccagtagaggacagctgaattctggagacctggcattcagcatggtgactgtagttaataagagtgttgggcacagagatttgccaggagagtaggcttcaggtgcttcaccacacacaaagaaacggtaactacgcgaggagacgtgtattcattagcttgactgtggtcatcattcacgatgtctgcgtgtgtcagaacatcaggctgtacaccttaaacatttacaattaaaaacaactcgaccgggcacaggggctcgcacctctaatcccagcactttgggaggccaaggcaggcgaatcacttgaggtcaggagttcgagactagcctcgccaacatggcaaaaccctgtctttactaaaaatagaaaattagccaggtgtgttggtgggtgctgtaatcccagctactcaggaggctgaggcaggagaactgcttgtgcctggaaggcagaggttgcagtgagctgagatcatgccactgcacgccagcctgggtgacagagcgagactctgtctcaaacacacacacacacacacacacacacacacacacacacacacacacacacactcttaaaataagctctcctgaagccccacagagacctgatttaagggaagatgatcaatctgaaatagtgaaacactggagctggatgtggtggtgtgaacctgtagtcccagctagttgggaggctgaggtgggtgggaggatcatttgagcccaggagttcaggaccagcctgggcaacatagtgagatcccatctctgaaaaacaaaacaaaaaactgaaatagtgaaacgccaggccattttctctacaaaacatccctgggccccttcaggaggaaagcttctcctccttctacttagatcttttgtgatgagtcccttcctgcctgtgttagtcttgtctttagcccgtatgtctttcctctaccagactatcatctctttaaagactccatcctagtccagttaccttttctaccctccatggcatctaacagatgcttcattgaaaacaattcacatttctaagaggccgtttggatatttatgtaaaaaaaaagataaccgaaagaaaatgttatcaaaggcttgcatggcagaagtcctccaggacttgcttaaatgtacagacaagtgttcagtttttaaaaaaacaagcatggtaactgcatcccgctgaagcggttgccatgaagatgcatttcctccagagcaggtgcggggcccacgcaattctgctgcacagctcatttctgctcatttctgttgtgagcgtcctctcgtgggctgaacagaggtttagacttataaagaagatgcagctaaatttaaaaggatgaggagtcagttaatgggaaaacactcgtatttcactccttaggagctcaccgatgcctggaagttaaactgtgtggtctgagacagattaaagaggaagaaatagtgtgtgtgacatcttttgcaggggaaaccttcagctctgctctcaccctgcccagaggacagtcctaagaaatgaagcttcaggctttgcggctctggttccgagagagtcacaggctccaggccacagcacgcacatttggacacggtaatataacccaacgcagggtgacaaaaccttcgtgatgccgtccatgaccagctcatggtgcacctacctggcttttttttagtaaacaaatatctcagtgtgggattcatttagggatgacacgatgaggtgacgtagcccacacacacgtcagcagtgctgatggaaaggctgatgagggggcagcgggaggaacccccctgtgccgctatcagatcgacgcctgtgctgccttgtagccccatcccagggctgaggagcagctgcagcaacctctgggacttttccaccagcagtattgccgcccaggaggaaggggaagcctcagaacaccagcagtattgctgcccaggaggaaggggaagcctcagaatgaggacttgccactccaccaaagtcgggtctgtgttctccgggaaggactcagcctgcttgtgtgcaagcagaccccgtgtggcttggtgtggccatcctgccgcataggggttcccacggtgggaatgcactcacacactggacttcctctccacccggcctttgtgtgaccaccgtgggtgcctttgtgatcaggcattggacccgcacaggaagtcacctggcacaggcgtcactgagactccctgtggcctctgcctgtgctcacgttcccggttaaatatgcgcctggtctccttgcggggagctgctgcactgggcggcctttccttttcaagatcaggacctgacataaatgcatcagatccagttgtgaagcaagagaggaagaggaagaggaagaggggaggaggagtggggatgggaggagctggccggaggctgggaaccaatcacacacaggagcagcagagcctgctgttctcagctggagcagtaagaatcagtcagaaaggaaagccggacctgtcctttctacttgagtcccattttaaattccgcatgtgtgcggcgagagactgaccgaccatctttgcactgtcccaggcagaaccatggacaagctttgaggtcataggtttcaaacccaaaatttagataaggcaacgtgagaaacagtttctttcacctttaaaggttcgtgaatttatgaatagaaaaaaatccagcaagaccaaacctttgaaatataacaatgtcctggaaagtctcaggcatgtggttaaagtacttatcaatcatggaaatgaaaaatcaagtttttcctaagaaattaagaatgaacacaactctcatgttaattcctaagaattaacacaactctcatgcttccctttaatcaagtaacgtgccttaaaatcaacccatctgtgacgtagcagcctctgaagtcatttccccccgctaacctcctgactctcccttcactccagagtcagtgagatccacagacggttccctctcgcaccagtcactgtccagggggtggaacaggatgatgagcaagctgagtcttcacccacactagggagctgcagggactgggggacattctcatgcttttggagccagaccacttaaggtaaccaaggacccagagcagacaccgtggtcccaggctggacacatctgacgagaaaggagaggctgccagacaccgggtctgtcctggagactcagggcccctgctgctggatgctgggtatgtcctggagactcagggcccccgctgctggacgccacgtctgtcctggagactcagggccccctgctactggacactgggcctgtcctggagactcaggggccccgctgctggatgctgggtctgtcctggatgctcagggtccccgctgttggacactcggtctgtccgggacactcagggccctgcctcccacatgccgagggaacattaaaacagttgtgagtagctgggggccgtgaaccagctcgggctgagcggatgccatctttggaggatttaaatgtttttaaaaattaggtggtgtaggaccatcccctccaccggggccaggccagggtcatctctggatgctctgaggtttggttgctggtggtgctgatggtgatgcctgcagtggtcatcctgggctgatcaaggaagctgcccagagacagtgcatggtgtggaatccaggcctgccatcttcccacccacccctgcctggactagtgcagtagctgacacagcagacaggcagatacacaggcaggcagacaggcagacaggcaggcagacagacaagacaggcagatagagacaagacaggcaggcagacagagacaagacacacaggcagacaggcagacagcgagacaggcagacagacaggcagacaaacaggcagacaggcagacgagccactggtgccgggtggtgggcggccctgcacggtgacagtcagctgtcaactgtcattctcctgcacctcggccttgtcaccggtggctggcaggcagttggaaggaaacaccgttaaattctttgggtcttccacagttccaagttcaggattttttcttaaccatagtaagaactatgatctacagatgccaaataataaaaagctgtatttacatcaagcctatcaatttggaaatgagaaaacatatccccccagctgaggcttcatcacagaatacttttagaaagcagaaactagaaattgaaagtgcacctttttcttggtaaaatgttgatgtgcaataagagtcaacacacatccgatgccagtgggacacctgctgacttcagcgagcgctttgtgctctctctgggggccaggagagctgtttcgtgtctgactctgtcctgaaaggcagcctgttcatcagacaggagaggcaaggctgaactttggagttgtcctcttggctgagcctcccatacagggagccagttcccacggtggctgtccccatgcctgggctcccgtggtggctctccccatgcctgggttcccaaggtggctgtccccgtgcctgggctcccgcggtggctgtccccgtgcctgggctcccgcggtggctgtccccgtgcctgggctcccgcggtggctgtccccgtgcctgggctcccgcggtggctgtccccgtgcctgggctcccgtggtggctgtccctgtgcctgggctccagggccctggctttccatgtcacatctgcagacatccactccgcacctgatggtgacagactatgctgcctacatttctggtttagaaacagctgttgtgtatctcctgggcacagccagtgtttggtggtgacacacagaagctctctctggaagaagagcacataattctgcagctctttctaaaaataggaaaggggggatggcgggtggccaactcccttcggttgactcgagccgcgtagcacagggtgtggtagaaggtggcgcagcaggtgcaggcagtagggaggtggtccgtgatggaatatcgatgcccgcggcccctcccctgcctccccggcagtcctaatcttacagctacagtcctgcccgcaggggcttctctgtgatccagctacagtcctgcctgcgggggcttctctgcgacagctgccctgtgcaccaggacatgactgggctggggacgcactgtggggccacgtccccgggaaggtgcagaccttgcttccccgtggggaagtctcggcacctggagaaagcgtcactttatctcctgtctctgaggactttgactttcacatattctgcgccttgagactctgcacacgtgtatttttgtaaacaacacctactctggaaatgccgaggtcactgctgccggatctctcttttctgtttatagagacgtcttcatgtcactgtgccttctttatctgtgaggagtgtgtatgctgaagagacaccctggcactacacatgtctgggtctagaatgggctttgcctcccaccagctgtgtggatctgggtgggtccttatggctctctgggccacagcttcatcctgggtagaattgggctcactctgtatatctctattttaattgtagtaaaagatacctaacatataatttaccgtttgtaagtgcacagtgcagcggcagtaagggccttcccaccgttctacaaccgtcaccgtcaccacgctcttcagagcattctcatcttcccaaatggaagccctgtcaccatcaagcccctctgcactgtcccctccctgagcccctggctactaccccctagattcatactaggcttctatgaatctgacgcctccggggaccccatgaggtggaatgatgggaggctcacgatggcttcatcgcagggtcaatggctcggccaaatgagatcccatatgggaagtgcctgcccagggcctggcattgaagagctcagtaaatgggacttcctttcttcccccagccccctttccttatgcccactggactcgaatgtcccctccaatgggtgcgtgtctttcactcaaggtggccccatttggcaggtgggaggcgtctttgcagattaaaatacactttctagagaaaggctttctagagaaaggctatctgacaggtacccaaagccgcagggatccaggagtggaccatggagacctgcctcctcctctcgtcttccttcctgatattcagcctcctccctaagcggcttgttgacagcaaccagagctcaacgcctgggggtgtcaacggatgggtatgaggtgttaagactccttatttagaagcattgaacaaaacagtaaaacctcacagccaaactcgtgttcctaatttaaaatttattagaatattcttaacccttcttcagatttaaattaggattttaaaaagaaagtttaggatttaaaaagaaaattaggattttaaaaagaaagttttacgcaccaccaagtccagacgccagccgaggccaagtttccttgtgacgtctgggctgacagcggcggcgtggatgaagagggagcttgtgggtggtgctctatgccgaggacggctttttctgcctcctgcagtgattttcaaaactctcaccaccccggctgtttccaccaaactctctggcttctttttctgttgtgttttgaatgtcagcaccctttttgaatttatgattgcagaaggaacatcatattccagatatcatcccagaatgaccagcagagaggacggtggacatgtttcttcctaagatcttgatatgacttcaaataatgtagcacaagattggcccatacttaagttttctttccattcttcctttaaaattgttccacactttaaaaaaaaagtttatatgacaaaatgacaccctcaccccaaaatgggtattctttccttgagggatgttttatttctaggccagtttactacttactagtaacactgatttctgaactgtaactcagacttccacagacccctctgagctggagtaaggaccaggaattcagccgaatgatttggagagcactcacagacaaggaattaatttggggtacatcttcctttaggtaatgaatttatttttaggaatttcttgatgtaagtcaaattttggaaatcaaattcttgaaatgcatccagtgtccatatagagctggttcactgcaggaaagcaccatgtgtgcagtgagtggtgaccctccgtggattttcgtgcacgttctgggctctgctcagggacgcagcacggacagaggtgctgtgggccctgcgggacggggagctgatggggcctcgcggtgccatgctgggggagaggctggtgagcatggagtgacctcgatgccccatgctcaccgaggggacttcccctgaacccgtcttccaggctccccccttctggacccatgggcccctgtacagcatttcttgctgaggaacttggggccctcctggctcctctgcctcccagcagcccagtgacctccaaacggactcctgacccatcaccatgtcatgtgggtgccaattagctgcttggaaaaggtcttttttcttcttagccattgtactgggtagaatcatgtacccccaaatccatgtccacctggaacccatgaatgtggtcttatttggaaatagggtctttgcatatgtggtcaagttaaggtgaggtcacacaggctaggatgagctctcagtccaatgactgacatccttagaagaggagggaaatttggaccctgacataaatccacggtggggaaaagctgtgtgacagggaggcagagatgagggggacacttcgaatcccccaaggagtgcacgggcctggggcagacacggccatctttcccatcacggcctttctcacgctcacactttcttcctggaatttgctgattaccgacagagaagaaacacctgtggacctgccccaaggaggagcttcagatcagcatcaacagccggagataaaaggaaggtgctttgggatgatccataaccttcagtctgtgtcccgatccttggtcagcatctgagaatggtccagaatggggatgcaggaggagacggtcactccaactcagcctgttgacttcgtcatcaccaacttcgcatttcaaatccacctttgtccttaaaaatacacgttaccgtgggtttggaaaagttctgccttccgtgggaggttttaaagacaggtgttcttcctctgcctgcgttctgctaagccagagagggcaaagagaaccctaactttgaatttttaagaatgtcaatcttggggcttactggtaagtattcaatgaagaacaacgcctgagagatgctgacattctaaaacacacggtttagaggcctcccaggcaaatgtgactgtgctaggaagcaactctcctccatcctgctctgtgtggatttatggcatcgatggtgggcagctcctgtgttctgcacagagggatccccaggttgaaggatgacgtggaagcaatgacgtcgtggtcagggacgtctgcagggagcaaaatgaagcgagtttctttagttcacaatttctcagaggctctgctcggctggcatgctcgagaacatcctgggagggctgaggctactggccatgagctcttgtcttagaaaagctgtgaccaggttgagggacgctggggtttcctggaaccacctgatacctgctgtccgagatgtgtctcaaaattatcttgcatttcaccttgctttaaaatttgtctctacttatttcatacagagatgcatcatttcaatttcaagaatatatgctccttgattatcactctaaaatagcccataagatgtaaacactgatcaaatgaattgcctccaacaattgcaactatccataataaacagtaagaaaaatggttcacgccttctattcactagccacaggaatctgggcacgctatgagcctctgagtctcacggaccacagagactacaggtcagcatgtgagagcttcatgtaggacccagcacctgctgaacggaggttggatgtgggcatcatcgtggtcgttgagtgtggacaccgagagccttcacacaggatggagggtggatgtggcacctgctgaacggaggttggatgtgggcatcatcgtggtcgttgagtgtggacgccgagaggcttcacacaggacggagggtggatgtggcacctgctgaaccaagggtggatgtgggcatcatcgtggtcgttgagcatggacgccaagagccttcacacaggacagagggtggatgtggcacctgctgaaccgagggtggatgtgggcatcatcgtggtcgttgagcatggatgccgagaggcttcacacatgacggagggtggacgtggcacctactgaaccgagggtggatgtgggcatcattgtggtcgttgagcgtggatgccgagagccttcacacaggacggagggtggatgtggcacctgctgaatggagggtggatgtgggcatcatcgtggtcgttgagtgtggatgccaagaggcttcacgcaggacggagggtggatgtggcacctgctgaatggagggtggatgtgggcatcatcgtggtcattgagtgtggatgccgagaggcttcacgcaggacggagggtggatgtggcacctgctgaatggagggtggatgtgggcatcatcgtggtcgttgagtgtggatgccgagaggcttcacgcaggatggagggtggatgtggcacctgctgaactgagagtggatgtgggcatcatcgtggtcgttgagcatggacaccgagagccttcacacaggacggagggtggatgtggcacctactgaaccgagggtggatgtgggcatcatcatggttgttgcgcgtggacaccgagagccttcacacaggatggtgggtggatgtggcacctgctgaacagagggtggatgtgggcatcatcgtggtcattgagtgtggatgccctccagaccctgtggctttgctggacagagaagtcttgcacaggtgaggagatgaagttgatgttgggctgtgggggcccaagggctcataaaaatgaaagaacacatatttgggggcaccccatgccacacaaataagcacattttgggtaatgggttgaggtggatgaaaactccagtggtattaggactccgtgggtattctctgcccgccctccaattctgaacactctgtccttttccctgagaagccggggtgagcgtgcacagcagggggcatccctggaagggccctggggctccattctaagggcagcgctgggacggatgggtccatgtttcaggaaggcaggtgtgtgccatgcaaagaccttcctaccacgaaactcctgagacgatgggccccagggtgccatcttctctgggaaaggcatgttctcaccgggctgggcgactccccagctgtgacaagtagggagcccaagtgcccccaaaaccatccaagtgccacaggttcgccgtgccatgccgggattacaagcttcaacaacgtcacacagagatgcagtttagttttatttatttattttcaatagtgtgaagacacaggcagacacaaagggcaggaggtcataccgatgtgtttcagatcctggcgtcatccgagctgtcctgggtaagtgatgccatctctccaatacccatgtgccttgcccataaaatgggatgatggcacctgaggattcaaatgctcaccatgcaagggtgctcggaggccctcggaaacccggatctgttccagacttttctggaaagccctgcagagactgttctcaagggcagagagaggaggctccccttcctgtaatcggagtcacgcgaggctgacgggaaagccaggaaagggaagtaaagggaataggaagagcctggggcagaagtgaatttaccaactccggtgcacagcgacatcaggaaatgtctcaccccagtgctgcacaggcgcccgggctgtggatcgccaggaggcccgggctttggatcaccaggaggcccgggctgtggatcgccaggaggctgcagcctgatcccagcgtcactgctgcgacaggcacctccctgcctggattctgccgcatgggtgacgcgtcgcttcccaccttcgtccccagctcgactctccttaggagctcctctctgccaggctcggggttggctggtgtgcccgacacgcggccggtgcctgtgctcctgcggtaactcacggccacgttccaggttccagaacccattcctattcagctttgtcacgtggctggtgaggggagacccgggggcagctggagaaggaagaccccacctgccctctgcatgttgctctatttgctgatgtttgacattcacgtcagccctcacgtctgtgccttcatctgtgtgacctgggcttgcgtcgagtagagaagcacggcctggccttcagatgccctacaggactccaggagaggatgacagaggatgtacttgggtcctgctgtgaccgccatcataacaacgccatggacaacaggcacatttcaataacatggaatgacttactaactttatcctcgctgttttataaaatgcaaatgtaaagtggcttaaaagtaatgatcttgaaagcattaaatctctcaaagggaattttttcatactcaagttttggaaaacaaaagattgataataaaaaatatgaacagactgaaattctgatataagtaacatttgatgagcatttgtaagaagtttgattggcctaatcagattcaagacatgattcgtgacccagttattgagatcttcttttcagaaagagagattttaatttaaaaatgttcacctgccaaaagtcagccacggtggcgggcagcggtccctgggtggcgatgtacgcggggttcctcgggtcgtgatccatctgcagagacaagaccacaccacagcggttagccaggagattaggaagcctggaggttaggaagcctggaggttaggaagccagaaggttaggaaacccggaggttaggaagccaggacgttaagaaacccggaggttaggaaacctgggggttaggaagccaggaggttaggaagcctggtgtttaggaagcccggaggttaggaagccagaaggttaggaagccaggaggttaggaagcctggaggttaggaagccaggaggttaggaagcctggtgtttaggaagcccggaggttaggaagccaggaggttaggaagcctggtggttaggaagcccggaagttagggagcccagaggttagggagcctggaggttaggaagccaggaagcagagcctgggttcaggaagagggaaaggtggcatctcctgaactgagcaacacacaacttgccctttgttgattcaaacgagcacccggcacaggtagggacccagctgtcccgagccttgagcctgaaccactgcgtctgaaatgctttccttatacctgaggttgaggttctaagagcagcatcaacagaaatgaagaccagtagcccaaggagggcaggcagccgttgttagcccactcagcaggtgcgaccccatgacatggatgagctttccagcctgcaagtgaccccagagcttcctggccacggagcccacccaggctgccctgtgttcaggagaacgagcctcttgctagagccacagggctggctggggtgaggctgagctccaagctctcaatggagagtgtgaacagggttcctccaggcctcatggacaaacttgccagcgtcctgggagaacgaactagcgctacctgctgcttccctgctggagttaactcgttgtgtgtgggggcttgtttttgtgtatcctggaaagggggcacaggcacagccggtcagcctgggcctgggtctgtggcagagccggggcggaagggccttgctgggagtggcctcctgttctgtttccccaccaggcagggaccagaaacaaagagggcaggtgtgggctctccggctccccagtttgtccgaacgcatcttgctagctccaatgggagaaggttggcttagaagaccataattattacatttatttcgaagattaagcacagaaaaaagaacttgaggacaaagccttgagaggcaagcgagatttgagcacattgctgaggggcgtcagatggaggtggttctgtcttccagagggcaagcccaggccaccctgcaaaggacacgaagataccaggacatcactatcatccccagggctcaccagctcctccccacacctcccagaagcatctgcagagaccgacccccggagagccggatgctgcgctgggggaacctcaccttggggaggcagccgcttgtgcatctgacgcacagtcctttcttctattgtgtctaggactaaaatggactcttttgctatcagggtttgattcgagatttacaatgttcagatttcaaggtaattattaagaaaacatttctcaacacagtgaaaaatgagcaaattttaaccctatgcaattttaagccaacgcacgaggacatcagtggtggccccggtgctaccttaagtgctgctgcatttgggaagctgacgtggggcacgttttctttaacagcgagccagtgagtccccgtgcagccgtcaccagccccagagatgatggctgtcagcacaaaagaaggcaccaaatgcaccttataattatgttcaccataaaagaggggcgagcataaaggaacagatgtaagttattctcacagaacaacacggtgacgctagccgggggctggggggaagcagggagaaaagctttttgtgcatctgatttagtgattcgtaattaaaactggacctcgttttgaaattcgccacaacacacacaatacaggtaaaattatgttaccgtcgctgaaagccccaattagaatgtttcagtagaaaaatgcttagcagaaataagttttgattttttgaaatatgcatttgttgggggtgacagctatttacagagacccctgtctcttccttgcaaatagtaatgcatgaaaaggaaagccccgcctccttctgaaatgtgtgtgtgtgtgtttttttttttgcccagagcaatttctacagcaacacattttaaaattgtaagcatgttcaaactagcacatttagttgctttcaaaatgagaaataggtgattgaaagtaaaatgctggacagggttgcaggagggtcgataaggtgactgttgatttaggtctgagttgttaaggtgtcctaaagtccacacacccatcacctgctccaatgcctaagacaggagcaaatacagtcagggtgctgggagggggatggctgaacaggaagtgtgggctgtgcagactgagtggggaccggcctcacctccctcccgcccacctgccgtcctgtgggggccactgggaaggcgggaacagcatgatgatccgagtggtgacatgtgtcatcggtttcacaataattcaggagacaattacattcatttaattccaggcacattctgttgaacagaaaattattctgggcagaaggattttgtggaagcagcaactgcaaaggccacaggcagcctccttgtggtctcacgcaggcttcgaggaaaagtcaagcaaatacttaactggccacacagagattttactacatttaaggttttcgggcaggataagtggctgtggaggaaatcaagtgagtttctactaacattgctttttccaatgagggcatctgcgtgacaaccggacatggtgggtgtgtgtccctctgtcttccccacccagcgatcacacggcacctactctggcttcctccggtcttcattcttacccttcgcctcctactcatgactttccatttcattgcaacatactttttatttgtatgactgttatgttcccgacacaaactgcccggctgtgggaaaaggcctgtcatatctccaggcctcagtctccgtatctgtatggtgggtgagctcagggagtgaggagcttggacgtcggcgtctccgggcctcagtctccatatctgtatggtgggtgagctcagggagtgaggagcttggacgtcggcgtctccgggcctcagtctccatatctgtatggtgggtgagctcagggagtgaggagcttggatgatgcggtttctaagtgtcctttagctctggattccagtgcacgtgcatgtgcagactcgtctgtgtgtatgtgtgtgtcctggtgttggtcatcccgaaactgtccgtgaaaacctgtaaatttattaggtgaacgccaagctgtcaggcggtctgcggcccgtgaacacgcgtccatgctgtcctcagtgaaccacagaaggaaggaaggatgctgcttcctcaagcacagagctgctgtgtcctccagtggtgtgcggggccaagcatctgaatggcgaggtgcggtcatttctgagcgctttctccccagacaggggcttctgcagcaacacatcccgcctagagaggccggtaccacagagaatccagtgtgactcactccaagtgacttcatgaaaatcaacagccagaaggcaagtacaattaacagtataattctgtttttacttttttttttttttgagatggagcctcaccctgtcatccatgctggagtgcagtggtgcaatcttggctcactgcaacctctgcctcctgggttcaagcgattctcctgcctcagcctccagagtggctgggattacaggcgtgtgccaccacacccagctactttttgtatttttagtagagatggggtttcaccatattggccaggctggtctcgaactcctgacctcaggcaatctgcctgctttggcctcccaaagtgctgggattacaggcataagccactgcgcctggcttacttttttaaaataaaaataaagcccatttgtctgtgttgactctgttatcccttggttgactgattcttatgaagatgtcatatgaactaggatgctagtgaggtgtgttcctctgtctctctgaatacacagtgtaaagatggcctagtgatgtgccttatgctatcagaggataattactaaacaagtatctttagaaaccctaatctgcatgaaaaacttagccacaatttccccaatattccaaacaaagctcattttagaaatgaagcactcagcatgtcaggaccactggactgtgtcctgcagtcctcaacagcctccatggtggcagaggcacccactgcggggcaggtgaagggaacgccagtttctgctcccaaaccagccccggcctctggcagctgtgaccttaacatcttaagaggatctggccagctttggggaagggcatgggtgtcacgtctttactctgaaatcttgcacagagaataagcacacacctcatctgtaggtatttctacctgcccacctctccacctgcccacctctccacctgcccacctctccacctgcccacctctccacctgcccctctccacctgcccacctctccacctgcccacctctccacctgcccacatctccacctgcctacctctccacctgcccacctctccacctgcccacctctccacctgcccacctctccacctgcccacctctccacctgcccacctctccacctgcctacctctccacctgcccacatctccacctgcccctctccacctgcccacctctccacctgcccacctctccacctgcccacatctccacctgcctacctctccacctgcccacctctccacctgcccacctctccacctgcccacctctccacctgcccacctctccacctgcctacctctccacctgcccacatctccacctgcccacatctccacctgcctttcctaacatttaaagcaaattgcatgaaacgctttcttgaaaaccaccatttgacttctcaagtctcttttccaaatactaaggcttaatatgggaatttattgggaaattgtagcttcagtaatcaatgggagattgacttgttttttttgagacagggtcttgttctttaccccaggctggagtgtggtggcatgatctcggctcactgcaacctctccctcctgggttcaaatgtttcttctgcctcagctgggattacaggtatgcaccaccatgcctggctagtttctgtgtttttagtagagatggggtttcaccatattggccaggctggtcttaaacttctgaactcaagtgattcgcctgccttggcctcccaaagtgctgggattacaggcatgagccactgcacccagtcagcagattgacttttgaacttgaaatatttttatatcgtattcttaggagttgagatttacttaagtaaaatactgaatataaaccattattatacacagaattttggttgtaaataactgaagtgattcccatatttggccaatttcttatgctagtcagaacatccaacctctcttctttttctgaaaagccactctgtccctacatagttaaatgcattctgaattaaaactttaaatgatgtttttttctcccttaatagacagtgaaatgaagaattaagctagtttttacacgtcactgggagtttcagagttgtcctggtaataaagcttgtgtgctgtgtttgagtgggctgttgcgtgaacaccattcctcaacttggtgtcctcagtaataatcaggctgttttaaatgtagctcatgggtttctctctcagacaacctacgagggaaaacagaattcccattgactttcatgacctctgatttaaaagcaaagattgcacattatttaccactggatgccttccctgaaatgtaatgaggactaagtacaaatatgacagatgtaattatcatagttttatcctgcacagccagggccttcctttgctgtaattgtgagcttttcattcagctgctgctaggaaggtaattatcattgtaccttcagctatttcataaagaagaggcaccatcgatttcttctgcttcattcttacaacccaaatttggaaaaaaaaaagaattgtggtatgaaataaaggaaagacacaaaatgtaccataaaattacttctccctcctggccttgccttctcacccaagctcctgcccagtaaggcctggagagggagttgcatgaatgtgcaggaattcatcccccaaacacacaccccctctggttcccacatgggatgaaagctgtccaccgtttccagctcgacacagttgctgcactgggcactgctgcccacgctggggcttggctgtggcctggaatagcgcagacatctgcaagttggaacccatcgagtgggggagagtgggcccagctgcaacgctgaactctcgtcttttaggcttgtgaatcacggctttattcctcattctggcttcatcaaatggttcatctcagggaaaagggacctcaacatggcttttcttttccttcggacggtttcgtgttgccaactctgctgcacatagtacaggaacggaatccaggcgcgcacacctggctttaccagaacgcacgttctgttcatcaagtgagaggctggcacatcagcgaggctttggtttgatgtttttgaattagaattgatgacagaaaaatactatgtgcatcacatcttattaaggaagatgaatgaggatctttgaaacccacacggaaccaagcttgggagtcaacctctgctggaaggaaggaagtgattccttcttaagaatgaacacataaacagaaacctgggttcaggtggtgtagaccaagtacactaggccagttcttcactttgaattcagtctctcaaagctgaacatgctcactgtgtgggccacgaattgcgggaaaacgggactggctcaggcatgtggacatcttcccagcgtgctttatcccacaggtgtgctgagaccagcagagccgagagctgagcaccctccaccatcagtggccgctgagaccagcagagccgagagctgagcaccgtccgccatcagtggccgctgagaccagcagagccgagagctgagcaccgtctgccatcagtggccgccgagaccagcagagccgagagctgagcactgtctgccatcagtggccactgagaccagcagagctgagagctgagcaccctccaccatcagtgaccgctgagaccagcagagctgagagctgagcgccatctgccatcagtggccactgagaccagcagagctgagagctgagcaccgtccgtcatcagtggccgctgagaccagcagagccgagagctgagcaccctccaccatcagtggctgctgagatcagcagagccgagagctgagcactgtccgccatcagtggccgtggcctgcaggcagttgggccaatactttcatccaaagctccctatggacgagcaaagaaactttgggacaccgtagggtgcgatttgtgcctcgatcacctgccccgtctcactcagccctagaacagcattgcatcctgcaggcaccatgtttgattaaaggcaaatttggaattttagtgagatgtcctcatccttccctgaagaccagaattgagaagagctgtttaaagggggaaacatgacaaccagtgtccgccataaatctgcatggagccccagcctctccaccactggtttaaagtgccatccgccaggtctccaaagccccggccctggacagtgtcccatcccgcccccgccacctgccaccatcactgctcatctgaacacccagtccgagtgtccccagcctgtggcttcagccctctccatgctcatatctctccctcctctgctcactctgggagggctgcaaacctccccattcagccctgctcccccgacaggtcatgacagggaagggggatgcccagagttaaatagggtgagagccgcgtctagcatgggctgagaggagcccctgggaagtgagggaccacaggccacagggactcataactcacggcacaggagctgccaccacactcgtccccagaaacacaggacagcccgatctccactgcacctgcgtctatcccagggggaggaacagccagcaaacggtctctttcataagaaacagggtcccattcactggaaatacttcaggaaaacgaacctgaaattctggacctgcctccaagccactgattgttacaaaaagcgtagactgaggcctcatgtccccatgccccatgaatatacagggaatgtgtagctccaggaaagaggaacggcacccactacgaacctctcctaaaagccatgtcttctagtcaggaaactgtccagtcaccattgctggatgttctacaagtcacggaacccaccgcccagcgtgagccgggacccacacggctcataaacagccccgctggtgaaggaacaggggagtggcgggagcccaatgggcagagtcggccctgtccaccgcagagacgctgagctgggtggggacgtgatttcccccgagaaccttcccacgtgatttgccgcgtccgtgccacccaagggaaagcctggggcccctgtcccggcagtgcacttacgatggggctagcgttgatgtagtctgagtggctgtggctgttctccgccttcagcaggacccgggagtggtcatctgcaaggacacagtgcaggggtcagaggaacattggcccacccagcagtgtgagacccccacttggcctccagggccccccacccagcagcacaggacccctgcccagcctccagggtccatcacacagcagtgtgggactcccaaacagcctccagggcctatagcccagcagtgtgggacccctgcccgggctccagggcccacccgcatcctctcccaggactctgctcacacccttctgaatgtggtttccaatgttcctgctcccatcctcccctccgtttgtgatcctccaggtgggaggcagacgaacggcatgtggggaactggcacaaagctcccgctcagcagaatggagatatcctggtgttttcccccacgtggagttcacacaccaaggtcaggggttcctctgcagaattttataccatgctggcctttaaatcacagacacacttggcaacacacagcaggtaaacagaaatatgaacgttaagcaatcgcccgcgtttcaaaatagaaagtttcatagtcaatgaacagttaagtcctcaagattactggaatttagttttaaaaggagagtaagagacaaataaaatgcagataaagaggaaatggaggaaaaatgtactggtggagactggcataaaaactcgctcggacagacagagtaacctgacggctgctgaagccgggcgcagcggggggacagtaggcacttgtgacgtgtgtgatatgagagctgtcttggctttggttctgggataacccccatcctgcttgctgtggccgccctcctctttgctctgtttttagaaacttcgacaagcagagctcacagaggagtggaagccgcaagagcccctcctgcacctcccaactccctggtgtgtggccgcttccttctctctgcaaggtgcgctttgtgttacaggatctttggggtggtgtttttctggccagaaatctctgtggccggtggcgcctttgcccaagttttgctcaggctgggcctggcaggccacgtttggctcacactaccagcctgggtcccatgcctgccaagggcgagtcaggcatggagtggcgaggggtgtgtgaggagcacggggtctggccacaccagtcaggcacgctgggtgctgcagcagggtgggcagctccaggtgccagcatgggtgcgggctctctgtgaggctgcggccagaccagacacactgcaagcagcttccatggttgacactgaggaacatggtagctcctggaagtttggagataccaggaaccacagggtcccaaagatggagtcacaggcctagctccgggagctcccaggtctgggctccctgaagggctacagctgttctctccttctcttcacccacagtgtggcgagcagggggcatgtctcagccctgtttgtgctacagctcttctagccccaccattcgacaggtcctgagttcttgttctgcgaccaggaagaatgaggtatggagacaagtggaggatgagcaagatgaagaggggtttatcgagcaatagaacagctcagtctcccacagggggcagctcctttctgcagccagggggtcccgatgagtgttcagctcctagcaaaggggaggctctggagtgggtagctcctctctgcagctggtcatccccatgtctgcccagctctggctatgcctggggcatttatgggcctcagaggggaggaagtacatgctgattggcccacgagtggccgtgggcaggcctggaaaaggcaccatgagttcccactctgatccacaggacttgcagcccagcccccagccttcaaaccctccctggcctgaaggtggtgcttcatggaggacctgcccccttttgcccaggaatctctgtctcctgctgccattcatggcacccaggctgtttgtgccaaggggcacctgcaggccagagctgagctgccctcagccctccttcggcttccctcccatgcttgttggtgcccaaagtccagagggggctgaggtggcagggggctggtgtgtcagcactgcccagagtgtcacacctgctgggctgtgacagcgcccgggctcagccctgactttgctccaagatcagcatgggtgccaacagcagggagaatccaggtagcaggaacaggcacttcctgcaggggcaaggatcttcttcctgggtgcctaagtgtgcagggctgcctgggtctgcagctacggtttgggcagctgtagctcctccccagcgtgggggtgggggtggggtcctgcctgccgcgtggaacaggatgcccaggttacgcctccctgctgcagctggtgtgatggtagtggccactccagagggcctgtcactgccatccctggctgaaatctggaagcaacaacatctcggctctgctgccgtttgtcccagggaaaacctcttggtgctgcacacaacaccaatttccatcttttctgagaaaacaaaagcaccctcgctggagccctcggaggccagtgcttggtggccgtgggtcccctctggacctgtggccaaactccaaactcgctgcgcacctcctgtgggcgctggcaccagaaggaagtggccccaatcatggagcagtgtggtggtggtgaagctgcacggactctgcttctctacgcaattctttcatttttcttggagattttacttacagtttttaaaacaacaaatcctagggcttggaaaacttagtgagtgttttaactgattgaactaggaaagtactgtgcactagagatcaatacactccaggttggatgctgtcctgacaccttccttcaggtaggaatgtcagcctctttcaggggtgacaagatgggataagataaaacatctagagagaggagaagaatgcatgtgtacatacgcacatgctctatgcagctgaatgcctcaggaatgtcatgaagctgcaagtcatcccatcagctctgaacgaaggtgtgaatgatgcaaaaatcccagggactcaatggcttttagctcctgcacaaattagttcttggagagtgaaaattggcagtggcaggaaattgtaatacaaatcatcagaaaaaaactggttgactctgacatctgaacaccccacacacactactccaaacattgattccagaaacccagtttcacagtggggccacacagacaccgcagccagagatgaggctgtggtcagaggtgctgggctgggcccggtgctgcagcccacacagagcgtgggaataaaagcaggggcttctggctgcttccaggggcctctagggccctgcctcattttcagcacagccacctttaggcacttgtgagaccagcaactgcggaccgttcttacgtgtctgagaaggcattaccaagagcagggtcaggagggagcagggcagggaacaggcagcgcagcctggagccctcaggcttttgacctggcttggtctcgtgctttgatggtgcccacggcaccctgagaccagtggcctggcctctacggagggcagaggaggcatcagggcagcgtgctgggagctcctcctcagctgaggggtccctgctgccaggccctgtgagcaacaggccacggggaaagtggccactgccattggactcagcagacaagtgccagctggattttctcattggaaaattaagaaaatgcttccctagctcgggagtcctggggagttagacatgcattctacgagcccggccctctcctctcgatggcagagggggaatctgccatgggcacctgagccctgctggcaagtggacaatccatgggcttcttggtggaaaattgttttagccgaattcatttcccccgaggtcaccctttaaagatggcactgagtcaaggacccggcttccatgacttcggagagctcctacttcctgatcgcatatttgattttgtgtcaacatattgcttttgaaattaccagcgaagtcttttttttaaagagacagggtcttgctccgtcacccaagctcaagtgcagtggcacaatattggatcactgcaacctccacctctcgggttcaagtgattctcctgcctcagcctcccgagtagctgggactacaggcacgcaccactgcacatggctaatttttgtatttttagtagagacagggcttcaccatgttggccagggtggtctcaaactcctgacctcagatgatccacctgcctcggcctcccaaagtgctgggattacaggcatgagccactgtgcctggccagcaaaatcattgtgtttgtaatatggggtcatttggaacctccgggaaatgcttggagccatcctgggagggccaagggacgctgcaggctgtggaggagggcggactctgattcctgcagggggcggcaaccgttcctcgtgcggagagttcatgtgcctggcgaatctctattttgtgattctcttactttttatgagatgttttgagagcaaataggatgatgccatccagttcccgagtcccctaaagggcagtttccttgacgtgcgaggcctgtggaggggtcttcgtgttctatgaagtgaagggaagcaggtggcctggggcctctcaaggccaaccccaggctggagatgaagccagggcaggcccacgcgcaatcagccctggcctgtgctcggggaactgaaggctgctcccttctgttgtcaaatgaaatatcagacctccctggggaggcaacacagagcaatggcgggaaccacagggtgagaattcataacagcctggggctcatgtttccattaagaacgggtgtgctctatcaaaaccgtagtctgagaatttactgagaggccaggaaaatgtgggaactcacgtagagtcttccttcacctggccctataactgagttaatgtcattgggttaaattaacccactgtgcacgttccttttctgaccctttactgtgtttatcatgcgttagtgccttgttcaacaatatttcaggccggccgcggtggctcacacctataatcccagtactttgggaggctgaggtgggtggatcacctgaggtcaggagttcgagaccagtctggccaaagtggcaaaaccacgtctctactaaaaatacaaaaattagccaggcgtggtggtgggcggctgtaatcccagctacttgggaggctgaggcaggagaattgcttgaacccgggaggcagaggttgcagtgagctgagactgtgccattgcactccagcctggacaacaagagtgaaactctgtctcaaaaaaatttttttttaaatataaaaaaaaagagtatttcaaatttctcagatgttccatattttcacggattagatcctcttctctcatcctggacccagtggccatcctggaccacggacagaacagggactactttcccgttttaggctgaagaaactaagactcataaggatggaacgattcacgtggccacggcctcgtggtccacaggggagcacagggtttgactcccagccccactgcttgccagcgggcgatcctgggtaaactgttcagtgttcggagaatgcaggatgataacatacaactcacagcactgttgtggtaaatggcacgcagcaagcaatgaggagcaaggctgagatgacggtggacacgcacccaactgcgcaggtcagccaagctggcaaagcgtgttcttgctgccccgtggtggcagaacatatggagcgatttttcatagatgccaacagaagagacacatcccacaatttcttgttgattattactatggcaaagagccttgggagatggcccagctaagcatgctagaggacgcggcggtatagtcattaatcatgatctagaacctcccgtgcccaccccactgcatctgaggaaagcgtgtggaagactcctctgcccggaacatcgtcttgctacacagatccctgaggacggcattcccccaggcctcctggcttgctgtccacactcaggaagctgctctgcagggccaagaatctgcctcccaccagcacatgggctccacggtgctgctgtttggaggatgcgtgaggccatctgtgaagccactgctgagtccaggggcctcacggaacttggcaatggggttccctcctcccaggggcctcacggaactcggcaatggggttccttccactcaggggtctcaggtgttctctcgggctctccaactgcctctgctttctgtgaaggtttaggctcagtcatttatgctggcaggaggccctcttcttcatgttgatggtgtggcctgtggagaggtggagccggtgtcttgctcctagagggagtcctgactccagcagagaacatgttccgggatgtgctccacagttggcaccagcacccacaagctcctgctccgagtttatggtgtccatcgaggtctgagggctgcaaaggcacatcccggggctgctggccgtcagcaagggccgtcagtgctgcttagggatcccagcggctcacacacagaaaggcctttgaacttgtcatagttgaggcaaaggaataaatgatcggaccacgtttgtttcaatactctgagaagctacatgggcttgattctttgcagacctgggcacttgaagaccagcaacagcgtgatgacagaacgcattctgaaggggcaggtcctcttcctcccacacgctcctgtccttagtcagcaggcagacattctgcttccaactatgcctttgggaaatgctcagctcaagctataaagctcatcgaacatttaggaaagtcagctgagtgtcattcagggcctccgcagctcagcatacaatgctgcatctgggcagactgggacaggctggggctcatatccagaaagccctgctacatccagagatggtcatgaaaatgagacctgccccacccaccactcaggaggcacgctgctcaccgctgagctgaataaccgagcgcgaggctggtgtccggcttccacactggacgcgtcaaaagcaggtcccagaggagcaacagtggccccaaatggcatggtcacaaggctggtttagtgtctcatgtcttaaatggtttcactggcatcccccacagacagatctctcagaaagtcgccccccaatgggatcggaagcatgttgggcaggtgacctggggcaggtggactagaaggagcctcaagccctgggggattcccatacctgaagcgattttaacccacactagtctcatctcaggcatctgtgtagaaggaactccccaggcagggctatgcgggggcagaatgcagggggaacagacgccaaaggtgtgtgggggttgccgtggccaggcagcgcccgcccagtcactgagctgacttggaggcaccaggtcccagggttgagctgcgtaccctcccccaaaaagacacactggagtcccagccctgggaacatgaccttatttggaaatagggtctttacagaggtaagcgagcggagggcatttgggcggccctaatgcaatatgactggcgtgctgttaggaagaaggactctgcacacccacacgggagggagagcgcccgtgtgaagacgaagacagccgcggtcatgctggggacacgcggagggagcgcgcccgtgtgaagacgaagacagccgcagtcatgctggggacacgcggagggagagcgcccgtgtgaagacgaagacagccgcagtcatgctggggacacgcggagggagagcgcccgtgtgaagacgaagacagccgcagtcatgctggggacacgcggagggagagcgcccgtgtgaagacgaagacagccgtggtcgtgctgaggagcgaggcctccagagaagccagccctgctgacaccctgacctccatttctggcctccggaatgggagacagcctgctttggccacatacactgcccatccctggcgctctgtccctgcagccctccaggcccagagcacctggagcgacctgggtttggcttcccatgccctgagcagcacctggtgcctgcacggagaaagcgccgcctggagccagcctgcagttgtggagtgtgggcaacccagagaccagctccagacacacagcgaggcgtggctgtgtgcgctggtggcgactttctcgcaggaactagaacagtttgctgtaacaggagcacagatatcagacaggcagggccacgctgtctgcacggctccaccgagaggccgtccatcgacactgatgacgaatctcgtctgtgcgagcagcgcagatgagtgtggcggcggcaagacagagacacaaacggctggggggcgcctccaaggagctgaaactaggagcagggggcagctcacacgccttatcaccaggacacagggtatcaccagaagaacagctctggcttgtggctgtgctgcctgagattaacgcccgttttgtggatcgggggcagaagctgcacctgtgaccgacggtcttggggctgccaggggagccgcagaaggcagtgacctctgaccccacagcacggggcgcagggcagactgtgccaagcaggcgcgtctggaaaagtaagggaggaaattcggcgggaacctacacattagctccctagaggcgtaactgatgggcaggtgtggaaaacgcccaaacagctcgcgggagcaactcacttccgccgcacgggaggggtcgcggtcaaagggcatccacagaggcgctggggtgaagcggggaagcgggtgggagcagctccggcggcacaccccggccagggcagggccccccacaccccacggcagccgaaggccccgcctccccgcccgggtctgcggctccgtgaagacacagcagctccggagggttgatctcactgacagggagagtccctgaggaggggccggggtgcttccggcctgggtggccggaggaggaggcagggagagccctgcggctgaacagggcagcgccccccgcatccggagggacaggcccggccccgtctccagtcccgcctcccgcctcagccgcagaacctcggtggttccttcagctcctgaagcggtccgcaaacaggtcgagggcgctgacgaggccgttttctgggctaagcagcgacggcgctaggcgactccgcttgtccttcgtttccgctgtcagctcagcaggtgacttattcccagtgctgctcttctcacagacacaaaaccaacagttccggtctcttccgatagttctggcagagacggctgcggggagacacgggcggaggcgggtccgggcgggccccacgtcgcgcagcctcagcgtgttgcgcctcccgcggctgcggccagagacttccgcaaacctcggggcctcaatcgacagaacgtgtcacctcaggcccaggagagcagggtccggggcgcgtcctcagaagccggcagggcgggctcctcgctgagccgcagggcgagcccggcttgggcctcttcccgcgggaggaggccgccgcgttccttccccggttctccagccgaccccgccgcctccgtctcccacacgcagggaccctctcccgacaccggcctgcctggaacgtgccagaatcgtctccctaacccggcggccgtggatgagcaaacctgcacccgcggcagcctgaactgccgtttgtcgcgtagtcctcgagtctcggagcgcaggggtcccgagggcaccccgggccgccgtcctgcggcccccccacagtgtgccgggactcggggtctctcaccacgagcagacctcggcgctgctatccggactcctcgagccccttacaggccacatggccaggggcgaccctcccgtcacaactgtgactctgtgagctcacagggctggcctccacattcttgctggtggaagaccacaagcaacgggatgccttggaaagcatcgttctgcagcaggactgctcaaccggccaatcagaacacagggaaccatgaaagaggtgggaggaggaaaaaggaggacggagaggagggggaagacaggggaggaagggggaggacaggggagggccagggtggagctcagggccaaggcagggtttgaagtctgtggcccgtggcaaggtcgcagagcaggctggtcatgttcctacagcatcgtggagacctgtacactccgggttcttgggaaacgggggttctggaagggggcaggtgagcttctcgtgggcttgcagagttccctacagacttccacatggagagtctgtgattgtttggaatgggaaagtggtcactaaaagaacagctttattaggtaccattcatatcaggaaaaaaagtcagggacagctgtttcaaaattaaaaagacgaaagagacacaaaacccaaaatgcaatgatgaatcttgactgcatcctggtggaaaaaacaaaacagacaacagataacagaccgtgttgtagagaaagcggcgggagtccctgggagtgtgtgatagcaatggcgctgtgggctgagctgtgccctgatgcccctgtgtgacgaccccaacccccaggactgcggagtgtggccatgtttggagacagggcctctagagaggccagtaagtgaaggtgaggtcctgagggggggcctagtgcagtgggtctgctgtccttaaacaaaggggacccttagttacagacagcacctgcaagccccagggagggcctcggacacggccagccctgccacatcctggaccgcagcctccggcctccaggactatggggaaatgcaattctgtggtttcacctgctcatctgctgtctccaaagcctgggcagatgggcacagctgggtgttagagggcactgagggattgttgttaattttcttagttataacggggctgcagctacctaggagaaggcccttgtatttaggacctgcaggcaggctaaagtatttggacgtcatgacgcctgatacttacttgaagtcgtccagccagaaaataaatgaagtgctcgcaggtcacgctaatacggccaacactgggcggctggccagcgtgggtggtgggtgtgcaggcgatgccacgctaccccttccacttgagtgtttaaaactcttgtaataaaaagtgggggaggaagtcatgctaagccagccacacttctgctccagagagggccctgcaagagcggtgtgcgtgggttgcggctgggtctgcgctggggtagtgtaggctgcactctccggggagccgctgaccttgggctccctaacctccttcagccccagctctgtccctgtgtgaatctcagggctgtttcgaggatgaaaaggaggtgtttagccccgagcctcacgtggaaacatctgatgagcctttgccaatatgctcgggacctggggacggctggggtgaccccatcgcaaggccgggccgtggaaacaatctcagccctggaaccagcgcctgggaagtcccgcggtggatccgcgtcacgggggaggattggctcagcactggtcctgcggaatgtgtttttatcaatgacttgacgacgtgaaaaacatgtttataaaacgagcagatggtgccgagctgagagggaggtgacgcagtgactcaggaaccacaagctctggaggctgaacgagaatcggttacaggagatgaacacaaggctcgattctcctgttaaacttgactgtcaccaacggggggtggggggtgcgcgaggccctgggctccaccgaagaccttaaggaaaagactctggatgttagtgggttcggcctcagaatcagccggcgctgagatgtgcacctggcaggatgaacgtaacttctggtggataaagtgggaggcctgatccaggaagaagcacaccgtggcctggggcccctctggagggtaggtcttccaagtcacgggaaacagggcgcccaggagacggtgagcccggctgctgccaccccgaaggccaggctcgccccacactgtgagaccctccccacacgaagattctgtaagcggaatcggaaggaggatgtgagaaggacgggtagccatgccacaccaggccagacatcttaccaacctatcggttcagttttaagaaagagagcaaagaggatctaaaatctgaactttgagcagctgaactgtgtggagtatcaacgtggctcctgacaaccccaccggcactgtttctttgcactggaggtcctgaagagctcacggaaggtgcacttgcagttgtagttcagagatgatgcttttagacaatctttcccttcgagaagtagcctaatgagaaggactctgtagatctcttcctaaaaaagaatcctcagtctctggcagaacagctgcccagaacagcttctgcctgtgaggtagcaaagaaaaaggcccacacagaatttgctgggatattttctttccaacaccaacaaaccgacagccttcccaaatcctagggcagagtcggctggcactgagatcaaaaggggtgaagggaaggcagccaggctgggagtctctctccagcaactttcttggcgaggtgacatatatgcccagaacctttttctatggaaggaaaaagaaaaccctggcttaatcatcagagttaggagaatcacccacgtattcatctttaaaagcaaatcatgataacttttggtcactcagaagtaaccaaggcaaaatattcctcttaggggactctgtttagagttttgggagagaaaaaaaaaaaaactaaaccaaaggtttatttagaaataaattgttttctgagtattctaaggaaagctatgcttagccaaagtgcttcagcccttgtacatgtttcaaatacttctgtagaagtttgaaatggacatggattttcccaacacacacgcacaatctcaggtgagcccaagacagcctatgaggatggcactggggagtctggatttcagctctgacgggcgggctctaaaccccaaagttcttgtcggccaagtgggggggtttcttgtgaggaccagaggtggcacatccacgggcatgggggacgctggctcacgatgccccagtgatgccgtggttaggacactgctcacgcagctgcagcgcagagcacgggggacgctggctcacgatgccccagtgatgccgtggttaggacgccgttcacgcagctgcagcgcagagcacgggggacgctggctcacgatgccccagtgatgccgtggttaggacgccgttcacgcagctgcagcgcagagcacgggcgacgctggctcacgatgccccagtgatgccgtggttaggacgccgttcacgcagctgcagcgcagagcacgggcgacgctggctcacgatgccccagtgatgctgtggttaggacgctgttcacgcagctgcagcgcagagcacgggggatgctggctcacgatgccccagtgatgccatggttaggatgctgctcaagcagctgcagcgcagggccagtgtggtgaccctgactcctgggaacggtgatcagctgggcctctgcctcactggaccacgctgcaaggcaagggcctgggagatgcccacagccgcgcctctggctgtgaggcagctgtggtcctccagcagcaatgccctcagaagctgggagatgtgaaccccacatgactctcctccttgctgtcttcctgtccctgagccttcagctcttcgttgtctctgtcttgtctctctgcattgtttgtcctggttctctctctctctctcgttattacaacatagagccaaaaatacttttttgtttaggatatggcaccaaaatagtatcatatccctgttcttcatctgaaatgcagacaagcgaaatgctgcataattcttttttaaacattcaaaaaacagaaaatgcatgttaagttctttaaacttctgagataatacaactagacctagcatggtgccagccaagcattgcataatgtgtgtttccttctcctttgggggctcattccgatcagggtgcatctgggaagtcgggcgactgtgtccatctcctgggtggaagaatgacccagggaagtgctccatggggaaggcggggcatgagagaagggaggggtggtcccgaggaccctttccatagacctgggagttcccggtgagcacgcggaaaggacgcggtgggagcggcaggtgcagagggaggacttgaaggttccatccctaacagaggacagcgtggccgagtactcatgcttccaaccctgcacagaggatagtgcatgcccagcatgcagactcgcttccatcgcgacacagaggacagcatggagcccagctcgagtgccgtccccccaccatgacagcgcagcatgggccttccaagccacagagccacagggaagccagtcctcctggaccgtgtgtggctgttttggagccagttgtgtcctgtgaagagcgcagcggccgcaggtgaggcaggagtgaagatggaggaggcggccatctctctggggcctggcaacagcgagagcttttgccaagccactgtctcccggaggacaagatctccttcccaaaagcaagatggccaagagtatggagaagaaagtaggtaatacaagtttgctcagaataaacctatgtgttcatgaaaatatttctatctagggttctcccaggaggtgaacttgccgttctctgtcttccctggtggcctctcaaccctgaagggcagtgctgtgtcttcacaccctggcacatgggtcgggagaaccctgggaggaggtgcaggcagcttctttctggctccagtgcgagtctcgggagggaggtgctttccccctcacccgtcacctggctcagaatgggcagggctgtcctgatccccatgagaacatcaggcgcccatccacatgtggccaccctgttggcaccggctgctacctggggaggctgcctgtgtcccatctgagcacggaccacttcaccatcactaggtccctcgcccccaacccccccatccacactgtacagacagagcccagaaggctgcagggcacacgggaggaaaaccccatcggcaggtcgtttctgccacgctccgggctgtctttggggagggcgtgctgtcagatgaatatttaccatgaaacacctcacaatctaagtaaatgaccagacacacagagacatataatgcacgcttactgcatggctatttaccacgaaccattctccactcaggactcagcaggatacccgctcaccaccaccctcacttgtcctaccacaccggcttcactccccgccctctcctcccccaggctgctcctctctgaggacagtggccaggcccccagagcctgttagtagcccccgacacagggccggtgcttagtaaatatctgttagttggctaatgggatgtattgtattttgcttttcttctaaatataaaatttataaatcacacagcttctgtttttagatctctttagggttaaaaccctcagacctcatagaaactggtctgaacactaaatgggtagcaagaagcgtgcacccagctgggtgaatgggattttacacaggtctgcagtgccccaggttagtttctgaagcaaaacaagattccagcttctcactgttctgacctgtaacacttcctgagggctggaaggagggcaagggcagtgcctctccctggcgtggggggctgtgctgctggtacggggacaggcggtgtctcagggacaccagtctgatcccttgaccggctccgaagggttgaggcagggacacagtgacggagagacggcctcggccacaggggacactggtcccgcctgatgctgagctgaaagtgagtgtggccgagtggtgctctcgaagtgtgagctgacgaagctccctctgttgcatcagagacatgcgcaagggccttgtcttagggtcctcaggagagtaactaagaaactctacccacactgtcatttatcattcatcactcaacgttgtgagtatctacttccccctgaaactctggtcaggaacatatctaggacccccttcctcctggcgggtgggtttataaccaatcaaagtgtggaaccttcattggaacctgctatacacatagaggatgagtgaggtggacgccagcgccgggcagtccttgccctcctcatcttgtaagcagcttagtgcctcccgtgctgtgggaacacgaggcggtgtctcttccagtccacgagagtcactcggagaactgctggcttatatttccattttctggcagtgatccctagctaggtagtaggtgctcagtttgtggaaataattgtaaagttaaagatgctgtaaaagcaaccactgttgattgtgtgcctgcgacgtaccggtgctatgctaatgacctcgtctaacccttacagcagtaatacttcaaggacgacagcgtgaccccaattacagatgtgacgtggaggctccaagaggttcaggaacatgtctcaagtcactcggtgacagagaacaatagagctgatgctcactggggtgcagatgtccccaggcccgtgctggaggaaaggaagacactggttccttgttggttgggctggggatggcatcgcagaggggagattcccaggagggccttcccagagggggcaagtctgctgcaggcggggggtgccgggaaggagaagcggagggctttgcagaccctcaggatggggctgtttcccccgcctgtaacccaggcctccctccccggggactggtacacacaggtcagcatggccagtttcccccgcctgtaacccaggcctcctgcccccgggactggtatgtacaggtcagcatggccagtttcccccgcctgtaacccaggcctcctgcccccgggactggtatgtacaggtcagcatggccagtttccccctcctgtcaccctggccacctgcccccggggctggtatgtacaggtcagcacggccagtttccccctcctgtaacccagtcctcccgcccccggtgctggtatgtacaggtcagcacggctagtttccactgcctgtaacccaggcctcccgtccccggggctggtacacacaggtcagcacggccagtttcctccgcccggaaccctggcctcctgccctcgggcctggtatgtacaggtcagcacggccagtttccaccgcccgtaacccaggcttcctgcccccggggctggtacgtacaggtcagcacggccagggagcggttcttgggcacgttctcctccctctgggccacgaacgagctgttgggctccgcctggtaggcgcacagcgcttcccactccttctccagccggttcttgttcttcaggtggtcctccatgtaggactgaaagggaaacacagggtcaggagcgcacctaggtggtgagcccagaccggcagatgcacaaaaggcagcggaggcctttgcactcgccgcgtgggccatgcccaccttgctcacgagcctgggccatggtgcgacgttgtgctacggtgcacaatgcatatcataccatgcaaccgttaagtgaaatatgtgcattgttaacacacattttacatatgtaaatataaactccggtgtttgggaatcagtttaccgctgagatgacaacaattatcacatgctttaacgacagggccagggagctcagaccaagctctcggtggggctgctccgcgtgcccatttctgcttgcatggaagtcatttttcttaaaaccggcgcacgtttctgaacccactgggtgtgatgcagttgagagactgggctgctctgatctgtgcaaaatgcgggacagcttctagcatgaaacaaacacaaatggatggaagcaaatattttaacccttggctgtttcgatcttaatttttctggtgcttgtcgttgagcattactatgagtagacaaggaaacaaaggcctcctgaaaattcccttccacaaaaacccccatgccgccagcacagcccactcggttcttattcatctgtaccgttgagaacaagccctgattttaagaaagaacatttcaaaggaccaaacccagctgcactatggcaccacaggaagtgacggcctcgtctgctgtcactctgcttgtggatttgcaaggtactgtgtgtcatgtgtagacacaggttccaagtgtgtccacacgagaaaataaagcatgcatgtgtacacatggtcctttgctgcaaagcggccacgcattccaatgtcaggcccggggtccaagcccttctcaccttctgcccaccccctgacatccccttcgattgatccgaggagctgggatggtccctccctgcccactggggcccgttccaggagacaggtagagaaagagacacagagggagggagggctggacacggcgaggcgggaatctcaggtcatcgtgccgtctagtggaagttttgaccacagccaacctgaacccatgcagcaaacacacaccctgctgtgctggcccagctcacacgggagcaggtgcatcgggcacctgtgctgtttgcgcgacacccccgcatctgggtgggtgtggtggtgagggacaatcgcctggctcagggtgggcactctaaggccgtctgttgggaggtcccaggttgtcactgtcacccccaccatggccctgcttgagctagttgggaaaagcagagggactccagtgccgttgagaagccgcaccgactgcctgctccacgcagcgaacgcttttcccccaccacaccttgagccttgggagcacacctgcgccaggaacagaaacatcagggctgctctgagccaaagcgaacgagttcatctactcccgtcaccagccccgacacccaggaagcctcgtggtttccttgtgcatggaagaagcaccccacagagatgtctcgagttgtgaaattaggcaaaattcaaatggctcaatctaggaaatgctacacattctttcttttgagacaatcattatggaacatcaaattcatatttttgtaccaaagttaccctaataggaaaaacatttttggatgatataatatttaagttttgtgaaaatactgaccagctcatctagcccaaatctggtgtgtgagggaagctgggaggttgatagttatggtgaaaggatagtcccagtctgtttctgtggctacttttctcaagttgggcttacgtagagttctacaaataggtaggtcgaaaatggttcctggcaaaatcattctgggtcctagcttttctttgaaaaatgctcttttcataaaatccatcacaaacaaatgggcttccttcagtaaaacatgatgggttctaaaatgatgaaccctagcaggtttaatccaatcgaaaatattatctgcaaaagaggcactggatattatcttaattcgtataaactacagctatttaaattctcacatttatcttaactataggaagcaaaattacactctaagttctcttgaatttctaaatttatggcaaaaatataaactgagcctgtgtggcccaaggttgggtggtaggagggaggaagaggtagatactgacgcgatgttttttcacggagaatgaagtcatctgcagaggcacgtgactctattaaaactgagatagagctgacatctctctgcacacgccactccagtgggctgtgtttgtcccgttctgctcatttcaatttgatctgttctgtattcttctatcaatattttttatgaaacatcctttgtgatattaaactgatgaaatatcccccaactacatcttaggagtcttttttctctttcatggcttgtagataagatgcttttcatctgtgagtctgtggggaagctaggccttcatagcaaagtaatgttttaaacaatgaaagcaaaaccaaaaggtaccacgggagcttagtacagatgctcccctacttatgatgggttatggcccaagaacttcttaagttgaaagtgcattgaggccgggctcggtggctcacgcctataatcctagcactttggaaggctgaggcgggtggatcacctgaggccaggagttcgagaccagcctggccaacatggtgaaaccttgtctctactaaaaatacaaaaattagtcgggcatggtggcgggcgcctctaagcccaactactcgggagactgaggcaggagaatcgcttgaacctgggaagcggatgttgcagtgaaccgagatcgcatcattgcactccagtctgggtgaccagagtgaaactccgtctcaaaaaaaaaaaaagtgcattgaacacaggtaacctactgagtgtcacagctgagcctagcctgccttacacatgctcagaatacctaccttcctctgctgctgggcaaacccatctcacacaaagcctactgaggataaagtgttgaatatcttacatgattcattgaacactgaactgaaagtgagtaacagaatggttgcatgggtacttgaagttcagtttctatttaatgcgtgttgcttctgcactgtaaagtcaaaccatcataagttgggggccgtctatactgtggtcatcctgcatgtgaacttggacaagtatagcaactctactcagacgtcttctggaattattaggaaattaacatgtaatttaaacagtatttgtggcttttccctggtagtgggcatttagctataggtgtttttaaaactgacatttaagcaaacaaatcagtaagaaaaaaaaacacaatcctatcaaaaagtgggctaaggacatgaatagacaattctcaaaagaagatatacaaatgaccaacagacatatgaaaaaatgctcaacatcactaatgatcagggaaatgcatatcaaaaccacaatgcaataccaccttcctcctgcaagaatggccataaccaaaaaatcaataaacagtagatgttggtgtggatgcagtgaacagggaacacttcttcgctgctgatgggaatgtaaactagtacagccactatagaaaacagtgtggagatttgttaaagaactaaaagtagaaataccatatgatccggcaatcccactactgggtatttacctagaggaaaagatgtcattatacgaaaaatatacttgcacatgcatgtttatagcagcacaattcacagctataaaattgtggaacaaacccaaatgcttatcaatcaatgagaggataaggaaactgtggtacatacatatgatggaatactacacagccataaaaaggaatgaattaacagcatttgcagtgacccggatgagactggagactattcttccaagttaagtaactcaggaatggaaaacccaaccatatgttctcactaatatgtgggagctaagctatgaggatgcagaggcataagaaagatacaatggactttggggacttgaggggaggagaaggaggggggcgagggataaaagattaacaaatatggtgcagtgtatactgctcaggtgatatgtcaccaaaatctcacaaatcaccactaaagaacttattcatgtaactaaataccacctgtaccccaataaatggaaaaaaatcataaaaaagttagctcagaaaaaaaaccttgacatttaaattcttttattttatagatgagtgcatgtgtgagagagtgtggtggtgggacggcttagtttcttaaggcactgcaacttttgttacataaatagcatatgtagaaaagaaaagaaaatgaagataagcagaatggcaacgaataaccccagggcccacagcaaactgtaaggcaaccttttcccccagtgctgagtaccttcatttcagctttggacatcctcaacagaatacaatttactgctttaaagtgaaaaaatgcagagatgaggctcacatcttacagataaggaaaccaaggcctagagaaggtaagcaattggtccacagcccccagcagccagtggcagcaccaaagcctgagcctggcctctgaaatgccctgtgggttttctcctggcccgtcactgcagccttctcgctgatcttcttaccatcgcttcccctttccagttgctttttcactgaacgaccaggttggcgtttctggtgcaaaatataacctatttaaaaaaattaccaagggtgcctagactagcattgtcctttttctgaatttccttttactaatctgatactttctatcccataagactgcttctcagcctttgccccgtccccaccgccatccttctctacattttgtgctgatttttctgtaatgaaccgacccagacttcaaggtgcagttcagacaacacttcctcctccaggagtccggtcaggacatgcccattacctaccccaccccatgatctttcttccctataacccaccccccacatcaaacagttactacttcaaacatacgtctctgtggcattcgtcacattcttcctgttgctttaactgtgggtttcaagctctgattcttctcatgagattaatttttttagggcagggactgtgtttcagctgctcagcacaggcagcaagcactcagccaatatctgtggaataataatgcataatctggaaatctctacaagtgatttatattataggtaaacattttattttgatgatgggcatccaaaacactgcctttgaatcttctgaaacttggaagaacttctccaaaaaggagcataaggaacttggaatgttttactatacatgaccttgctgccatcttcctttctggggttgcccagcaaacatcactgtaactcatgacagacaggtgtcagctcattgagtgttcctgtaacaacctgaacctaacagcagtcgtataaatttggaagggcaacagttcagagagctcttctctacaagtctcctccacaactcttctccttttttcacatctccctcattctccacagtccaggtcccaggtggggtgctccatctcccctggagccttctcagtggcctccaggcaccagtgtgcaccgcacctgcagctgggtctcctccggggcgtgagctcctggtggtcagggaccccttctcacaccgtgtcccacttcacacagctccttgctctgggctctccgtcagtgcctctgagttgaagctttatgaagaaagctctagaatgagctgactgaggctgacaataccagagggagtgagccagtgaaggcgggattgcaccacaatgcgtgctcacatcaggaaatccatgaagagtgaaaacagggagcgaagaattggtggtgaatctcagtcgatgcaggctgaagtgcttagggaagttggagttgctgtctgttccctgatccttaggaagcgtttggaggtgtgtctttcgtcttttagagctgcttgctctataattttgggttttgaagggctcttggctgggagaactcagtctgacattttcatatttttaaactccattaagggaattttacttaagctgtttctagataagccctgagtgaaaaggtgtctccaaccttctcaaattctcatacttcctgagggcctagacatgatgtgcttgtggaagagtgaattcctagatcaaaccattcatggagaaagctacggggactcaggaagtgggtttcccaagggtgttgccaacattcactatctgacgtagatcccagagcacacgacatccacaccacagcagctgaagatgtggctgcattctttttcgcgttctcaccctttgagaatgacaccatcagcgctcacataatctactttgttagagatatgaactcaatctaaggtttcccctgtcatccttctcccgtttctgaatccatcctgccagtccctgtctcatggtgttttctagctcatcctacgagaccatttagggttggagcattaaggacagtcactgggtcacaagactgggtgctgctagacgggttttggaggaaacagcctccatgtgtcaggcaaaccaactggcttccacatttaatggaatcattatacacagaaccccaaaatttgtgtaacaaaagtgtgattgccatgaacactttgagggagaatgtgttcacaatgtattacatagcacaaatgtcgtcagcaccgtcttccggtcaaatggtcaacaccttgaggtcaaggggctgatttctaggaacacggagcacagacagtccagaacacaacagtgtctgttaacgattgcaagagcaccttctcttcaggagaggaaccaccctgtcactcgcagagatgaacatggaaaggagcttctgtggaacaggaacgcacatgaacacactgggaaggcactggactttgtgttgatagagttcttaacagtcttacacagaacggtgtgggtccctcccacagctactttttggcgtggagccttccggcaagtcaggccatctgactgagccccacgggtgcaccccttcgtaacctggtcatcacagctcacaggggagagccagagtctatgttcccaaggaggttttgaggggtgatgcgtgaatatgggagacacagtagaaggtgtgtgcccggggatggggtgcgggacggtctcagtgtttcagtagaggaagagggtactggaaagactcctgagttccctcccacgctctgtggctgcactgcggttctggggagactcttatcctcttgtttaaggaaatacaacatgtccactctcttctgttcacttcttttttgaagagggaaatatttcatggcctgtcttcaggagaggaaatcctaggaaatgcctgtttaagagactatgtgacactaaactgctagttaacaaggacaatttctccggtgggaagagcacaccagcatcccgtgtgcatctgatgcaggacccgctcacacgaaacatgctcgccttcctgttggcaccaggaggaagtgcagctgccacctctgagtactggggtagtgcatctggagacttgtaaagggtccagatgtggttccatgtgaatcccgtccacaggcactgggatcctgggtcagccaatgctgattcacctgttcctgcagaccctgctgccaaagacaccgcagaacccatggggaggcagaagaaaggctggagcaggtcagtgctatttcagctccattcagagtcacagaaattaggttattttggcatctatctgttggctgtaacaatgaagaagtgagatactgagaggtgcaagatgatttattattattattaaaaataataatgagaataaactcccaccatgcaatactaaaactcctaaggagtcctaaggactcctaaaactcagtggactatttaaaaatgagcaaaagccggtccatctggcattatttctcatcaatcaaaccactcgtgcagtggaaagtgagtccccacggatgactggaggcgcccatcatcactccgtgggtcttcggatatgggacgagtggaaactgtcctggtgaaacttcgttcctacaacgatgctgccagcagtggagacttcttcccactgtagaacaaggcgtgttaaagaaagctgggctttggggaacccagtcattactgggaaggctatacttctcttttctacaatggcgcctattgcagcacaatgccctttaatttactgaacattacaatcaaaccttttgttaaaacgaataatagaatccctttacattttccttcttgtgacgagaccacaggtttgtgtgttgaagtcacaagttagagtaatgcttttaaaagcaaggactaagctgcttccactgccacttggggaaatgatgaccttttctttctttaaaaataaacacagtcacctgtcttcattaatacatgaacgggaaatattcatgttaaatttttgaattccaaaagtaggacaattgaattccaagcaaaactgtgaaaagatgaaaggagaagttcgatgaggttgattgtcctggctcagcacacacagctatgggggcttcgggagcagcaaacccttgatgagaaggtattttattgtctgtagattgctgcatctggcatattttaaatattatttgttaatattatgcagcaggaatgttaaaatatttaaaattagaaattcaaagtagtacatgtgaacacaaagaagaacagataatggttaaaggatcagaagatagtttcactatttcttagtttaagaaagctcttcctgaaacaggaatcccgacccatacgaccatattcaacttgccatctcactctcagaaagcaatgcccacaacgtgaggcggcagggagtgaaccggcttcttcaccatcccgctcctctaacacaccgtgtgcccgtcacggcagcacctttgacttgccatggaattacgggtcttactcaacagctgaaacaggcattgttccggctctccaaacaagcaacttgagatgcagggcagatatgcacacattaccaaaaggcacaggcccatggcagccaactcgaagtgtgcctgcatgccagggtggagtttgctcgggagaagcaaacacacggttttggaattcagcctctgggtcatccgtacaaagccaaaaagaagtagaaatgggacccaaggaattaacaagagtgtgtgaaagaccattcatggggtcttctcgcttttgatcacattttaaaaactgctttcctgacaacttgtttgtaaggaggaggcattcccacacgtatctgcagtaagtcatatgcttcccttaccgcagggaactgggaagtggtcaacacagatgaaactggcaaaagcctcctcctgtgggcaccacaactggcttccctgatggatgtgaattaatgccatttattccaagctctttctctgagagttttgtctccagctgacctattctgaggaccacctagaatctctggcaagcccagagacccttgaaaactgttctccctgcgtcttaatgtgacttagaaatccatttccattctttgccttgttaccaatcaaactgtggagtaacagaaaattataaaccattaaggtagtggagaaaagttcaaatacttcaaaatggaatcttccggagaaagtccccagttggtatgcagttcgggtggagaaggtgaagtagcagcggcaggaacaaagcgtagaaggggaaacaacgtgtggtgcgtgttggttttgagaccgggaacgctactgaactatctgctttatttaaaactttttcatcattgaaaaataaattcactcactgagaattaagaatcccagcactttgggaggctgaggcgggcggatcacgaggtcaggagatcgagaccatcctggctaacacggtgaaaccctgtctctactaaaaatacaaaaaattagccaggcgtggtggcgggcgcctgtaatcccagcactttgggaggccgaggcgggtggatcacgaggtcaggagatcgagtccatcctggctaacacggtgaaaccccgtctctgctaaaaatacaaaaaattagccaggcgtggtggtgggcacctgtagtcccagctacacaggaggctgaggcaggagaacggcgtgaacccgggaggcggagcttgcagtgagccgagattgtgccactgcactccagcctgggcgacagagcgagactccgtctcaaaaaaaaaaaaaaaaagagagaattaagaatgcccttcagataaggctgtcaagaaaatgacatgcttttttcaaagtcctgttagaaaaacactgtaagaggacagattccttgcctctaatagaggcactgggacatgatcacagaccttacgtactttccgaagagcaaagggaaaggaaggttaactctttgcaaagtggtgtgttaagaggacatgaaaactggctctatcttgattgagtagaaactttaattagtgtatttttattataatttggcttttgatgttccaaatcgataacaaagtccagagttgtaagaaatcacactgacaaaggagttcttacacaatgcccaggtgacctgcagggtacttcctggagtccacagccggcccagtctctgcctcacctctagaaggactgcatgaagacctgcgatgcgtggaaaggtggcctggtgcaccaacgcctggtgatcctcgatttcagtttatgacttccactaaacttctgttacacatttacagaaaaatatgacaatttgataaagacttaacaacaaaaaccccaatggaagatgttaatagtgaacacattgtgttctagaaatgttctaattaataaacttaaaaagataagtaattttttccttaccacctactcttactaagtaggggaaagtcttgttctttcatacgattgatggattgttttacgttgggcattttttagcaagatatcatattagggagtgtgcgtaggagggggtgacaggggtcacctgcagaaagactaagaaagaagctgtttaataatggggatgatgacagaggcatcactttgtatttcaggctgtcattctcagagaagcgcaaagaattttaaatgaacaattttatgaatcttattatcttatttaacatcttaaaaattaaggttatgtgaacataggtaaaatacagagatgaatgcttataagcaatggaaaataattcagagaattatactatgttttccataaatgtacagctattaatatttaaatttagggcaaaagaggtctgcttggcattctaagtgaaatgtgaatgcctcatctggttttgggacagagggctaagagctgctgtcatttctgtcggattcctgccgatgttgtggtggtctagtcatctgtcccttcagtcatccagtttgattaagcacgtcctataagccagggatgacctaggttcgggagcacagtagttagctggccaaagaccctgtcctcatgtggctcatttctttagtttcttttcttttcttttttttttttttgagacagagtctcactctgttgcccaggctggagtgcagtggtatgatctcagctcactgtaacctccacctcctgggttcaagcaatcctcctgcctcagcctcccaagtagctaggactacaggtgcaaaccatcatacgaaaacgaaatttttgtatttttagtagagacagggttttaccatgttggccgggctgggctcaaactcctgacctcgggtgatctgcctgccttggcctcccacagtactgggattataggcatgagctacaacgcctggcctcattaatttctttagctggagggcagaccatctgcaagtagataaacacagctttaaaaagtgatttcagacaacagtgagtagtaagaagatgcggacaagagtcacgacgcagagcctgggtgtggggacggggtgcacctgggatggcactgagggggcccctctgaagggtaaactctcagagccatgggccgagtccccgatgctaaggacctgggcagggcctgagtgggggtggggtcctacagggaagggcagtgaaggctggagcccagggcaggagggcgtggccactccgggaggagggaaggtcggggctgcagagaaggaatggatgtgagggcaacggtgtccggcagaccaggagctgttggcctgcaaggactcagcagtttattttaagagccacgggaagctttcatgagttttaagccaaagatgcttgtgatggtggttgatggtggcgcttttggaagaccaccctggttcccaggtggcagtgcaggatgcaagtcaggactgctgcagcccaccatggaagagcaggcagtggctgtggcatggggaacagcgcgtggggaacagcagtggaggcgggcgaatgagagaactgggcagggtgcaccgcgtcctgcaggcaacacgtcctaggattcccgtctgctcatctgacctgcccttcctcacacacctaagttgtcttcagctctttagcttgcaaaatattttgtcattgtttaaactcttcacccctcacagaaccacagcaaggaaagaccctaatgatttgatctgagaagcaaggtcatacctacccttaagttacctgaagttaacagtctggataaaaacctgaaaaattctatccacaactctgatatttccaatagccttcatgcttttgttacatgggcaagacattcagatattgaatggcactattcagctttcgtcaaagtaagtttgctcaaagtaccatagaaaattaactgcccatagctaaaccccaaatttaaaatgtaaagacaaccgaatcactaacctaacctgggacgccgtgatgtgcttgtccacagatgaggcaactcctgaaacacagaccaaggcatccgggtgcctgtgtgcacacagggctgcgttgtcaatgcatcgcgaccgggcatggtcctgggagtgaattatcccccacaggtcagaggggccgtacgacctcttccagaccccccgggctccagttattaaatgactcctgcaatcatgaactgctttccaaagaacacaaaacaattctgtgaaagattcacaggctgacgtaggctgacaggggttctagcccattaaatccatttcaaactgaaaccagggagacagcaagtttgagaaaaccagaatttttaagagatgaaaactgcacatctgcagtggacgtggtcacctgcctgttgtccttggacaccgcgtgtgggaggagcccagaactttctaaagaacctaacaggcctccaggtcccagatgttctgaccagccagcatgtctcgagtgtgacgttaagtccagaacacacgtgaaggacggcacactggtccatctccctggacgtcctttctcctgtccacagcgacacgggctctaaccagccaacgccacgtatattgagtcagtgccattggttcagtgggaagaatcatgaggacaaagatgtaaatggcaggtgtgcgttaggcactccccataagctaactgtttgctcttcatggtgtctctaacgtctgacatagcctggtacaccctacatgatcagtaaccatgtgttggatgaactcagggtacaggcacccacggaatttcattgtgggaatgtgggagtgcctcccagtttctgatcaaaggcctcttgtgtccaaggctggtcatgtgtgccaggcacatgggtttcaggtaacagtcaccttcactttggaagtgcaggtgcaatgtactgagccacggcagtgctgccatgaaggcgtttcggacaaatggttaccagtgtttcatggaatgattttcttcaccaatatttgtcattcaccatctaaaatcaagtgaacaatcagagggggagaagggtacagatctgggacaataaaccaattttcatttttctagaattttctcctatattttattgtcttcgcctcagctcttttctctggctagcttacagactctcaccccagccaggatatctggattttctagaattttctcctatattttattttcttagccttagctgttttctctggctagcttacagactctcaccccagccaggatatttggattttctataattttctcctatattttattttcttagcctcagctctttcctctggctagcttacagtctctcaccccagccaggacatttggaactattgcataatccattcccagaatgcatgagcagctctggaccctataaaatattcattcactttcaaaaatatttgcaccctgctgtcaaatgtagacaaagtcacatgaagtatcaggaaatcgctattttaatggcaaatacttccccaaccctctctttccactaaaacattttcttcaaaattattttcataagaaagattaacaatttcaacattagctgctaatcccctttcatttaaaactctgctgataaaattctttgcttgtcattcaaacagtaagtaataattatagatttgaggcttccatctctggcttcattaatggtaaattgcatggaagtctgaagcataagtcagctttgatacatctcaaaatgcaatttccatagcttcccttggctatgtacaattaattacacagttaataagggaaatatgttaatgaaaggaacattattcatcaagaccacctgcctttaccaaatatcctttgtgtgtttctcttcttcttgtaattttggtctacagacagttaaaaaaaacaacaacaacaattgacagtgtgatgattttaataccagactgcagctacttcgattaaaacaagtctaatgaaaaattaattcagtcttataatatttctactgatttctgccttttagaagtttaaaatgtctacccatatatttctactgatttctgccttttagaagtttcaaatatttacccatggtatttcaaattcctgaaatggctatttatcaaacacaaagtttactattcaggtgtcttctttataccaggatctgcggtcatcacctttatagatgaatggaaaacactggagaactttggagaaatggcgtggaagatgaagagataatgctcaatcattctaaacagattaaactcccccaattcttttcccgtccattttaaacctctctgcttagcaataattaaatcctctcattccatttggataatcaaagtttaactatagatagtttaacacagaaaccaatgctaacctttacaaagaaagtaaatatcttctaagcctttgatgaggaagagaaatcggaatattataaccagaaaaaggaagttggaaaaaactatatttctgtttactttttataacttatttgaacaatatgaacaaatgtatttgcaaatatttgttctacaacatttttttattaatataaatcaatacacattccttattcaatgagaaaagaatttgactctagcttcgaacatatccctttgacatatgaaatatagtttaagccatgagttacttaaaaattccattagtgtgcaaaattcagctgaaaaccaaccttggattccaaacagatcataggaaaagagggtgcaagagaaagaaaacagttcatgaaatgcaacctttacgtaactaagccctgaagaggtctcctaccacactaacatattctaggagaagagcagaatctctaaagtgaacagcagcccctgtcatcccagctctgtgacaagcagccctgggtgggggaatcggggtggctcagcagcaacatccacaccagcctccagcagcctggggagtggcggtttccgtaagatcccttcaaaagccgtttcgtatcacgatttctatgctttgtgtggcagcagacccatttgtttaagtggtcatgcacccacctctccccaccctgatggtcacctacaaagcccatatggccaaaacggtatgatcagattctctcagagaccagactcctttgctggcacccgacccaggagaagcagcccagaggggaccatttttactccactgatgacgacagtggttctaacagggagacctttcagaagaaggatgaggaggggcggttgccaggcaacgcatagacagcttctcccgctcccaagtagcaggtcttttcttagcagcagcattctctattctgtgccaacgatgtactcattacgattttctgatgaagtttttaggaagaataaagagttccagcaagtgctgtaaaggttacttaggacagtgatggagacatgcatgtcttcttccataagcagaggagaaacactgaattctatagcaccttatttgaaaatgccgaagttctaaaggtgctcactgaaagtagaatgttttgatgcttcacttcctaaaacccacaggctatatgcacatgagcaataatacaagaaaaggggaacaaaacaactgacaaggtgatggcaccaaaaataccagaaagacttgcttgtctgagacaaagttaatatccagctcttcaccaaccaaacgtgatcacaaggaatggatcttgaaggggtcagtctatgtgcgagacaaagttattgtccagctcttcaccaaccaaacgtgctcacaaggaacggagcttggaggggtcagtctatgtgcgagacaaagttaatatccagctcttcaccaaccaaacgtgctcacaaggaactgagcctggagggctcagtctacctcctccaccttccagaccttcctgtgagcagtgaaatttctaaaatgttggtgaagggaagagaacattcaggcttccatagtcaaccacaattaccaagtgttgactggtcaccactcctcttccaattgctttgaaacgaggagtttggaggagaagagaacagagagctgatatgtcaaacagtgttttcacttttcagggtgaagagttagaggtgagactatcagagatattttacatcttttcccagctcagtgccagtcacacggcatggggaccaaatgacatgcccgctggcattcccagggtttggagggtgaggtgggagtggatgatcggggtcactcttcttgctgggacttctcatctgtccctccctgcagctgccttgtcgtcactcagccacgtggaccacctggacttccctaaggccatcagcattagccgtcagggcccactcgctgctcacctgctgcagaccttggcccatcagcactcccagaggcagagcattctggacacagcgatccctttgactgcttacagaaaggtgagtgtggaaacccggcggaatgtgatcattacctgctcatctttgactctagacagccatcggtaggatgtctttctttccttctttctttctttttttttttttgacagagtcttgctctgtggcccatgctggagtgcagtggtgtgatctcggctcactgcaacctctgcctcctgggttcaagtgattctcctgcctcagcctcctgagtagctgggattataggcatgcgccaccaaatctagctaagttttgtatttctggtagagatggggtttcgcctgttggccaggctggtcttgaactcctgacctcaagtgatctgcccgccttggcctcccaaagtgttggggttacaggtgtaagccactgtgcccagctatctttctttattagggagaacacacagttggttcttggaggcaattgtcaatgtgatgtgagatgaagcacagtgcggcctctgcactgttttcctttgtgtaatttgcatggcatgtgtgtttccagtgatatgaagaaggagataacctgaagtgtcttcctccacagacacgtagaatgctggacaaatggcacagtcagcctttcacagaattaagggaaatccccaggaatccaagctgaaggagaaagtgaaactggaatgggggatgtgcggcctgaagccgctcaagccctgggtggaaggcaggcgacaggattccctacatctaaaatcagggtcttggactttgctgcccatgtggggccagcagggaaaaccctgccttgctggaggtagagagctggacccgagccccccacataacacaggaccctcaacaaccacacccttagcaaatgggtgtgctcacaccacaggaatctcgtctgtcaccatatggactcaaaatgggaagacgcttgaaacatgggcctcatccagaattgaggctcaaacacatgagtgatctgggtgaggaattgacatgaagatagtctcagtttaatgacagcctagtgtgtctggcaaaagctctcttgaggttaatactctcagaacagggccatacaaaactagaactaaagccccaccaatgaggagcttataatctggaattatagaacccaccagacaacaaactaccatgagcaaatcagcaaacatcaaagagcaggcttagacccatgagaccttaataaacgtgttagaaaccatcggataatgcattgatcatgattgaaggtgttaaagtaggaaccaacaatttaagaaaagaacaacccagcaggttgatctgaaaaagaacaaaatagaacttcaagtgaaaaccatactctttaacattataactacaatgcatggattacaggttagacactgctgaagagaaacactgtatgttggaagacagatctgaggaaattccctggaatgcaggacagaaagatagagaaaataggaaagggatttaagggacatgggaataagaaggtacaacttatttccattagaggggagaatggaagagagtcaaatgtaaattatatatggtttataattttttaggattagctggagaaaggaattctcagattcaggaatcacagtaagtttggagcaaaaattaaaaataaaataagtccttaccaagacaggacacaaggaaactccaaaacagtaaaggttaatcaggaaggagcggcccacaaaggaaccaccatcagacatagcgatcaggaaggagctagagctggcacacaaaggaaccaccatccgaccagcaacagacagtcttctcaagtgcaggggcaccagagacaagagaacagggtttcaaggtaataaaagaaaaagaaatagaacttgacccttggctaatctgttatgcaagtgtgaggatcaaagacattttcagacaaagagaaggaaactttcccaataaaagactgaaagaaggatatctttcagaaaaaaggtagttttacccaaaatgaagaattgagcagtaaaaggaatggtgatggggggagaggggaacctcataaaatgagagtcggtctgaacaaatgctgactatgaaagctagtaaaacaaacggttgatttcaggatacaaagacaaggcacaactgaaatactgaacaatactgtatgtgtcagagggaggtagctgaggtctgtgtctcaggtcctgggtttatttgtgaggagggcagaaatgtgaactccagatattgttaagccaagcatggttattaaaagtatcaggataattactaaagtataactgctgaactagccaagggggagagagggaataaagaaaacccattcattcccacagaaggcaggagaggatgctgcaacaaaatacaactcagaaaatgcagggcatatgtaaggcaaagaatgagatgtacacaggccaaacactgagtgagtgagagattagcttttttaaagaaaaacttacttggcaacatggtttctataattttagaaacgtcactgcaatactctgcagtatgttaggagattttcccacagtgggcgtcattatttttctttacggcagtatggttgcatgagttttgtaaccagccatattttgtggaaggggaagccagagttcacaggatgtaatgctggcccagatgtcacactgggaagccagactctggacgtggcaccatcttttcactgcagcaccaaatcttcctgtctttccaagatcactgtcctcttgctccagaagagaaaacactagtgacaagtcaggacccactcagtccctggctcatgcatcctaagtgctcccaccttctgcaaacgtacacaaataagtgaataatgtcgacttttcgggttcaagaagtcacaacaattacatgtggagtcaagcaccactccacatgtggacgcacaaagctacctgacgtctggctcaaggtgttcactcgagtccaggctgagctcatcttctgctccttccaccgtgaactccaattctgtgaactgccctctgcttcctgatggagctgtgctgttccctcctctgcatgccacctgcccaacacagctgtcttcaccgaccaaaacctggtctcaaatgtccacctcaagtctcctctgtagcccccctgccacgcccgacactcccgtcaaggacagagacgtcttctagcaaaagaatgcagcttggtgtgtggcaatgtctagtgtttctccagcccttcacccccttttgccccaaattggctgtaagcctcttaggagccagactgctggcctccttcacacccagcatccccatggtcctctgcccaggagccgtgctgaggacatgaaggtaagcagagcccacctgacgccagctcatttctgaactgcttgtggaatttcaaaagctgcattttattaaactcgtgttaggtttacacatttacacaaagaatcagataactccatccaggccctgaactgctgtgattcaattcctctgatgctgtctataaacctgcagatgcaggagtcactggacagaccagatggaggcggcctctggtctcgcctcctcgcctcgggtttctccaggaagtttccatgagttcccgagcagcctgtggacgtctccgtccgtcactgggtgctcagaaaacgctgcacgaatgagcactttccagacctgactttatgcaccagcttcaagtgtttcctcccacaaccgttaattcgtggacctgttaacttttaccaagtttaatgtttggttacccaatttaattcaacaagtatgagttggatgcttgattccacttcttctatcatgccccattcacacactataagaagggtctaccaagtcaagaaacagcaaaaaaaaaaaaaaaaaaaaaaaaaaaaaagcagctaaaacgcagggctgcgggacagtgggtgccatttacctaagccaatcgccccggcagccaaaggccaagctgcatcacagcagcttacctctttctcccgcagactctctggaccatcacccaccttctctggagcccaaacatccaatcaaaccaggtcgtaaatatacaggtagtccccgcttatgatggggctatggcaggataaacctctttggagttgaaaatatcattaagtcaaaaatgcactttcaacttacgatgggtttgttgggacataacccaccatctgtcatactaaagatggtacaaactcttcctatagactcagccacttgtctcgctggggccagcatggcagcagggactggtcagattggggtcagagaatttttcctttaaacattaagtgctcaaggcagaaaagacaacatattgaaaacttggagagactgaaaaataaagcactagcatggctctagcattttaagcagcaaatcagatttttaaaaaataaaaagtcaaatcactccccctcccacaaaaaaatagagttccacaccctcaataaaggcggatcatggaagggacactctctgcctgtgtcacaacccaactatccacagagcgctgcaaggggcactgtggcggaggtgtgggggctgcaggggaaggccgtgatggccgctgaccaaggcacagctgctgcaggacgggcacacccacggcccgggcatcccagggaaatccagaaccagtggctgtgactgctcccccgacggagcccctgttccttgcacagccgctgctgcctccagcctctgtctgcgcccttcccaaggaccccctgcagacacccgcacccacagtaaaggaggtgggagcaggcggccaggctccagccaggaagtgtgagctgagctctagaaagtggtggtgtctaaagtggctcaccagcctctccgtcaggcctcgaaggttcgtcaccaactcgtgcagcagatagacggcagtccgggctgtggcaggtgacagcccagggcccagacaccggccagcctcatagtgctcgccgcacgctcagctcaccagtgcggggagactggagcttcccccgtgggactgtggctggaagaccaggggcctctcatgcgctacaagctaccagaaaacactggtgtgcatcaggcgtcggtccctgttacgggctgaaccattccctagaatccatgtgctgcctccctaatcccctccaggttaccccgcaacataacctcatttgcaggtggggcctttacagagatgatggagttaaaatgaggccactggggttggccccagaccaatctgagtgaggtcctgagaagacagagcaggatgtgctcccacagacgaaaggttctgggaggacacaggaaaaagatgtcatctgccagccacggagagagacctcaggaggaacaagccctgcctgcattgtagacttctggcctccgaaactgtgaggaagacactgctgtggtttcagctgcccagcctgagggatgtcgtcacggcagccccagcaggccagggcaggcccctggaggtccacagacctcacatagccagcatacgcctctcccaggagccccattcttgcttcatcaattaaagcagcactctggctgggcgcggtggctcatgcctgtaatcccagcactttgggaggctgaggcaggcggatcacgaggtcaggagtttgagatcagcctgaccaacatggagaaaccccgactctactaaaaatacaaaattagccaggcgtggtggctaacgcctataattccagttactcggaaggctgaggcaggagaatcacttgaacccgagaggcagaggttgcagtgagccgagatcacaccattgcactccagcctgggcaacaagagtgaaactccatctcaaaaaacaaaaaaaaaaaaacaaaaaacaaaagaaaacaaaacaaaagcagcagcactgtctgctctgagctacaatcctatgcacgatttccacccgtgggaaccacacgggcccgagctacccagccggctcctttctcacctggtcacatacatctggacaggacaagaactctcagagggctttctctttctccttggtcttcctaaactttgccctaattaatcgatatcactgcctctctcagaggtgactgtggctgtgatgacggacacggaggagacgaacaggagcagaacagtttcactgccacgtccatttccgtgacagcacctgtgattgatgttgcgtggacgtgccacacttgcacttggcaggctttcgaggctgctggccttgctgccatgaggactgtgtccaaaaccactcttggaaggaaccataaacggctcccaaacatgagaaagtatgctcagtctcacgcaagccagagaaacagaagtgaaaaccacttggatgcagcccttcccacctaccagcggcaaagttcaaaggttcgctgatacctgaggctgggagacctgggacagaggtaccatgtctatggcactagggggacgccatcttggcaaagattattgcagggaatgtggcagtatctatcaaaataaacaataagcatccgcgatgactcaggatctggcttctaaaaactcacatttcacatggtccgtgtagtctggagtggcaaaagtttgaaattgcctacattgcccttactaggagacagtaaatttctgtgcgtccaataacaggagaacatatggctgttaggagggtggggccgggctgtacacactcatgcagggccctctcctgagagcggcgtcatgtgaggagctgctgtttacgcaccacatgaccacagcagcaccggctggccctggggagggggctgggccccagagtcccggtgtgggtgggcacccctgccgtggttaccttccccacaatgatgccgagtggctgtaatgtcttcatgaagcacgtcccagaccaaaccagcccgggacttgcttgctgggacacagtcccaccccttggtacaatatgacaaagaaaaccacgagtttagagcttaggtcactgtaaagctgcttttgaaaaaggtgcaagacgtaagggctaaaatctttcagtttagagattagcagatgaagggcctcctttcagggaagagagtggagcctgtaccccaaaaccccaaagtagcagaaccagggatcctgctgatcactgactgaatgccaactgtttgccaggcacacagtaggcgctgcctccgcatggccttgtgatgtggtttggatctgtgtcctggccagtctcatgttgaaatgtagccccagggctggaggtggggcctggtgggaagtggctgggtcacagggtggtttctcatgggtggtttagaccatccccttggcgctgtcctcaggatagtgagcaggctttcctgagatggtgttgttaaaagtgtgcggcactccccatctgttctctccctcctgcacctgccatgtgacgtcttggctcccctttgccttccgccatgactggatacttcctgaggcctccccaggagcagaggccaccatgcttcctgtacagcctacagaaccctgagccaattcaacctcttttctttatgaattacccagcctcaggtatttctgtatagcagtgtgacaacagcctaacacacctgtctaatgaacccgggtctaattaacagcccatgtcctcccacccaggggaggcccttgcacaggggaggctgggtcccactggtaccgggccctgtgagagtctcaggtacagaacagagtcccaggagcgtcaagcaggagctgtggcttgggtggctgcatggacacgggaggctctagaacgtcccctcaagcaagttagggtgtgaggacggatacttgggtctgcaccgggcccaaaggccatggcagccactgggaggtcagacccatccagcgtgcaccgaactcagtgggtcggacccattcactgtgcaccgaactcggtgggtcagacccatccagtgtgcactgaactcggtgggtcagacccatccagggtgcactgaactcggtgggttggacccattcactgtgcactgaactcggtgggtcggacccattcactgtgcactgaactcggtgggtcggacccatccagcgtgcactgaactcggtgggtcggacccattcactgtgcactgaactcggtgggtcagacccatccagcatgcactgaacttggtgggtcggacccattcactgtgcactgaactcggtgggtcagacccatccagcatgcactgaacttggtgggtcggacccattcactgtgcactgaactcggtgggtcagacccatccagcgtgcactgaactcggtgggtcagacccatgcagcgtgcactgaactcggtgggtcagacccatccagtgtgcactgaactcggtgggtcggacccattcgctgtgcactgaactcggtgggtcggacccatccagcgtgcactgaactcggtgggtcggacccattcgctgtgcactgaactcggtgggtcggacccatccagcgtgcactgaactcggtgggttggacccattcactgtgcactgaactcggtgggtcggacccatccagcgtgcactgaactcggtgggtcggacccatccagcatgcactgaactcggtgggttggacccatccagcgtgcactgaactcggtgggtcggacccattcactgtgcactgaactcggtgggtcagacccatccagtgtgcactgaactcggtgggtcggacccattcactgtgcactgaactcggtgggtcggacccattcactgtgcactgaactcagtgggtcggacccatccagcgtgcactgaactcggtgggtcggacccattcactgtgcactgaactcggtgggtcagacccatccagcatgcactgaacttggtgggtcggacccattcactgtgcactgaactcggtgggtcagacccatccagcatgcactgaacttggtgggtcggacccattcactgtgcactgaactcggtgggtcagacccatccagcgtgcactgaactcggtgggtcagacccatgcagcgtgcactgaactcggtgggtcagacccatccagtgtgcactgaactcggtgggtcggacccattcgctgtgcactgaactcggtgggtcagacccatccagcgtgcactgaactcggtgggtcggacccattcgctgtgcactgaactcggtgggtcggacccatccagcgtgcactgaactcggtgggttggacccattcactgtgcactgaactcggtgggtcggacccatccagcgtgcactgaactcggtgggtcggacccatccagcatgcactgaactcggtgggttggacccatccagcgtgcactgaactcggtgggtcggacccattcactgtgcactgaactcggtgggtcagacccatccagtgtgcactgaactcggtgggtcggacccattcactgtgcactgaactcggtgggtcggacccattcactgtgcactgaactcggtgggtcggacccatccagcgtgcactgaactcggtgggtcggacccatccagcgtgcactgaactcggtgggtcagaccctttcactgtgcactgaactcggtgggtcagacccatccagcatgcactgaactcggtgggtcggacccatccagcgtgcactgaactcggtgggttggacccatccagcatgcactgaactcggtgggtcagaccctttcactgtgcactgaactcggtgggtcagacccattcactgtgcactgaactcggtgggtcggacccatccagtgtgcactgaactcggtgggtcggacccattcactgtgcactgaactcggtgggtcagacccatccagcgtgcactgaactcggtgggtcggacccatccagcgtgcactgaactcggtgggtcggacccatccagcgtgcactgaactcggtgggttggaccctttcactgtgcactgaacttggtgggtcagacccatccagtgtgcactgaactcggtgggtcggacccatccactgtgcactgaactcggtgggtcggatccattcactgtgcactgaactcggtgggttggacccatccagcgtgcactgaactcggtgggtcagacccattcactgtgcactgaactcggtgggtcggacccattcactgtgcactgaactcggtgggtcggacccatccagcgtgcactgaactcggtgggtcggacccattcgctgtgcactgaactcggtgggtcagacccatccagcgtgcactgaactcggtgggttggacccattcactgtgcactgaactcggtgggtcggacccatccagcgtgcactgaacttggtgggtcggacccattcactgtgcactgaactcagtgggtcagacccatccagcgtgcactgaactcggtgggtcggacccatccagcgtgcactgaactcggtgggtcagaccctttcactgtgcactgaactcggtgggtcagacccatctagcgtgcactgaactcggtgggtcggacccatccactgtgcactgaactcggtgggtcggacccattcactgtgcactgaactcggtgggtcggacccatccagcgtgcactgaactcggtgggtcggacccattcactgtgcactgaactcggtgggtccgatccattcactgtgcactgaactcggtgggtcggacccatccagcgtgcactgaactcggtgggtcggacccattcactgtgcactgaactcggtgggtcggacccattcactgtgcactgaactcggtgggtcagacccatccagtgtgcactgaacttggtgggtcggacccatccagcgtgcactgaactcggtgggtcggacccattcactgtgcactgaactcggtgggttggacccacccagggtgcactgaactcggtgggtcggacccatccagcgtgcactgaactcggtgggtcggacccatccagtgtgcactgaactcggtgggttggacccatccagcgtgcactgaactcggtgggtcggacccattcactgtgcactgaactcggtggacgcgtaaatggctctcaaaggagctccccaggcccgcaggagtgaggctgggaagtctcggggtctccagagccggctactatggcacctggacgctcctcctctcctggctctgcctcttgccccagctttccccttccctgctggtttaatgccgtctctggtcatggggctccgtgcctggtcctgtgtggcgtgaaggcttcccaaacctgcccgccggagagagacatcccccgcaggggctccccatcagggcagggcacacccccacccgccgtgctgggaaggggggactatgtacccctccatgtgcaggccttgcctatgccacgcagtcctcaatggtgagaaacagctttcctgcaaaaataggctcctccaaatgtgcgccacaaagccggcatcgtccagacagcagcaacggcctgccgtgtctgtgaacgcaggccccacaaagctggagagttcgccctgcggcctggtttactcatcaggcctccgcgccagcacccgagccagagcgagaacggccagcccagccgcgtggccccagagtgaaattctcggtggcccagtgcccctcatcctgggagagcagccatctgtgcccgtcaaccacgtgggaacgatggaatggaatcttccagaaatacagggcactgggtctgaaggtggagggactggggccaggggagcgcctgccaaggccccggcactggtggcgtggggtgcaggggaccccagcccctttctgctgcagctggtgacttgcagccttgggcagggacatctggcatggtttcgcgaggccctcctggttcggtgacttatcgctaagaactaagaagcctggagcctgacaagatcaaacaatgagagacagagatctctcaaggtgcacaggcagagacacgacgggcccagggaagactccaggcaggcaggagggccgaagttcagaggccgtgagccgtgtgggtctgaggaggtcacagcttgtgccggcatctgttggtcgccagcacagacacgcatcacgcgtctcacgctgggagttcagaaaccccacaggcaaatctgcggaaggtgcggcgcgactccacaggctggcagcaccccctccctcctcagcaaaattcatgaactttcctgttttctgtgatcatgggaaatctttggtcacttcctgcaatgcctaacttttcgtttttcacgtctctgtcactgcgcttggttttaatgtcgtcatctgtgaaatgggcctactcacagctcctgtgccctcagtgcctcaggactctccaaggatgagcgaactcaaagatcactgtccatatcctcatcttcaacactcaagaggatggattctgaaaagcacttactcagcacggctttcccaagttaagttctatattatttaagtcgaatggagaagtatgaagccaacttttttcttaacatccccactctccaaaaaacgttctctagcctttaaaggtggacgcggtggctcccggccgactcaggcgtaattagtcacatcgggacggtgacactcttctccacctcctcactcagagccagccaggcagaaatgtcacccttctgaaagcaaagtgatagggaaacagatcttgaaaaaactcgatgattctttatcttacaaaaggatgtgacaggatttcttgagaagccacgtccccgcagatgattaacacgcagccgctttgataaccgtcctgcgaagtcgccttcatcacgtccttgcttttcagagtcccgagccttgctctgagtgagcatctccgtgttgcctttcggccgtttccagagaaatgtaccggtttcttgatggaagtgtttccttcctgcctctccctcctctgagtgctccattcacccgcaggtgagcctcgactcagcttcttccagacagtccaaggcaggggcacggactgcaccttccctgcgcctgggaggcccattttccaggaacaagtgacattctgggctgggttttccctgcaaataaagccctttctccttagttcatcccagaagaaaactggaatttttaaaggacctttctaagaaaatgaaggcaaagcaacacaaaaaccagaatcaaagcccagagacagggatcaggcagagtgtagagaatgcaggcccagaggcccaaaccctaccaagcaaaggccccgccgggctctgttccttcagcacaaccccttcctctccagcccgacgcaccttcggcacaggtgaggtctcaggatgggcggcatctcagatgctcacccggttttaccctcacaggaaccccaggggaaaggcactgccatcaagcccgtctcacaggggagaagaaggttggaggtctgtcctgggacacagcacctgcaacagcaaagcgtctcagctctgacaccttgctgatggagcccagaatctgtgctccacatctagacctgaccacctgctgtcatggcagagcgggggacccagcggctgccccaatgacctgcccacccctgccccttcccatcaggctttcatgtggccccttccccgggggtccctgagacgtgtgctctccctcttgttccacctgctgggacaccttgaccaggtaactaagtccctccctgcagtcctgagacaccagcctcttcctggtgacacccagtggctgcacagccccatggatccccccatcggggcaggcacctgccgcctcctgtctcccagggaagcctccttctctcacaccctggcctgtctcctttataagagtgttgtatgctcccctctctagatggagtgctcatttctagagttctgttactccgggtctccagcacggaatcccagcctctgtgcagaaagcagcagcgtgagctccagtgggtagagtgccccagggcgggagggggctctcggggccaggaggcccttcctgtggggccacagccaggccagccccgcctgaaggtctgggctccggggcagtgtgcagcctccaccctgccacatgtgtcctttgtcacagaaagtctccgctcttggtgctgagcctgccccccagacggtgcagccggcctctcccacctgctggggctcctcacatctagcttggcctccagacatcaccaacctctgctgtttatttcatcggatcgtggggttcagatgccacgttttgtccaacgtgccccaggagtggctgcatgtcaggaacatgtcgctgggaatctctgtggcttatctgaccatcctgccatcctcaggtgaggggcactgaggtggccggttgggtgtctggcggaaacgaggctttgcgcacagagggctgggctgctggatcaccacggaattggctgccttgtagctgtgatgagtcggaaggtcggcgactctgatgcgttcctgcggcaccaacctgcatgtgctttctacagcctgtgtgtgccagggagggtggcggtcagtgccccgagattggctgtagcttccgagcctaaaaggctacctgtgtgagtcctgggaagaggtctacctggagctcacctgtggcgtgagtctgtgcctctctgctcctgtaccagggacatgcccaccaggagaccccgcatggctgagagggcacgggaatgcacttgtaaagtgagctcagaggaaggaaaatcagaactgctgagtgagaggagacgccagggtccaaggcccacgtctggcccacttggttgctggactccacacgatgcccgctgctccccacacccaccccaactgcacacgacgcccgccactccccacacccaccccgactccacacgatgcccgctgatccccacacccaccccaactccacatgacgcccgtctctccccacacccaccccaactgcacacgatgcccgctgctccccacacccaccccgactccacaccatgcccgccgctccccacacccaccccgactccacacgacgcccgcctctccccacacccaccccaactccacacgatgcccgccgctccccacacccaccccgactccacaccatgcccgccgctccccacacccaccccaactccacactgcccgccactccccacacccaccccgactccgcacgatgcccacctctccccacacccaccccaactccacacgacgcctgccgcttcccactcccaccccgactccgcacgatgcccaccactccccacacccaccccaattccacaccatgcccgccgctccccacaccctccccaactccacactgtgcccgccgctccccacacccaccctgactcccaccagcacctgctggcatcgtggagtcagggaaatatctcagtaacattcattttcaaaacagcattggttgatgaggaagatccagtttccctgagtttacaatctgtacgcacagagtctaagtcagccggactcatacttggcctgagtgtgtttctcgtttcggccctgcagttgtgggcggtggtgagacgcgttccgaaacaggaccccgtcacggtgtgtggccctcgatgaccccccaacagggtgtctggagtcaggctttgcagggtttccgccaggtggaggctgagtctgtccttgcggtttaggcattccagcagaagtggtgcttgctgtcagagctgccattacatatgtgaatgccaaacacaattctctgagaaatacagtatttccaggtaccaatagagcttgagatatcatcaaattgttactcaagcaccttgaaatgtggaaatatcagaacacaatgagagctcgctaagcggctctcctcttggctgacctgtcagatgaatgtctttggctgatgggtttggccctaataccaaatctcatcacaaatatgaactcctggtctctgctccttttctaaaagggacaaatgtcaaaacagcctcagaaaagtcagatctaaagtaacaaaaccacagtccatcaagggaggaggttctgccaaagtcgatgacaggtctgccgagtgaactccacgagctgtctgctcccgggt[450 bp omitted]tggtacggcgaagaatgtttccctgacccgtaagtgcagccgctgcttcggccaagcagcgtaacaggctctgccctttcaccccagaggctccgtctccagtgcgggaaacagcacagccaggcacggtcacccaccaggacgacgcctacggcctggagatccaggaggcagccagcaggacgtgctgcgctattgacagctgtcctaataacacccggacattcattatgtatggagtggcaatgcacggccacacacgcgtgatcactccagcgaggaccctggaaaaggccgctgaagccgcgtcgccgtgagcctctggccggcgccaccaggaaggctcctgtgaagagccgagcacccagcccacacctcctcctgccttgctgtcacagcagtgacatttatttacccaaatgacgcttgctggccttgagtgccaaggagacagcagctgcttccgagtcagaggcccaaaacggcagcgcacatggtaggcactaacagacgtgtattccactgaaaactaaatagcgggtgctcactcttacacaccagggactgtgtgtgggggctgcacgttccaggcagaagcacggcaaagatctcaggaagtaaatattcttgtttatctaaattaagaagactccctgcagaaagagccctgcctgtcagcctctgcagcgggcagggtgcagccatcatcgcccagtccccgagggtcagcgggcgcagatgctgggtgttgcaggggccgaggaaggagggccctggtgtttgtgtggcagggagtgcaaagactgggcttaccaggatcatgtggccggtggagatgtccatgttggactgcacaggctcctcggaccaggatgaggcgctgctgcgtgcggaggggctggggatcggcccgtcgctgaactgggatgagacgctgctgatgcgtgacgtgtgcgggccctcaggtcggtctggtggccgcgtggccatacgctggcggcacagctcctgcaggacagggggaggaagagcagggggttagtggcattggggacacccagcaggacgagggccacggcacccacgtggcacaaccccttctcctgctaagatccaaggttcaggcaggcgagagtttaccccagggcaggccagcgcaacatgacggtcaacgcaccccaaagcacgcgcccagcacggtgacccgagaagacttcaggcttgtgcaggaaaagagaggccttgctctcagaatctgagaatacaaacacacatacacacacacatatacacacacacaccacacacacacacacatcacacatatatacacacatacaccacacacaccacacacatcacacatatacacacacacacgccacacacacacaccacacacatcacacatatacacacacatacaccacacacaccacacacatcacacatatacacacacatacgccacacacacaccacacacatcacacatatacacacacatacaccacacacaccacacacgtcacacatatacacacacatacgccacacacacacaccacacacatcacacatatacacacacatacgccacacacacacaccacacacatcacatatacacacacatatgccacacacacaccacacacatcacacatatacacacacatacgccacacacacacaccacacacatcacacatatacacacacatacaccacacacacaccacacacatcacacatatacacacacacaccacacacatcacacatatacacacacatacaccacacacaccacacacatcacacatatacacacacaaacgccacacacacaccacacacatcacacatatacacacacatacgccacacacacacaccacacacatcacacatatacacacacatacaccacacacaccacacacatcacatatacacacacatacaccacacaaaccacacacatcacacatatacacacacaccacacacacaccacacacatcacacatatacacacacatacaccacacacacaccacacacatcacacatatacacacacacaccacacacatcacacatatacacacacatacaccccacacacacaccacacacatcacacatatacacacacatacaccccacacacacaccacacacatcacacatatacacacacatacaccacacacaccacacacatcacacatatacacacacaaacgccacacacaccacacacatcacacatatacacacacatacaccacacacaccacacacatcacacatatacacacacaccacacacacacaccacacacatcacagacacacacacaccacacacatcgcagacacaccacacacacacaccacacacatatgtaacagacacacacacaccacacacacgtcacagacacacacaccacacacacatacacacatcacagacacacacacactgcacacgccacaaacactcactcctatagattcaagaaagcatccactggatcctcctctgtcatcaacgtggaatattctgggataacgccacagtagccttcgttgggtggcttctcattctatcagaatataagccacaggggaggccgggggcggtttgcactgtggactgagatacagaaactggtaccacaatcaaagagtctgcagaaaaaagaagaacctcattctgacgtttctttctctttccaaagcaatgtccaagagcccatgcaagagaaggcaaatggagccgtgcgggagacagaaggcacaggggagggagaaaggcctgtgctgctgagtagacaccaaagcagaagttcccgtatttaaaggaaactctcaacattacaccccaagacagcttctgagggatcactgcagggtcttcgaccctccttccccaggcaaagctcaaccacacacgcggtgggcatcccgagcacctgcccggccgtatgggacccgcctgcaggcaggacacggccacgcagcctcaggtgctcagaacacgccgggaccccgctgctgccgctcaccttcagggtgcagcctgggtgcccccctgacgtctgaccaacaatctcgttttgaaagtgttctaaccactgtgttaggatagcccgtcctattgcctgatgaaaatatacctgtaccctgagtctgcaaagtgaaatgatacccagaaaaagtttataagagaactggagctcaacagaagaggtgaaaatgcattcgtgagaaaaagaaaggctccggggaacctcgtgggctgctgctgccttggtttcattttggtggtgtccgggggaggccaagccacccactcgctccccacagccgtgtgcgtcaaaggccttgcactccccaaggcaatcgccaaagctcaggaaacactccatgtgtcccttctcccttcaccccggggtgccggcttccttgtgtccattctcccttcaccccgggctgccggcttccttggctttaaagatgtctgccaagcccaccggcaccacaccatctagaaaacatttccctccacctggctctctgggatgagcaattcatgctcccgggctctctgcttcggactcatagcgagatacaggtgctgtgggaaggggccctgcggcccccactctccaggagcctgcagcccctgtgagagcagctggggacaaggaggatgaccgcggggactgggaggatgactgcggggacggggggggatgaccccggggactggggggggacgactgcggggatggggggggacgactgtggggaagggggggacggccgcggggatgggggggatggctggggggactgggcgggaggtggatagccgcagggacaggggtgggaggatggtcacagggatggggggggcgggggggatgactatggggaccgggcagagacgcacaggggaaggtggactttaccaagggcctctggtgagggtaaggggtctctaagaaaagggagagttccagttccttctttcccatacatcttcaggtacttgttagtttatagacagttttaaaatagtgagtgtgtttaaaaaaatccacccacgttttctcagaatctcaaaaacaaagcaaaataaacaaacaaaaaaaaccccacaaaggataattctttattttttatttttatttttatttttgatatggagcctcactctgtctcccaggctggagtggagaggcacgatctcggctcactgcagcctccacctcctgggttcaaacgattctcctgcctcactcccctgattagctgggattacaggcgcctgccaccacgcccggctaatttttctatttttagtagagacagggtttcaccatattggccaggctggtctcgaactcctgacctgaggtgatccacccaatgagggatgattttaataaggtagatgataccagtaaccaacctgagtatacatctcatttatttctcaattgtgcacatgaattttgcttgacgtgggggaaaagcacactgagaaatgtttctgaagtaacttctatctcttcacacaatttctccagaaaaataacgtccaaccaaagcatgagaacagctacagctcagggaacccagagggtccgagaatgtgaccctctggggaagaggatttgaaacgctggagatttactcacataaaaataaaaaatcaagctagttccatgcccatcctgtgatttgccacccatgggagagctacagtgaggtctgagctctgttatttcctgagtgccatggagggtgaagccaccaagaggccccacaggactgaggtccctgctgcaccacaaacttccgtttttattgtatttatttttctcccaaagtcaccaatagcaaacaaccacaaacttttcatgtgaacttgggaaaacctctaaaggtctctaagcctattttttcactttataaatggagataatcctatagttactgtgaagattaaaatagatggtttcctgtatattcagtgcttagcatggaggcagctacagagaaagcctcaagcattcatgagtaagagagacgtattagtgaatagaagttagggccgttctctaagccagagccaaactcttgacggcttggcaaatgtaaagatatttctgaagaagttacagaatttattattactattattatgagacagagtctcgctctgtcgcccaggctggagtgcagtggtgtaatctcagctcactgcagcctccgcctcccgggttcaagcgattctgctgcctcagcctcccgagtagctggaattataggcgtgcaccaccacacccagctaatttttgtatttttagtagagacgggcttcaccacgttggccaggctgatcttgaactcctgaccttaggtgatccacccgccttggcctcgcaaagtgttgggattacaggcgtgagccactgcaccgggccaaagtcgcagaatttagagctggacaagccgacatcgcctcctccggcgggtggctcagtgcccagtggctcagtgctggtgcacggtgagggagacccagggttcggtgcctctcagcggggacccgcggctctcaccagtggtctcgcgtcactgcgcagcgcagggtcttcttgaaggtcttaactttttcaaaggagggaaactgcgataaagatccaagaaaaatgtccctggcagagaggaagcccccgaaagcttggcgcagaatgctggagacccgtggcggcagctcttcgcctgtgcagagggagacgctgccgtgggagaagggtgtgcccacagcaaggcaacgcgcggccggggacgctgctcttgcccgaaggcgctctccctgcgggcttccgcctgggaacgggggcgggtgctctagcccggcgctgctccgctctgaacccaccgctaccaagtttctattcagcaagtggctcaggcaaacatctgagcagcgataaggccgggaatggcctgcagggaggaatgggatgatggggaagccgggtcctgggtggaggaggttggcagtgataaggccaggaatggcctgcagggaggaacgggatggtggggaagccgggtcctgggtggaggaggtgtctggggctgaagccccccatgctgcccctgagcctgggggcaggtgagagacgcgtcctacttccctggacactacgatgggcaggacgtggctccccggaggcaccagccatgtttccctcacatcaccagcgcaggcttttctgaaggctctgggggaacctgccacttaggagagtctctgcacctccacaaagctgccctgagacagaggcaacggggccaccatggacgcctcctagaaaccaggacccagaaaacaggtatgtcttcagaggagcaggatgagaactgcaaaaacagacctaactttggttcttttccttgacgtccagggcagtcattgactcattcactcatagcacctgcagtcagagggcctgattttgaatctgggcttcaggtcttactgactgtgtggccttgggaaaacactaatctctgtgtgcctcagtttccccatctgtgaagtggtgataatggtaccgacttcaccgctgggaggattaaataagataacatgcttagagtgaggctttgggcctgtgcctgacacacaccaggtgattatttgctgttcctactacgatgattattagtttattcaaaatcaggtttgctatggtcccttgccgagtcagcactgcacagggtgccaggaacaccaggctgagccaggctgggtcagactcgccgggccctgacccccgagcactcccacgccacccagagctgggcacgagtgaccgcaagaagcgatgggaatgacagcaacagcacgtgttgggcgttcgtgggaaggggtgccgtggggccgggaggaggggaccctccctgaacttgaggtcaaagaaagctttaggcaggagaggctcaggccccaaggctaggccgcaatggcacctgcagagatggggaggtgtgagcaggcatggggcctggaggtgcgtaagagcttccacggggcgaggaaggaggaggaggagagagaaggggccgccactccctacagcctcctgggtgggcagtgctgcgggcacagcgctctgcatccatgccgcgactgctttcggaatgtgcttttccagggcgagccttctttttggacatgggatgtacccgatgtctacaagcttgaagtaacattgccgaccgtgtgcttcttgtgcatgcagggtctgaagggaaggccttgcatccaccgcccacctaacctcacggctcagccacgttcacgcagcacggttcagtcagaagttcacacctcattcaacccagctgttgctaagtcagtgtggctgtcatgggaccaactgaagagtgtcctgcctcacgccgtatctcaggacatccacaaagcattgcttttgccacattctgcttggccgcgaagccactttctgcagcccgagctccacccccggccataacccaggctgggaagaagttccccgggcatcggcgactccctgcaggtacggcaggggtggcaaggggcgaacagcgcaccaggcccgcgaggaggtcactgagcaagggctgtgcgcgtggaaaccgtgatgacatcacactgacaagttaaaccctggagtcccagcggcactggctgtcggccgtcctgcacgtgcccctgggaagacgtggctgcaggcccaactcctggtgtctcccttggcgataaacacaagaaagccacatctatctactggagacagaaacagaaattcctcacaagtgagctggaaatgcgccagtctgctgcgctcacggggaacggggtcgggccagctccctccaaggacgggggctgggacgtttggccgctgcctctcccactcactgtggcctgcccctgccagcgtcccttccccttgctgtgtggcccctttctgggccacctgccagagctcctcacagtggggaccggcccctccctctccacccttccctggacactcttgggaatctccagacgtgggggaagccaggaaggagcctggattctgcctcatggcttgctggagaaagcactgaggggcatctcatgtggtctcattcactggtcctttaggctgattatagtttccaaattcataatggaaattctatagtctgtccattctcagtcctttaccttaacatttaaaaattttgtaaggaaaaacacacttcttactagaatggaataagaaatgtagaacgctacttgacttagtaatggtttagccagtgccaacgagacaaacctcacagcatttgaaatcgctctaggttataatttgggacatttccaccctgcatgaggtgactctaaccctctaagcaaggctgccagtgtgggctcactggagatgccactgggagctgtttttcccctcccaagactagaaagtgactggctacagcgggggagggggccacactcctcactcttcattgaaaagtagcatccacacctgaaaaggcagtcgcatccacggtgctgaacggaggcgtgagcttgctgaccgctgaggcgatgactgaatggacagcgtggcacacatacttctttaaaacctcagttgaaggttacagcatcagctgccatcacaccagaactgccatcagacgagagcagccgctgcccgtatcacctgcgttcattatcagacttctgtgggggcccagggcacagagcgggggctcctgtcagccagtgacagaaatggccatcgccactacgaatactctaagtaccattctgtgtggtgagtttaaaatacagaacggtagtcgggcgtggtggctcacgcctgtaatcccagcactttgggaagtaggtgggaggatcccttgagcccaggagtttgagaccagcctgggcaacatagtgagaccccatctccaaaaaaataattagctaggtgtggtggcgtgcacctgtactcccagctacttgagaggccgaggtgggaggatcacttgagcccaggaggatgaggctgcagtgagctatgattgcaccaatgcactccaaccctggtgacagagcaagaccctgtccgcctacacccgccaaaaatacagagctatgatctcgagagcattttatttgagcaaaagataatttataaagcaaaatcaacaacatgagcctcctctgagagaaagctggaggccagccccatcatgttttgaaatttccctgatttataatcctcggtaaacacaaagggtgcatcctcacccggaacaaaactctcctggtcagacggtgaacaccccagagtgaggcctgtgggccacacgagcctgctgaaggggttaaccggcagtggtgccaagcaggaagccccgagacctgcccctccacagcgcctgcttgcaggggcccaagggcctcccctgcacagcctggcctgggggcactgacacatttttggcaaacagatcttggccggacagaaggtccaatccttccagccacttcacttaaaggaaaatcttctatttaagatccagactcagcctaacaatcacgaagatggctctgtttatgatccgcgactatgcaccttcagccacagcggcccagtgtgtgcagcttggcgaccttgagtttgtaaggatgagtaagaccttgtggcatttgcgtgactcaataaccaacaggtaattaaatatgaatgaagaagaaaggtagatgtaaccacataactcttttgattgtagatttagctgcgatgtcggcggcacttgcgaattccctccccactctgaggagctggacggaggctccatcccactgagggctgggcatgggcctgcctggccctgaaggcacccacggggccactcccaccagggtgtggatgaaacctgttttcttttctcttcccaattcatactctttagcagcgaagaaaaaacaatatatatgtgaactaagaaaaggactataaatcatgctaccataaggacacatgcacacatatgtttattgtggcactattcacaatagtaaagacttggaaccaacccaaatgtccatcaatgatagactggattaagaaaatgtggcacatatacaccatggaatactatgcagccataaaaaaggatgagttcatgttctttgcagggacatggatgaagctggaaaccatcattctcagcaaaatatcacaaagacagaaaatcaaacaccacatgttctcactcatcggtgggaagtgaacaatgagaacacttggacacaaggcggggaccatcacacaccacagcctgtcaggggctgggggccagggggaggggtagcattaggagaaatacctaatgtaaatgacgagttggtgggtgcagcaatccaacatggcacatgtatacatatgtaacaaacctgcacgttgtgcacatgtaccctagaacttaaagtataattaaaaaaaaaaaaagaaaaaaaattccaggtacaaaggggaagtcatttatttttgtgccatgctgccttgcatttttggaatgcctgtccctggagatggagctcacatctttccggaaagctctgaaggtccctgcgtctcagtatagctgctctgtagctttttagctgtctggcccctcttaggtgttgagaaagttattaagaaaattattaaggatagcatgtcaaattcccagtgagaaggacgcatttgcaataatggaaaaagggcacggttttgcaggtcatctccatagtaaaatatcaatgattataatgtgcctctattcttgagaagaaagtattccagagccattagtgtgttagaaaaaaaaaaaaccccacagtagaaaatgaaatccattattggcaaaaaaagcaagccaagacagagctgagatctgcacggtgtggccgtgtaaggcagaggctgaggaccaggactctgggtccagatcacccggggctgtgtgccactggacaggctgccaaaagctgcgtgtgtgtttttaatctgtgaaatggggatgaaggcagagcagctccacagagttgttgggaggactctgagggtggatgtgtgtggagcacagagtacaaggcctggcttgcagactcggcccgtgtgacactgatctcaggtgggtgcaacaagtacacagcctgacttgcacacttggcccatgcggcactgatctcaggtgggtgtgatgagtacgagccctggcttgcacactcagcctgtgggacactgatctctggtgggtgcaatgagtacacagcctggcttgcacgctcagcctgtgggacactgatctctggtgtgtgcaatgagtacacagcctgacttgcacactcggcccgtgggacactgatctcaggtgggtgcaacgagtacacagcctggcttgcacgctcagcctgtgggacactgatctctggtgggtgcaatgagtacacagcctggcttgcacgctcagcctgtgggacactgatctctggtgtgtgcaatgagtacacagcctggcttgcacgctcagcctgtgggacactgatctctggtgtgtgcaatgagtacacagcctggcttgcacactcggcccgtgggacactgatctcaggtgggtgcaacgagtacacagcctggcttgcacactcggcccgtgggacactgatctcaggtgggtgcaacgagtacacagcctgacttgcacactcggcccgtgggacactgatcttacacgggtgtgggcatccccctgccagtgcccgcatctacatttgggcacagagaagccacacagcctcacgggagctgggggcctctggcagggcctccttccaggacacaataccaaggaggccagacccccagggctgtccgcactggatgaccctctggccactctgtcctgctgatgagaccctctccctgcctcctccctctcagtaaaactagagtaactaggcatttttaaagaagatggtggcgtcttccactgttgccctaaatggaaatgctccaccgcaaaactcaatgtgatgctagtgcctcacgacctaacaccctccccacggggcagcgtttgtcaggaacggtaaacccagcgcgtccgcacccaggcgcagaaactctccatcagggaaatgtgaaaaattgatctttttgcagctcggtgctgcctccaacacatccagagccaactggaactgtgagtgtgagcccagtggcactgcaagcgcccacaccagcaccctgccctgggcagagtcacgtgggaccatccccgcaggacagtgctgcacccagagcccccaccctgaaagcttcccgtgctctgagcagctcctcaggtgtgagcacacaaacagaggaggccatggtcagcacggcacattcggacaccacagtcctcgctcgccgtagagccgcctgctcctctgctgtgcccaggccggggccctgggcgtgtccgcagagtcctcaaagtatcttatacttctctataacacaatgtgcaaaataagctgaagaggattctgggggcagaaattcatccatacacatcacaaggcaaatgtctcatctcttaactcagcatctgatggagaaaattacagagtggaaatcactcagagaagagacctgtcattcttgaattctgccaaaagaagaccaggacaacaaaggtttcaggaaaacctctctgcacgcttccgggagccaactgaatgaagccgtgttgcccgagtgtgcgcacagagagccttgggtttttagggttatttcgagagtgtaatcactagtaacaggacaacactaaggaattaaacgtacaaagctgggcaggaaaaagtgggttcactgggctctgctggggaggaataaaggccactctccagactggacgtggcaccaagagaacgtggtgaacgggaaccggctctgtttggggagggccctggccttcagctcagagggcaacacacagcagaagccgcggggcccggtgcaaccacaggtggctcgaatgtaaaacggttaaggaaaaagcctgcgctctgtcagtttgacactgaggctgcagggcacgtgacgacaggaaatctaaacaggaaggtgaaatgttgagaaagcgtgtgcagggaaaaggccggggaaaaatattccaggttgttaaacggggtcatgtgtcatagtggggaaaaaaagaaaaaaaggtttcttgtataatcacctctccccgatcatgacacagttttacttgattttatttcatcataaaactcagagggactcagaaggaaccgcctcacatgctaggccagcaaggccagctgggagcagaggagcagtaaccaatgatttcgttgaggagagcgactttacacaaacactccaccatgctaggtctctgatcggcaccgctacaaggtgctccggggtctgggtgcatctggggcagccctgtgagacctcagggaacacagggccacgctcacttctggagagcaaatggcccacggccgcccctgaatgccaggggagcctcccttcttctgccacggagtcagggccccggcagccgagcctgtccgtgatctaagccggggacgtcctcggctcatggcccacgtggccaacgctgctctggtgacacagtcccaccgcctccagtggcttctccttggtgtccaggtaacttttacacttggaccaagaacaacccacacacgtgtttgcacgcgcacacacacacacacccaggggaggatgcccctgacagcagcgcccaagccagggccacagagctctgcaggcccctccccgctcctgacacacgacgacacccagtcaggggctgtaagcacagctcctgcaggaaggggttccacgcacgggcaaacaagccgagtcagcccacgatgagcgatgttggccaagcaatatggagtgagttcttcccatttcgcaagatgttttctcaaaacaaaaattaaagatatagacatgtttcatgtaagtgaaaaataattttcaacactcttctaaatgtggaacagtcttggaacagcctaagatcagtaggaaaaaagcggcctctccgctcgctcagcccccatccctgcggcgcccagagcaccagccctttctcgagtccccacacaacctcgaggccgggctccgggcatccaggcgtgtgctgtttcctagttattttcacgtccatacccctgcctcccacactcaagagcagaagtccttctgtctgctttctgtacccacagcatctacgtggtgcagaggggccctcgctgagcccctgcacactggtcagcatccctggcctccagatcacggctcgctcagggaccgagtgtcccacaccaaggcagccctgggggagcagcaaggggcacggctggagcagctgcatcgagcccccgccggccgacagctgcggcttcctgctctggggaggtgagggctgtgtttgaatctcctgaagcccctggtgggtggctgggaaacgcaggtgctccacgtgaagcacagaaggcacgtacgggctcacgggacccgcggtcagctgcatccgagagtgaccgacgtgctgaaacccgacctcctgcctccctttttcttagggactgcctctcccctaagactaaagacattcattttcttcatttgctctgctcctgataacatcagattgaaaccaggaaacagttgtgaaaataaagacattggaaggaaacacagaattttaatgagcatcttctctctggaacagcccatgtctaagaccggcttctgtgatggtctttaatgcttccataaaggtggcatcttagatgtgagagggagcacctttaacccacgatgcctgcaacccttcccgttgtcatgggagaccccagtcacaccgcagcaaagcccctccagccagactgccgttggtgagacaaatccctcccttcccggctcccacggaggatgactcaccgggcaattaagttctaagggcttccaaaaaagtcagtggtgccttcaaagttcacagatccaacacgacctctgtgagcaaagccagccttgagaggccccacaggctgaaccttgcttttcagtttcatagtcagacaatttaaaatagccagtcagtaagaaacaagtcatccgccttcagagcagcccaggcctgacgtggaagtagagaacgggcagctgttttttttacaagaaacttttgcaccttcctaattttctttttgctcagaataagggctgattttcatgtgccatccctgtcatcacccgcatcttcagcctgcagcgcgtagggaggactccccatgggcgggcaggactctggacctgagaattgcacaggatggtttccaagagggtttacatgctcccccgccccccgtcccctgcccacagacctgctcttaccacatcaagatcttagttcaatgtatcgattcattcttatcgagcatgtaaaggtccccggtgggtgctgtgggtctattggacagacctggcctttgggaagccaaggctgtccccacacgggctggtctggtgtgggcaacaaggcccgctctgcacccaggcctgcctccatccaacacaatgaggaagtcaccctacactggagggatggtgacgagacgtcaccgcagaggcggcagaagggataaaggggaggtagggatgaatagggccctggtgttcgggatgggacgggccaccccgggctgagatggaagctcaggggacgggggtctgcacagggctggacagatgggagggtctgcagggataaagtgggagggggggcggtgcaacggagggagccgggcaaacaaaggctcagaagcagaggagcccagcccagggacacaaaaggtattcacatccttccattcggtggccaccacagcttaattaagccaaaggaagggcaggggcatgcgggctgggggcggagcggctactggagcagctgcttctccattttcggaactgcacgtcgttctggggcccaattattctacctaaaactgatctgagtgacacctgaactgcacaaggcctgaaggacgccctgaagagcttcttcctaccagacccccgaaggccagggtctgggggcctgctgggaatcccggtctcagaggtctcagctctgaccgaagggtgctgagccctaaggtctgtacggggagtttctaaaagtctacgctgtaccccaagaaggggacgggtggggcagcagccctggaggaaaacccgtgagcgagtcgtggagggagtgtgagggtttttggggagtgaactttgcagagggtgctgggagcagccggcccgaggacaccgctgactggggtacaggggccacgggtcgcacgtggggtgtcagctctgccgcctcacttggggttgatttgaaatctcaagatgtgtctgaaaaccccccctggagaagcgaggggcccactgggaacgggaaggcctgagcaagacagacgcatgcccggggcgaggaaggggagcctggaaatccaccctcagaagaatcagacacgttttctagactttccccttcacatttcagcttcacgtttggggctcacttaacaatttgtatatttgttctccttgaatctggtagagaataagaaatccctgggatggggacagaaataattctgaaactcacacaccagctccagtttccatccaatttagtattttgttttgcaaaaaaaatctgcattgtatttcctcccactcaggaacatccgatctctggtttcagggtgcgttttacaggccaggaaaggtgattccaggtcgggaaaggccattccaggaagattgcgttattgtccactctcctgcatcatcgtcttcaccaaaaaagctgaaagcgacgaaacgcctacccagagggcaaatccagcttccgctctcctcagaggtactcagtccagttatacatcaatgtgagaatagtcccagcacttatcacttgtaaactcttttaattgattagctattaaatggcataagatcaatccaagtttaaacctgtatatcaaatccacattccacaaactctgtagtgaattatgtattttaaaacatgtagctttactggctaatgtaatcgtctgcgaatcttcccatctgttcttcaagtcactgtacctggaggcgcacactagcacagacccagacactcaattctggggctgcattattatcctgtacattaaaaaatcttgaaagggtgcttgttcacacctgccacctttctagtgagtctcttgtacttgctaatagagaaataacatacccaggttccatcctttttttttgagatgaagttttgatttcggctcaccgcaacgtctgcctcccaggttcaagcaattttcctgcctcagcctcccgagtagctgggatgacacgtgcacgccaccacacctggctaatttttgtatttttaatagagacggggtttcgccatgttggccaggctggtctcaaattcctgacctcaggtgatctgcctgcctcggcctcccaaagtgctgggattacaggtgagcccctgtgccagtcccaagatttcattcttaaccatcagtaattctcccaaagcagaaaagccacggagacgttacattttgagcaacaaagtttcagaacagctggctggatgaagaagggagcactattctgcagcccccatggaacaggaaaagccgctgttcagacacctgcagaaatgcctgactctgcccacctcacgtccacataaacctgaaaaaatgggagaggagtagctagctgtctgcccctggaagcccctccatttcccttgtgcatcctggcccctctctctctgagctcaggcccttccatgctcctctcccgccccacagaggccccctctgtcctggcccctctctctctgagctcaggcccttccatgctcctctcccgccccacagaggccccctctgccgttgcctttttcttcctctcccacgttctgttctcacgtactctgaaccccacgcggcacccagggctccccgcgttctctgagccccatgcccgccccacccggcacccagggctcccctagggtcacagtgttgtctgtttccgggttcacactggggagtccttcacaaaggcagactgggccgactctgatgtaagatcaagttctctgctgtccccgttgttccagaatatgggattctacccttagaagcgataagctttctgagaaaacgccttctgggtcagctccaagttcagctatcccgaggttccaaggctgtctgcccacccagacccaaggtgtccaatccttaggggtgaccctcgggccaacaccaatcacagctctggggacccccacgtgtcagccatggcaaaatgaacccccaacacagcaggggagggaaggaggaggcggggctcacagagcagagagccatggagagctccgggccgaaggggacttgggcctgggagagaagagacagccaggcggcgagggacttgtcctgtggaggcctccccaggaggcgagggtggggggactcctgctggaggcggccggcagatcagccttccttatccacgtcctcgaagtgatccccgtttgacatttggaaatgactttcatctgctgggtcctcctcggtttgacgtgcaattgcttttcccgaagctttctcctcttgtaacacccagctcctgcatgccgtggcggctccagccatcattcctcatcccaccaccccgcgcagcgtcttgcctccttttatgccggtgtacgtgttgtgttaagagctgggctttgccatttttgacaggctaatgcatttcaccacagataatgccattcaccacagaggcgcattctctctcgtgcccatcaaggcagaggctgagaagaaggtctgctttacagcaacggcctgaggaccctcggccccaaggtgaggccccgcgcaggtacctctgtacacgcctgtggagtcccaccctgtcgtgtgcacgaggctgtcacctggagattccggccctgccgggcgtctcctcccacgccgagctcctcctgccgggggggtctgcacagttctgggtgggggaggctccaggagctacccgaggcttcttctccttgccaacaacgatgccctcctcccgagggacggtggccccaaggggagccgggagagcagaggctacaggcagggagtggggagacccagccttcaagcacagcgccccttgggtgggacttgcctcttgctcacacccactcctacctcctggtacccgcctgctggaatctcctccccaccgcctactgtttcttttgaaatcccagtttaatccacttttttacacttccctttactccctcaagtgtctcctcccaacacccactttatttcacagcggctcgcgtccttcggagagcctgcctcccgccatgggcagcagggttcccgctgagctgggcccacctgaccagggcttccctcctgccgagccctcacctcgatgtgagccctgaagccccttgggctgggaggtgaggtgttcagagcacagatgcccgaggctgcacctgcaccaagacctgaccttaccccccagggccccggaccacacaggggctcacccgggtgttggctcacccgggcgccttctccgaacaccttccatcaagtgtcttgaattctgcagagcagcccaggtttcagggctttgcttctgttttcttctctggaagtgcatgctttgcagacaccaatgtcctcagttttagttcagaaaatgtgtcccgcctctctaatcaggtctaagggaggggagcagctcatgccgaggaggaagtgtgcggaaacgggtaccctggaaacgggaggagcaggcaggaatccaacacccatcccagccccgcgggcactgacagtcgctgcagaccgggcaagtcaccctcgggcagcgcttcagagctgacgtggcacccgcacccacagggctgccctcatccgcatggcggcccaagaggaggccccagttcatagatgaggaaggcggccttcgggagggaggggctgggcctcgcaccccagggaatggaagggcaatggcacctttcttccatgaatttcaccattggagaaaaagttaaaagatgaaaagtgtggcaagaggggaataagataagaaggaagaaacggaggggggtgaaagcaggcagaatgtgcctcttctgatcctcttggggtcactcagccacaccgagccatggaccgtcccttggagcgccacagactgcagggtttgtccttgtcacgaactcaaagagctgacctctctgggccggcacacaacttgcagccgagtcctttccacgacaccccagctccctgtctaaactcttggcctgactgggaggacctcttccctctagcccagttcctcctggcagccctgcaaatgcccaccctcttgggtctgtccctaccctgcagatggctccagcacctgccccagccacgcctccatctcccgccagccgccaagagctccacccaccacctggcccagcccctcctctgtcatctccaaggatttgatttcagtttcacacgaatcacctcctagtgatgcgtggactaatgctgtttaccgccggttcactttcattgcaaactcctcatctccaagaaatcatcaaccgagaaaagaaaggatgtcaccttttcccaaatctcccacagtgcctcacactacgagggaagatggtggaggagctgtccagacccacgggacagaaaagcccgggccagcccctcaacaccctgcagtggggacagcgcagctggggaccgcccagtgcagctctgccactggccctgtgggctggggcgcctctcagtttatctgctgctgactttgcccccttgtaaaacagggttgggagataatgagatgcctggggaaggtgtcctgggtccctttccacagggtccctttccacggggtgggtgactgatgaggacagggggtgcctaggaacaggggctcggaaggacctgctgtgcatgcaggggtcaccccaggagcgaccctggctttgacgagaaggaagtgttctctggttctggcagagaaatgtgtgaggcggactggtacacaacacaagcctaagggaagcagcacccgctccacagacaccacgcacaccgcccctcccctggtgctgtgtgagcacccatcctcctcccggggcccagccctcttccttggctgctggagtgcagggtgagcacgtctggaagaagcctgcagcccccacctcctttcctgcgcccctccttgtgtgtagcaggaagtggcttccttaggaagcagttattcgagtcatacccaggtgtgaaaagctaccaaggtcaaggcaaacataggaatggcctagtgccaaaatgaagccacagaattcagccctccacattttatgtctcagactttccaattttttttttatttccaaatatctcactgcgtggtctctgtgattttaattaagtctgatctaatgactactgtctgatggggggagtggcttgctgtaccccaacgagcagcatgcttctgttttatgtttagaggtttctctggccacctttcgagacttcattgttctctgaagatcgagctctatctctcaggagctgtatctgaggaagcattttgggcaaaacggcaggatgtacactgcttttggaaactgcatctgtgaacacttcagatttatgagaaaaatgcacttcaaaggggcactttccagaaaaacgttcagactcatggtgaaaaggtatctagaagattccatggagcctgcagaaaccaagccggctgaccccacatactgatgatctatactgaacacacaggcaaacaaaaacaggttcttcccacactggggacgacacgtaccctttaccctcatcatcctggctaaattctgcaggtttccttccgatttccttcacatcagaaaccatgggatttggcaccagcgtgacaaccatttagcatttgctgattcctagttagtccagggaagttctgtgccgccatggagtatgggaggagggaggcacggccttgccctcccggggcctggagtctgttcccggacaatctgcaaaaccgaatccacgtctcgaaagtttcaagagaattctactgtagacatctgtactatcagctacatttggaaaggattataaaattagaaaaatttccattttcaggcttgactttacaataaaatgttctctaatcataattatttcataacaaatgatctttaatgttgtatttttatacttgtaaactatttggcacagttttcacagggtgcccttcatttttgaagcagcataggttttgcttatttgagttttgcaaaaaatatattattttgacctggaaatttaaatatatagtgaggaaagccattctaagatacagagctgattgaaaaggctttgttaaaaacttctggtggggtcaagtaaacctcagtaaaagtcactgttttccaatttaattgtgaacatcctacttctattactcgtgattacaccaatgcctgaagattaaactcacctagagaaagaacggtctcttaaagccccagagaatgaaccaaggcgtgacctgtgctctttgtcagaactcagctttctgcaccgggggtaagaagtcagggtgcatttgggacttgcagacacgccagccccagtcaactgagcaccctcagatcgcagcaattgccaccacactgtcactgcctttgtaatcacttgctaatgggagcagcagcagcgaccgagacgtgcacttagccgctgtgtttacaggaggtccccgtggcccggatgcatgctttcctctgggtttggttccaaaggcctccaagtacacaaggaaacctgctgggtattgtgaaataaaccatcaaaagagaacttgctgaaaattctgcaggagtctctgccctcatgtcggggaagggagagtgggctggcagaatactaaacttgctgctcaaagatgatcaaagcctcaaggaaatggatgcaacattcaaagagactccgagagaaaaggaggagaatgtcttctaatcatctaacaacttatttttggcacagtttttacccaatcaccttccatagaaataggacacctacatgaaaaaagaatgcataaagtatactggtaccaaaaatcacaattcttccatgtcttcacattatccttagtgtgtgtgtgtgtacatgtgtgtataaatatatatatacacacatatatgcatatatgacaggctatgccaatttgaaaaaaaagaataaaagtcaataaaattggatttttacatcatgaagtacagaattaatccaaatatatcatgttttatctatttagaagaaaaaacaacatttactaaaacaatggggagaagtttggtgcgagtagtctgttaaacaaatgacctttaagaatatatttcagttattctgaaagttaatacacccaatttttgctccagtctgagcaaattaaacttggctggattatctgatggggttgatatcctggtaagtgtcaaaaatatgagagtctgtcaaaaaagatttgcttttccaataggtaaggcaaacaaaaatatcacactcatgtaaatgaagaaagctctaacatcctgaccctgtccatgaaatagttctattttgaggaaaaacaggtaaacatgtttgaaggtgtttgcattagaagctagtaattcaatctccttactgcttcaaaactattttaagaaaagctctcttactccccaggagcacaacgtgggccccctgtggtcccaagcccaggctctgactcacacacacaggggtcggggctggggggttctgtacaagcactaatgatgtgcgtgcattatcagggctgaggcggacaaatgctttagcagaggttggcaacatgagggccccccaggtcacgcgggaagtgccttgccaggacactaacccagctgctgtttaacagaggacatgaggattcaccttttggaaccccagggaggacgcagctctacaccctgaggccaccagtgccccccaggataccacctccacgcacccgtctcctccactccatcagaacacctctgctcctgaccttcctttccccaggtaagaacacaagttcttttgtttaaagtgtaacttcatattctgatattaataaaacttatgatattgccacctaccattctctctctccgaggttacctacctctcacctaccttgcacaataatctttttatttttcagaagctttaagacaatgaattgagtagttccagcatgtccccatgaaataaagcataagatcaaattgttccattttccttgtaacccagtgatgagagttatcatccacaacctcactgtgattatagaatcagcaaagtacacaggttcagtgagccagaaataaatacattaatgcgagaagacacctttcctgaaatttgttttatgtttgcaatattttaaaaaacttttcaaacagatttttacacttcacaggggactcatggctgtgatagaaaacccaagtgagatatggatacgttaatgaattaatacctgcttcatttaccaaagtaaatatcctttccttgtaaccgcaattgtctgagtccttgacacgttactcagctaacttcaaagtgaacaatcatacagtcccatcctcactactgcgtcctgctccgccaaaacacaaatcacaacaacacaatggttcggcacctagaactttctcaccgggaaacaatccaccgtgatggggcaaacccccactttaatcaaagtacttccctaaagggcattttgtggtgatttcaaagctaaaccaaccagaaagtctttacactcatttcatttccaaattttcctagatcacatttttaaagaaaaaaagttttttttcctttttattaatctggattgaagaaaagcacacatttcatttattgtctggattacagattcttattaaacaaaccggagctcattataaaatcaatatcaacttaaccaccatgccctcaggaggaacagcaaaaaggtcactccaagaaattcaaacaattttcctgctggaagggcatgattttaattacagatactattaattagagctgtcactgggaaggcttttttttttctgttaattatcacaaactcagtcctaagtatgcattttcaacctgcagtttttttttcaaattagtcatttctgcatgcaagtccaacctttccattctatcaatattttatatttgaatttcaaagtatatcaaagggcgccacgctttctaaaaatctctgcctgtatgatcttccgtctctcacgcatggaacagaactggtgtgataatttatttatgtactgacacagacttggcctgaagacctggcatcctacattgaaggtcttgctcaatggaatttctggataaattcttactagtttatgtgacatttttttcaggctgcttcttcaaacgtgattttccttttgctttgaagcaaagctatgcactgcaactgaaatgccagcctcaacacatttgaagttgccatttctttgtaagaaaaagatcgtcctgaccgggctggtgaccctctccagaaaactggaggcttcctccattcaatggcaataccaggaattttgaaatgggaggaaaagctgtcttgtggtcaatctcttttaagcatagagattgtgtaaattccttatgtgggggagggtcctgagagctcacagagtatagaaaagctagctccaaggagctcaggcagcaggagggtatggtgctggagggcgctttgtggagagagcttgagagcccacccatgtaactctgatgatggaataataatatttactttacatacgactgtaaaaatgatgaattatttacaagacgtattgcacactgtaatcatgtgactagagaaaacaaaggatccagtccaatgaggaaatcttacacatgtactgaccaaacttttaaaacagtggttaaggagtcatcctaccttcccagatgggaatatcttctcggaattaaatgatattttatatgcaaaggaatcaaacgccttgactggtgtaagtattctgggcttatgctgctgttaaaaccgaaggcctatgttcattacaggacaatactaaatacgaaatgtgcgccatagaacttccagaaactctgtggttttttaaaaatgcccgacttggtctgaacttgccttcctcgcatcctccccggtttccagctcatttccaggggtgtctgtggtgcctctagagaaggtgtccctcatggggacgcgtgtgggtcaccttcccctggtcagcgttaggcttcactggaccggacaacagcacagggtggcaactgggcaggtcaaaggatcttttcacagaagaccccgaggaagccgatgatttttgagacatcttcaaacacctacacgccaaatgatctcgcaactctggcacttttcagtagtagtggccaaactaagataacagataatacatcattcatgtactgtactttttccacacttctaattaacaacattcttccagagttaacacgaggctatccaagaagagcagacggatacagagctgcacaactgtggctgcaacgtatttgcacgaatgctgatgagaagttccaaactgtcctcataaaagaccccaaactatgatacaggaacaactgctgggaatggaggaggggccagagaggaacgccatcatctgcctgttcaacagataaatccgatataccactttttaaaaagtctcctcttacctggtaggcggcagtggcatctgcacctgggtcgccccctagtcccgagagcttctccttcagcctgtgctgagagctatggcggaggcagtagatgaggccagaggccaggaggacgcccaggatgcaggcgagggagaccagggtgagcgcgatgaacttggtggagtcttcttgctccgcctgaggaggcaggaacttgagtttgcttttctgcagaacaaggagagaggggtgtgttagctcctgacaaagcatgacctcctaaaaacacacgtctccaaatgcaacttgaaagtggaaagctcagccccacaggacgctgtgctggccctggagccacaacgggagggccctgcggaacaacccccgtcaaaggagaagcagaaatcatttgaaaatagcacatcgcagattgcagcgtgctcaagaggacagtcagaggcatcactttttccttcagtggtggctgtttttcaaatttatgtaacgtatttggcagctaatttgctgccttaagtaaagtatccatcccttcttctaaccgggcacagcagtttgtccagagcttgcacaatgattgtcgggggtgctggggggaggccaggcttggcggtggaggagggtgggcaggcccggagccttctgcagcttcaagtagccaccaagtccagcacatcttcagcaacaaaggaacgtgggactggctctgtgcatcttcacagaacattctccctcccaggtcaggggatttggatccacctgtcttgaaaggcgagcgctggtcgaatcccacctgactccagtcactctccaggagtggcctggtgcagaccacaacacttgccacctatgcacctacgtatttttccttgaaaggagctgcagagcctttggaacttcacttctcagcgaggaaaacccttcagattctcactgcttcttggagggcgggggtagggctggtgaaaatatgagaaagccctttcggtgcatttcacttgtctccacgtgcaaatagttgcacggctctcccctcattaacttcattagaaggtatattagcaacaattaaggacgccacaggaaaatgggaaggccgccccgcagaccgcgcgccctgcacaatgactcggggagtgaatgggggagcacgcccggccttggtcctggctgctacaagatgagaacaattagcaaacccctttccaccacctaatttcgcgtggtaacaaaatggatttttccccatgaatgcctggccggcctattcattatctctcttctattagtaattttctgctccgtattcagcctcccaactcttcatttcctcccgtctcccagcgtacacagtgcctcttatgtcaggccgggcccgtttttatcttgtaatcataaaggccaccaaagcaattatcgccggtcttgactggaaaagctggtcattaattagcctccttttgccttcggtgcagcggattagctggtgccgggactgagttaatggaaacgcgggttaaatgagaaaagacgcccggattttcctgcctggatgcgcggctcggaggaggaccgcgaggttctccagcggcgggaggcggtggagccgccgcggagagggagggaggctttggagagggagggaaggaaagggggagggagagggaaaggggggagagggagaggaggcgcggggtgggggaggggagtgagcagggagccgggagagggaggaggggcgggaaccaggggagcggcccgaaccccgtttggtccggaccccgcagccaccgctgggtctcgccgccgggtcgcccttcgcgtggagatccggtccgcgccccctccccggtctcctcccctcccctcccctccgcccccctccctccggcccacacagcctcttccagaaagaagtcactctagagccgcgcgacccagccccagagtccgccggggtccgcccaccgggtctcctgcgcgcccctccccgcccctccccgggcacagcccgttcacgaaacctaaggcgccggccacgcgccacctcccccgggccggggtctcctcggtccccgcgcgggcgctggttctcccgggtgggcggcagccccgccctgtgccctcctgggccggcgcgagggaccctagagcgcgcggggggccccaggcggggaggagcggccgcgaccccggatgcgagaggcgtgtgggtccaagcggcgccgggacaggggccgggtcctctgcccaccccagggtccatgttcgcctgcggggccgcgtcccccggagccatacctgggcgggagggcttttcccgggggcccggcctgcgcccctcgccgcccctcgcccctcgcctctcgcctcccgcgggtcccgcctggccttggccgacggaacaagaacaacaaaggaagcggcgcgaccggcggagggggcgcccgccgccctcccacccctcatcccggccgggccgatggcccccgcgcgcctccatccgccccagcgcggaggcgaccccggccccgctgccccggcgtcgggaggacaccgcgcgctcacgtggatgactgcgcccgggaacagggacttcccgaaccttcctgccccgcgccgtgaggcccacacgcgcgcggtgaccaccctggttctgagggggcggcggggccacggcgtgtggcggacccggcagtggcacccaggctgtgcgcgcgggtgtgtggggttccgaggcgcagggcgaccgccggctccggctccccgaggaaggggcacaggcgctgcccgcggtcactcgggccaggtgagggcaggggacgcgcgggggccggaggaggaggcctggtctgcgggcggcaggagggacccggggccagccgaggctgttcccagggaggcagacacctgctgtcgccgggaccctcgacacgctccgcacgcgcgggagcggaaccgggcctgctttggaggcctcccttggcgcgcttggatttactcaaaggtcaaagaaaaatgtcaaggagagcgattgcctggagagctcctggctctcctcccgggtccccgctgggtcccaggagtccccggaggggaagcaaggagccccagtgccctggagtcctgtctccaccaacctcgcccggctccctgctgcctaggcccgcgctgtcccagcagaggaggggtgggagccgccccaggcccacctccccgcgccggtccacaaggaggcccctcctgcaacctgggagaggccgggggaggcccggagggcgaccgcgcggggccgcgggacctggacagccggggagtcgtgaccgcgggcagcgccggggctgagggcgaggagggtcttactgcagggaagggcgggacgctggacagagggaccgactggggtccaccggcctgacacagaagtcgctggatcccagggcccggctgggaaacccgcttcctacccgcccgcgggcgccgcagaagaaaccgaagaaagaggtcttccctccacgcccaggacggtttcaagtgtcccacccagcgctgagcaggagggtgatgcggagggaaaaactgttggctgcaagtcaggtcttaggaatcccggaagaaacgaagatttaaagaatttttttctaagtgattgagttccaataactttacaatgacttgactccctttttgtggagttaaaaaaaatcttcaaactcctgctagccatggcctttaagagaaagaaatgagtttaaaagtgagtttgaggcacagtcttgacccaggtgtggctttggtggtcctcagcgccatctcccccatgggcaccgaccccccaaggctgcaccacggcgggtggaccccaaagagagcccagactaattagaggcatcttatcagtcttgacttgaaattgaaagaaaattatgtttaaatatttatgactttgacatttacagtcaggcgtttttgaaaagcggaacacccccttctgtacagcggcagctcaatgactgaaagtttggaacagagaagaagtgaggaggaggaggagggagaaggaggcctggtaacacagcggcaggggtgcgtcccgggtgggggagatgcacagataggcacacttcagtgctgagttctcagaggcaggaatagtataatttaaaaaaataatcaggaatgattaagttaattttatcccaggttagatctatcttgagaataagatgaagtacaatatcgcatatttcttcctctcaaccgtctgcacctgcaactcctcaaatttagaatagacagtattgcaaaagttgtgattcaaaataagtgtatgaccacagagacaatttgtggagctgtcttagaacttagcatctgcagacactgtcctgaccaatttaaattattttgaccgtgcccctgagtggaggtgcatgaggcttccaccccatgcccttgtgagccatttacgggaaaatgccttcagaacttttttagctgtccatgtggtaagcttaaaagaaaagaaaaaaggacatgttatgcccaaactcaattgtgagagctgatacagccacacaaatacaaaactttatggtaaatatgtgttgacgggtagccagatttagtccttttccaaggttgtgtgatataaccagttaacaggagcagttcattctctgagtcacgatgtgcagtattaaaatatgcttgcatcataaagacgtagggatacaggtgctcggtgccagttaatgttaaacttctaacattgttgatgctttcatttgtatcatttctaaggaatcagatttcagtcccagcctcatcctatctttgtgtgcatttaaattactaaattataaatacctttttctcttaaaacttagaagtcagttttagagaccattaatgagttgctgtaacaagtttatctttggtttgctggatgaatcctcttagaattattaggaaatttcattctaaatttactaaaaggcattactaaaatataatactcactttagggctgatgaacattttaagttttcaggccatagcaagtgatccaacttgaaaacacgggggaaggggtgtcttaaaatattttaaaagtattttttaaagctgttaacggaactacttttaatttggaatttgccacagaattctaataaatgagagaagtcaggcggaaataatcatgtattaattctctgcattacaaaatcttttcagaagctattatcagagcaagaggcactgcggtctgaattcagggtgggagaagccctttgtgcaactgaaagctattgttcctccgtgcagatgaaattgtacttgcaaatctgccattcaagtggccaaaaaacccaaaaaagcaaaagaaaagaatcttcaaggaaaaattattcttaaatgtaaactttaatgaaaataagttgggatatactgttttaaaatgggctatttgttgagtttttccaggcatacacttaaaagtgaatatacaagaaaggcaataaattgtctatttgccatctttaagcactcctaaaacatcagttttaaagaaatactgtgttttaagacatcagggaagatttatgatactgatgtccaaagggggaagcacccttgtgcaaactaattctaaccagcagattgcctccggtgggagagagggacccagaggctgagcaggggaaggatgcccctgagaaagccgcccccagcctctttcagactctccgctggcgttttcatgacacccaaactcagactcagcggatcacacttaaggcaccggctcctgacccctatttttggcccgcccgcctggtccccaggcctgcctggacgcacgcgcgccttccacaccaggtgcttctcgggacggggcctggcctccccaccccgcaagaaccagaccctcttcaggactgggggggttaccgcttcgcctcctctacccggactcagaagccccaacccaagacccgcctagcgtcgcttgtcagaacccctctgtggcacgactttgagcagagggcgagggaaaggagggtcagcgttcggccccgtcccctgcctgggctttctcccccgcttccccgtccctcccccctcgccggttcaccgcatccccacaggagtcataaagatcaggccccagcgccggacacaaaggccaagggttcccgggagccgcgggtattcagagccaggagaggggtcccggcgcggagggtgctgcggcccagcctcctggccacagagcgcgccggccgcgagggaggaccaaggtccccaaccacgcccgcgtccacccgtgaatcccggcgctcgcagcccccgggcggcgcagccgccaccgccgccgtcttctctggagcgcagaggggtgtgcttgggagggggcgggagggcactttcctctgtgtcggtgaaaggaagagcttccagctccctcctccgcacaaaccttcacttcctctcttgttcgatcgcgtcctaaaatctgggatcggcgacgcaaggacagcctggtttggcgaagacccctcggacaccctgcgctccggactccaggcgggtggctccacggtgccggccgggacgcgcagctcggggggcgggaccacgtccgggaccccggggccgctgtccgaggacggaggtcggtgacttgaaccgcgtcgtcctcagggctgtggcggggcccctctcccagccgtccagcccgcagcgcccagctcagcgcactgaggaccaaaaagggcgggagactctctccggccctaaaaggcaattgtgctgagattttaactctaacttgggggttcgcccgattccctggagcaacgcttctctaaaaccacggagcaggccagtgttcggaactgcacaggtagttacgaaggaaggaaatgaagtccctcgttccaacagcttcgggtccagtcacaagtttctctctggcgagcacgcggccgcctcacctggggtgggggaggcgctgagaaagcgcagttctctttgggggaggagagatggcctctcagaggcgtccccacctgcctctggaacgcctctccctgcaggccccctcggttccctgcaattcgccgcccgctgggatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgctggggagaagtcccggaggtcctagactccttggggcggtctctgcggggcgctgggccaggacagctgccaaccctccaaatctgtgcgctcagaaggagctgccctttgcccgctcctcctcacaggcccaccctagacccacttggggatgatcccaggcgcagctctcccctgccggcccaagcctttgacaggagtcctgcggcgaggcagagaccccctgaactgagctctccgacgccctagttgcccgttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtcttgcgagacgcggaactggtgagactttgccaccatttggtccaggccaatgtcggccgccagcccaaaacgccgaagggagacggcggtgaaaacccaggcgtgcgagctgcgtccttgcccttccccctacccaggtcaatggtctggcctagaccaccgctctgcgggcgaaaggagtggagcagaatcacaggccacgctcccagtcgttcgagcctgcccacataacccccggcccctggcgcagtcaggcccgcagcgggcgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcacaaacctagttctgtaaaacctgggggcgagccccagggggcagggctcagaggcgggggttgtccacagatatgagtacggtgccgtccgctgcaggcccctgtctaaaagtggccgaaggaccccgtttcctctgactgcaggcccaggctgagttccgcatttatttttgtatttatagggcaaggccagagcgcttcataaagctccagggcaaagaagtggcctcgcatcgggccatggttcccgcaggcctgagcgggctgcaggaggcccggtgcggctcggcgggggcgcgagaggcgagaaactgcggcgtcactggcgtcctctgcccatgagtgaacccctccagtaggcggggacggggtacatcaccttggccctctcgtcccccctgcccagggcaaggcccgcaaaaacccccgcaccctggctcgggggcggcgcggcggcgggcaggtcagagagaagcggtactcgggttcccccagcgcccgggatgccctcccagggaccttctcgggcaaagagtcgagtggtagcggttcctgtccctccccgccaccctcctccggtgcctcggcgtccccagccaggctccagggcgaccccaggcccggccctgggcagagacagaggaggggaggggaggtggcgctggggggcggggggccggagacggcgggaggaggactcgggagccggggcgggaagaggggaagacagcggagagaagggacggggaggggagggggctcggaggaggggacctgctgccctcagcctggctggtaaccggcctctccatagcaacggccagcgcgcgcgtctgtgtgtgcgcgcgtgtctgatgtgtgtgtgcccgtggtgttcccgggactccccgcgggggctgggaggggatcgcagaaccctagggtggcgacagagcaaacccctccaggactggaggcccgacctccgcggtgctgggagcgccctagggtctggctgcgccgcgctggcgacggggtaggctcggggaacgcgcgcaggccccgggatcggccgctggggcattggggcatcctgccctcgctgccccgaccctcccgctgcggtcgcagggccttggggcaccggggagtgggcgggtcttcccagcgacccggagcacaggggcgggcgacggcgcccccaccatggccctgcccggcccgagcgcccggcgcacctgaggtctgggccggggagcagctggggaaccgcgcgtcgcctcggggagctcccggccaggccggctccgggcagaggccagaggggccctggcgcaccctccccgcccgcggcgacctcgcaccaccttccccgccagcccgcggctctcctcgccctggatcgccggagcctcatccaggctggggtctccagcaggcggccgggagctctccgaggtggccaggagtggccggtagccgtctccctcggccaggccgtgtccagcccctcagtctccacggcggcgcagaccgcacgcggccaccctgggcctcggacagggctagggggacgcagaccctgccgtctgggggtcctggggcggccacggggccggcgaccccagagcaaggcggagcctagtacaggccagagagctggttttgctttcttcacagacatgacctgacagtgaatacacaaataaatacaattcttttcgttagtcccttcttccgttgtctcagtgtttcacttccaacatcaaagcaccgcattcctgatttgatcttaatttaatgacctgtctttctagtgctttgaggaaagatgggtgggaggtggcaccaattcagttcaatttgggtcactttaaaaatcgtgagagggcctgaaaggttccatgcgggttcaccagcagaacagcacacttcctcgtccacgccttggtgcacctgcggcaatatattctgggtggcagacggttatttatgtctgagagcctccaactcactccccttcctcccaccacccctcctctaaggtgcggcctgacctcagtggggctgcagaactggcctcgccaaagctgaaggcggacccacactctaagccctagagtctaggggggtcatgagaagaacgcgtttgtatttgaggtgctggttcttttagtctattgcttcagaaactggtaagttactcgccagatttccattctatttttctttattttaaattccctttttatttccagggcaggaaaatgtatcttctaattcttgaaaatactttagaaaagtgtctcggcaataatgtgagactagattcagctaatttgaagaatgaataatgatgtgaggattttttcttttttcttttttttttggtcatgagatcttagacttcatttaataataaatttcaatttacatgatttcaataacattttcagagaaaacttttaaacatgacacaaaatatttttgagagacatgttgattgaaatcatttatatatgacaaatgagtacattattcatatagaagttagggttgtttggctgatgaataaaaaatataatatatgtaaaattctccaagacctacaaaatagctacacaatataaatagtttaaaaatgatttgttgatcctgccaatacttcttttaaagtgcatttcacatttgttatgtgtaaaacctaatgttctgtgataagaatctcattttcaatttaaggaacaccaaattgttatagattacacatttaagtgattagaataaatatcccatgcactaaattatcaaagaaaatgtatttttaaacaaaatagagaaagactgttatgggaaacatgattattataaagcaaaacacatatttcaggaatttaaaataatatggtaaggtagaaaatgatttaaaaaacacctgagactcttgatttcagaagtctaaatcaattttgttttttaaactaagacagtaatttataattttacagtacacaaatagtatttaaaatacttttgatttctaaatccatttttaaaaagtatttactattataatataaaaataaaaatagatccttaaaaatattgtaggtatgtgtataaggcatttcttcatgcatatatttaaagaaaacaacattttaaagtaacaatgagtgcattttgaaaacaagatgttttgagaggtcagcctcctagtaaagcatagtagttggcattgagataatttaagaacaaagacacttccacagacaaatatggatgactctgagttgaaatgtattaaccaccagtagttattttttcaaggacaatatttggaagagcatcagacactagtgagaagtccttattcatcataaaagaaggtaagtccattgcaacaatagggcagtgaaacaactgcatcttagtagagccctcaccgtctacccgtgcatactggatcttagtagagccctcaccatctacccatgcatactgggtcttggcagagccctcaccatctacccatgcatactggatcttagtagagccctcaccatctacccatgcatactgggtcttggcagagccctcaccatctacccatgcatactgggtcttggcagagccctcaccatctacccatgcatactgggtcttggaagagccctcaccatctacccatgcatactgggtcttggcagagccctcaccatctacccatgcatactgggtcttggcagagccctcaccatctacccatgcatactgggtcttgggagagccctcaccatctacccatgcacactgggtcttggcagagccctcaccatctacccatgcatactggatcttagtagagccctcaccatctacccatgcatactggatcttagtagagccctcaccatctacccatgcatactgggtcttagtagagccctcaccatctactcatgcatactggatcttagtagagccctcaccatctacccatgcatactgggtcttagtagagccctcaccatctacccatgcatactggatcttagtagagccctcaccatctacccatgcatactggatcttggcagagccctcaccatctacccatgcatactgggtcttggcagagccctcaccatctacccatgcatactggatcttagtagagccctcaccatctacccatgcatactggatcttagtagagccctcaccatctacccatgcatactgggtcttagtagagccctcaccatctacctatgcatactggatcttggcagagccctcaccgtctacccatgcatactgggtcttagcagagccctcaccgtctacccatgcatactggatcttggcagagccctcaccatctacccatgcatactggatcttggcagagccctcaccatctacacatgcatactgggtcttggcagagccctcaccgtctacacatgcatactgggtcttggcagagccctcaccgtctacccatgcatactgggtcttggcagagccctcaccgtctactcatgcatactgggtcttggcagagccctcaccgtctacccatgcatactgggtcttggcagagccctcaccatctacccatgcatactggttcttggcagagccctcaccatctacccatgcatactgggtcttggcagagccctcaccatctacccatgcatactgggtcttggcagagccctcaccatctacccatgcatactgggtcttggcagagccctcaccatctacccatgcatactgggtcttggcagagccctcaccatctacccatgcatactgggtcttggcagagccctcaccatctacccatgcatactgtgtcttggcagattcctcaccatctacccatgcatactgggtcttggcagagccctcaccatctacccatgcatactggatcttagtagagccctcaccatctacccatgcatactgggtcttagtagagccctcaccatctacccatgcatactggatcttagtagagccctcaccatctacccatgcatactgggtcttagtagagccctcaccatctactcatgcatactggatcttagtagagccctcaccatctacccatgcatactggatcttggcagagccctcaccatctacccatgcatactgggtcttggcagagccctcaccatctacccatgcatactgggtcttagtagagccctcaccgtctacccatgcatactggatctcggcagagccctcaccgtctacccatgcatactgggtcttagcagagccctcaccgtctacccatgcatactggatcttggcagagccctcaccgtctacccatgcatactggatcttggcagagccctcaccatctacccatgcatactgggtcttcgcagagccctcactgtctacccatgcatactggatcttggcagagccctcaccatctactcatgcatactgggtcttggcagagccctcaccatctactcatgcatactgggtcttggcagagccctcaccatctacccatgcatactggatcttagcagagccctcaccatctacccatgcatactgggtcttggcagagccctcaccatctacccatgcatactggaagcagagtttatcccacaggacaaattcatgaactgggaagatttttaagataagattttgccacattgcttatgttagatataacataagcaatgcaaatgtaagcagtgcaaatgtaagatatagctataaaatcaatgcccttattttaaaattgagaaatgctaaaattattttttcaaattatttcactttatttcaagaaaaatatgaattctttacttaaagcagaacaatgcaagtcattttttgttttgaaaaataaatcaccaacacaactcagcttttattattaattctcatgctggctcatatgccgatgaatctgaagcttttgaaatccaaaaataggaactcaatgatgagatagacttgatatcccaccaatggcttgacatgcttacatgaaaccacgtgcttataaaccaagtatgtgtttcagcaaacatttctgcttgaaggattggctgacaaatatgtcgggatgtttagacttttcttccccaaacttcaaagttataattcaaagaatagaaaaagcctcaaggcttcattattactattattagttttgtccattaaaagtagcattttgaaaaaatactgttcataagcacaggtacttataaacagtgcagtctccctagaggtgaatccggttttcactgtctagattctagtatagaggatctattacttttaatcaacgtatttgtaaagatctaatattttattatttacagaataatgccataaggcacgtatttaatagttgatgttcagtatagtatatatattgtattttcataactagattatattcttttcaaaactgagctaaaattccttagattgaatgtttgtaagaaagactcattaccacatgaacaagaatctaacttttttgaaaatggctaaatagtgccattatgttcagatgaaaggaaacaagataattctgtgaagaataaccaggtcatctctatttttgtttaaaatctctttcacatattttgtcagttacatactacacatccattacaatatttggaaacttttcctcgggttgctttggaattaaaagtagaacaataattcaggtaattcaggtaaatgtttgtttcacaattatataacttagccatgtcctgttcacatattctttaagaaaagtgcctatgtatattttaatgtatgaaaataggctccaattaaatgaaagaacagcaacagcctgacaaagctcacctttgtacctggattctactgagaaggaaaatcaaatgatcaccatcaagtgacattttttgattttatattgcaaatatgtctatacatatttagatctaatgtgaacaaaaattcaggaagcagccagttgcttttcttttcttttttttctttttactgagacggagtcttgctctgtcacccaggctggagtgcagtggcgtgatcctggctcactgccaaccgccgacacccaggttcaaatgattctgctgccagtagctgggattacaggtgtctgccaccaggcccagtgaatttttttttgtatttttagtaaagacagggttttgccatcttggccaggctgttcttgagctcccaacctcgggtggtctgcccaccttgagcctcccaaagtgctggaattacaggcgggagccaccgcaccctgcccagttgcttttcattctgacacagtgcggagcaggttcagggtaagctgtcactgagacggagcattggtggtgcaggattccatgtgactcaccctcagctgccaagtggccaactgcatggagccgccgcatgtcctcggtcagtgcggtgggatgcacgctggcattctagcaagtctggcacattagcatataatctgcaacagggtgctgtcaggtactgagaccacttttaaaaccctcatgaatctgccacatgtaactatatgtctccctaatatgtttccattcacacactttaggaagtgatatacctacttcgaccttgctcagtcatttctgaaattcccatttggaattgtcttcagaaatatgcccaaagaaaaccagaaatctagtcttacgttttctaagctttttcacttgtgattctccacaccttaacctcatcactcctccagttgactgtccttgtctccaaatggctttagagtattaaaaaagaaacaaatctgaaatatcacttccaccattaagagtgcatttgaaaaggccatttcaaaagagtagtgccccagacatggtgagcactaagacagacagcacctctgagtgacactgcggaaaaaccaggctcacttgtccaagcacgttcgcaacagagtcagttacttttcctccactgggtttcccagtttccatgacgacagcctgtcctgaatgtccatctttggggtgaggcttgaggcttccttgtcttttgtcctccccacaatcagatcccattacttttttcgggtcatcccttatctgaccttattccccatccccctatgctgatggcggctggcctcctgcagtcctggggtctggtcccctccatccaccaccctcagcctcggccatctctaccttgtccactggaacagcttcctgtccctccctgaaaattccaccaacccttcctcacacccatcagaggctggctccctttcatctgatcaaccaaggacacacaggggcgcctccagacctcccctgcatgccttccccacaccaggagcccctggtcagcggccgcgagggcaccctcaccctctcctgcacactctctccccatcgaggaaccctggctggctcagcggtgggctcggggcctttcatttgtttgaggtcgaatgctgagtccctcaccttcagaacatgtgagtgctacggactgctcatcatttcacgcatgtgcacatgcactgtctctcacacacgcacgctttcgcacacgtggagacaggcgagtactttctagtcagcatgacagcagcggctccatcctgtcaagctactttcccatattttatttcctttcactcccagagaaaccgtggaattcatgcatttttttttccagttttacagatgagaaaaccaaagtactgagaggtaaatgaagtatccgaagctggtcagtggcagaatctcaatcaacacacaggctcctatgcgaacccacacactgagggcatgtttcacaggggagagctccgttcttagctacagactcaggcaggcttggagtcactcctctctgcagtctgagctccgcgggtctccgccagagcctccaagcctccccccagtaataatattaataatagttactattctttgaatagtaattcaataatagtatcagtctttcaaaaagatggtggtctttattctctattttccatagaatgtggtcacaggcatcgtgtgagcactgccatttctgtgcttctaccacacacactctaagaggccagggggtgtctgctccggcagctccagatgcaccttccaggggcgtctcctcctgtcactcagcgctgcccccagacccttcctacccgaagttctgtggccacagccatgcagactttatcctacactctgacccactcacaaagcactgcggttctaggtatgaaagcttctcactcttaactgacgtgggctgtgcgtttataagagagccgggtcaatgctggtgtaactgacacgggctgtgggtttgtaagagagccgggtaggtgctggtgtaactgacgcgggctgtgcatttataagaaagcccggtcggtgctggtgtaactgacacgggctgtgggtttgtaagagagccgggtaggtgctggtgtaactgacgcgggctgtgcatttataagaaagcccggtcggtgctggtgtaactgacgcgggctgtgggtttgtaagagagccgggtaggtgctggtgtaactgacgcgggctgtgcatttataagaaagcccggtcggtgctggtgtaactgacgtgggctgtgcatttataagaaagcctggtcggtcctggtgtaactgttgcgggctctgcctttgtgtgaaagcccggtcggtcctggtgtaactgacacgggctgtgggtttgtaagagagccgggtaggtgctggtgtaactgacgtgggctgtgcatttatgagaaagcctggtcggtcctggtgtaactgacgtgggctgtgcatttataagaaagcctggtcggtcctggtgtaactgttgcgggctctgcctttgtgagaaagcccggtcggtgctggtgtaactatgagaaagcctggtaggtgctggtgtaactgacacgggctctgagtttatgagaaagcctggtcggtgctggtgaacatgggtgtctcccctcagagaagtaagctgaggtgtgtgcacctctcacagcccagtggggagcacagggctgcctgcccacgctcactggctggctcagtgccctccataggctcctgtccaccggcaggcgtgctgcggcgttggtgagagccccggggcggaggctcaccatcaggcttccagcatatggtggataataatctctggcaacacaaaaaggcaggcagcagctcagctcactgtttcatctgttgatcagtctacaggtccagggttttaaaaatggatttttgctaaatgaataccacaacatatgccaccagaaaagtgcgtgtgtgccatttcaaacacccgccgtcctgctgctccgcgctgccgaatctgctcctctctcctctggccccgcgtccctcagaaggagctgaggtcagaaggaggtgtctccaggaaacactaggggaccttcatacctgaggggccaaaatagctgttttcaagctgctgctgttggagaccggtcttaggaaggggctgtgatagagctctttgtggaaagccttaaattaagatgaaggggagaaaaggaagtatcgaaagtttggaaaaatagagaaataagaagagctcctaaactgagcctgtggcaaagggagtatcctgaaattgaacgggctcattcttgaaatgtcagtgtggccggcagcctctgagacggcccagggcctccgtcctcctggaattctctttcctgagcgccactggacctggtgactccactccgatgcctggaggacagcaaaggcagcagagatggctgctaaggacgcacactggggtccccgaccgactttcgagctccgagggatgtctgctgccaggtggtggcggctgatggggaaacctggtggacagggcccatggacaggggctaacagcacagagggcctggggctgccgctgctgagctgagaggacaccctcagcacagcctatagggacgcagctggaacccccagctggtccacaccaggaccccaggcccacagaaactgtaagataaaacatggttgtgttaagctaagtttcgggataactcgctgtgcagtggagggtaactactggagctagcaacgtcaagccgtccaggagagaaccagatgggaacacccagcgtgggtcttccacaaaagaacttcttctcagccaggcagaggcacctgcaggaggtgaaaggcaagttcccggccagcctggtggggttcctgcggtccaacccccacctcagcacgctcccctcactccccgcggccgcttgtcctctgccgctgctctggatttgggattccgagactggcaggtcaggaggcccggaaaactacatttgcctcactctggttctccggggctgtggtgaggctgcctctcccctgccctccactttctctttccctgtaatatttatgtagctgagtgcagcaaacattttgaatgcgtgatcaccgtggggctcagggccctctgaagctctcactcgcccaaagctgacggcctctgttttttccagctgcagctccgggtgccatcctccgcggggtgaggtgccaccaggaatccctttccttagattgtctgatgctgtgagttagaagattcctgtttctactcacacgattgggtgcccagtatacactgccatggtttagaggaagctctgccactaactgtgtgactgaggcaagtggcttcactgccctgtgcctcagtttctctccctgaaaatgggaataaaatgtacttgactcatgggcttaatgaactgatcccgggagctcttggctgtaaggtgctcaggacagggtggcatccacaccctcaggggccctgctactttttattaccatcttgactctaggagctccgaccttggttttcatggatgccaatggaaattctgttttcagacaaatgtggaaggcatccttaaagataataggattaagtaacacaaatataaagaggaaaaatgatcaccgatgaagagtgcaagagaccacgtgtgtgtgcttgggaatggagggcctgaaggtcccaccctcggctgggcccgccctgccccatgctgctcccgctctcctgggcaccctaccacctcctggctccccacattcgcttctgggcacacgtggagggagggcaggtgcccctcaggtgttccctttctttccttctcagcacctcctgaggaagccccaggacagaacaggaaccactggagtcagaagcagaatgaggggcatctgtattcactgcagtttacggcggccattctattgctctcgtaacttgcaaagcagacttttaacttagaattgacatatactaaatatttaaagtaatcttcataagccccagagtgtgtgtctgtaactaaggacaattttttcacaattaaaaaaccctcatgaaatgacagtgactgttatcaaatgtctaactctgtgctcgagcactaacctccatgcttgcaggaaggctctttgtgaaactgacaataatcctgtgaggtgagcaccattaaaacctgtacttggccgggcgtggtggctcacgcctgtaatccagcactttgggaggcccagggggcggatcacgaggtcaggagttcgagaccagcctggccaatatggtgaaaccccgtctctactaaaaatacaaaaaaattagctgggcatggtggcatgcgcctgtagtcccagctactcaggaggctgaggcagaagaattgcttgaacccaggaggtggaggttgcagtgagccgagattgtaccactgcactccagcctgggtgacagagtgagactccaaaacaaaacaaaacacaacaaaacaaaaccctccattttccagacaggcaaatgaagcccagagtgacaaggtaacctgcttaaggtcacacagcaggaggcgaggcagggtatgaattgagtgaatctgacgccagagccttctggatcaacatgggccacattcccccagaatgccaggaactgagtgaatgtgaccccagtgccttccagatcaacgcggatcacatcccccagaatgctgggaattgagtgaatctgacccaggtgccttccggatcaatgcggatcacatcccccagaatgctgggaattgagtgaatctgacctcagtgccttccagataaatgcggatcacatcccccagaatgctgggaattgagtgaatctgacccaggtgccttctggataaacgcggatcacatcccccagaatgctgggaattcagtgaatctgacccaggtgccttccggataaacgcggaccatatcccccagaatgctgggaattgaatgaatctgacccaggtgccttccagatcaatgcggatcacatcccccagaatgctgggaattgagtgaatctgacccaggtgccttctggataaaggcggaccacatccttccagaatgctgggaactgggtgaatctgacgccagtgccttccagatcaatgtgaccacatccctccagaatgccaggaactgagtgaatctcaccccagtgccttccaaatcaacgtggaccacatccccctagaatgccgggaactgagccaatctgtcccaggtgccttccggattaacgtggaccacattcctccagaatgctgggaattgagcaaatctgaccccagcaccttccagatcaatgtgcactacacccctcccaatgccaggaactgaccaaatctgactccagtgccttctggattagcgggaaccccattcctccagatggtgggaactgcgtgaatctgacgcagtgctgtctggattagcgtgaaccccattcctccagatggcgggaactgagtgaatctgacccagtgccttccggatcaacatgcactacatccctccacgatgtgggaactgggcgaatgtgaccccagtgccttccagatcaatgtggaccacatccctccagaatgttaggaactgagcaaatctcatgccagtgctttccggatcaacagggaccacatccctctagaatgccgggaactgagcgaatctgacccaggtgccttctggataaacgtggaccacatccttccagaatgctgggaactgggtgaatctgaccccagtgccttccagatcaacgtgaccacatccttccagaatgctgggaattgagtgaatctgacccaggtgccttctggataaaggcggatcacatcccccagaatgctgggaattgagtgaatctgacccaggtgccttctggataaacgtggaccacatccttccagaatgctgggaactgggtgaatctgaccccagtgccttccagatcaacgtgaccacatccctcctgattgccagcaaatgagcgaatctgaccccagtatcttccagatcaatgtggaccacatccctccagaatgccgggaactgagcaaatctgacccaggtgccttctggatcaaggtggaacacatccttccagaatgccgggaactgagtgaatctgaccccggtgccttccggatcaaggtggaccacatccctccagaatgccagacagatgaaggacacagaaaacttaatagtaaaacatattttctgatacgcaggtacctgggaatctatagattcaggtttagtgctgtgggttgtccttttatacacagcacacataccacaaacacacacagatacagcatacacgcacacacacaaccacattcacatagacaagtacctcgcacacacatacacagaaacacacacaccacacatacacacagacacatacccagcatacttacacacacagcacacacacaaccacattcacacacacataggcatatagtaaacaccaactcaagcacacatcacacgtgcatggacaccccccccacacacgtggagatagagtcgacactatattagcttcccatgaattgatgtcataagctcagttaacatacgtgcccgctaagtacccttcagggatggcaatgctaacccgctgtagtttaaaagcttcagggaagacttgatcagtctcggcaggtattacaggcagaggcagatttctttttcctttttttttctttttttttgagacagagtctcactctgtcactaggctggactggagtgcagtgacacgatctctgctcactgcaacctccgcctcctgggttcaagtgattctcctgcctcagcctcccataatcccaattgggattacagttgggattacaggcacgcaccactacgcccagctaatttttgtatttttagtagagacggggtttcaccatgttagccaggatggtcttgaccttgtgatccactcgccttggcccccaaagtgctgggattacaggcgtgagccactgcgcccagccagaggaagatttcttatgctgcttttaaaacaaaagtagccacaagagttaacatttctagttttaactctcaaaaataaagtccttgtggattttatgatctcatttcagcaaatgtcactgcaaagtggagatgctatcatcccttagcagtgtgcatctgccttgggccgctggggccagccgctggctgctctgcaaggaagggtccctgtaagcaggacagtggccttccagggctgaggctggagaaaggtgctttgcctcggatgggcaccctttcttttagctctgattctgccccgtgccgtgtgcctctgagtgttgccttcccttctgaagctcaggcacatcctctcctctgctgccagctccctggtgccagttccctcctgcttccattccctgccttccaggcggggtgccaccctgtgtccccttacgattatctctctgcttgtgcaagcatcaccatctgcccacgacccttcagccaggacctgcagcactcagagctggccacagagactcgttccttccacagggactgtccagatcatcctaaaggttgggcagtggtgtgagtggctctcggccattcaggagtacctgcaggtggcagaaggtactccagagttggacggaggggccgtcccagggctctcggtgagactgagaaggttcatgagctccgtgttcctgtctgagatgaccagaaccagggcaggcctcatgtgtgccccaacttccgtaaaaccacacatgcatagtcacaagcggctccctgctttatgcattctaaagcaattcagcattccacatgaaaacgcagccgtgacggcactgtgtgattgataatgctctccgtgagacttacgggtccataaaccaaagaatggctataatcacccacaggtccatcatttctttatcctttacatcaaacatgagatggtcatagtcacaattcaataacaagccacgtatggctccatgaaagccaccagtgagagctgaacgtgctctcccagctactcttctctactagagcctgcaccccaccgactttgaaaagagataactgtcacctgggaaccgacactcctgctggggaggggaagccacctggggctggagactacagtctggaccctcaggcggcagaggagcgagccgagagagacaactgtggcttctgcctctcccagtgggagtgaggcccctggtcagagggcctgggtcgggggctgtgctgcccatggctgggtgggattttaatctaggctctcacaggtggtcacacagagcggccctgctgactcccatcaggggagatggaggccatacgtgccacagatcaatacgatgcccttccatgcacagctctggacaaaagctcctcctgggcatagtgtctgaaatgagctgcttacttttatttccaagaaaatgacaaagacgattttgacccctgacaattctttcagtcctggtcctcctgcgggtagctgagagcctaagtgaggtgtgtgggacagaatgaggtgctgggaaattactggcagtggacatttaccactgggttactcggacatctagagcacgaagtgagtgacacagaggccggggaccctccttccctcccaagtgggcacccctctgagaaattccctgcgagccccccagctctgtcttctatggggacttcgacctcgctccacgttgtgcagccacatggcccacaggaatgggcggtcctgctacatgggaaggagcttagggtttaacacgcctgctccaggagctgcgccacacacccgccttcagattcagcccggcgtgcctgggcttctgaagtcccagagcactcagcccggcccatccacggatggctgggacagagatttacacatacaagtcggatattctggggagctggaattcaaggatggacaatgaaagcccagagacagaatcctcatcagtgagcagacaaggctctggcagggatgttttgggggagcagtggttccttacaacgtgagcctgaaggagtttccctcacttagccctcagctgggggcaaaccgtggatgctggagagaggagcgtgaggcatacagaggcccaggtggctctgtgggggtcggacgcatgggtgtgtccccaccacccacagaagggtgctcgcctgagacacagggtcggccgtgaggacacagtttcaggaagcatccacacaaggggaacccacagggcacttgggttatacgaacctaacaaagagctaaaatctgagctctctccctcctgcgtccattcgatccccttggacgaggctttctggaacgtccagaataaagagaatcctcatttctcagcacacggacttctgatgtgagaagacagtgactgtgtgctcattaaaactcactcttggccaggtgtggtggctcatgtctgtaatctcagcactttgggaggccgaggcgggaggattacttgggcctagagtttcagaccaggtggccaacacagtgagaccccatctctacaaacaataaaaaaatcacccaagctgcctaaccgcccccacccccccgccccgtggcacaggatgtttcccagggcagagagtgacatggctgcggggtcccgctgcagaagaaccctgtgcagtgagggccacaggcctgggaccccaagccgctcaggaccgtgcacagctcccagatgtcccctggggggacatctcttccggaggatctttagggtccctttcagccctgccatctgtacgcccaccatggactggtgcctactgcctgccgcctgggcacaggtgcccttgcgcctggccctcagcccgcccatgtgcaggaggggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagccgggttacacgcgagagccccacgcgccggaggttccggggcagcccggttacacgcgagagccccacgcgccggaggttccggggcagccgggttacacgcgagagccccacgcgccggaggttccggggcagccgggttacacgcgagagccccacgcgccggaggttccggggcagccgggttacacgcagagccccacgcgccggaggttccggggcagccgggttacacgcgagagccccacgcgccggaggttccggggcagccgggttacacgcgagagccccacgcgccagaggttccggggcagccgggttacacgcgagagccccacgcgccggaggttccggggcagccgggttacacgcgagagccccacgcgccggaggtccggtttgtgcacctgcacacgggtcctgtctgtgctcccctgcagcccgggggagtcctggcccttcaccacgtgggaggctgtcctgggacctgaggactccgcccacactccatgccctccttcccttcctcaggcccacctgaccccggcagacctcctgctctcctctttgtcttctggccttgcaggcagctgtctaatgcagggcctaggcctgaggacaagcccccggggtggccaagctggctgcatccctgggaccctggtctccgtcactgggacgcagcagttctgccgggttaacctcagggggcatatgtgtctctcccatggccgtcattttctaccgactttgttatttcagcattcatttagtgcatatattccttttaagaggtgtctaaatccttcgtgggccacaacagggtagacatcaggggctgtagcctccagtgtctggggggccatgcaggccacatgagtggggggaggggctgcgtggtggaaggggggccgggcagctgggggcaccatgagtggggggaggggctgcgtggtggaaggggggccgggcaggccacatgagtggggggaggggctgcgtggtggaaggggggccgggcagctgggggcaccatgagtggggggaggggctgcgtcgtggaaggggggctgggtggctgggggcggccagtcctaccccaaggggagagcacacaggtactgctggctgggaatgcgggtctggggttgctcagatctttgattaagaaaatagaaatcaggcatttgtattatttatgtaaaatttctcaattttgaaaaccctcattgagctcttagagtacaaactgtgtcccctcaagaggatatgttgagtcttaaccccaggacctcagcatgttatgtaacttggaaaaaggaccttcacagatgtaatcaagtgaccacgaagtctctggggtaggccatgaatccagtaggactggtgtcctgatcaaaaacggaaatttgaggctgggcagggtggctcacgcctgtaatcccagcactttgggaggctgaggcgggcggatcacctgaggtcaggagtttaagaccagcctgaccaacatagtgaaaccccgtctctacttaaaatgtaaaaattagccaggcgtggtggtgggcacctgtaatctcagctacttgggaggctgaggcaggagaattgcttgaacggaggaggtggaggttgcggctacccaagattgcgccattgcactccagcctgggctgtgagagtgaaactccatctcaaaaaaaaaaaaaaaaaaaaaaagggaaattcagacacagacagacgtgcacagggagcgggtcacacacagaggcagggactggagtggggcagccacaagccgagggacactgggagctgtcaggtgctggcagaggctggaggaggagggagcacagcttcagacatgctctcagacttctggctcccagcactgtgggagaataaacgcctgttgtttgaaggcccctaggttcatggtacttggtgagggcggcctcgggcagctcacacatgggccacacagaacgtggctgtgggcgggattgttctgggtgagccatgcgcatcccctgctatcagcaacacagtggactcacactggctctaaaacccctgaggtcgtttccatctgatggtcgcacttgggcagggctcttctggtgccagcgggagaccttactcagaccctcatctccatccacccctcctcctcctagcactgcatggtccaaaagtttactcaacccaatgacgcatctttaattctattattgacaacatcgtggaatataacagaattgaggaatagccccacggcacgtttctagagaacccctttgcacttaatctattttctcctcattaagtaattatttaattaatagcctgtaagaatagtgtacgtaggtagaaatttatctaacggcatgatcgttccaagtctctatcttttcttttggatactttgtaaaaaaaaaaatcattaaaatctatacttgtgatgtcaacagccgttcctccatctctcagcaagaaatgccatcagcaaagagacggtgtgacgcccggctccctccccgtcactgatacggcctaggatctcaccagggaccaaggcaagcacactggtctgcggttcccacaatctacctgtaaccctttctgaatgtttgtccaactctcttattccggcgtctttcccaactctgccaatccctcagacattcccgacagctgtggccagatccagctttgctacggacacggagccacagaactggtctggacatggagccacagaactggtgagagccccacgaagcagctctcgtgggctgtgccctccagccctcacatggcacacacctgctgctctgcagagcacgcctcgctccccttcacgaaggagcggaaatacaatggcagccgcgaagctctggctactaagatgcattatctgctccaagctttcaattgagtgattatgtcttaaaagaatcacataaatgatacagctccacattttgaggtgtgtaaagccacgaaggcatcgtcttctatatcttattcttgctgactatatgacgatgacattcttaggtgagctcactacctcatggcatcaactctgcagagacgtctcacaggtcacgttagaaggctatgaaaaattaaaacacataaaaaacaatgtttaaacctgtgtgcatcactgagtttgacagacacagtgtatggatgccagattagttcgttttactgtcagtatagtacagtccgttaaactgcgcatctttgatgagttactacctgtggggtggcacctgacccaggccaggacagtctgagtggtccttcctttcgccctgtgcagggctgggcttgcgacctcagtctttcccggcagctctgcttggcagaattgagggatgtctccattttatccagggcgagctactataggaataacaatggaggcttaagatctgtagaaaaatctatgagtttaggaattgtgattcctgatttttattgagtaaaatgctcaccctaatttcttcaacagaaaatcaatattccaaaccctccagaaatctggtatttgcaggaatcccgacactcactaacagaggtggcacaaaaggccctgaagtcagggatccctggggaacgatgcccagtccgacgtgcttctcctgagccgattttgggtttcccgttttctaaagccagctccccagggaacggcgcccagtccgacatgcttctgaaaggattctaggtctcccgctttctgaagccaactccctggggaacggcactgagcttgaggcgcttctcctgagcagattctaggtctcccgctttctgaggccatttccccagggaatggctccaagcccgatcacttctcctgaatgtattctgggtctcccgctttccgaggccagctccccagggaacggcgcccagccccatgtgcttttcctgaatggattctccgtctcctgcttttggaggccagcttcctggggaagagctctgagcccgacgcgcttgtcctgctttctgagcacttgaatctggtggcttctgtgtcatcttcactctgaatgagtgaaatgtgtgcttaaaatggccttgagaaaagcaccccctgcagggtgggagagaaataccgacaggtggggagggctggaggcgggagtccaggccgtgcgcccaagaggagggtcgtggtgggaatgaatgaggcccagggagtgttgggagacaggccggcggccgcgggaaacccctcagcaacctaccagcacagatgcaaggacactggggtgccagtccccccgctaccataaaggaagaagaggaaaacagaatgaggcaaagtgataggggatgaagggcatgaggaggctgctgtgtgctcgcagaggaggggaggcccccggttctgcttggcgctggctactcttcttggttgttgttttctaagtgctgttgactgctggctggacctcagtgaatgacccttctgctaaagctgccaggcactgcgctggtgtaagctgatcatagctccatcatcccaaatctaaaccactccagaaacaggccggcccctgctgcaacagcaagttgatctgtgactttgggcaaatccactcagcgccagactgccaagagaaaacggcggtctccgccgtccaagcagcacatcgtggagggcctacacaccccgatgttctgggggagcacttacatcttcagcaatgcctgtcaagatggagacagactcctgtgctgaggttgcagggttgcactctgaaaagacacccagggcagcactccaggcaggctgcatgctccggggagacacagatggcaaggagcagggcagcgggcggcctggaggtacagctacaccagctctggggttccacgctctgatctgacttagctgttttccaccctaaccccatgtgagacagccactgccccaaaactagggatgggaaccaaaacctttgagaagcccacgtgggacatgggatggcctgtgacccatcagctcccgggccatccctttgggttcagccacaggctgggggtgggaggtggtgccaggacactgtgggcatcgccttgggctgaaaaagggggctgtgaggaactcatacacctgagtcctcgtcctaagaagtcgcagttgttgggtgggccatggccacgaagactctgcgggaacactgcctggtcacacagactctgcaggaacactgcctggccacgtagactctgcaggaacactgcctggccacatagactctgcaggaacactgcctggtcacacagactctgcaggaacactgcctggccacacagactctgcaggaacactgcctggccacgtagactctgcaggaacactgcctggccacgtagactctgcaggaacactgcctggccacgtagactctgcgggaacactgcctggtcacacagactctgcaggaacactgcctggccacgtagactctgcaggaacactgcctggccacgtagactctgcgggaacactgcctggtcacacagactctgcaggaacactgcctggccacgtagactctgagggaacactgcctggccacgtagactctgcgggaacactgcctggtcacacagactctgcgggaacactgcctggccacgtagactctgcgggaacactgcctggtcacacagactctgcgggaacactgcctggccacgtagactctgcaggaacactgcctggccacgtagactctgcgggaacactgcctggccacgtagactctgcgggaacactgcctggccacgtagactctgcgggaacactgcctggccacgtagactctgcgggaacactgcctggccacgtagactctgcgggaacactgcctggccacgtagactctgagggaacactgcctggccacgtagactctgcgggaacactgcctggccacgtagactctgcgggaacactgcctggccacgtagactctgcaggaacactgcctggccacttagactctgcaggaacactgctgttacctctcactgcacggggactcacagacacaaagatggtcattcacagcatcaccaaaatcgatccacgaggctttgagaaaatgcatctctaaaaaaagcacatttggtgggtccaacaagcctcacttattcacggtcctgaactcagtgcatggaggcaagaggcatgtcggtgacccagtgagggaacaactgcacatctggggcaacagcctgatggtgccgtgggagccacgggtgggtatcctgcaaacatcagcttggacactcagcacctgcatgggacatgcatcgccacaaggtcacaggtgggcacctgggtgctgcagggtcagctgacttagtcaaaggctaagcctgcagtgagtgtccgagcctgcaattgaccgcggaagccagtgccctccctagttggcaacgttgttcagctgagctacagagaaagagctcggaggtctatggactccttcatggaaatcgctcccttgcgtctcctcatgtggacacagctccacgcctcacctctcaggccaggcagcggccaacccagcctcttcaccaggtatgggcaccggctgctccttgctgcaggaccgctggctggggtggccggggcacgcagcaggcacatcccgacctgcgggccagcacctgcgccccatccctgttacacctgttctgaagccttcaagagcaaagactgatgttcatcatggccaaagcagctgggctctttactacggaaggagattaattgctaccccgcgtacctttcagaggtttatatgaagccatttttcggtatttctctaagtgactgaaacatgcgcagccatttcatgtatttctacgcgtgtgggcaggcggccagggccctgggccacattccccagaaagccacgtctccactctggggaggggaatgcttcgtttttctgtgagtggtgaggtctctcttttaacctgttataaattaccttttgtaatctctcctaaaccattatatagaggagggaggggagacaaagaataaatacatctgtaataaatgtgggatttgggaaagatgataagatcagaacaatttgaatgaacgtggcaaatgaatttagagtttttgaactatcagctatttctgcaaataatgacttgtagaaggagaggctatttttaaaacaattcatgttctctgctttcatgtgaaggaaataaaacaaggcactcatgaatgagctcttcaagcacggactttcctggagctcacaggaaggggccagcacaggtcaggctggaggcacagtctgattctacggtggcttcacagggcgtgtttggagagcgccttcctcctcccaaccctgcagtccccggcctggctccaggtctgccccgcagccctgaggtgagtctcagcatgtccaggcgtctgaggtgacactgcagcctctctccgtggccctgtggtgagtctcagcatgtccaggcatctgaggtgacactgcagcctctctcggtggccccgtggtgagtctcagcatgtccaggcatccgcggtgacactgcagccactctccatggccccagggtgagtctcagcacgtccaggcgtccgcggtgacactgcagccactctccatggccccggggtgagtctcagcacgtccaggcgtccgcggtgacactgcagccactcttggtttctcagctgccgcaatcggtccttccagtgtccgacctctggggccctcagacccccaaacccaccttgtcgctgtggcctctccgcctcctgcaggtggcagcgctactgtagcctgccatgccccaccccttgcctccatccccacacattgccctgtttcttgggcagccatcttctggacctctccctcctgcaggcgtctctggccctgggggctccaggagggggtctccccaggagcgtgttccccagtgcatggcccctgtcctccaacacctgctcaggcctgcagccaaacccacatctcccattcctgcctctcctgagcaggaagccccatgagagggtccctttacaattcgtccaggctggccctgggccctgtgtggccgcaggtggtcacggaagccccacctgagcttccaggcccctcgtgccaggacttctgaaggttgtgcctgactcacgtctccattctcgacccattaaagggggagcggagatcgtgcttcccaagggaccctgaggccttctctctaggtctgagaagtgggaagtcccccattgggagtggaaggccaaggccacagcactgccgtcatgcgctccagagaaaggtcacctgccacccttctgtgtgcttacatgtctgtcaggacagcccggctccggccatgccctttgcacatcccggcctcctgggaacgcggagaacttcgtgcctgctgtccagttcttggcatccgggagctccagctggcatgaaggcagaaagaataacagccagtggcagtggaaggcatgagcgcccccggagagcagggccagaccatcagcagggcccctccaagaggagctctgtatgccgggggagtgggctcggcccgcgggacaaggctgaaagagctccccagacccctctctgaagacagcctctgcaatctccggccttcccgcagttgcccgcgtactttcttcattcctcaaaggtctcattaatttacagtctaagtggaccaagagagatgttacatatgttaccaggaagctagcatgttcattaattaatttctgtctagtcatccaatatttattgagtccttaagtctgaggcattataatagttactgctgtggggtcatacagataaataagacatggttcctatttctcagactcatcacccactggtaagacagccaccgatggaaacgactccaatcgactggaaaatagagaggaaattcctttggaatttaggggaaagaataagacttttggctggggtgtcagatattcgcttataggagcaatttcttctcagctgcatggcaccaccagggaccaggccccggggccagtccagatatctgcagtgttagcgagagacgctgttgacccttcttggcttatcatggaactgaatttccttaggttcagttggtagctaccctcgccccatcatgccgcggtgacactgcagccactcttggtttctcggctgccgcaatcggtcattccaatgtccgacctctggggccctcagacccccaaacccaccttgtcactctggcttctccgcctcctgcagctcctgctctgtgtttgggaacgcgtgcggcccacaggacaaagccttgttgcacacccgggtcaagggcaaatcccagctgcacagccgggtgatccagcggccgaccctgcttccctgcgtaggaggcctgagccaaggacactgcggccccggctgcaccgatgcatgggtgtgcacgcggggaccgagggagtcacgtgaatcatgtggcttccacgagctacctcttcccacaccaggagcaggtgccctcgtctccatcaagcgctttctggggagaaactccttcaaggataacggcaaatggtgagcgtgcctcactctttataatagaaattacaaaaagatggagaaacaggcagaatcccacccattcctgtggcaaagccgagaccctcatttccagtctttctgggacagcggagccctgggcaggggacaccgtgtgactggctctagctctcctaaaacacgggacgcaggagtgtttcttaagtgtgacaaggtgaaagcccctcgcgagttgaggaaggtctcattacttctgacagaggccccatgttggggaggtaggtgtgggggctcggggaggtgtcaggacagcgggatggacgtgggtccacagagctgactatcacagccgctcaggatgcagccgtggtgtgtgtgctctggcctattttaggtacagatataaaacagaagacttcggggcaaaaggaagtcttagaaaaatataaaggaatagaaagaaacagctgttccccggcacagaaaattcctgctaagaacacacaacgggcacggtgtaggcccattagtgttgctctgggtgctgcatccacaagggagatttgcttcttcagaaatgtcaggggtgcctggtctgcaaggggcttccctcgtcggaaagtctcccatccacatcccttcatgtgccatgttcgcatcatgagcaatgttgtaatgaacagccacgcacttcattctttgcacatctcaaagaattgtgtccttaggatgaagtgtcaggggacgagtgtccatgccaaagcatctccacacgtcgagagcttcggatgtgcacagctgcgttgcctcctgactgtcagccgagcccagcgtcccaccagcaggagccacagcaccgctgtctgttcccaccgatgcccagtgtcagcgtccactgagtcgcagctcccctctacactgggtgtgcccgagcttgctgcatgggaggaaggtggctgatggcaagggtgtgtgtctcgacactgtggctgcagcacggtttcctcacagatgtttggggagaggctgagaggacctgcctgccctggagagccgggtttctgcctagggctcctcctgtgctcctgctcccaccccaggggcctggggctcccgctggaggatggtggctttgcagacccttccattttattcatcgtgttacagagcattctaaacctccttccttctagagtagaggctcaggggttaagggatatgtgtcttcaaacgagaacacttcattcaacagacttttcccgaagaccacgtgctgtgcgcagcctgacatgtggtgctcggccgcaaaagcgcttcagtctcgccccccacccccggagcagccaccaaccaagaaacattgtctgtatctggcagcatttggtccctgtcatgaggttacagtgagcccctggcccccaccctcacgtgtctgtgaggtcagctccccacgccctggtcctccccacctgcgaggaggctcgtggcacccacttcacggctggtgggaagacgggtgagaccacgtgtgccatgtgcctcatatgctgcctggcatattttgggtgctcacgaatgctgactgcagcctggcattgggaagggagtgatcccgccagggaggggaggcctgacagaagacatggtctctcagggggggtcctgatgtcatgtcagatggagccagggccaggggcagggcgggggtgcaggggctctcgaggcagaacctgggacccagcgcccatgtcggtgcagttgggaaaggtgcgtggctcccgtgggtggtgcagacgagcagtgaatgaagatgaagctggagtggcagcttggcccagatcctggaggctttgcgtttgcactgaaatgtgtggacttgacgccagaagcaactcctgcgtggcccgagtgtgggcctgggcggccctccattcctcggcagggcactgcctatcgcagcatccaggtgcagccgggggggacaggggtgaggagggaaggaggcatgagtgccagcctccccacacctgggagagcagcctagagaggagtagagggcagcaggggcccagtctgtcatccagagaggcaagggagaaggcaggggtgagcgaggcggtgcagggtggggctctgctcccacgggttcgatgtggggccatgcttggtggtggggccaggctgtgtcacctgtgaggtcacccctgttcctggcacctggtaggtcactgaatcaacagcccaccgccagcagggcagggcgatgcattttgcgtccctggctcaactgcagagtttcgttaccatttcccggaaacccagactctcaccaatgcagatggtctcctagctatttttaatgagggaagatttgttggaagcacaaaattgaattaagtcacattcagaaattctccttcaaagaggaactcacacagtcaagctgagaaagccagcatctgaggatagcggagctgctctgtggtgaacatagaatgtggggccctgacggactgtccccttgccctgacgcctctcctggcctctgcccccacactctggcaccagaatgtccacggggacagctctggtctggcctggcctgagctgcaggctctcctgtcacagcactggctgaatgcctcccctggtgtcccctggcctttccccggctggccacctgtcccccactgagctcacggcttctccctgaaccagcttctactccagtcccaaaccagctccacactgtggctctcggccccgtgcccctctccccacaccagcatgtcactgcgctcgccggctgtgttcccaagcactttctccctcctctcctttctctaccacagcccaggccttcctcacctcatgctcttcacccatccacctgtccatccttgtccccggagacgctgtcatcccacccaagtgacctgccagccactgtggaagttctatgcactgcagatgttaaacgtgaggctttttcctactcagggatgtgcagtcaaattggtgctcagatggagtctgatgaaaggcaagctctggaaggaacacggaccctgagcaagtgtgagagacgtaagccagcaatgaagccatgccccaaagcgaatccaccaccatccaattcccgctcatacacagcaggccagaaagacttccacgctgcacacaacgctcagagcagaacgtctgggaatcaatctatccaaatttgatttaatttatgtggaatttagagacctgagacctgttgatttatgtagaatttaggcttcccccgtctgaatcgcgctggtgtatctggaatttaggcttcccccgtctgaattgtgctggtgtatctggaatttaggcttcccccgtctgaagtgtgctggtgtgggtggaatttaggcttcccccatctgaatcgcgctggtgtatctggaatttaggcttccctcgtctgaattgtgctggtgtgggtggaatttaggcttcccccgtctgaattgcgctggtttacgtgacatttaggctacccccacctgaaacacatttatttgcagacgcttgcttacaaatagcagcctgaaactgttcattttctcttgtaattcacaaataaaacaggaattacgaacataaaacttctataatcaaacgggtaaggatattagccatcaggtcactgaaagctttgtttgtctattattggagccaatttcctggttaaatttactttacattttgatatgtattcagttctcagataaacacactatggaggttcctcagtgtatgatggggttacatcatggggttacatcccaatgaacccggtgcaagtcgaaatgtgctaggttagagacgtactggatccatataacctgctgagcatcacagctcagcccagcctgccttacgtgtgctcagaacactcatgcaagcctgcagctgggcgaaaccatctctcacaaagcctgtttatgataaagtgctgaagatatcaggccatttcttgactactgccctgaaagtgaataacagcgtagttgggtgagcactcagagtacagtttcacaccactgtaaagtgagaaatactaagtccaaccatcctgaggcggggaccatctgtgtattgttgagtctgctttccatgaatcatgcttcttcttacatgataaatttaaagtaaattaaaaggcatgcattacatgttaaatgggacagagtcaatatctggcttgaaatattatcaatattttaaagataatattaactaaattttataaccttaaaaatgtactgatctgaaataaaattctcgtgtccttaaaaataacctgctttttcccatactaaacaaaaataaactgacttttaaaaaacctgtgggggaaaggacggtttcctcaacaggtggttctgggagaactggatatctacacgcagaggagtgagccagaccctcgcctcccaggagaactggatatccacacgcagaggactgcggccagaccctcgcctcccaggagaactggatatccacatgcagaggagtgagccagaccctggcctcccaggagaactggatacctacacccagaggagtgtggccagaccctcgcctcccaggagaactggatatctacacacagaggagtgtggccagaccctcgcctcccaggagaactggatatctacacacagaggagtgagccagaccctcgcctcccaggagaactggatatccacatgcagaggagtgagccagaccctcacctcccaggagaactggatatccacacgcagaggacggcggccagaccctcacctcccaggagaactggatatccacacgcagaggagtgagccagaccctcgcctcccaggagaactggatacctacacccagaggagtgtggccataccctcgcctcccaggagaactggatatctacacacagaggagtgagccagaccctcgcctcccaggagaactggatatccacatgcagaggagtgagccagaccctcacctcccaggagaactggatatccacacgcagaggactgcggccagaccctcacctcccaggagaactggatatccacacgcagaggagtgagccagaccctcgcctcccaggagaactggatatccacacgcagaggagtgaaccagaccctcgcctcccaggagaactggatatccacacgcagaggagtgagccagaccctcgcctcccaggagaactggatatccacatgcagaggagtgagccagaccctcgcctcccaggagaactggatatccacacgcagaggagtgtggccagaccctcgcctcccaggagaactggatatccacacgcagaggagtgtggccagaccctcacctcccaggaaaactggatatccacatgcagaggaatgagccagactctcgcctcccaggaaaactggatatccacatgcagaggaatgagccagactctcgcctcccaggagaactggatatccacacgcagaggagtgtggccagaccctcacctcccaggaaaactggatatccacatgcagaggaatgagccagaccctcgcctcccaggagaactggatatccacacgcagaggagtgtggccataccctcgcctcccaggagaactggatatccacacgcagaggagtgtggccagaccctcgcctcccaggaaaactggatatccacacgcagaggagtgagccagaccgtcacctcccacccgagcgtgcgctgactcacagcgaatagcagagtggctggacgcacacttggccagaacatacatgaactcagagctaaatgtgagacctaaaacatacagggcaagacctttatgacattggatttggccacgatttcctggatataacaccaaaaacacaggcacaaaagaaaaaaatagataaattgggtttgatgacactcaaaacgtttgtgcgtcaaagcgcaccatccagagagcgaaaagacaacccatataaagggggaaaagatttgcgaatcaaattgcagtgggggattaatatccagaacatgtaggaaacttccacaactcaactacaataacgatggaaaaccatctcgttcagaaaacacaaagtacttgaacacatgtttctccaaagaagacacacaaatgacctcaggcacaggcagaggcgcttggcgtcaccaaaatcattggggaagcatgattcctcagtgcaattccacctcatgccatgtgcgtgactcttaccgaaaaaaacagaaagtaacaggtgctggtgagaaggcagagagatgggaacactgcgctattgcagcagctagggagaacagggtggcggttcctcagagttagaaatggaattcccataggagccggcagccctatgtctgggtgtccatggagaacaactgaaagcagggtcttgaagaggtatttgcacgccaggttcacagcaactttatgacagcagccaaagggtggatgcaaggccagcatctgtggacggatggacagaggagcaaaatgtggtccatccacactgacagatgtcaccagccctaagaggagggggtgcagacatatggcataacatggggagtcctgaggacatgtgcccagtgaaataagccagtcaccaaaggacacatacagcacaacacagggaaccctggggacactgcccagtgaaagaagccatcactagaggacacagactgtgtgattccacttgtgtgaggtccctggagtcatcaaactcagagacagagggtagagtgggctgccggggtggggggaggaacaggggtcagtgtttactggggacagagttccagtttgggatgatggaaggttctggaaatgggtggtggagatgctcgcacaacgttgtgaacacatacaatgctaagaggcgtgcacctaaaaacggttaggacgatccattttctgttttgtgtcgtttacgtaactatgagattctgtattactgagaaaaaggcttgagagaaccagaagtgtcacgtaaagtgtgaggcgtgagccgtgagcagtgattgagcccagacccccgcgaccagctctgctgctggccctgcctgaagctgcagcagcccctgcccttggacccctgagtctgtggggcctgcactgctgcatctctggctgccctgtgcccagaaacccaccctccatccttccacactcagagcctcctcccagctgagcaccctcccctctgctatggggcatctgtgggccccccagctcccaccctgcagacgtctgtgggctctgcctctcccgtctacacctggaggcccagaggggctcctgagggccacctggtacccggtgggtacccagcgagggtctggcaaggaggtcagctcagctgggcagacacatgcagcccggaggcctggggtgtccgggtcccacgaagccaggagaacacagatggggccgactctgccgcgcggtctcctcactgtgcttcctgcaatcatgccttgtacagcctcctgacaggccaccctcagccccatgtggccagcagcaagggctgctgttgcaccccaagcctctccgtctaggggaagaaggcgcgtgaagatctttctcagaaaggacaagcccacagcatctgcgtcggtgcctcctgcctctgacagggctcctggcgcccatggcggctggggtttcacgggggcgaggggctgggccacacttgtctgcatcccggggcccttggctcagtggacaaaacagctttaaagttcaaggataactcaaattggattttagaaatacaaagtcttaaaacatttgtaccagactaagggattacactcttaacttatccacagaaaggcttttgaagaggtggggaaaggtagctcagattttaaattggggcctcaaaacctgcctgtctgcggctccttcctttgcctggctgctattatcaaaaggtaaaatgtcttagactattgaaaaaaggatttgcataaattgcttttacctgcttcttatatgaggttaatgaaattggaacaaaaaggaatgaattcccaatcccagaccagaacctcaaatcccccagaagagacttccatgagccccactgagcccaggcatgaagaactctttctctgggtccaggagtggcaccaccttaatcagctctcctcataaatgtcccaaggagaccaggaaacagcctcgagggagacggcgctgacccggggccaggggagtttggctcacgtgatccagtcacacagaggtcggtcgttgtctggacacagacaatgggaatctgggctgataccgggcctttgaaaatagtcggggaggaaaacagaaaagatgcagaagttgataattgctttgatatacccatctctgtttttttttttggacagaattcctattaaatacaatatagagtatttcattttctgcatctgcccatctttgaatcttcatgtatttttaaaaaagaatgaatttaaaactctaatccacttggcccagatttgttttgggaggcaggtgggaacccatgagctgtcttgagcacagtggctggagtctgtgcggtggctggaaccctgggctctggagggctggatgccttcaggtcccggaccccccactctgctcccgtggacagctccatcttcagcagctccgtgcatagggactcctgggaagacttctctttgaggaaatgtttccgctgctaaaatgcaaagttccccgaaggcaggtgggcactgtgctggtgctgtccgagtggagcctctggtgagccggacaccatcaaacaacatcagagcttgcaaaaggagctctgcagtgcctgagacctgcaaagggccatcctggggtccgagggcttcctggtcctgacccagtcctgcagggaggtcctgggagggtcgctagggtgaggacgctgagagcccatgtgctggaaaggacccaggaagagggctgaggtctcacgcctggcagagatggtgcccaggtagtgactgcaccacacccataagggccacctgctggccacgtggaggacggggagcggcaggcggatgagggaaggaccgtccatttgactgggccacaggtgtttagattaaacctgatccacgtgtgtctgtgagtgtgactcggaggagtccagcattggattcagtgggccaggaacagggcattcttctctccagggagcagaaaccacaagatagacatggcccattgtgctcgagggtcactttcattggaagatttagagaaaatgatttttatacaataacgatatgggcttatagggtaaagtccacattcgcataaaattttaaccaagtagggacagagcctggcaattctgggttctgagacccctggggatggcacctgagtcccactcaggccaccacccctgcccccccccgggcactcggggtgaagctgtgtcactgtggctggacacatgtcctggaatcagagttgctctttaactgtgtctggctttaaggctcgtcttctacgccagacaaagtaaacttcctggaactgttttttgaaatgtggctactgtcctttcctcttctagaaaaacgaggatgaggagccaaaacagaggagggtgtcgcaagcggcagacatttgaaagcagcttaagcccctgagccccctttctggggttcctgggcaagaggtcgcacgcctggccgaggtggtgccccaggggtgacagcggttgccctcctgtatggcacaactgaaaataaaggctgggccatttccccctccatctgccaaaatcccattactgaggttgtcaaaatgcttcaacctctcttaaaatgcagtgagattgcttcacgatgaagggtatgaccaagtggaattgtacacggtatagttaggaggtgatgatgaccacagtggggtctttaaaacagtgcacggcccgcctaggggacagagccggccctcccaacacttccccgctacagaggcgttctgtggccccggggctgctccccgcctgggcacatggcggagacatgcaagccacaggggagggctctgacctcggcgtggctcccgccagggacctggcagctcttccgcttgttctctctctcattcctcatggggactgcactaggactttccccttctccccaactccccacccaatgccccctcttttgtggcaggtgagctcacgtcctgctctgaagagaaaatggaggtgccacacgtggtctcctgaactcccagccctggacgagggggtcctgtctcattcaagtaaaccccctgcagttcccagcagccttaggacagcaggctcctttacgacttcacctctgcgctgcccccactgagaagctcctgctaacctcgtccagttgtcaaatcacttcttagcatgcaaaaccttgcccgcatatcagctgctctgccaagcccaccctgagttccgaggaaggtaatcgaggtgccttcctgaaggtctgcaccaggcagaaagccctgttacagcctagttgcatcgtgtgacaactgcctgctcataatgtgaactctgcggtgactagaaccgtatctggcatatggcagacattcagtacaaaacccatggacagaacaaataagtaagtccagaggtctccctggggacagggcctgtgttactcttccttcccacgcgcccagcacagttaccctttcccgtcccatgcgcccagcacagttaccctttcccgtcccatgcgcccagcacagttaccctttcccgtcccatgcgcccagcacagttactcttttccaccccatgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttactcttttccaccccatgcgcccagcacagttacccttttccgccccatgcgcccagcacagttacccttttccgccccatgcgcccagcacagttactcttttccgccccatgcgcccagcacagttactctttcccgtcccatgcgcccagcacagttaccctttcccgtcccatgcgcccagcacagttaccctttcccgtcccatgcgcccagcacagttaccctttcccgtcccatggcccagcacagttacccttttccgccccatggcccagcacagttactcttttccaccccatgcgcccagcacagttaccctttcccgtcccacgcgcccagcacagttactcttttccgccccatgcgcccagcacagttaccctttcccgtcccatgcgcccagcacagttacccttttccgccccacgcgcccagcacagttactctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacacgcccagcacagttacccttttccaccccacgcgcccagcacagttacccttttccgccccatgcgcccagcacagttacccttttccgccccatgcgcccagcacagttacccttttccgtcccatgcgcccagcacagttaccctttcccgtcccatgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttaccctttcccgtcccacgcgcccagcacagttactcttttccgtcccacgcgcccagcacagttactcttccgtcccacgcgcccagcacagttaccctttcccgtcccacgcgcccagcacagttactcttttccgtcccatgcgcccagcacagttactctttcccgtcccatgcgcccagcacagttaccctttcccgtcccatgcgcccagcacagttaccctttcccgtcccatgcgcccagcacagttaccctttcccgtcccaggcgcccagcacagttaccctttcccgtcccacgcgcccagcacagttacccttttccgtcccacgcgcccagcacagttactcttccgtcccatgcgcccagcacagttactctttcccgtcccaggcgcccagcacagttactctttcccgtcccaggcgcccagcacagttaccctttcccgtcccatgcgcccagcacagttaccctttcccgtcccacgcgcccagcacagttactcttttccgtcccacgcgcccagcacagttactcttccgtcccatgcgcccagcacagttaccctttcccgtcccacgcgcccagcacagttactcttttccgtcccatgcgcccagcacagttactcttttccgtcccatgcgcccagcacagttacccttccaccccatgcgcccagcacagttactcttttccgtcccatgcgcccagcacagttactcttttccgccccatgcgcccagcacagttactcttttccgtcccatgcgcccagcacagttactctttgccgtcccatgcgcccagcacagttactctttgccgtcccatgcgcccagcacagttaccctttcccgtcccatgcgcccagcacagttaccctttcccgtcccatgcgcccagcacagttaccctttcccgtcccatgcgcccagcacagttaccctttcccgtcccatgcgcccagcacagttaccctttcccgtcccatgcgcccagcacagttaccctttcccgtcccaggcgcccagcacagttaccctttcccgtcccacgcgcccagcacagttactcttttccgtcccacgcgcccagcacagttactcttccgtcccatgcgcccagcacagttactcttttccgtcccatgcgcccagcacagttacccttttccgtcccaggcgcccagcacagttaccctttcccgtcccatgcgcccagcacagttaccctttcccgtcccatgcgcccagcacagttacccttttccgtcccatgcgcccagcacagttaccctttcccgtcccatgcgcccagcacagttacccttttccgtcccatgcacccagcacagttaccctttcccgtcccatgcgcccagcacagttaccctttcccgtcccaggcgcccagcacagttactcttttccaccccatgcacccagcacagttactcttttccgtcccatgcgcccagcacagttactcttccaccccatgctcccagcacactcttccgtcccatgtgcccagtgcagtcttccgtcccatgcgcccagtgcagttactcttccgtcccatgcacccagcgcagttactcttttccattccatgcacccagcacagtcataggcttccagggtaggtactgtcaatgtttgttccaggaaaacccaattcagcttttcaaacaagatttatacacaccttcaggagcaagcatgcttgaatataatgagtctacctttaaggtaaatttcagctctttgggtttgtaatggatggaaaaaggcaggcaaagaaacaatttcaacatcttccagccccagagatgtacaaatattttagcaacatcccagtgactaaatggtgattcagccgagacgccccaaataaacagtctctattcttaactctgctcccatcttactgaagcgttacaaggctgtacttacatctggggtcaagccattctcatttggcttcgaaatgataacacaaaactgttacaataacctggaactgtaagggtcctggggatcccacattcagtcccacccgtgtcatggatgaacccgggaccagcagggcagccagccagaggcaaacccacaccaggacctggcgctcggccatgtgcctgcgttttccaatattgatgtcgacgtgggaggcaagttgctatggaggaaacgcgcacacacatctgagattattaaatagcagccgctaactgcctcgatgcaggagtcccatctccccaaacaaattctggctgtgatgccaactgcagcaggacggttagtggtgccgctggcaccgagagcacctggcctggtggacctgtctcccagacctgctggggagcgccgtgtgctcagctgaacacggctcctgtggccacagtcctgtgttgctcccgtggttcggccggcgaagctccgtgttcatgtgcacagccacattggccattttgacccaacagacactcaagcaactcttgcgtgaatttggtgggaagatccatcgaatgtattgtttttggactaacctgatgagtccctttggtaaagcagtcccactgactatgcctgtggacccagctgggtgcagccatctctgactgtatggtgtccatcctgagctccaagtcatcagagagcggccaggagtgcatctgactttgctggtgacctgcatcttatctgcgtccacactcaactgtgtgcagcggcccaggaaggtggagggctgctgagctgctttagaaaatgagggtttgaagctgccctttggaaatgattaggttgttcaaaagtaattgagctttctcaaaaggcagctggggctaaaataaatggaagtctacttaacatattgttaaaaatatgaaggggttgaatggcatcaaaacacattaaatgacagaacatgactcgcctccttggctggattctaaactcctcggggcaggcgctttctttagtgacactctcagtgttgtttgtgggagacgctccgcaaatgtggggagcaggtgggcgcctttggtccccgtcctcctggcaggcagtggctgagtaccttctcgggaaaggaggcccccgtgaggctgggtgggctctgaattcccggtgtgttgatagcgatcggcacatgcctcaagccacctggaagagaagctgccccaagattctccaggccctttctgagctgaaggtgacgtgacagacaggcttcaaagaagggtcagagacggccggtgggtgggccccgttcccaaacacccaccttggatctcatgccctggagcagagcatgtgtcctggtcctgcctgggcgaggccggcacccgctgccctagcttcaccactggtagccccaagcatctctggctggggatacatcacccgatcacaccagcccgagaaccttccctttcccaccaccattcaaaggaggctgctcttagccagaaggcctctgtgttccaggcttaaatctgggcgagattcagggtttaactctggccttgcagttttagaggttgttataggctgaattgtgaccccccaaatccatccattgaagctctgatccccatgtgcctatatttggagacaggacctccaaggagctaattaaggttcaatgaggccaaaagggcggccccgatcctacaggactggtgtccttacaagaagagtgagagacaccccgtgcctgcaccagggaaaggccgtgtgaggacatggggagaagatgctgtccacaagcccgggagagaggtcacaggaagaaccgcccccacccccgccgccccccacagcttggtctgggactgtcagagctgtgagaacagacgtgtcctgcagtttaatgcacccagtctgtggtcctgggcacggccacccgtgatgacttacacacagatgcacgcagacggcttggggagcatggccagtgcttgtcttagtgtgggaggcttggtgtccgcccctggccacggagtctcgtgtctcctgctctttcgtggacggcgctcacctacatcttacatgcaggtccctccatgttgagtgaaaaaatcagaggaggtacaatcccaccagtgcccggctggacacatattggttttggagccaaggggtaacagtttccctctacaaatgaaaagctcctctccgtcctggtgggatggggatgacatttttaaagggtagagtaaatgtgctcctgcttcaggtgccctttgcagaggcttcccgagtctcccgggggcaatgcatcttctcagtaagaagaaaccccagcaagaaatcacaccaggcgtcttggataaacagaagtgaactacgtcctggttgcagctgtatttatttcacacattcatttaaaaagttaatttgacatgtatttcatgaagcttcggtacacacgccacgttgctccccgattttatcttcatgcgtcttccttcaccagacggcctggcgagctcactctcctgtctgagggctgagaagcccaagctcgccccagactggggcctgtgtggacgcggcccccagcagtgttcctgtgtccgtggtttggaggctctgttcgctgagcctcagcacgacctcaacctgatctgggagtctgagtgcgctgggcttggagggcacgtgtgctgtgagtgagccctacatgcaggagcatggtgctctctggccgggcagcctcacctccagtggaagctaagcgttgtgcccgggcagggggcgcaggcaggagggctgagcttccctggttatcccctgaggcgaggacgcagcagcaagttcccatcccctggcctggcttctctgggcccaggcgctcccattcgtactcacggtcctgagttgagctccagagtgttcccctacagggaggggtttgctttccccagaatggggcctgggcgtggcagcccctccacagaggaagggccctggtcctcgggagcatttacagcatcgtgggtgccggctggggcgccagccaccaaggccacaaggccggcttagaaggtctggaagagcctgactaggaattaggatgctgtgcgttaatctgcaaataccacccccgatgcggggaggacctggtgtctgggcgggggaggaggctccgaggggctcttgctgccttggccagacctgcagcagcagggacagaggctcccgggaatgcctgggtcagaagagagggctctgccactcacccctcctctcttctcatccatctcctggtgccccaaagggcctcactgttcctgtggagagctgttattttgaaattatatcttgtcatgaaagtttcacttttaaacactattaaggcctctcggtattatacttcttttgaaacatctattagaataaggatctcacaggcagctgagaatcaacaggaatgtggccgtacacaataagctccacgtgacccagggggacgtatctgtgtgctctgggaaggctgacatttcaacattcctggcgtctgaattcgacatctctcccaccaccgggaaggaggcgccccagaggggagggaggtgctggggagcgggattgagagcctgatactggcgtgaagttcatcagcagaggagcgaagggaggagggcagggtcaagaccagggactcatggaagcatttggcatcctgtgaagtttctcagcctctggaggctcctctctgatgggagccttatccgagaggtgggtgggagggacgcaggctgccggtgctggtcccgggttgtttgtggtgcagccagcggctggtcactcacatgcagactgagctgacgcttaggacaaaatccatgttttttcattttgaataaaatcactcgatatttgacattttaggcattgaagtcgtcatcacggctcatcacaggagaaatcagagctctgtgctgttgtttctggatacgtgcttgttttagggttttgtatgtattatttcagagctccgtgctgtttctggacacgtgttttagggttttgtatgtattatttctagttccatgaaggggtaggggcatcatgtccttaggatgctcacaggtcaaattagggctgtcccaccagccacccacacatccccagcgactttggtttggaggaagatggaaaagagtcaggagagaggggtgcagcccaggagacagagcacctggaaggatttgattttaagatttaacttcgcattaggggttttcttcataggctcctgcaattcagatagtatctttattccaaggagctttgagtggtttctgcatcagttttcatttcttgttcccaaatctctgtgacatagggagacaggcctttctctaaaacccactgcagacatgaagagccacagccgggggggactcacccaaggtcacacggttaatcctccatgttccggagattaaagcaaactccatggctctcagtctcgtctgaaacttcatgcctctgaattgcccctgaattacccacataacagcagctggacacaaatataagcagcagcagatgtgatgttggctgggacagccgagggaaactggtaaaatgcctcttcttcctgactactctctcaccccggcatctgcctccagagtctcgcagcctttggagatgggtttgcggcccaggggcaccttcgttgtagcttattcgtctatgaggggaggaaaagatggtctcctgtaaaaaatgttaaagtgccagcaagaaattgagggtagtatcttggagtgttgtgagaagagccgtcctgagttctgacggtcaccatacaggcagagtgacacctgtgccttcagctgccccgaggtcaactcaatgccaactgccatctgggactcttggagagctctttctccccaggtgtgaccagacaaggttgttatggaatcaaataccaaattatggcagatgctaatttcagtcatcttgcacacagatcagccctggggtcaccatactgtgtttttgggacactccaagatggatgtgctttggttctgacggcagagaacaggacacctcccaaggtgaccgcaaggaggcctgagctcctgggccgctcattccaccccctctgcgtgctcacgcatggctccccagcaagacagagcagctttcctctgacctcttcctcttccagaagccagagccagccagggttcagggagagcggaatcactgggactgtatggagtttccacttttagcacagctggatcttttcattaatttttttatatctacatgggtttaactgtacattatattgtgcttttttattgctgattcggccagcaggaccccttcctccatatgccttttatcactttatttaaccgtgttgtacacatacacccactttgctttgtatatggtgagctaccttaatgccattgcccagatgcagatttgttattatgtatacattgttaaatttaacactttccttggtggatcaggttcctgtagggcacagaacactaacctatcaatgacccagactcagaaaagccaccagagaaccagcaaggtcaaattgcttcggcttcagctccggaacatcgtctccctccgtccacggcaacgcgggagcctgaccagctccggaacatcgtctccctccatccacggcaaggcagggggagcctcaccagctccggaaccccgtctccctccgtccacggcaacgcgggagcctgaccagctccggaaccctgtctccctctgtccacggggtgacttcatgctgccatggccatcacctgggttgggggtgggtagtgcccagggcaggggaaacacacagagcaactgaaatattgtcgtctttccccagagagggctccaaggagtggcgggagcttctcagaggctcctaatcaatgctttttcttttaaacaatccacgagctaatgagagggtggagaatcccatcccgatgggcactggcttctttccagcaagcctcggaatcacctcagtgcccctggcccacgggatcccaggaatcaagttctgatggatttgtaagcagattcgttcttcagattataattagagccgctctctctccccgcctttttgaaagttcccattagcctgagcaagggccaaaatattattggaaaacccatgggccactttgttccctctgtaccacaggttaaaaccctatttactttgtcagagaggaaaaaataatcaaataaactctccatttcagatgctactgaaacgagcaacaagggaaggggggagatgatgctcatgtgatttggaggccaaaggtgcttctaactcacagtcggagccaccccacgcctccttccacaggctccatgacggcaaaggccctgtccaccagccctatggaaaagagcctggctccagcacctttcctgggacttgatttcctcactttttaaaatgacttgccaatcaattatcaattgataatgactactgattgcaacatatctttagtaagtaaaatgaaaggtgtgtcttactactgctggctgtttccggccaacaagcccaagactgagaattggtgaaggaaggcattgcctgtggacctccctcccatgggtgcccggcctgctcttagtcccccactgaaggctcttcggcacctagagccccatcatcccttccccgtgtgtttgctaacgctgttcatcttgtctaggatgcttctcctccatcaaaaccacttcaagaatcagtccctcctggaaccctccccggagacgctctcttcctcacctctctctggacatttgcaggaagaagcaagacccgtccacatgacccatgcacgattcagtggctctcctccctctgggaggtcagttttactggttgtacgtggagtcctctaagctatgagggaagaaggggacaactgtttggccaaaccatagtctctgtggcccttgggaagaaggatgttgtggacactgcacctggcatctcctgggcttctgtcctctctcagctttgctcttcatgtccccggcatttttaactcctagctcagttacttctctgctcatctttcctcttagacttggggtccttgagggccagctctatgtctggttcatctttgcattctccatcagattgcagaagttgtgtcaacgacgaaccaataaatgaatgtgtgcagtcgggtgtggcagggaccaacaatctgaccagcgctctttctgtgtggatggtctggccctgtgttgacaaacacctaaataatccagcacgattcccttctagatgtatctctctacggtgactgagtgtgctcaatgcttacaactaggctttttccaatcacctgtaactcatgtgaatgtggtcactgatttgagcatcaaaagggccaaagttatcgagggcttttgcatatgtagatggagaacaggtgactggggtaacgcgttatttacctgtatttagatgggcagtctccagatgtttttaaacaggtgactggggtaaccagctacttaactgtatttagacggggcagtctccagagatttttgaaaaggaagaaggaagtaaattcagttacttggatacaagtaggacagaaaatattcctttgagattgtgagggtatttattcattgaacagttttagaggtacagagagactacttgatgagctgacttctgtttttttttttttttccagaagtgggtatctaggtttgctgattgctggagtaaacgatgaatgtggatggcagggcagcattttggaggtgaagccatctgcagatgcgtgtaccccacgagggtgagaagctccaagcacacccagaatctagggtgggggactgttcgcctgagcagcaccaactccatctcaagatgtgtgtctgctgtctgttgctgttctttgtttgagctttgaactcctcacataaccccttaactgtcctcttgatcttttattcatgagcttgacacattgggcagaaagacacagtctcagtgagatgataccaacttggagcttagtttcttcttcctaataccttttgcttgtaattccaaagtattgatattaaatactcataagtagccaaggaagaggaccatcccactactcagtttaatctgtcttgaaaatgcttcggtattgcatgaacgtgatgcatgatccaacccaatgctctgtgctaaggctgtgcttgtgttatctgtggtgaagagaaccttgtaatgaatggaccactcactgagccaggctgtgcttgtgttatctgtggtggagagaaccttgtaatgaacggaccactcactgagcctgggcagctccctgcatctgacttctggagagttctagagatactcacaggtcaggaggtctcttggggtgagggcaggggaggcagctctgggaaccgaccatcagcaaaggtcagagacttagatgcccatccagtgggttcgaatgtcagccgccttccacagcgaggtctggtaatgggcttggacctgcctgaatcctcctggctaagctgtggagtggagccaggagtgctgtctgctcacggtgggaccagcctgcaatcggtgcggcgggctatgcttagggcctaagaattaggcttcccacctgccagcgatacaggcacgggataggccacattaccctgcttttgtgactcatccttcctccatttaagtgggacccacacttgtggctgggataacaatttccaggttggctgagttgggctcctggcaagccatggctgggatagctatctccaggttggctgagttgggctcctggcaagccatggctgggatagctatctccgggttggctgagttaggttcctggcaaggccatggctggggtaacgatctccaggttggctgagctgggcttctggcaagtccgtggctgggatagctatctctgggttggctgagttgggctctcggcaaggctgtggctgggataacaatctccaggttggctgagctgggcttctggcaaggccgtggctgggatagttatttccaggttggctgaattaggttcctggcatggctgtgaaagtgctgccccatttctttgccaccagccacggaagtcgcagctccctgtgtcctctttgcacgttgcatgtgtcgtggtgggagctgtgaggcggtgccgtgacggggcgatgctgctgcaggagacgtgctccggggcacgactctgacgcagcttagaagagctaatgcttgacaccatctggatccccttcatgctttctgtttttatgggaagtcctaattcaacacatgtttcctgaggtgctactacgtgctaggttactgggtacagcaagaccatggaggaatcagagcgtaaacaagcgggcgcgaggtggtccaggcatggagggcacagaagccgtgatgctggggtgggctgggggtcagctggcctcaacggggtgaacacagcagctctcccagacatcgaaggagattcaaggagcctgaaactcaaacaagtggaagaggctggaacgtcacctaaggtgataggaactggggacccgacctggcgcccgttcaacagacccaagcctcccatcccagcatcgggccgtgatgtgccgtccattacacaacgatggaatctgctctgggaagaataaatggctctggtgagcatgctcagaattccattttaatattaaaaaatttaaaataattcttggtttaaaacacaaatagaggtataatatagtagccatctagaacctcaatttaagatatgagattgggtctgcttttgaattttagaaagtagtaagagtctgctgttttcatgtttaaatgtgtgaggcacttcagtaccatcagaacgtgtgcagaagacggaggatgtggaagggcccccaaggacaggtctgtctgcctggtggacactgagtgaggtggaggggaagccacagatccccactgtcctcatcactcaggcacatccaggctgatgaaaaagcaacagaatgggttcaaaggcctcttaccaaacgactcggggcttccctcagcccctgggtgttcacttcagccgcaccccagtcccccggcatctctgaggggccctgaggcgtgtcacctcactccccaccacccctcacttctgcctccatgaaatgtgggtccccttccaggcggcaccttccttacgaggactacgggtgtctgagaggcgcctctgagtccctatgccaccgcatctgggttgggtcacgatgctccccttgcacggagctaagatttatagaccgagacagctccaggagtggccaccccagcatttctcaggggaagaaatgaggatgaaagaggtggagctcgtacagtcagcaacggtggcccctgggcagaccctagagctcctggggccctgcccaggtccttctgtgtatgtctcagcccaggtcatcacagatccagccagtgatctgctggatgagaagcttctgcacggactcgtccaccctctcactgtaaacattgctccagacgaacgcaaggctgagagccgggggtggtctgcgggaggcaggcatgggggagaggacaggctgcgggaggcaggttgggggagaggacaggctgtgggaggcaggctcagggacagggcaggctcagggaggcaggctgggggagagggcaggctgcacaatgctgggctcctccgacaatgctcacctctcttctcccctccatttgcacctcagtcctgatatttatctccccaaaacgtctgggacactgggcagaggctgagtgagggtgccagcatctgcagggcaggctggaggccgctgctttgctctcaaatgtcagcatcttttgtaggctccagaaccgtgtggataaagcaaaacgctcacccaagaggaagctgatacagcagcaaagaccacccaacgatctggttcctacccatttccaggcagtcggtaaatgaaacctaacatgtttgacgcacgccctgatttgaccatcacaaagctccttctctggctgcaggatgcactcagcacgcacgccacaaacatggagatcacaggactccctacacaccatagtccatacagggccttgagtgtggagatcacaggcctcccctgcaccccacagtcctcacagggccctgagtgtggagatcacaggactccctgcaccccacagtcctcacagggccctgagtgtggagatcacaggactccctacaccccacagtcctccctacaccccacagtcctcacagggccaagagcatggagatcatgggcctccctacaccccacagtcctcatgggaccctgagcatgaagatcacgggcctcccctagaccccacagtcctcatgggaccctgagcatggagatcatgggcctccctacactccacagtccacatggggccaagagcatggagatcatgggcctcccctagaccctacagtcctcacggggccctgagcaaggagatcatgggattccctacaacccacagtcctcacggggccctgagcaaggagatcacgggactccccgcaccccacagtccacacggagccctgagtgtggagatcacgggactccctacaccctacagtactcacggggccctgagcaaggagatcacgggactccctgcaccccacagtccacacggggccctgagtgtgatcacgggactccctacaccccacagtcctcacggggccaagggcgtggagatcacgggcctccatacaccccacagtcctcacggtgccaacagcatagagatcacgggcctctatacaccccacagtcttcacggggccctgagtatggagatcacgggactgccctgcacccacagtcctcagcagtttctagagcagaagatgcccattaaaggcagatctcttccgttcagctgcctggtctgctgagcagttgagggggatggtgaggcagtgtgggaatccgcatgtgttgaggcctgcatccctgagctgcgggcagttgaggtgattctgaggcctgtgtccctgagctgtgggctgttgaggtgattctgaggcctgcgtccctgagctctgggctgtccgggtgattctgaggcctgcgtctctcagctgtgggctgttgaggcgattctgaggcctgtgtccctgagctgtgggctgttgaggtgattctgaggcctgcgtccctgagctgtggggtgtccgggtgattctgaggcctgcatctctgagctgtgggctgttgaggcgattctgaggcctgtgtccctgagctgtgggctgttgaggtgattctgaggcctgcgtccctgagctgtggggtgtgcgggtgattctgaggcctgcgtccctgagctgtgggctgttgaggtgattctgaggcctgcgtctctgagctgtggggtgtccgggtgattctgaggcctgcgtctctgagctgtggggtgtccgggtgattctgaggcctgcgtccctgagctgtggggtgtccgggtgattctgaggcctgcgtccctgagctgtgggctgttgaggtgattctgaggcctgcgtccctgagctttgggctgtccgggtgattctgaggcctgcgtccctgagctgtggggtgtccgcgtgattctgaggcctgcgtccctgagctgtggggtgtgcgggtgattctgaggcctgcgtccctgagctgtgggctgttgaggtgattctgaggcctgcgtctctgagctgtggggtgtccgggtgattctgaggcctgcgtctctgagctgtggggtgtgcgggtgattctgaggcctgcgtccctgagctgtgggctgttgaggtgattctgaggcctgcgtctctcagctgtgggctgttgaggtgattctgaggcctgcatctctgagctctgggctgtccgggtgattctgaggcctgcgtccctgagctgtgggctgttgaggtgattctgaggcctgcgtccctgagctttgggctgtccgggtgattctgaggcctgcgtccctgagctgtggggtgtccgggtgattctgaggcctgcgtccctgaggtgtggggtgtccgggcgattgtgaggcctgtgtccctgagctgcaggctgttgaggtgattctgaggcctgcgtctctgagctgtggggtgtccgggtgattctgaggcctgcgtccctgagctctgggctgtccgggtgattctgaggcctgcgtctctcagctgtgggctgttgaggtgattctgaggcctgcgtccctgagctgtctggtgtctgggtgattctgacccctgcgtctctgagctgtagggtgtctgggagattctgaggcctgcgtccctgagctgtgagctgttgaggtaattctgaggcctgcgtccctgaggtaggagctgcccgggtgattctgaggcctgcgtccctgagctgtggggtgtctgggggattctgaggcctgcatctctgagcagaggggtgtccgggcaattctgaggcctgcgtccctgagctgtgagctgcctgggtgattttgaggcctgcgtccctgagctgcggggtttctcggtaattctgaggcctgtgtccctgagctgtggggtgtctgggtgattctgaggcctgcgtccctgagctgcggagtgtctgggtgattcttaggtctgcgtctctgagctgtggggtgtccgggtgattctgaggcctgcgtccctgagctctggggtgtctgggtgattctgaggtctgcgtccctgagctgtgggctgttgacgtgattctgatgcctgcgtccctgagctgtgggctgttcaggtgattgtgaggcctgcgtctatgagctgtgggctgttgaggtgattctgaggcctgcgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctctgggctgtccgggtgattctgaggcctgcgtccctgagctgtgggctgttgaggtgattctgaggcctgcgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctctgggctgtccgggtgattctgaggcctgcgtccctgagctgtgggctgttgaggtgattctgaggcgtgcgtccctgagctgtgaactgcccgggtgattctgaggcctgcgtccctgaggtgcggggtgtctgggtgattctgaggcctgcgtccctgagctacaggctgttgaggtgattctgtggcctgtgtccctgagctgtggggtgtccgggtgattctgaggcctgcgtccctgagctacaggctgttgaggtgattctgtggcctgtgtccctgagctgtgggttgtctgggtgattctgaggcctgcgtccctgagctgcgggctgttgaggtgattctgaggcctgtgtccctgagctgcggggtgtctgggtgattctgaagcctgcggctgtgagctgtggggtgtctgagtgattctgcggcctgtgtctctgagctgtggggtgtccgggtgattctgaggcctgcgtccctgagctgcggggtgtcagggtgattctgaggcctgtgtccctgagctgtgagctgcccgggtgattctgaggcctgcgtccctgagctgcggggtgtgtgggtgattctgaggcctgcgtccctcagctgtggggtgcctgggtgattttgaggcctgcgtccctgagctgtgggctgttgaggtgattctgaggcctgtgtccctgcgctgtggggtgtctgggtgattctgaggcctgcatctctgagctgtggggtgtccgggtgattctgaggcctgtgtccccgagctgtgggctgttcacgtgattctgaggcctgtgtccctgagctgtagactgttcgggtgactctgaggcctgcttctctgtgctgtgggctccccaggggattctgagggctcttttgcttgtggcccttctgcttggcatgcatactcaggcctgcaacatagcacgtggtcctgatccttcttcgtaatgtgtattttactggttggttgcttgttgttcataatttttattatatcatcttttagagaatgctcgatttagagaaaaaaggatgagttttggaagcagccctaccaatgttctttctcttgtttcttgttgtgtggttttggccaaacgatcaaaacaatcaaatctctgggtcttggcttcccccacggcaatgaggctggccggatgtagggagtgaggcgtagaggatgagctgctactactgcacaggaatgtcccagcctgctgccagctccttggggaagcagcaagatgccacccaggtgagctgcttcctccgcacctatgagaggcaggaagtggcaggtaacatggagctgctggagacccagccccagggaccccctgccaatatctgagtgaacagttcttgcaagctaggaaggctggcccgaggatggcagttgtatctggcatttcttggagtgtctccagtttattttggaaataggttttggcaaaagttcaaaatgtcaaactcctgaggctttcagttgtcctctccctccggctccagtgtcgagtacccagtgagctgttgagagagaaattcttaaatgtaccgcagcgttcagctcctcagtgggttcggaaacagctggaaggaagggtgtaaagcccgcctgagatggcttcctcagggtttgcctcccagagacaccgtggcattggagcagggtgcagctgcattctggggtgggccagctcggcaccatcggccgatcttcctggacgagccagggctcgctggtaggccgtggaaccttctggccgcatctttagcttctctagaaagggctactcgaccgtgggctctaaagagcctcctcaccagtgagcgtcctgcccaactctgggaaaacctcccagatcctggcggggagctgctgtgagctgtggggccgaggaggctcccgacgcccagtagtaggctggggggacctgcagccgcaggaccaagggattgatttctttctcggttataaattgcaactggagacatgctgacatgtgaagggaagctcgtggatggggggcacaaggcaatatcccgaggagagagacaggctcaattccagtttgcgcgcactggacaaagtgaggatggggtcagcgagggagagcaggtggaaagaaaaaaatccatgcggcgaacgccctggctgtggcagcgggtttatttttgaatgaaggcaccatgcatttaaattaaatgtcagatgtaatttagcacccaggcatcaagaggctgagcgtgtgcagggaaagccggcagctcgcaggagtggctgagtgcctgctctccagcgcccacggagtgcgctcgctcgggaggtgtctctgtcctcggcgtgggagggtctttgagaaggtgaagcttggctgttgctaagacacacgagatcattgtttggaaggcgttttcccttctctctccctcaaatgactgtttaattgaggttactctgcaccgctgacacgcggtggaaagcccgacatcacttggagaacttaatcaaggctgatggagccgcgcgcacagaatcccaactgcccgcaccctttgtttcatgttcaccaagaccgaggggaccattcctacgggatgaggaaacacatctaacacaggccttctaaagagagaggagggagggagggagggatggaaagggggaaggacagagaccaccgtgaacacatctccgcttttcgctatgggcagatgcttccatagacatgggactttgcagccaagtgggacttgcagttgccctggacagcccggccttgcgagactcccattccgatttcttgacccctgagggtagatatgctcagaaaagctctggtcttcaggctgcaagctcccaagcaggatccacgagctcctgcaccccaaaccccaggctcctccacacgcactcacgaggggctcttcagagcccacctgcctgctgtgtctgcagctctggcctggctcggctgggttttctccagggtgggggcaccgagtggccagggcggctaagacaggtcggccatcacggatgtagcggggaacgtcgtaagtgctgcctcaacaacatggtgacttgtccgaacatgacctgactttgcatcccagggaaggcacagccacagcttcccatcctctgagagccccagagggggcaggcttcaggatgggtctgcagctgtgctctgggcgagcacgtgccctcgtccagtctcccttcctgggcagcccaggccagagctcccctggggtcgagctgggcgactggtgcgcggtgtggctgtcgcccttttgtgctggcctcagggtcaacgcgcactctctcttctgcttccctgtttccagctggcttcttcacccgaaagcccatcctcgtcttatcaaatctgatcctctccccagccacaagctcccacctaacctacagcccacctccaggtacagaggccaccctctctgtttccgtcttcctgccctgattgcagcttcctctcctacctggagtccagcatccatattttcatcttttagaacagaggacacccatcaaaggcagcaaaccactgactctggaaatctgtgattagagatggccagctccatctcagggatggcgagggccgccaagacaaggaacagccgtgggacagaccctcgcagcagccacgccgcctttcagaagggttcagggcttatgacaaacatctggcagcacccactcctgctggaagcccagacagtcagtgaccagatggttttgccatggccggcagtgctgataacagacggtcaggagatggatttctgtggtgtggctgttctccaaggggcaggaactaactgggaggaaaggcggggtgtcggcacaggcaccctctccaggcctgcgtgcagggggcaaggacagtgaagctactgacacttatgtctctgctcaaatcctaaacgcctccctctgctgacgtcggaacccacaccccgcgcagtgggcttctgtcccccgggcagtgccatgtgccaggcatgtctgctgtgctgtgggaggagacggtgctgttccctggccgatgcccactggaccccacagaggaactgtgctgtggggtgtggttcccacagacccttcatcgggaaagttgagaacttacaataggaagtgcagtttggtgcaagcttttcccttcctgccagcctcctgtgctatcagaacacagccccagacacaaagcccattacaaagtgaccagcacaggcaccagccaccactgcttctcctcccgtctgggcctcactccagccctagtggcctccgtctgggccgcagctcacagcatggcagtgacccttcctccaacacccccacctctgaaaatgtccatgtttctagtcgaagctccgttctctaccacgtgccaggccccacacctgccttaacgcctcccctccgttctctaccatgtgccaggccccacacctgccttaacgcctcccctccgttctctaccatgtgccaggccccacacctgccctaacgcttcccagatcgtggcatgcgtgcatggctgcaggtccctgctctcctggcatctgcaaccgtgccctgcccacctccccatcccccaccggttccttgccaggcaagaaccaaagccacctagcacagcacccccatccgcggccatggctgctgtccaggcatcacgcccacacctgccaccaggcccagcatcttgctccctcctcatcctggcaccagctgaccccatccttgggaggccttggtctctggttccccgctcccctatctgaagtgggtgctggtgagaggctgggaggaccaggcgttgtggctgggatctgtggcaacccaggaaggagctgcaactccgaggagttggggtgtgaaaacaatcgtccactgtgggctcaggaagagcagggcctggtgcgggcccttcccgaggaagcctgtggggcctgagtcctgggagaagcaaactcaggcctggaggctgagtccgtgtggggaatgtggcctgtgctgctgctcctgtggactcacgagccgtcaggacactgagccacgttacctggtgcttctccagcatgggcctgtctagcaaagcagtggcagtgctctgagctgggggcaggcggacatgccccgacactcggcttccaccaaacagggtggtccaagcactgagttctagaaagaaaaccgggaggaggcggtgtgggaccgtgggcagacatcaacctagaccagcccctgtccccccttggctgtgtcagaggtgacagtgacagtggccttccattctctgcacccactgcactcacgggactccctctgcaactctgccagggtggcttcatcaccacctttggaggaggccgaggctccggctggaaaggtgcccagtctgggggggcccttctcaagggatctttgtgttttactgaagttcacggggtgcccccagccctacttggcatgcgtgttttctttgtagttagttttctttgtagttattgggatgccacgtcaagttggtcatttcaggtaaaaggtggcgtaaacactggagctgcagagaaaggaaggtgcttcatgaacactctgcagcggggtgtgcttcaaggggaggaagaacttagattataatgcttttgttgttgttgtttgagacagagtctcactctgtcgcccaggctggagtgcagtggtgcagtctgggatcactgaagcctcaccttccctgggctcaagccatcctcccacctcagcctcctgaggagctgggactatgggtgtgcgctgccacgcccggctaatttttataatttttgtagagacagggtttctccatgttgcccaggctggtctcaaactcctgggctcagcaatctgcctgccttggcctcccaaagcgctgggattacaggcgtgagccaccacacccagacaatattataattttactcttaaaaatctttatgaaagatgtaaatatgtaaatattgagatgtttagactattcaagctgtcaaagacaaaaactacccagaaacccagtactgtgccaaatgttgagaaaatctgtaattccaaacagtagcttctgatgatgtttgttattttaaaaattacaatttagtcctgggtacgaatgggagtatttcagcctttcttgagaagttcatcgaacttctagggcaggttcatgtttacagctgtgtcttcacgggggggtttgagaagttgagtcatcctcatttgattataagaaaatgtggtccatatacaccgtggaatactatgcaaccataaaaagaatgaaatcatgtcttttgcagcaacatgggtgcagctggaggccatgatcctaagcaagctaatgcagaaacagaaaaccaaatgccacatgttctcacttatgagtgggaggtaagcactgggtacccatggacacaaagatgggaatgacagacactggggacccccagagggagggggtaggaaggggagagggaaggagtgaaaaaaaaccaccccttggctactatgctcactgcctggagacggatccattcttactccaaacctcagcatcatgcaatacacccaggaagcaaacctgcacacgtacccccgattctaaaataaatttgaaaaaaagaagaatgcgagcatttcccattggtcacaggcccttcccacggcagcgtccagcacccaggttcccagccagggctgggcggggctggcattgtgtaggtaaatgctgcagtggtttacttggcatctgactaccctgacattttatgggtaggatttgtaccactgcacaaaaatagttttaaccaaaaatatacttgtgaaaaacagtaggaaatgccagaaagaccagacttctttacaatcaaagaattacgtgtatgtgtttttaagtggaattatctggaagagtggcacttccaaaagagtttccatgaatgagtgaataatgaagttctaggttaggatctcggctctgtaatttattatctgggtaaaccagggcaaattttttaatcttttaattaattttttttttttttgagacaggatctgtcgcccaggctggagtgcagtggcgcgatctcggctcactgcagcctctgcctctcaggttgaagtgattctcctgcctcagcctcccgaagtacctgggattacaggtgtccgtcaccacgcccagctaatttttgtatttttaatagagacgggttgcaccatgttggccaggttggtctcagctgcccacctcagcctcccaaagtgctgggattacaggtgtgagccactgcgcccagcctttaaccttctaaagctcagcctcctgttttgtggagtagcagtatctgcgcctgcgctgctctcactgcgcaatggaagcaatacagcacggagcttagcagggaaaggcatgagaagctgctagcgtggggactcaaggaacatcagcagtgtccttaccttcataggaattaaggccaaaccatttatgggtgactatgtcaggagaagggaggaaaaaaaaaaaaaaaccctgttcctgatagacgagaaactgctcaggggaaagaggacgtcgctttccatgtcattattcctcagccagggttgtgcggatgggagcgctggtcacttaagcacatgaagaagaaaaagtctttctgcgaaacatggacggagcctggaacatgcagggccacgcgtgagggacgggccgaagtcagggatgtggggccaggagccgccgtgtggggtggacccctgccagaaaagcaaacgggcagtggatggactatggtatgctatgcggctcacaagataaaagtttttttttaaaacctcccccaccccctaaagagatcattattgttacgacatagaaaaacctagccttgcagctgaggctgcaccgtgcaggcagagaccgtcgaggaacccacagcagaattggccatgggtgaaggctgagtctgcaccgtgcaggcagagaccgtcgaggaacccacagcagaagtggcccacggaggaggagcactgagccgcctcctatggcagcgacacagaagccaggcctggaaggcagagcgggagagcagagagacatgctccacgccgcaggcccagctcaccctccgactgaggcaggagtgctggagctctcggcggccggtggggacaaggaggaccccggcaggcgcgggcagggccggggcaactgggcaggaccccagggaactttggatacgggcagaggaaggtcttccagtcggggaaggcgggaggtgttaagatgcaagcacttggcagttagcgggctatgaggatcttttctatctcgaagccgtgcgtctttcacctgttgttcgactggtatgctctgtggctcacaagatacaagtttttttttttaaacctcccccaccccctaaataaattattattgcaatttaaaaacctagccttgcaaaacagcttttgaagaacaagggaaataattgctcaaagcccacttgctctacaaacaggtgatttcagagacctttgaaaagagccccagctgctgaacttaacctggggccccgcgaatgaaccaggctccgcccctgacgcccgagacaccgcgcacaagaaggcagtgctggatctcccgcagggccctgaagcagctctctggtgcactgaaaaggcagcaccacgtggtggatcatccacggggcagccccagggcaaacgtggtgaagccaggggtttgcgggagggacagccttgccggtgcgggggacgcggtctcgggactgacggcgcaggggacgcgcgggattgacggagcgggagatgcggtcgcgggatgggatgtgctccccgtagctcccggcgtggctgcagtgggccggttgcggggaagaaaagggccggtgtcgtaattgactggacaggtactaatgccgaccacatccaaatatggatgatgacgagcgtggtgttgcccacagtccaggcctgtccaggcgccattccccgtggcctgcacgctcctgggtcatgctccgctcaggcggctccttcagtgaagttgcacagcagtcagggtaacctccatgtccccaaagggcaagaccggctcagaggcgaggtaggtggcacgaggccacacagctggtcagctcagccgggctgggacgcgggccccagaccgtggcccccgtgcagctctgggtccagctggccaaggtggactttgcacaaggtttgggaggctaaagggagccgaggcaggtggcagctgctgtgctgggaaggctgcgtgcgcggggcatcctctcttggcccgggtgggcggacgcaggggtccctggaggacgggactggcatgtctcctgcatcccgcggtgtccttgctttgtgtccaggtccctcctgacccccgcccatccaccctactggctcagagacgtggaggcagtggtcccttccccagctccccacgctaccccccaacccttgctgcacagcagaaggccctgctcagaaaatccctgatttcacgggactcctagtggctctgcctcccggatggagccctgcctgcgtggctgctctgtggctaacaaacagcgtgctcctggtttccctgccacggtacgcccctccagccacgtcaggccattgctcaactggaggagtgacatcgctccttaactttcatacctaggtttatgtcatactttccaagttacacaagtcacatcaaataattccgacgtttcaagaaaaaggcaagtgactctattattcctcgtttctcttgggtctgaaaaatcatgtcctgtgaagcccttcagacctgcctggggttcgagtccctggatctgccgctccccccttccctctcctgggagcatcggtgcctgggcgccgtgggcgcaggcggtcggcattgttacttaggtccgagctaagttacgtctcctctgcccaaatcctgtcaatgcagcaccgtgtccaccatgcgccaagggagcctgctgggctgagatgcacctgtttaggcagcatcggggagcgatgttcctgaggagctgggaggccctgcttcctggatggactggctcctgcgggaactccggcaggtgggagaacccgaggtggacagaggtctgctagtgtcagccgcttggcccaggagcctggcgtgtccagtgtcagctccttgtaagcccatcagggccgcttcattaaagttgaatttaaagccagactttaaagaatgaactgctgtcttttcaaaggcctccttcaaatggaagacggacacgtgtgactcagacatgtggggctcactgtccggggcggcctggctttttatcttcagcggttgctgttattggtcaatgatgttggtgttcagatctgcaagttctggactcatgactttgaggctttaaaaattactttaacaaataatgtacgcgttgagaatggtcgcctgggcagcgattataatggaagttctttgtgttatatctttcaaaatgtgccagtccatgtggggtgctggtgctttggggcaccagcccctgcccctctcttggggaggagctggatggaacacaagtccagcactcacagaggctcatcctgagttgtctgcccagggaacatcagtgagaaccatagtgtaggaagagaccgggcgggcaaagtgggaccatccagcagcccctacctgtcagggggacccaccccttccttccagccttccctgttcacagagggtgctgcaggccgccagggtgctgtccccccaacgccatatcggcattcagaacagatgccatactctgctctaggggcctccttctgcccccacatcacccactgaatctctctaacaaacatcccccacgtggtgatcagtttcccacgtgctcagggggttctgcgccctgccccaaatcttacagctgatgtggggtagagacagaatcccacccaggtttggctcccaggagtgtgacccaggatgggacagcgatttgtgctttgcagagaagtgaactcagcagtcgggatgcagggtgcacgttctcggtgtccccacgttcagctctacatgcacgaccccaaacttcctaaaggctcatgacgcaaataaaaccacaagtcctgccctcgagagatcattatctgggcccagagcagctgctccacagaagtgcgaaggagaatgagcagagccagtccttcctgtcctctccctgtcctccctcccatcctccccacctcccacatcttccctgtgctccccgagtcttctccatgcccctcagccctcttctggccagatccagcctcaccccatcaccattgctattcagcggtcacagtctccactgacacctgctggggtacttgccttttaacaaggcatccaaaataagaaaaaacttttcagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattaattgaataccctttatttccttctcctgcctaattgccctggccaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaaactactttaaagttcatatggaatcaaaaaagagcccacattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgcctcatatctacaactatctgatctttgacaaacctgagaaaaacaagcaatggggaaaggattccctatttaatgaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacgccaaaagcaatggcaacagaagacaaaattgaccaatgggatctaattaaactaaagagcttctgcacagcaaaagaaaccgccatcagagtgaacaggcaacctacagaatgggagaaaatttttgcaacctactcatctgacaaagggctaatatccagaatctacaatgaactcaaacaaatttacaagaaaaaaaccccatcaaaaagtgggcgaagaacatgaacagacacttctcaaaagaagacatttatgcagccaaaaaacacatgaaaaaaggctcatcatcactggccatcagagaaatgcaaatcaaaaccacaatgagataccatctcacaccagttagaatggcaatcattaaaaagtcaggaaacaacaggtgctggagagggtgtggagaaataggaacacttttacactgttggtgggactgcaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcagcattattcacgatagcaaagatttggaaccaacccaaatgtccaacaataatagactggattaagaaaatgtggcacatatacaccatggaatactatgcagccataaaaaatgatgagttcatgtcctttgtagggacatggatgaaattggaaatcatcattctcagtaaactatcgcaaaaacaaaaaaccgaacaccgcatattctcactcataggtgggaattgaacaatgagatcacatggacacaggaaggggaatatcacactctggggactgttgtggggtggggggaggggggagggatagcaatgggagatatacctaatgctagatgacgagttagtgggtgcagcgcaccagcatggcacatgtatacatatgtaactaacctgcacaatgtgcacatgtaccctaaaacttaaagtataataataaaaaaaaaagagaaaaaagaaaaaacttttcagagccaaaggagagaggtgggagcatggtggccccaggcaccgcatgcagggaggggtatcagggccccccttgggaagtgtgtccctgcgtgtccaaggccctgcagccacaatccagccccgcccctgaaaagcatgttaggcccaggtgctggtgccggaggctaaccctccatcagagcccacagccgcccactcacggtcggtcacagggctaaccctccatcagagcccacagccgcccactcacagtcggtcacagggctaaccctccatcagagcccacggccgcccactcatggtcacagagctaaccatcagagcccacggccgcccactcatggtcggtcacagggttaaccctccatcagagcccatggctgcccactcacaggcacagagtccatcccaggccacagtgggaaggagagggagatgccctgaggtgtccagtccaactcaaatttccagccacatacaccatgacctctggcgtgatgtgccctcctcatttttctctcccttcccttttccaacaaaagctcagccctggtgatgacagcacagactccagctctccagaggcccaagacagcctgccccagtcactgtggccatggggcggccttcgctctgaggcacaggttggcggtggccctgagccaggctggtgtggcctcgagtcccttctcctagccccaaaccccacggcacagttggggatcctctcggctgggtccccaggggagctgcacactgagcctccacctccttttcagagttgggagcagctgcccccctggccatgggggaaggccacgcccctaacctgactgcagattaaattcttctggaaatcttagcctgcctcactgcttggtttcctcttcattcggaattaattcctcccttggatgctgagggctggtggctggtcctctcttcgcagtgcagtcacttgctggagtctcctgagggcaggagagccccggcagtggtaggaggaggctgcaccgggcagggttaggggctgctgggcctctgctgtgtggccactgccccatgtggctgccccatcccccagagcaccacggtgcccaccttttgttttcagagaagcaacaacacctcatattcagtctaacctgtgaccattttccaaacactctcatgttcgtttgatcttcatgatgtccgtgaacacagggaagctttagtcgcagccacatgagtggagcatgtggaggctaggagaggccatgcacgcaccctctaggatggccgtaactaaacacacacacacaacaaaaacgtgctggcgagaatgctgaggaatcgtaactggcacactctgcagggaggaatatagcatgatgcagtcgctgttagtgggtcctcaaaaaactaaccacagaatcagcccaggacccagcagttccaccaggggcatatgcccaaaagcaccgaatgcagtgactcagagagagattcgcacgcccatgttcatagcagcagcgctcacagaagccaagaggtgaggccacccaagcgtccaccaatggaagaaaagataaacatcatgtggtccacccacacatgggaatattactcagcactgaaaaggcagagattttggatgcaggctacaacatggatgaaccttgaagatgttatgctaagtgaaataagccagtcacaatatgataaacactgtgtgattccactcgtatggggtccttagagtcatcagatccatagagacagaatgtaggacagtgggtcctgggggctggggagttagtgtttaatggggacagacttccagtgtggaaagatggaaagagttttagaagcagatagtgatgatggttgcacagtattttgaatgtaaatactaccactaaattgtacatttaaaggttaaaaatcacaaatgttatatattttaccacaataaaaaattaaaaaataaaagagtgagagactgcgtgcctggcatacagcaggggacaggagccgattgtctgtcctacagctgggaaatgatccatcctgccattcatccatccatccatcaagcactcatccatccttccatccttcatccacccatccatctacccatccatccatccattgatccatccatatccatccatccatatccatccatccacccacccacccatccatctacccatccactttcatccatccaaccatccatcattcttccatccatccatccatcatgcactcatccatccctccatccttcctccatcatccatgcatccatacctccatccatccaaccacccatccttcccccatccatccactcactccccatccatccttcatccatccatccatccttcttttatccatccaaccatccatccatcattcctccatgcatccatccttcacccatccatccatccttctttcatccacccacccacctgtcattcatcatccattcttcctccattcatccacccatccaaccatccatccatctttccttcatccatccctccatcatccatccacccatccatcatcctttcacccatccatcatccactcttcttccatctatccaccatccctcatccgtacaacccatccatcatccattcttcctccatctgtccacccttcacccatccatccatccttctttcatccacccacacacccacccatccatccatccttcctccatccattcacccacccatccatcatccatcatccatttttcctccatccacccatccactcatccatccatccatcattgctccatccatccacccacctacccatccatcatccattcttcctccatccgtccacccttcacccatccatccatccttctttcatccacccacatacccatccacccatccatcatccattcttcatccattcacccttcacccatccatccatccttctttcatccacccaaactcccactcatccatccatccttcctccatccattcactcacccatccatcatccattcttcctccatccatccactcatccactcatccatccatccatccatcattactccatccatccatccatccacccacccatccatccatcatccattcttcctccatccatccacccttcacccatccatccatccttctttcatccacccacacacccatccatccatccaaccatccatccttccttcatccacccatccatccaaccaaccattcatccttcctccatccatccatccatctatccgcccacccatccatcatccattcttcttccattcatccatccatcatccatctacttatccatcatccactcttcttccatccatccaccatcccccatctgtccaccaatccatccatccatccatccatccatccacccacacacccatccatccatccaaccatccatccttcctccatccatccatccttccatccattcacccacacatccatcatccattcttcttacatccatccacccatccatccttccttcatccatccatccatcatccatctacccatccatcatccactcttcttccatccaaccaccatccctcatctgtcaaccaaaccatccatccatccatccatgcatccatccttctttcctccatccatctatccacccatccttcctccatccatccattgatccacccataaacaaacactttcactgaagagacacgggaggaatcagaaaaagctattctcagagcttctatcctagagaattgctggcacttgcagagtgtgtttggatgacttgggtgttcctcacaaatgcctgtgctgcgggtcctattcttttccccagtttatggaggagacactaaggtacccagaactgcaagaacttgctcaatgctccatagcatttggctgagacaccatttcttggaggacaggacattgaaatctcagaggctgggtgagacacagggccactttgcaggtggctctcgaaacacgtccccttggctacctccgttggggccttcaccctctacttgtagttgatggcaccagaaatggtcttttctgggcttatgtctctgtcttcctggccagctctcagcactggctcttgccgggtgggtggaatcctgtctgatgacccagctgggagtggcttgtccccctctggacactgccagccctcctcctggcaccacctagcaccatacaatagtcactccaggggctgccattgccacagctccccctgcagggtaggggccaggccttggcacgtcttgattcaaatcctggcacttgcagtgtagatgaggagctctgggcaaggtactgagcttccctggctgcagggaggttgacatgaagtagccaggctgtgctgggcacacagcactccacgtccatcatccatctgtggcttatgaacgccttgtaccagatttatccttggaccctaccaatttaaggggaccacggaagcttctgaacaagaaggaggggtttccctgttcctcctggcatcttggttttacaatgagactgactgccatgttatctgtgttcttaggataacccaatctttctctctccttctaccttgataatgatgcctgacactttgtacggtgtttgcctttgcgtacaaatggctgggaagtcctcacagtcacaccctgcagtaagaatgctcacgaatacagcagtaagaatgctcctgctctcccaggaaacactgcattggggaagtgagtgcccatgggtgcaagtcagcaactggccagggcgaccgctctttcactgccaggccagtctgccttccgtggtcacaggcgaacactgttctgtttggtgctgtgcctctgcagtgtggtgagaactgtctatactcctgctcctcttagaaacgctgtgtgtgtgtggaggcggtgggaaccagtggtcctggcaaggcctgccaggctcagacctggagcagagccaggccccagctgaagcagaaacttccagctctgtgctccttgctattttttgtttgtttgttttgttattgtttttaaactcaaaaggcaggtaggacttaggaggcaagaaagcccgcttgagggacattaaggacatgaaggcacagtcatgggacgcttccatacacgattcctgcttattgctgacaccgagcggtaaaaagagaattgccactgtgagtcacacactctgcagtgtggcgactaatattgatcttccaaacggtaaaaacaagaacaaactggaaagacaaactctacttcagattgcaactacttaagcatctttgtttaacaaaatcaataaaaaaagatttcactaacaagactgcaacctatatttgtggctatgaattccccagattgctggaatatcaaatccagagcacaggagatgcagagagagtgaggcccagcaagcctgttttacagtcaacggatcgtcctctgctcctccgagcagctcatctgcgttcggctgtgcgatctgagtgtgttcactgaagcacagcacacgggcagaaccgcacgctacatcctcaggctttgctttggggccaagaagcgacccccctacagtgacagagtgtggctccgggccggacgccccacgctggcctcccgttcccatatcccggccatgagagcacgcggccgcaacacttgtcttcaaggagccatgatggggatgacgtgaggctccccagctcctggagaggccaagggggctgcgacgccccagcccagccccagctccaccccagatgtttctgttcagaaacaaaatcagttacaaaaaaacctaaacacatcaccccacaagaaaagtcatttggaaaaatcatttggaaatcacactgatttccttaaaatataaaaaacattgatttatctcgatctcatccattctgcttaggggagcagtttctgctttaattgtagtgtctttctttagaaaataaggacaagtgattggggtgttttggcacccacagtgccatggcacctatggaggctttaaagaacaaacatgccctcggaagaagttactcggcgaagtcgacacacacatctctgagtcagacatttcctcacattgtcccctcatttgtcaacacataattactgtcaccgctgtgtgctgacgctggcatcaggttgcacgtgccagtcagcataaaaatatggccgtaatgttggcataatttttcatgatcatcttcattaaccacagcgaacgggaggagcgtttgcctgcacccagccatcgtcatgacaacgcctccaccgcggccagcccagtgtccaccgagggcagcggttgaatgtcctcattattccgccccccacacgctttgcccgtgccaagcaaggaccaacacatgccggtgatttatccccaggccactcccgacggcatccaggcttaaggcgctggtctgatttcacagtttaattactgctaatctgagaggccacagctaatgagctgccggcaaccagctcgccctgctggaattccacaccccttccctggatgactcccctcattgtcgggggggcagttaaggaaggtgtattgacttctaggtgtgacaggttgactaagcacctatggaaacatcacagcaatgtcaacaggcaaatggaacacagataggattttggaattcagccaccacaactccactgaagacagtatgggttgctgatacaccccagaccttctgcaggccttgggtagaagatgttgggcttggctttagccacgccacgggctcccttggtcctgcataaaacacacccacacatcttcaccaggatttgtaacagcacagcagacatgtcaccagcccctccacacggaactctcttccgcagctccctgtggctcagcgcgttcctgcctcccactccaccacagctccctcccagacctgcaggcttcacatctaaaacactatcccaggcgctcctcacctggattccctgggggctgccatgggcccctccctgccacccgcccctttgcacactttattcttcccaagacccggcagatggcctgaaagcacatgtggggctgtggcctctggtgcaggcatcatggcttactgggctttaggatacacaccccgacctcggctaccgcatccacgcttggccccagcagcccgtccggcctggggttctctgtggcttccttggtctccgagcctccccagcactttcacttcccgctgccaccggccccggtgaatgctgcttctgcttctagaacactgctctgcaatttagagatgaaattctggcacccttaattctatttgtttaatccagtgaatttaatttcaggaacatattggaaccatgcttagcttcagagcagagtttatgtagatagaatatgactggaggtttctgctggtttaagtgtgtcagtcacagaatgcatgatgtcagtataacaactacccttgcttaatgataacgctaattaaatattcttagcagcatcatgtggagaaactggattttcaattaagcactttctgaggtgagggtctcagcaggtcccacctctttacgttaaaccggaggctttctgctgttgtcaggccctgtgcacccagagaatgtaggaattatgaatgcgtgaagctaatttcttttcattttcattcaatggtatgtgagcttttccaaatacatgatcctactctctcctttggggagaaatctttgttaaaaattagcgctataggggagcttattttgcccaatgacagagcagatctgaaaaaagcatcaaatcttccttcgtatcctctaatacatccctccagctcgggtagacggacatcctcgggaagagcgttcagccagctccagacacagcaaggtcatgaggcgcctgcattcagattcattgctgggtgtgctgaagagggccacacattctctgacgcacttgcccccgaggtgagacctctgtcctccccacctgagtgtgggggctgtgggcccgcttggccagttgaggcagcagaatgcacctgcccccgaggtgagacctctgtcctccccacctgagtgcgggggctgtgggcccgcttggccggttgaggcagcagaagtaacgccctgccagtttctggcttctgggctcagactcgagagactggcagctcccatttcctctcttgggacacttgttcttgggaaactcgctgccattctgtgaggaagcccaagcagccttgtggaggctccacatgcagaggcccagagctcccagccacagccctggctgagctccacaactgccaccacaatgtgccagctatgtagacaagccctctttggggcgagccctccagcccccttggaccactccagctgatgccagtggagcagaaacaagacttccctgtcatgcctgaccagattatagagctgagagcaaaacagggctctccaatttgggataatttgctatgcagatatagattcctggggtacctgcccccccattccctgtctccatctctgatataaaactaatcccacctgctgccagttcatgcccttctgtggcttgcagcagctgacactgacacctctttgccaactcaatttaacagccacccaccatgtcacgggtgcagagtgctggatctgggactccacagagcagtgagacacagcccctgccctcagggagcttacaactgagtggaggagaaagacacacacggcacagggaaaatgtgctggcaaagcagtgcaaagggcagtgcacacacacagtcagagacacacaaacacacagacacacatgcagacacacaaacacacagacacacacgaacacacacagacgcacaaacagacgcagatacagacacaaacagacacacatgcagacacagacacacactcacagacacagacacaaacacacagacacagacacagaaacacacagacacaagacacaaacagacacacacggagacacaggcacacatgaacacacacagacacagacacaaacacacacagacaaacacacagagacacacacagacacatacaaagacacacatacagacagacacacacacatacacacggacacacatgaacacacacagatacatacacagacacacgcacacacagatgcacagacacccacacatagaaatacacacagatacacacacagaacacagacacaaacacacacatggatacacacacacagacatacacatacacagacagacacacacacagacacaaacacacacacaggcacagacatacacagacacagacacacatacatacacagagacacacatagacacagacacacacacatacacacagacacagacgcacacagacacccatacagacatacacagacacacaaacacacagacatacagacacacatagacacagacacacacatacacacagacatacacacacacacatacacacagacacagacacacacagatacacagacacaaacagagacacacatagacacaaacacagtttgtgagagccctggcccgcagaccatggtggctgcagtgtgagcccagcagagtcctgctcagtgctgcccagagacctggggcaggaagtggaaagaggcccctgatccaggtgcagctcctgctcccggaaccgcctgtgaacgactgtgacctgggcgaatcctgctgcgggcggcctcagctccacactctctctaggatgaatcaggtggagctggcacccagggcgaccccagaggacacacgaggctctcggcattgggtctcagcgttgggtctcttggccgggtctggggggacccctgtggggggtgggagaacatctttttgaacaaacacgtaaacacattgagtctttggtcgcttttgcatcttctttcttctctggcctctgcgccccagctcctttgtgcgaggtcccatgtgctgctaggccacgggtggctgtccagggtgtggcttggagccgtggagctggaggcctgggtgatatggtccaggctgcatgccgactccgggtgtacactgggtactggcggggtcttcctgggccgcctgctcccctgtaaatgggcagtgatacaaccagcttcccagaactcccagaactggatccaggcctgggtgagaaggtgccttgcacagatgtccacacatcatcctcagtgctgggaccatcaagatgctacagtttccaaccagcagctcatcgcgaggacctcgttctaggcactcgcagcagacggaggcaggggtcctccacctccgcttttctgacccctctctcttcaggacaagcctccttggtcatgctccggctggcctttagctgaggtttagctctacgcggacattagaagcacaaaccaagcacagccccttctgtgagtgggagtcatgcctagaaaacaaacaggagagaggcggctcccaacctccaggagatgaaaacctgttcttacaatgcgtgggactcttaccctgacgagctctgcagtccccacagacgcctttgctcaagcccacctgcctcttcccagcaccacccgtgtcttcatctggggagaagagcccgtgctcagttttctccatcagcccgctgcgagggccaggggcccctatgcactcaacatcagcttcacaaagatgtagtgggctgtggggccaggcggcttgctgtacctcccacccaagcccagggccctctcacccagactttggcccagtgcctccctctgtctgtgttgcctctgttccttggagctgtatcttcctcagcctcaatttctctgcccattggtgtctttgttcccgaacctcagcccccaggtcctggttggtggggcttgtgtccgcctcatccagttctggactctttgtgatgatggtaacaataactggactgatccaagttgaagtcagttggtgaatgaatcaataaactccaactgagagctctacacagcacatcctaagtgtcatacagagcactaagtaatttgctttttcatttatacctcacttcattccagaaagatgcatacaagttagcaaagtaaacacatatttaaaaagaggtgacaaaaagaaaacatagggaaaacaagaatgggaaataagttggagcctagaatgaggttagtatgcaaaacccatgacacggacctacttactaggagctggctacggatggggctgtgagctccctagctgccacggggaagagaggaacaggatccacaatgtctatatgacaaaaacagacaatctattttttgaaaatcatagctattcttaaattaaaaaagaaatgttccaggagtcctcacagagatgcgctgaatagaatatgcaccatcctccatgatgtctttatacaacagggcaagggaatgcctagggttgctggcctcaggccaagtaaaaatggctatgcaggagcccagcatggcctgggcatcatgcctgtcaagcctggtgaatcctagggtgggcctgcgagggtttagaagggataaaccacgtcaatattattcttcccaaccaagatttcactggaagttgagctgcagtgagtttaagaaaatggtaagccccccatctctgcacgcagttcataatctaggttgtgagaccacacaccggctcatgtgcacaagacagtgtgcgtggagggtgacagtgtcggcaaaagtgggctcagggctcagagctgtaactgcggttaaggggttaggaagctggccttgggctggatccaggaccccagagtgactcagcctcatggtacagcagagggcacgcccgacaggggaggtcttcgagtcaacaatgggaagtagaaatctgcccaagatgaggggaccagtccgagtggggaggcttccaaagatgagaggaccagtccgacgggggaggcttcctctagaggaaccatgaggacaagtcagagtggaggtaaaaggcctgaaataataactggtcaaggaacatggtctcttcttctgctacttacatgccagagtctctgaaagttcttgatgagaacagtgacacaatgaaagcaaagtcagggaagatgagaaggtggccttgcatcctaactgctgtcagcagagtctgagggcctgaaaacgtccacatgccagggagtccctcagtcctcaggaaggagaaacgtttcatgaaaacgcgaacagtctcggaacgcctcactccgtcacggcagtgtaggctcagatgtgacttgggaagatggcgccactctgcaggacgccgtgtgtggcaaccactcgctctcacccttcgggtctgcggcagctactgtcatatgagctgctctttagagggacagaaatccacaggaccccagtttccacccaaattcatgagccgcagtggccaggctacctcacctcaccctgctgggtctgggcagtccctattctcccataggcataacggggacagtgaaggtgcaaccagcatggacagggccgagggatggaaggaaaacaaacccttgcagttcaacccacagggcggaggcggcagcgtgagaagcttcctgaatacaggactcgatgcctcgaggagaggagcgtggagcacgcccggggcacatggggacacagcagcgctgggaaggcttcgtcctcgggagccggcgctcacatgcagggagtcgcccaggacagcaagcctgggtgtggggctgaggcgggcgcagcctcggggcagtccccacacaagggcaggacggagcctggacggaagctccacgccctggggtacctgctggggcatccagggtttcctgccccaggcccgggtcatggtgtcccccgcaggcctgcaggctgggttcctcacagggcatctgctcaccaagtaagcctggcgtggccagaactgtgtttcttgagttgtttgagccgtttctgttcatgacctacagtaacgccgctgtctctgtgatgctatagggatggtcagtgaggagaccgccgcaaaatgcagactcagaggtgtgcataggtgggctgggcccggggggatagccgcagccagctgtgtactcggaggtgggcaaggagtgaggcggagggggcgtcacctcctccctctcctcctcctcttcctccctcttctcttcctccctcctctccacctcctctctcctctcctttttcacctcctccctctcctcctccctcctctcctttttcacctcctccctgtcctccttctccctctccttcacttcctccctctcctcctccatctcctcctcctccttctcatcttcctccctcctctccctctcctcctccctcctcttcctcttcacctcctccctgtcctccttctccctctcctcttcctccctctcctcctcctccatctcctcctcctccttctcctcttcctccctcctctctcttcttcctcactctcctcctcctccatctcctcctcctcctcctcttcctccctcctctgtctctcctcttcctcactctcctcctcctccctctccttctccctctcctcctccctctccttctccctctcctcctccctctccttctccctctcctctctctccttctccctctcctcctctctctccttctccctctcctcctccctcttcttctccctctcctcctctctcctcctccctacctctccactcccctcctctggtgctgtggctttccctcttttcctcctctcttcctccctcctctgctcctccctcctcctgcctccctctcctccgcctccctctcctcctccctctcctcatgctctctcctccctctcctcctacctttcctcctcctcttcctccctctcctcctccctttcctcctccacttcctcctccctctcctccctctcttcctcctccctctcctcctcctccctctcctcctcctccctctcctcctccatctcctcctccttctccccctcctcctcgctcttctcctcgtccttcctctcctcttcctcttccctctcctcctcctccatcttctccttctcctcctccctctcctcctcttccctctcctcctcttccctctcctcctcctccctacctctccactcccctcctctggtgctgtggctttccctcttttcctcctctcttcctttccctcattttctttctccgcttttcctgttctcttttcaacacttttatcctcagtatcattttctccacacacaattcaattttagagaatgcttgcatttttttcacattcaaacagatccacaaattcttgttagatacacaagaaacacatacaagtggaattggaaacacgcccatgtcggtcgctgagttacagaaggggccatgcactgtgacttcctgatgccagaggacacgcagtgccccacactgctaagctcagggacgcagccttcctgatgccggaggacacgcagtgccccacactgctaagctcagggatgcagccttcttgatgccggaggacacgcagtgccccacactgctaagctcagggacgcagccttcctgatgccggaggacacgcagtgccccacactgctaagctcagggatgcagcaaggctctggcagatcctgcctgtcatgtcctgtcccccggacactatgaaagggcagtcccgctgcatcagggacatgcatgctcctctcacacatgtggattcagagctagggccagaaggtgtgcttaggcacagcagtcattcctgggctgctgacataattcagcgaacttcacatcccagtgggaagggcaggctcgctcatttataatcagtctgcatgcaatgcctacagtaaaactttgaaatagaaatgaaaatttctttattgttatttactttaaaagcactgaaagatccaccagaataagatgtctgctgaaaagctagtttctttcaaccactgctgaggaaaatggtttaatccataatattgatgcataattgacttgtataacattaaaggacctttagaaaaatctttacaccacagcaaaaaaaaaaaaaaaaataccccaattcaaaccaaacgagagcaaaaaccaattcagacaggaaccactgaaggaattaaaagttacagaaccagagtctaaagtgagcacagcaaactccgcggtgacaccagagctccaagaacacacagactccctgttttcctccctggggacaggctaggaagtgaggaaggcaactgaccttctcaaaagccaacgctccgcctgcatggctcaggctgacgactaaacatgtccacgtgaatgcaggcgtcgaatgcccaagtacatgtgaatacaggtgtcgaatgcccacgtaaacatgtacatgtgaatacaggcatcaaatgcccacgtacatgtgattacagttgttgaatgcccacgtaaacatgtccacgtgaatacaggtgttgaatgcccacgtacatgtgaatacaggcatcaaatgcccacgtaaacatgtacacaggtgaatgaatacaggtgttgggtgcccatgtaaacatgtacacgtgaatacaggtatcgaatgcctatgtaaacatgtacatgtgaatacaggtgttggatgcccacatacatgtgcattcaggtgttgaatgtccacataaacatgtacatgtgaatacaggtatcgaatgcctatgtagacatgtacacatgaatacaggcactggatgcccacgtaaacatgtccatgtgaatacatgcactgaacgcccatgtaaacatgtccacctgaatacaggtgccgaatgcccacgtaaacatgtccacgtgaatacgggtgccgaatgcccacataaacatgtccacgtgaatacaggtgccgccgaatgcccacataaacatgtccacgtgaatacaggcgctgaatgcccacatatgcaacaagtcaatgtcttcctatgccactgctctctggacagaccacattctgaaaacaatgatgaagccacacagtgctcagctcaagtcccaggaacttcctgctttatgctggaaacgggccacagcgctcaagcagagctccgctcacagccaggtggccgtgttctctgaggggttgtgccggggtcttcagacagtgccctccctggggtcttgggaccctcaagcaaatgccacctagaagcaaaacctgacttaggtcaccaggtgcaggccttacatatagaggtagtagcgctacattgaggatgctggacacggcttatctcctggaggagggctgcctccttgccatgggagccccgccctggctgccaggcttccctgggcaaggtcagcaaggcatgtgctcggtggaggaggcctaactgttgctactcttggtgacctgaggtgaaaggtcacgtgctggtcgcttgtgctgagcaaggccttgcttctcatctgaccaaagaagaccgtgtttcctgggaccctgcaggctgccagaatgaccgcccacccgctgcccctcaccacacactgctgcactgtgctccacatcctgacaggcagcaggaacccccaaattccctcctcaggccagtgccctccacgttgtccccagcagggcgacggagggtgggggcggcaggctgtctccggtgcttgccttctctgtctaaataacttgcttctcaccctgctgcaggagtctccgaagcacaaaggctgaccctagactctggccaggacgagctggggtgaggggccccggccagaaggatgtcctgatgaggggtcctgagggtctggggaaggcgctgtggcctgaatgctcaccctatggctgggtcacccagggcaccccgaggtcatcagcctgaggaagagtgctgggtgatttcattctccctggttgctgaaaatgagcagtgtgtgtcctcccaagcagggctgggacgccactgataccatcgacgtacaacacgccgcaagcagccctcgaggaatggaaaactctcagactgctgtgtccacacgggttaataaaaatgctgaccccagttcccaaggtccacaatgtccatggagagtaggattttacacacttattgatgaactgctatgagtttttgatgatggcttggctagttgaattctgattcgatactttataattagggctcactagtgacgagcaaaagcccgtgaaactgtctttgtttatgatcccaccacgtatctctactattaaagaattagcctctgggccgtgtgtcctcctggtctacctccagcacaaggacgttcctcagagcaaggcatttgctcgctccccttgctccttacacacggccttcccactcccagctaacacctgaaataggatgggatagtgcacactctgaaggtgaagctttaggtgacgtcgaagcatccagccatatctgtcagtttatataaggggtggcggctgctcagcgaggcctcaggagtgtgaaggaggcttggctggcggaggggccgtgctgctggatcagatggcggaacacggcccagagcaactgaagttcgcttgtccccacaggcagctcgacatggtgcagaccgtggcagccaagtcaggcatacagcagccctcttgctggcttccagtactggctctgcacgccttcaccgtgagaggcccctggacaagggactgccttcctctgtgcctcagtttccctgtttgcacaatggggcttcacccatttcgcagggtggtcacgggtattccctatgttggaatgcatgatggggccacacccagcacggagagagcacttgacactgttgcttgcatgtgcccccgggccaaggtggacgagctctccaaactcgctttctctgcctcatccgtgatgagctgccccgcgggtccccacagatcaatcaggacagaatactcactaaccaaaggtcggtttcacttctctcctcagtgcacacctgaactctcaccacccccaccgaggcagtgggcagcccctgagccaggcagctccaggccaaaccttctctggcctcctgccgctcacggccacaatcaccccacatcctggtccactcacacccacgtcacccacatgcggctccttctagccatgctcactcccctctgcggaacaagacaagggctcccttcgcctggctgtggtagtgcttgcggtcctatggccagagcactgccctgccacagccctgaccccacagcaccaggccttttgatgaaaagtctgtccttcccaggtccacggctgcttttgatttgatatattacacatgggctagtgttattatcatctcctcaaagtggagggtctgctacattaccgcctggacatgtccggaccaaaacatattttcagaataacacacagttaaccctccctgtgccaagttgttgatgtcaagtctctttgaggacagtgcttacaacatgcgtgcccttcttctggtcccagcaaatgcagcaaacaccatcgaatcaggccagactcgaccactgcaatcaattcttctgggtctgctctcagacttcaaggtgagatgaatctgtactaagaaaacttccactttttcaatactatcccagagagcctggttttattgtcatgggttcccatctcatacaagttcgagtatgaagcgtgcagctgggagagctcctggatggtgcatggcggaagcttcctgactgaggacaagctgacccagcttcctcccaggttgctttcttgccctcagtcaaatcgttatttctgcatctttatcaagtcatctgacttcacagtacccaaaacgtatattacttcagcctcaataccctgccccagcctcccagccagctccaaatcacatcccactgctgtcgctgacttctgtggcaaaccacaccccactgactttggcagcagctgtcagccctttctgggctttcaggggtggatgtgaaatgcccacacagcagcttcaggcagatgcccatatgcctgagaagcttcctgcattttcagccaccactgtcctccaagcttgccacagacgggagtaggttcccaggtgcgggcacacaggtatggcctcgcctatgctatctctttcactgtccctagggaatagacctgggctggctttgccaaaggtgtgggtggatttgccctgatggcttacccaggcctcgcctgctctgcacaggaccgtagaccccatgctgaggggcggccacagaggtgtgcagtgcaaagccacagaccaaactgcaagtaatttgttcatgtaagaattcagctcatgagctcagccctggcacaggctccagtcaaccacgctaagtgggtctggactcaggcatccgagaattaatggggccccgggttgggatgcatgcagtgccaggcggaatcggttccagcaggcgtctgggagggccggtttggccccagtatctgaaaacggtgaatcagctctaagggtaggagctgcagcccgccctccacagagggggtccagggcttcttactgatcatccaggcatgggaagctgatcagggtcaacctatgaaatcacacatcccagttatgttgtctataatcttaacagaaacagcagaaataacctgagagagaggagccatctaaaaactcatacatgtataatataccaactgcccccaggggtccctgaaagaacgacgagtgtcggtactccaagaaattatttggaaaatgactacccaagagatgatcacacagcatcgcatcaacattcaggatttctttccagcacaaaaatgcccagtttggaaagaggaatcagaggaaaatggacaatgaaaataaaggctttgctctctttccttaaatagtagaggcgctgggatgacagaatgtgctggctgcttgactcggggagccttgagtgcactcggtgctggctggctaacatggtctgactgtgtccccacccaaatctcatcttgaattgtcccataatccccacatgttgggggagtgacctggtgggaggtaattgcatcacaggggtggataccccatgctgttctcatgatagtgaccgagttctcacaagatctgacggttttatcatgggcttttccccctttgctcggcacttctccttgctgccgccacgtgaagaagaacatgtttgcttccccttctgctgtgattgtaagtttcctgaggcctcctcagccctgcagaactgtgagtccattaaacctctttccttcataaattacccagtcttgggtgtgtctttattagcagcgtgagaacagacgaatacacctgccttggcggtgctgtgacacgtggcctgttactcacgttcccatctgaatatgtaatgcacaatggacactcccatgcacagcacaccgggagggtcctcaccacacagcctgggacatacgtccatccatacctaggaaggttcatcgaacgcatgtctgagcctgatgttcctcggcactgctggcccaagaggagctgacagcccacaatcctgaacattaccttgtgcttatttaatctagtatgaagtcatcttactaagaactccactaattctgagcatgcaggggccagcggagtccatactaaagttgaccgatcctggctataaaaagttctgcaaagaaaagtatggcagtaaacaagattccaggagccctcttgaaacagcagagaagacgccctggcaggaaggcctgtcccacctgtgggtcctggattcagcctcccgccccactcccacttactcggaacagggactttcccatgtggattcgtatgaccctacttttgagtgatttcctccggaggctgttcacatttcatctttgctccaggccctctgaggcttgaacactgccctgttttcattcaagaagaaaagtgaaaccaggaaggcaggtgtctttccagagggctgggaggctggttgaatggaggatattccatctcttactctttcaagcagagcgcagctgctgtcccacaggagtaaattcaggatgagtggctgaaacatttcccacatggttggagtttaagtctctcaaggtagagacactcatggtgtaagtgcagaggaggagaaggaagctgggatgggtgtgtttagttctgcttccagggactattcctaaattctgcttgtgggcagggcacaggcagctcaacgttaggccagggaccaatcttaccacgtggcttctggcccagagcagctcgtgagtcagcctggcctagttggaaaggcaccaactaggtctcaggaggccaagtggggggcctgcccccacctctggggtctcagcatctgcacagtgacggattaggggggcggttcagcagcccctcgaaccttcacccggggctcgtttgctgcttcacactggaggaggtgctcctagcaagatgccgacctgcagcagcgcccacaaggctcagggctgggtccagcctcacctgcaaaagctgtggctgcgggaaccttcctgccctgcaggaaccacctcagcctcagcctcagcgctggagagaaagccctatcccgctcggcctgaccctcctctccacaaagggcttgaagagcaactgacccatgaaacgggcaggggctgggctgatcccatatgaaacgggcaggggctgggctgatcccgtatgaaacgggcaggggctgggctgatcccgtatgaaacgggcaggggctgagctgatcccgtggcagtgcaaaccgagggccccctgggtctcgacatttcaccgcaaaccctgaccccacacccggcctctctgcagctaatggaaggaaatgaacccatcgtgtggggcgacataggggcccagggggcctggacaagtaataaggtcaagatatttttggacttgttcaaatgggtgggcagctgtttctctgaggaaacgcgcccctccccagtggccaggtgagcagtggggctggagaggagagcagagggagccgaggccctctgtccaggcggctgaggtcacgcggtctcttcagtttccatttttccacttgtaacggctgttacagccgctgtttcatcgcgtcgtcataggagttgaacaaagctgtgtgtgtgtttccagaatgttggcacagcggcgagaaggctgaccgaacaccgagaagcagccagcacaggctctccacaggggctctggcatggagcaggataacccgggcccacgtggggacacgccccgccccacaggcttgcaccggggtgcggcctgccctgtctggggcgccaaggccagtggtgtaaatccacactctatggtgacggtggatccacagctgccgcgggtccccccaaccccaaagccactgagtgaaaacagaccacggtgctccaaaacgaaatcgcccccgaggatgaaagggggtggtggaaaaggccttggagcctggggcagggctcagaggggccccaggccggccccactcccagactagagccagcactcgcgggcaggcctccccaggaccagagcgcctgcgacctgcctgggtgccatccgcaaacctggtctctgctgaaatctgaacagtctacactggacagacatggagggaagcttctcccaggaccagggtccctgctttctgcagacggtgggcagagggcagagacggagaccgtgggcacagcacaccaagggggagcctgctcagagatgggcatggggccggcctgggaagcatggcgggaggggagaagaatcgcgatcctttccaggtacacagtctagcagctgccacgcccggctgggagctgagacgcgcagggggcccagctgaagcctgcgttttcccttctgcacaacagcggaggttttcctggagttcataatcactggttttttttgtgtgcgtgttcaccagcctgctcacctgggtagcagggtgggagggccgggtggggatggctgcagggaccccctgggccggctctgggtgctgctgctcccaggagagatggtcccgtgcaagtgccaggcccctgctgtttggcctcctctgccccctgtggggcacgagcgttagccgcactccgagtgcgcgccaagggcttcagctggctgagcgcttttgctgtggggtggatcccaggccctcgggccagccctgcgtggggttctccctgctcacacaaaccacacggggaacggcacaggtaatattaaccaggactagcacctagggccccacaggtaccgttcacgtatcctggctttagtcttgctggttttctcaccagcatttagtgctagttcagtatttatttaaatcaacatgttttgaaaaactgcctaagtatctgaattgttataaagtttaaggaccatgaagtctaagaaggaagattatttattgtacttctgggaaaagcccccagaggtgggctcatttgctgtgatcttcgtcccattcacaaagcactcctgggcactgtcccagctgtggatggcactggaaactgggcttgtccacagcgtgagtcccttgaggctggaagcacagagtggctgtccccaggtagttggtgacggggtgaggaccgggctcgctcccactctcaggagcctcactatggtccccagagatagaggacggtgaggcgctgccggtgagggccacaccaggccacatccgtgcagaaagcaccctctcattgcaatgtgtttggaaacatgaattcatgtggcagcggtaacatttagaagagaaacagccacatttaaaaacgcgtaagactcacagaacctcagcctgctgtggtttcatcatcaggtgggtggcacattccagcggctttggccttgcctgcccagtgcccagagctcagtgcccactgtgggaagtgcagggagcagctctggcacatcccacagtgctgtctgcaccaccgcacacagagtgccagtgtcagctgtaggtcccatggcctgaggaagccactgagcctgggacagcttgaggggcaggaggcggacacaggtgcggcgggggacgcgggggtggctgcccgggaggcggacgcgggtgcggcgggggacgcgggggtggctgcccgggaggcggacgcgggtgcggcgggggacgcgggggtggctgcccgggaggcggacgcgggtgcggcgggggacgcgggggtggctgcccgggactggctcttctggaagcaattcgtgggaaacccacttggatgccacttatgacccccgcgtgccagtggatgcccacaacccctctggggtgtcggggatcaggtgagcaagggggctcatccgtggcctccaggccccaccttgatggaaactgcgacaggagggggtctggcctctgctgggagtgacatctgaagatgccatagaaagtctggcgcagcagccggtgggcctggggggcgcgtggactcccagctgttgctgtgcctgggtcaccccagtgggcagggcgggcagggggcttccccacagtctagggggccaggagagcccctgggcctcacgtcctgcttctctccttgtccttcatgtcttgtaggcgaccccacagagagagaggcagaggagagtggccgtgacctggaggacaaggacatgcatttcacactgaccggggcctccctgggacaccctgaacacctgctctgtgggagacggggtggtgtttgagctggtgccatctgggtcccctggggtggtggctgggtgagcccagccccatctttccctcggacttcatttgtgctcatggctgggggaggcacctgggggccccgtccaagctgccaagggctggggtgggctgttcccctcttggcatctccctcacacctctgcacccccagtggataaaagctgctggcaacatcgacgtccccaagacactgacaggcctggaggtctggacaatggggagccagcaccgggtcccctgggaaccacgcagccggggcctggaggccgacacaagccagacccagcctctctgccattcgcaaatcccagtgttcaaacagagttctgccaaagaagagaagaaccagtaaaaagcagggaagaggctgggcgcggtggctcatgcctgtaatcccagcactttgggaggctgaggcgggcggatcacgaggtcaggagatcgagatcatcccggctaacatggtgaaactccgtctctactaaaagtacaaaaaagtagccaggtgtggtagcatgagcctgtagtcccagctactggggaggctgaggcaggagattcacttgaacctgggaggcggaggttgcagtgagctgagattgcaccactgcactccagcctgggaaacagaatgagactccatctcaaaaaaaaaaaaaaaaaagaaagtacaggaagctttcagcctccttggcaagacactgctgtctggagaccctgggagaagtgtgccatcaaccaacgtgaccagaacccatcctggtttagggaggagctctccacaggcctccacggggctggagcagtccccaagctccaaagagtcccccacgacctcttagtcgtcacccctaggaagggcctagaaggcagatttcccaccatgagaagccacatggagcccagctcccaggcatgcagccctgctgggctatgcggggaagatgtgtgctctgaaggcctctggggccacccaactgccatgcaggaggcctccggggccaccccactgccacgcgggaggcctcgggggccacatctccgccataggggaggcttctggggccagccctctgccacacgtgaggctgccggcccacttctctgccatgtgggaggcagccggggccacatctctgctatgctggaggccgctggaaccacctctccaatgctggggatagctccctggagccatctcctttctcacagaggcgaaacccacaccttccccaaggaacggagctcacgccccttcctgcctccatttcccaagctgtcaccgtaacagtcactacaggacagtcagaatggtaggatttgagctaaattgctagaattagagagcgtcacaaaaattctaggaggtcagcaactttaggtaatgcccacacctgatgggggaaatcactgtcttccggcgggctggtcctctttggtgacagatgaagtcagatgcttccgggatgaatttggttcacctttgaaggacactttgaaagcaacacaacaaaactggctgggccttgtactctccgctccctcgagaagctccccgcccggtgccgctggcttctactgtttctaagctgcctgttgggcacgttccctcctggtggtcccggggcagccagacccaccctgggacatccaggccccctgggcacagacatcttgtacaaggtcagagagactgggtttcgggcttcatgagcctcagaaattcagctctcaggaggctcgtgggaggcctccagggtcaggtctctgccggagagaaaaggggcggcctgggcttctcttcaaaagtgttacctgacaacaagggaattcagccacacaccaggtggctccgtggtcccctgaggtccccagcctttgacagtgtgtgtgtatgtggtgtgtggtgtgaaatgtgggtgtgatatgtgtgtgtggtatgtgtgcatgtatgtgtgtgggggtatgtgtgtgtggtgtgtgtggtatggtgtgtgtgtctgtggggtacatgtgtggtgtgtgtggggtatatgtgtggtgtgtgtgtatatggtatgtgtgtggtgtgtgtgtgatgtgtgtagtatgtggtatgtttgtgtgtgtagtatatgtggtgtgatgtgtatgtggtgtgtgtagtatgtgtgcaggtatgtgtgtggtatgtgtggtgctgtgtgtgtggtatgttgtgtgtgtatggtatgtggtgtgtgtgtggtggtgacatgtgcgtatggtggtgtgtgtgtggtgggggtgtgtgtggtgtttgtgtggtgtgaatgtgtgtgtggtgggggtgtgtgtggtgtttgtgtggtgtgaatgtgtggtgtgtgtgtgtggtgtgtgtggtggtgacatgtgtgtatggtggtgtgtgtgtggtgtgtgtgtggtgggggtgtgtgtggtgtgaatgtggtgtgtgtggtgtgtgtatggtggtgtgtgtgtgtggtgcgtggggtggtgacgtgtgtgtatggtggtgtgtgtgtgtgtctgtggtgggggtgtgtgtgtggtgtttgtgtggtgtgaatgtgtgtggtgtgtgtatggtggtgtgtgtgtgtggtgcgggggtggcaggatgtcattaacttggttctaaaggtggtttgggttcaggtcctggagtacatgctcaggaactgtcaagcaatctgggggcacaggaaggagaccgggcgctcctgcaggtattaaatcgtgttttgcgtgaagatcagcgttcagaccagtagtacaaaacagatggtctaggaatgaacgtgacaacacaagggcctggagtgtatgacgaagggggcatttcaaacccgtgggtacagaaaaaatccacccgataaacacaagtgggaaattgtgtaagaaaatgaagtgagattccaatattaaaaagtcagataggtcaaaatctaaataataaacaatttaccataagataattagaagaaaatataaaatactttttaatcttgggttcaagttgtcacaaaacctaagctattttttttaatccagaagtattaaaagtttgctatttcctatagacaaatagctcctacaacttggtgaggaaacagggtccaggagcattttctctgctcgggtgaagctcaggggaagacataagtacatgaaagacattccgttctgtaatgattaaaaaatcaaaagttaacaccatcacattggtaaacgttaaaaggtttaataactttttttaatatactgctgttgcacatgcaaactgataaagcctttttggaaagtaatttggcaataaaaatgcacatactttatgagcaaaaaaaatcccgtttcttataatctaattgataagaattatagcataagtgcatgtatgtgtatgagaacagtcactctggcatcgcctgcaacagcaaataaatgagtggcaaacaagctctcgcggagggtatttaaatattttatgtgactaagaagaatgagatacgtccatttgctgtgataagaaaagatattccacagtttcgtatttgttaagtattttcagcaaatcatggaacacgatgcaacacccgattccatgtttgaaaacagaacagaacaaaattcaacaagaaataagcgcccgcgtccacatattctcgtgcctggcgtgttttacgtgcttgggaagcggagcggccgctgggcttggctctgaggtcgggactggtgcaggcggatgcatgtatgtgcccgggtcccgcctccacacgcctgcctggcgccagcctgcctgtcctccctgcacccgcccccgctccctgcacccacctgccccccctccctgcacccgccccccctccctgcacccacctgccctactcagggtggtgagagcggaggggctctggggcttcatccacacgtctcctagtcaccctctcgaccaagagcatcctctggattttacattcacttggcaacaaaaaaagtttgagagaggactttgaacatcaaaaatgcttacatttgttatgtcacaaacacaaagcgttctcctaggaggtttctggtacagaccatgtttcctgaggacctggagggtatcgcacctacagccagcaacgccgtgcagcacgctcggagcgcacccaagagggcagatcagaggggcgcacgcggatccccaaaatcctgaagatatgtacggaaaatatgtgcggcttttcctgccgaccaggcctccacgaagtgcttcgataaaataaaaccagcctgtcatggaggagtcccctttgcccggagagcctgtccttcccctctgggggtcacactgccagtttgtcaaagttgggcgaagtggcccctgcctggaactctctggccttatgaagccccctccccgttcatgccgctcaatcgagtgactcttacagatcatcttgagctgcctcatggggtggggctcgcgttcccatctgccttctgcaaggtgtggcctctgacctgcagcccgcactgagccagcaagccgcgggagaggccaggcgcccgcagcggggcatctgcgcctggtgtgcagcgtacttgctatactcaggccagcccagccctgggccatctccctgagtttcagctccccggggccacctctcctgggtcccctctttgctgtggctctggcggacattagccagcagtggagagaagcccatctccacccccagggagctcagccgaggtctccgcgtcccagcaccagctgccttcagctcgagggtgtgttttcgggggtggggatcccacatggcacggctcctgcacgtccagggcatctgctagtcgtctttgcctgctccccagtgtcccaagcaactcagtaggaccttggggaagctgggtgctcacagaacaccttgtaagcgaatgaggaaagcaggcttgtccgctggccacactgcacgacagacgtctgcccaggctggggccgggggtctctgctcctacagcccgcagatgggccacccggaggctgccccgtgatggctggacctgaggctttccagtgactaggagggcttgggtacttcttattcatgagctgtacgttctacagcgtggctggtcatttaatgtgtgcaatcgatgggcactgcgcttcaacttcaaagcatgaccgggcggatcaatctcccagggccgcgggtgccgagtttaaaactcatctctttttctaaagtggaggcaagggaccccagtttgggattaatcagcagtgatgagcttaaataaatgagataaattttctatctatcttgtaaggctttttttcagaattaatgggacccctctacaatgcgctgtgcccggggagaggaagggggcgcagctgcatctgcagctgcggttgtggtcgggagaatgagggcctggagctgcccaggacgggctcaggcacaggcacccagccgagagtcccctgctgttccctctgcagagcaaacacagtttctgctgaaaagaatgtggcagatgaacaaaaattgtaaggttttctaaaggtgtttcattacgtgagatggcagaggttggtctccatgtcacagatgaccctcgcggcggtgataacctttacattttggggtgctctgtggaccccctgtgtaccctgtgagtatgcacgtttctagaggtggagtttgacccttgaattgttcaaattataagtagaatcacagaaattgggggaggaaaggatctgaggggcctccagggcccgtggcttcaccctggggtgggggcaagggcggggcgtggtgcctcttccggggtgggatgggtggatgctcgtggttcattcccacgtgggattctcacatgctcgccctccggctgtcaggagcaatggtgagttctgccacacgtggaaaacacgttggcttctctgggttttaagtgtcctgtcagcagctcggagcctctaggagacaccgtcccccagggccacgtatagatccactggaggcctgaatggcataattcgtggcacccctggcaccacacaggggtgtttctgtccccttctcctcccatggcttagaagcagtaatctcctgacctccaggcagaagtcaatttcctcctttgcctcctccgccttgcagggaccccagggctgacctgcctccctcggccccctctctgccagagccaggtctgaggtcaaggctttcggtgtttctgaggccacgctgagggccccacagccccttcccgggtccccaccctccaggccaccttcgggcctcggcagcacacctcgaggggcccaggacaagctcggggcccaggtggccgggagggggccgcctgtgtctcgcccctcattctctgctctgacccgggctcgcacctcccctcgttctctgctctgacccgggctcgcacctctcctcgttctctgccctgacccgggatcacacctccgacccgggctcacacctcccctcgttctctgctccgacccgggctcacacctcccctcgttctctgctccgacccgggctcacacctcccctcgttctctgctctgacccgggctcacacctccctgctccacccaggctgcctgcacttccggttctgcgtctggccggcctacgggcactcgggcagtgcggtgaccaattatagcgtcgacgatggcagcttccctctgaaagcccattgtgtctgcccctattctttgaagcttcactgctttcggataagtatgaaaataggctctccctctctgagtcaaaggaggcaattatacaataggactatcaccctcactgtcactctccgctttgtttaaatgtggggatttcatttcttcatcgcctctgtgaacacccactaaaaccgtaagtgggaaaagtgggtgccttctgtattttacattttttattgtgtcacttactgcaaagcagctcaaggagcctgaagacacccagcctgaaaccacgataaatgtgtggagttgtggagacagctcaccagcagaacagtgagctaccttctctcccagtaaccttttccagaggaaacctctttgaaatatcacaagcaaaatttaaatcacaaaatacttcatatctgcctgcactcattgtcatgctaaagcacatcacctcggtcctcagagaggagggatttccatgtgaaagaggccagagtgcttccctcacttagcggggatgcaattataaagtattgaaacttcctctaagacatggatccctgtgcgtcgcagcccctcacctgtgcacctgggaggcacctggggatggggtgggggtgtcaagcttgaagcccctcacctgtgcacctgggaggctcctggggctcaagctcaaagccccctcacctgtgcatctaggaggcacttcggcggggtcgggggcggggggggctcaagctaaaagcccctcacctgtgcacctgggtggcacctgggagggggactcaagctcaaagccccctcacctgtgcatctagggggcactttggcaggagggagggtgctcaaactaaaagcccctcacctatgcacctgggaggcccccaggagctgcagcaaagctgggccccagccacagcctgcaaaatctccgactccacatggggcctcagcaccgtctgtttgctcaccctccccagggggctgaggctgggaaccactgctctttaactctcaacctcttcccaaggtgctgtctatctgtggcccttggagttctgtactcggcagtcatttatttacaagtcgcatgagaaagtccttccagccactttctgtgcttgctctgacatttgcccaaactaacgttgctgaggttgacctcatgtttattcagggaacttgattcattttcaagctattgataacaacaaagtcctccccaaccaaggaacttccgccatggaggcgttttcaaaagaaagtgcttgtgctcatccccagagggttcctgagcctgtggacgaggcgggaggcgggaggtggaggaggtggcacctggcagctcacctggtgtaccttctgtgagacccagccagcccatcggtcaccaaggggtgcatgtcacaccctgacctgcctgacggagggagcccatgaagcagaacaaacacatgtgatgctgacgccctcagaaacctggggctaaggccacacctgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcacatgattttcctattcattcccgaatctcacattttaccgggatggtgacatccctgtggggccttgtgggctctgagctcatctacacccaatcctagtcagctctgctgcccctgcggggtaaactggcagctctgagttcactgggtgctgtttactgaacgcctgcccatggaagccactgtcctcatcactgggaaaggcgcagagaagagaaggaaacgttaaaaatctggttggagagaggaaacaaacttggaccatctttgacagtggtattagtccattctccatggctacaaagaaacacctgagactggatgattctaggaaagaggcttaatcggctcagagctctgcaggttgcacagggagcacggcagcttctgcttctggggaggcctcagggagcttccagtcacggtggaaggcgaaagggaagcaatctcgtcccacggtgggcgtaggcgcaaggtgggaggggctacccaggtttaaacacacgggtctcagaaaactcactatcatgagaacagcaaggagagggtggtgcaaaaccattcaaaaatcacccccaagtccagtcaccaccccccaggccccacacccaacactggggattacggttcgacaggagattttggggcacactgatccaaccatctcaacagcaaagagtgatctgcctcgagttccgactcgccgctcagacgaactcacggctcagctgggagaatcacacgggaggggcccatgaacgggcactggggccacagccggggattcaactgcaccgaaatcccagccctcaacacggcccacggctgtgtcatcccggatttatcactataaagcaaaaccaaaaacggacctcaggtttctctgcaatatgtaggatccgtgaaacctccaacgtgaaatgagaagtaggtagcctcgaatctgcacccaggcagccccaaaggctatctgatgacaacacacattttctcatgaagcggaggagagtccggccttgttgctgggcctgcaggacatcccatcgctcatcttaattctcctgagggtgatatttacacctgatatttacaaggtgtggcaagtgagaatttcatcccagcctcctgcctggcaggttacacaagctggccacagggatgcttatgggctgaggtcgtgggaggcatcccgtgagggtcacaggctgaggtcgtgggaggcatcccgtgagggtcacacaggcaaagactgtcagccaaaaggaattccaaggcccggacgggaggcggccacaggctcctgggtgtgctgtgggacgtaccactcggtggcagggcctggccagagagctgccctgcaggcctgtgggatccttcaacgcgaagcttgcattccaggagctccctgagccctgagaccatggtgaggggctgcgttgggccaggctgggtgtgcacctgtcagttacattttcctatgtgtcctccttcctttctttggagcctgaatctttgtctttagcatcctttgtagtcttgaattctgagcccattcctgagacccctctgaacctccagaggccccgcagctctcaagctggaggactggggactatgctcatctttcctttgaccccaggtctgtcttcctacatttctttaacgattatttctctgggccaggcgtcgtggctcatgcctgtaatcccggcactttgggaggctgaggcgggtggatcacctgaggtcaggagttcgagaccagtctgtccaatatggtgaaatcccgtctctactaaaaatacaaaaattagctgggtgtggtggcgcacgcctgtaatccaagctgctcgggagactgaggcaggagaatcgtttgaacctgggaggcggaggttgcagtgagctgagatcgtgccactgcactccagcctcggtgacagagcgagactcagtcctaaaaaaataaataaaaataaaaatagaaaagaattatttctctaccttttggaatgtgaaattgcctctgagacgaacctgtgatttgtcacctctgggagatgacaaggatgcctctgtgacctttgtccccatgctaaatattttgtcaccatgctggctttcttgtttgcatcagtaacagaccggccatttctcccatttggctgtacagtcgttagcagtggcccctccacacacacagacacacacggacacacacagacacacacatggacacacacggacacacacacacacgtcgcttctggtctgagaatgtctgcctcctttccattcccctgggcaggttattttcttctcctaatcacaaaacccatccttcatcttaataattctcctgagagcgatatttacaccctataattagaactttatgttcgttttattaattacctcttttttgcctattgatgtgaaagaatctggggctaaaagtattacagatggctctacacattgaaccgttgatatttaaactcaatcagcagatgctggtgctgtggggtggggtggggcagggtgggcgtcccaccggctcctcaggccttcctccacatcccatcggctccactcagggactccacttcttctcagcacctgtgccctccagtccctctcccaggaaggcagcaggagaggagacccccgtgccatcttcaataccacccctgtgactagggtgctgccccctcctcctttcttctccaacttctagatttggcccctaaatgtgactgaataacgtggcaagcccttcagacatgacaaccccatcgggtcagagaggtagtggttgcagctgggcctggcccaccatcggggtggggccagcaggagcaggagcacgctgtgtgctcgtggggaggaagggctgggtgaggctggagcgtgggtgggaggtgctggacagggatgctgagggcaacgggccctccctgcaccgaggcttcagcagccctgctctctgctgtcagcctcggatccgggctggcctggccttcatctctccccaggctccaaagaccccacatcgccatctcttgccgtgagacctccccacgctgaacgtgtgttcctctagccacttactcaacgtctccactgcaggccccagtgtaacttggccaagcagacatttcattttccccaccagagcagacccagcccagggctccctcctcaccttgggacctacagcaggtcctgccccagctccatgtgcgggtccctcatctgactcgcacactgcccctccgactggcccagggcctccactccagcgtgtgctcctcaggcccagtgttctgagcgtggagtgaactttctaagtcacaatttaagtcacatccctctccctctggaaatgtctgctggctttgcacccaccaaggacaagatccacagccttcaacacacggcatcacgaaccacctcccgagccggccccctccatccctcagagtcaccacaatcggcctaccccgtccctcagaggcaccacagccggccccctccatccctcagaggcaccacagccggccccctccatccctcagaggcaccacagccggccccctccatccctcagaggcaccacagccggccccctccatccctcagaggcaccacagccggcctcctttgtccctcagaggtaccacagccggcctcccccatacctcagaggcaccacaggcagcctcctctgtccctcagaggcaccacagccggcctcccccatcccttagaggtaccacaggcagcctcctccatccctgaggcaccacaggcggcctcctccatccctcagaggcaccacaggcggcctccccatccctcagaggtaccacagatgccctcctccatccctcagaggcaccacagccagcctgcgtggcctctgtgtttctccccggggtctttccaggctgggcttcttctcgtcctaacgctcagaggcctctgcttagccccaccttccatcactgtgccctcttctcctttcttcacatcacaccttactagaaattacccggtcactatagtgcctgtcccttctccgcgacaaggggacccctagcgtgcttccccgctgcgctcccagctcctacaacagtgtctggcccctcaaagcgactcaacgaccctctgctgatccaaagactcggcatccatgtgcctcccaggccgccgcactcctcctcctgggaacaccctcgtacggacgttctgtggaaatagatgttgtgttttcacctcttgtaccttgttcacttaaaatttaatcaacatcttattagagaaagaaagaggttctttgctttttttaacttttaaaatatgaatacctgccgggtgcggtggctcaggcctgtaatcccagcactttgggaggccgaggcgggcggatcacgaggtcaggagatcgagaccatcctggccaacacggtgaaaccccgtctctactaaaaatacaaaaaaccagccgggtgtggtggcgggcacctgtagtcccagctactcaggaggctgaggcaggagaatggcgtgaacccgggaggcggagcttgcagtgagccgagatcgcaccactgcactccagcctgggcaacagagagagactccgtttcaaaaaaaatatatatatacatatatatatatacacacacatatatatacacacatatacatatacacacacatatatatacacatatatatacacatatatacacatatatatacacatatatatacacacacacacacatatatatatgcacatatatatgaatacccaatacccaatccacagctttctctttgtggtgcttatgtggtgtcacaatgcgtcttgtgcctctcatctgattccgctacacggtgcaagttacgccagaccagaaactgaaccgacgctgaaagtatcaggccttccgcttagcgctgccttcgagatcagtctctcgacccctgttaggagcaacggcggtgaggcaggatgaacggcctcatccacggagcactgctttgccgtctccagaaagagctgtcgaggtttatttattcacggagaggctctgcatcacgagagtgctgcgttaacccaggtgcgggggatattatcctccccgtgagagcagctgcatggatttttttaatgtcaaattccatatgaaacagcacaaatccccatttctgccccactgggttgagaaatctgtgggtgatagagtataggtaaaaacatcttagcctgcatgaaaacaaacatcatcttagaagaaggaaagagcaaatgttttaaaggcctaaaaataataattttctctagggaaaaatttgatgggcacgctatgatttattgccaaatgatatttaagaaaaattcacaggagaggcggctgctgaatgcctccaccgagggttctgggaaggaaaacgcccgcttagtggaagaacagaacggccgcacagaaagtgcttggtccttggcttcctgtgtctcccccaaaacacacgtggcttatcagaaacctgcaggaaaacaacacagatttattctctcacaggaggccacggtccagatgggtttcactgagctgaagtcagggcttgggtgggccgcacgctctggggcggctcctgaccttttctggcttgtggcacctggctggacttctcggcgtgcagctccttcgtccaccgtgaaacccgccccggcgtccctctccgactccgcttccttcatgggacttcacttccgtgtgctaagaacgtgtagcgaggcccaccgtgttgacacttccctgagtgtgcagcgtggtactgttggctctcaaccgtacggcagatgtcgagaccgcgttgaggccgcgtcgctgaaaccttgtgcccttggaacggccccttcccgtgcttcccccagcgccagacccggcagcctccatcctcctctcttcttcggtgcgttcaattgtcatagattccacgcttcagcgacgtcgtgcagcctctgtcctgggcctggcttttgtttcacttcacgtcatgtcatgcaggtttatccctgttgttgcagatggcaggttgtccgtcttgtcttaaggctgaagagcacccactgggtctatgcaccacgctttcctgcccgctcgtccctgggggacatgtgcttccatgtcttggctcctgtgaacaatgccgtgatgaactccggagcgcacccgtcacttcgaggtcctgatttaacttcctttggataaatatctggaagtgggattgctgaatcatatggtggctctatttttaattttttgagaaaacttcatactgttttccataatggttgcaccatttatattcccaccaacagcatgtaagtgttcagagtctacacatcctcaccaacacacgtctttttggtcacagcctcctgatgggtacagagacgtatctcatcgtggctctgatttgcatgttcctgatcattagtgatgttgagcatctttccatgtacagtgtgttggccatttgtatgccttctttggagaaatgtctactaaagtcctttgcccatttttaaatcaggttatcattattatttgctattgaattgtaggaagtccctatacattttattttattattattactttttggagatggagtcttgctctgtcatccaggctggaatgcagtggcaccatctcggctcactgcaacctccacctcccagattcaagtgattctcctgcctcagcctcccaagtagctgggattacgggtgcccgccatcacacccagctaatttttgtatttttagtagagacagggttttgccatgttagccaggctggtctcgaactcctgaccttaagtgatccacccacctttgcctcccaaagtgctgggattataggtgtgagccaccacacccagccacctatacattttaaatattaactccttatccgttatgtggtatgcaaatatttcctccccggtgaccagtaggggatgcagagaccacacacccaccactcaccctacctttcgtgggctgccctctggatttgctgattgtttccctgctgatgcaggagctcactggtttgatgttgtcctgcatgttcacatttgcttctgttgcttgtgcctttggtgtcagatccaagaaacctttgcctagatgaatgtcatcatgcttcccccgtgttttcttctagtacgtttatggtttccagtcttatgtctcagtctttagcccatgttgagtgggtttttgtggatgtgaggtgagggtccgatgccgttcttttgcatgtggacatccagtttccccagcacctgtgaagaggcgacccttccctatggtgtattctcctcatgcttatgaaggagcacttggcagtgtatgagttgtttctggactctctgttccattgatctataagtctgtttttatgccagtagtgtattgttttaataaccatagctttgtaatatattttggaattgggaactgttgcatgattttttgtggagctctgggcaggtttttcatgatggcaaaatatgtcaacttttctttttggtgtaatttcttcattgctaacattttccctagacagtgaaataataaacattttctaaaagttcctcaagaaaaactattgaaattatttagtagaaacatatgcaagagtagataatattgatgtatccttattatatttagaagttaaaattaaagaggatcttatgggaaatttaaaaattgcacagtaagggattccttaagaaacaggcgcaagcccttatttcgtagcatctaattcctcaccgggtgtggaggggcctgtttacccaatgcccccgcgaagtcatagtttggtggcatacagctcttaagaatgcttattagctcttaatatcagagaggattaacctcctacttcatgaaacaatttgctaaggctgggaatttttcttccatgtctgtgaggactgccttcccttctttccacacacttcttcattcgttgtgtacctgctgagcactcatgatatgtcagaccaagttctagggactgcagtggtgaacaactccagtgtctgtgcacggagcttccattctgtaaccatgcagctgctccagagaatgccaaggtcccagccaaaaagctctagatgattctagactgtgcacggagcttccattctgtaactgcagctgctccagagaatgccaaggtcccagccaaatagctctagatgaggggtgacacataaggtgaggacccacgcgtgcacacacatacacacacttgcacacacatgcacacagtctcccctctgacccttctcgccctactgggtgaccagtaggtgatgcagagaccacccacccaccattcagcaagatctgacaccttctgactcttgacagatgatttctgcagacagatccgatgtcatcttcctcccagccccccttctcccagtcctgcctcttcccaccctgcaggtctaggcctcactcacgagagaaggctggttttatccactgtgtgtggagcctggcaacaagcatcccacattggtgtgatccaggttaccctctcgccatgcagtgccctcactgcccttgctgcccctgagctctcagagggatgcgctgcctcagcgtggggtgggagtgccgctctgcacactagactcagtcctctctctgcctggaaatacccacaaaggccacaggatacagataatagctgtactggtgctctcagacacattttccatgaaaagaagaaaatagcaaattccagtaagcattaaggaaactccttctctgggagtctctgttcctctcccccacagtgcttcttatactgtgcatttgaaaggtgttttaaaaggacttgttgtttctttaagaagcatagaaaaaatatatatactcctgtgtgtgtgtgtgtgtgtgtgtgtgtgcgtgtgcaaatacatcatcaactgaaggtctgaagaaaagggaaaagatcgcagctcatcaggaatgaaaggtggcttgttctccagcatcctagttaaaagttcaaagcacatttttcttataaattaggctggagtaaaattcagggagatgggaaaaggaagacataaatttttaaaacatgcgaagaatttaaatgagcaccaggggtgaaaattagacacatagaacatgtattcgacgtaaactcccggttgtttaaagtcattaacgttgtgtcgttatgtctagtgtcaggttatggctccacagcctgtttgccagttaagcggtgggggcagggcaggccttggtcaatatttgagtaaaagaagaatcttaataaacccaagaaagtaacttcaataataagaccaggcagtgttttgcaaagcagaacagaagcaattcaaaagggagagagacacagccagaggccccaggagcccccaccttggggacatggagtgtctgtgtgagcctggctttgttctgaggcaggagggacccgagtgcttggggccagccctgtcctgttctgcgttagcgatggggtctggtgcttctccacacacaccgtggctgtgtgtgcaccggctgggtgacggcccaggtggttttgtgccagctgctgatgctgagtgcacctgaaaggcccacttagcctctttgtgaagaggtgtgggaagatgtgcacacagtagagagcagactatcacaagccacaaaaatgtgtgtgtgtgtaatatatataaaggtcgaccattccttatctgaagtgattggaaccagaagtgtctcaaattttgcattttagaatatttacatcacacttactggttgagcatcccaaatacaaaaatctgaaatccaagatgctccaaatcagcattttcctttagggtcaggcctatgctcaaaaagttttcgatttgggggcattttgggttttagatctgggatgctcaacctgtaggtgcatgtatatatgtgtatatatgtatatctacatatgtattcatgcatgtgtacaaaaatatgcacatatgtacatacagatgtatctgtatatatgtatatgtgtgcatgtatgtgtgcatatgtgtctatagatgtctggtatatatgtatatgtgcaggtgtaaatgtgtgcaatagatgcatatacgtgtatatgtgtgtatgtatgtatacatagatgcatatgtgtgtatacatgtatatgcgtgtacatctgtgtgcccataaagatatatgcatgtgtatgtgcatacgcatgtatgtgtgtgtgtgtgtacatcttctgtctctgcattcttactggcaggattattgggaactattggatctttctgaggaggccaggatgatttccgtggcctgccagtttctcagagctatctgggttgaggcactgagaaccccctcagtccaggcagaccacggcccggtggtctgcatgaacaaagtgagtacttggagggccactggcatgggcccagcttcccgctctcctctgcatgcacagcctctatcccatcagacctgcacctcagcagcaccaagctcaggggctgccctgggctcccctctgagcatcagctcctctgttccagggagagcctctgctcccctcagggcccacctccttctagcagaaagctgattcttccccagactgggccctcagttctctgctaggtttggccaggctggtgtctttgacatgatcttctgggaggagaggcagaaatggggcccttccgatgtagctggcaaagctgtaggtgaacggtttgtaccaccagggaactgtgcccgagaacacatatgttcccacaacaatggggtttgtcagcttgcaggtgcccagccctttccgtgccctcttgagatgggttggggcagacagagtaggaatgcttcctggctgattacaaggaaatcccggcccattggatggggaagccacaagacggctgcttggagagatggtgctgcacacacatggcagccagaacgagtgtgggttcagagagcaggaatagcactccctgcccttgtcatgctgtggccaaggtttaggactccacagggcccagatgtctcctctggtcccaggaggatggagcctcagacctggggccatggggagggaagaggtgttccttgggacaagcaggagcccagtgggcagatgcctttctgcacagccaggggactgctcctatttctactgtttgcctggcccaattcatcacaggagggtgagggcagggctgcatgcctgagagctgacaaatccttcacatcctggagctttgtactgaacactgcagggttccatacagctgtcagctgcagagactaggcaccgcccctgcaaatgcctggcctcctgctgtccagctgccttcactctggcccggaagtggttctggggacagtggcttccttccagggcagaagctgagatccagtgtctgtggagcctctcatggcacgtcaggctctgggatggatgtttacgtgggttaccctaccaaatccctgagaactgctgctatgattcccactttacagatgagaaaactgaggcttagaacattaagcactgtgagctgagatcattggctagtgagcagcagagctgaggtccaactccaagtgtgtttgcccccaaactcacactctgtaaaagtccatgggcatcccagatctcccacccatgtcttcccactggaccaggcatccccagcctctgggccacggactgacaccagtctgtggcctgttaggaactggggtgcacagcaggaggtgagtggtgggtgagtgagctgttgagtggccggtgagtggtgggtgagtgagcaggtgagtggcaggtaggtgagtgggtgagtggcgggagagtgagctgttgagtggccggtgagtggtgggtgagtgagtacgtgagtggcaggtaagcgggtgagtggcgggtgagtgagcgagtgaaactttgtcggtatttatagccagtccccatggctcacagtactgcctgggctccacctcctgtcagctcagcagtggcatcagattctcataggagcttgagccctgttgtgaactgtgcatgtgagggatccaggttgcacgctccttatgaaaatctaatgcctgatgatctgtcactgtctcccatcacccccagatgggaccagccagttgcaggaaaacaagctcagggcacccactgattctacatgatggtgggttttataattatttaattatatattacaatgtaataataacacaaattaagtgcacagtaaatgtaatgcgtttgaatcatcctgaaaccttcccccaaccttggtccatggaaaaaccgtcttccatggaacaggtccctggtgccaaaaagagtatggaccgctgtcctggacaaaccctgggcctggaattgaccttgttgaaaacactcttttggattaagcatctataagattcagttgttgccttggacgattcacatttcacatggtcagtccctgcagcacctcccgaagtgtggtgtgtcacttgcttttatgtggaatgtgggcagttcttaaaactttattttaatgcacacgttcagtccctgcagcacctcccgaagtgtgctgtgtcacttgcttttatgtggaatgtgggcaatttttaaaactttattttaatgtgcacgagaaaaagcaaaatagtacatcaaaaacatgaattttgtgggtactgttgcttaggataagtaagaaggtttcgaaagctgagtcagtccaaagaggaacgtgttgcgacaagccagatgccttatggagccaggaggctgtgactctggccctggagggggctcagccctgagcgaggtgtggaaggagcccggcaccacccctgccgtgtgagctcccacgtaggcccagggttggatgagatgacaccgaggctgtggagccaggaggctgtgactctggccctggagggggctcagccctgagcgaggtgtggaaggagccccgcgccacccccgccgtgtgagctcccgcgtaggcccagggttggatgagatgacaccaaggcactgtggcgagcagaaccgtttccccaaaaagacacgttcaactcctaacaccagcacagtgaatgccgccttctggacatagggtctctgtggatggagttagtaaagatgaggcccttatccagtacggccggcatccttctaagaagagacagcacagacacgccccgaggacggagacggaacggagtgaggcgtctacctgccaaggagcccccggcattgccaggagccacagagagtcgcccgagagcttcctgagcacgtggccctgacaacacctggatctccagcttccggcccgcggtcccgtcagacaattcatttctgtggtttgaagccacccagtttgtggcactttgaccccaggatcctcacaggaaaccgtctcactggcccagtcctgctgggccctgcccatgggatggacttgctgtccttgaacaggaggcaggttcggggaacaggactgtaatgggtcatggaaaataccaggctgatggcagagggtgcgtggggaggagatcagggaaccgccaggccggagctggaagccggggccaccgtccaactcacgagggctcggcagagaggacaggggagcttcccctgctggctgaagtgggtggaggcgaacctggcccacaacaccctgagcttctgcggagccatgtgagggccacgtggagaacactgcagttccaccttcatcagataaagccaaccgttgttgtttaagcaaaggctgcggacagtgagcacagaacttcacaacacatcatggtcgcagcgcaccatcccccgtgatcccaaagcagcgatctagacgtgtggggtccacaggcgggcgccctggcactgggggctctgcaacttgacgaggctatgccaggctgggctagaggtgccgtgctgggcacaggctctccacgggatggcgggactgctgggcacaggctctccacggggacggcggggctgctgggcacaggctctccacggggacagcggggctgctgggcacagggtctccatggggacggcgggactgctgggagctgggttctccacggggacggggacggcgggactgctgggggctgggctctccatggggacagggacggggacggcgggactgctgggggctgggctctccatggggacggggacgggaacggcgggactgctgggggctgggctcttcacggggacggcgggacttctgggggctggctctccacggggacggcgggactgctggaggctggctctccacggggacggcgggactgctgggcacaggctctccacaaggacggcaggactgctgggcacaggctttccacggggacggcgggactgctggggtctgtgctcctcaccccagggctcacgcttttccatgagaccctccccagccacatcgggggctctgaagactgagcactgagggtcagcagcaggtaggagatgtctttgaagtttcatctgttatcttaaaaactcgtggatttttggggcggggcgctgtggctcatgcctgtaatcctagcactttgggaggccaaggcaggcggatcacgaagtcaggagatcgagaccatcctggctaacacagtgaaaccccatctctactaaaaacacaaaaaattagccgggcgtggtggcgggcacctgtagtcccagctactcgggaggctgaggcaggagaatggcatgaacccgggaggtggagcttgcagtgagcggagatcgcaccactataccccagcctggatgacagagcgagactccatctcaaaaaaaaaaacccaaaaaaataaaacaaaaaaaactcatggatttttgtaatctactctattatatatatatatatatatatatatatgcacacacatgtatgttttagtatcaaaatgacttcaccccaaatctccacgtgaagtagatgcgtctcctctccatcgtggctgttggcacagtgctgtgtacctgagtgtgttcaacgtcttgagatttctaagcttaagggcaggagatagcccagggctggcacccaaatcctaagaaccctggccaaatatacaggatttaatgtcctcagcaccaggcatcacacaggaacgtgcgtgagcccatgaaatacttgctcaataataaatgctgccaagctgctaagcttggggaacctgatgagcactcggcttatgggagactgatgctccccacaggccggcccctgtgccgagactccacgcagtggcttcctcgctgtgacagcctcccctcatctgacgaggtccaaacagcgggtccaattctacccacacctctttgcatagggtgcttctctggattttagggtctagaccaaagctgaggctgttttatacattttggggtccctggaactcaggacaaggccatctgtatccccaatgctgaatgagtctccgacaggtgatagggcgatggggtcgctgtctaagtagggaaggaccaccctcgacttaagacatggctcagtgaaaaaagcctcgctctgaggacaggcagtgagaaatgaggaggttcagggcaggcggactccatgtgactgagggtttggccgggctccccttatcaacccggcatccctcgaccatgttctctggtgcacacaggtgagcagagggcagtgtctgctctggccaaggcaggggcaccccaacatcgcagccccttttggatgtgaggtccgctcattagatccgaggggccgtcctcctcccgtgctgggacccttggggcttgccgggagagacgcccagagggaaggggctttgtgggaggaggggttccgctgcccttcctggggcacctgtttcgctttttgtctttctttcctccctttccactccactccctttggggcatgagggaggtgagggaggagggtgggaagaacaaaggagagaattctgaggagggcgtcctgagttccagggacttctttcatcaagaggaaaaagaaaaactctttcaacactccctgtgcatagggtgctaatgagctgcaaattgaaattatttggagtttttcttaatggtgaaaagaaagaagttgtcagaggagaccagaaactctatgtcagctgagaaagctgtaagcgagagagatgaatggacggctcatctgtgctttggtgcatctttcatcagccggtgtcacccttggtagccgggtgctggccaatttccatttaacttccatttaacgtatagccaaggaggcccgtgatttcacctgtctgacccaccacagatgggtagctgggcttcacagaaatggaggttgagttcccggagcggtagcccagggctggtatgttgagaattccgtttggaaaccagcgttgtgcaaaccggggttaggatgtggaaaactcgccctccttccaaacccagaagccttcgtcttggtttagaagtccctaagccaagtccctacccacattccacgctgctccctaatttcacccggaccacagcctctggatgagcttctgttaaaaagagatgactcggtgacaaacaggaggacggtgctcaaatgactgtgacacgtgccgtgtatctgcaaagacctgtgccgtgctaaaaccacacgcatggcagcctcccccaagccaaccacccgggcccacagacaagcatctccagagcgcgtgggaccgtagagaaggcagtgacagggccagggcaagccggttggagaagtggaacttcagtggtaagcccagacctttgggacccctcaccctgcccggtcctcctgctgtggggtgtgagtccagccagtgctgggaagccggtgtggctaggacaacaaagaccaaggacagcggggaacggtggggagggaagagggtgggagaccagagtcagaggcggacaggggttcgatacgccattcaggtccccaaaacagcatgtgcagctctcgttaaatggaaaaggccctaatgtcatgggaaagtctaacaatttgttaaactttgttagtgtacaaaatgtggtgatcctactcgtataaaaaagaaagttcaaatgcgcagaagaaagatcagaggacaagatgcccacgaatgataagcgcctttgctgcctctgggcgggtccgggggagtcgcatttcttcctcactgcatcgctgtattttccagatgtccactgaggaatgagcattgctttttaattagcagctgccccgagtgctccagctgccctgcgtgtggctgtctacacagcacgcattccttaccccggtggttttcatctggaccctgagtcagaatggcctggagcgcgggtaaaacagctcggggccagccagagcttctgagccagggctgggcccaagaacgtgcatttgcgttgttccccaggtgatgctgctggtgaccccggggaccccgccgtgagagccccgacacaagtcgcggtttgtggtgctttggaggagtttgctccttagagtgagggggattgttctgccccaatggcctcttcagagctgcgagactgtgcccacgcgaggcagtggtcgccacacccacactgccgtgctgcgcaggtgaggcctggtgcacggagcccctgggggacacggcgaagggccttctcctgccatctgctcaggaacccctccctgggcttggcctccatcttgacaggcaggcgaggaagcccctgctgacgccatttacaactgcaaacctcccatttcctcccaggtccttaaagctccacatcataaaacggatgtgcgcgtgaaggaaacgtgggtgtccacagagagctcccccggagaaggccacgtccacggtgccgcctgacagcaatggcttcctcagcgtttgacgggcagggagaagggtggggaggccacaaggacaggagaactggcgctcgacatggggcaggacgggagcaggatgggaacaggaggggacaggagggggcaggacagggacagaggagagacacggggcaggacggggcaggacggggacaggcgggggcaggacagagggaggacagggacggaggagagacggggggcaggagggggcaggagggggcagggagccacgtcttctccaatcccatatggggccatctgccaccctctgcccaaaatgtacgattcaccatggcaaggaggcgagaagcggggagatccctctaaacccaaatgaacacagagtgatggggccccagcaccccatccacaggctcattccattatttgaaaatgtttctaaaaactgagcttcttttcatctttgaattggcttcttgtcacagagcagctttgcaggcagcctgtttcaggtgtccacactttgcagagggcgcctctgcacagaagcgcacgagtcccagatggagggaagcaaatctcacccaactttaaatatttgtttctccaaagctacgtggtcacccgtgcatggtgacggtgatgtttgatttcaggtgactttgaggctgaccttccacacggggccctgcgtttctctcctctgcacctgaaccctcctagtctttattctgggagcagcgcgggaggcagtggagacgtggaagcaggctccggctgctgggcctgcatgaccggtttccctgcagaagattctgcgcccttcagcctcaccgtcctcacctggcctgggtgctgctgtgggcaggcgctgggcacgctgggaagagcagggccagccgtttgcaggacgggaggctgaggctgtgtgcacctcctgagggctgggccacaggtgggctcaggcctgcgccctcccatggccgtggcctcttcctcggtcctttgccctccagggtgccaggcctaggcctccgcgcatcagtgtggtcaaaaggcaggactggtgtgtggtgtttcctgacattttgttacctgtagagccacttagagaagcaccgctgccgaggtgggaaagccggagtcccagccagtgggctgagctcagggtgctggggtcctgggcccagactctgtgctgggaccttgtttggaaatagggtctttctagaggatcacatttagatgacgtcatgggagttggccctagtccagtgttgctggcatccttttaaagggacattcggatgcagacaggcactcatgggggtcgacgtgaaggagagagccacccacatccaaggactgttggaggccaccagaagctgtagagatcctgggacagaccacccttacagcctgccatgagctggggcgcgcgcacatgtgtgtaaagcagcacacatgcatgccacaaagcagaggctaagcagtgcacactgtgcacactctgcacacgctcaggcggtgacacgttgcagacatcgctgtgcttcagaaagagctgggcggcaagattcacacaagtaagcatgttgcagactccccagcacacgccctctctggcttgtgctcatatgaacatactgtcaccctcgtgcagatgtgaagatgtgctctcactcatgcacgtacagatcacgccctctcgctggtgtacatgtgaacacatgctcccctcatatatacaaatacactcactccttctccacccttgttcacagcagcagcctgagaagacacagaattccatgaattgcagcccagagaccccccagccctgccggctcgcctcctgcctcccgcctcctagcgtgctctgaggtggagaccagctgctgccccgtgcctgccccgcctccctgggccatgctgccttgcagactctgctgctcggtgtggtcgggggcctgggtcggccccagggtgaatgagtgatgggttccaccctaaactggctgtggagaccttccacacactttcctcccctccacgagctctagggcagggcaagcttggaagccaagggctggcagaggccgagccagcctggatctcagagtggccacacggagcagagccacactccacctcaggacgctgcactggatatgagtgagaaacaaactttcttgggttaagttgttaagatttcggggatgtgtttaaagtccctagtgttctttttactgtccactgcctgtctccaggaggggcccgggggcaggcactgaagcccccgcagtctacaggcctctggcactcagacaggagctctgctctcagaaaagcaggcaggctggcattcggcacatccttggaagcgggtggtgcgagactctgccctctaccctctgccctctgccctctgccctggcgttgagtgctttgctgggactgcggctccctggccccctctcttgccccacatgtggattcgcacagaccctgcagcatccccctccctttctcctcctcttttctctttactcaggaatatcccatcttagttacggggctgggcaccccaagacctctctctaacaggggtccccacatccagggcactgcagatgggctgccgaccacatgcctctggcctccggccagtctcgggccatttgctgacaccccggaggccgatgggccctctcgctgctcaaggtggagggaggctgtgcaccgggggtgtcggcatgggagcgctgtgttccgggggcgccgcgggtccctcctccccaggctgcttacgcgtcacaccagcagctctgatttaaacccaaatcctttcacataaaacccttcacttgtgctcttaggagagggttttgcacacgtctggctctgcttcccttctgctgcattttgctggtgcgctgggggtctgtgtgtcttattcggagaagacgttgctgctcccccaaacgaagaatcatgtcacaggaaaccatgacaaaccccccttttgactgtgcctcccagcaggagaacagggagctgagaagacaatgaggagcaggctgtggggaaaggagaggtcactgaggtcacatgagtatcaggcagatggtgccactgccggagccaccccagagccaccatcacggcaccgtttcatcccatccagtcctccccacgtcctcaggtggccaaagaccacattacaccacatctgtcctcagggaaaagaggagagaatgcatctgagaggacctgtcgaccagggacacacccgacctgcacaaagcagcatctggagctacggccggggccatcaatggggtgagggggccaaggagagccctggctgccctgcagagggtgtgtccgtgtggcctgtgtgcatgcacgtgtgtgtctatgtgtaatgtgtgagagacgtgtgtgatgtgtgcatgtgtacatgtctgtgtatgtgtgcatgtttggtgtgtgtgtgtagcgtatgtgtgtggtgcgtgtgtgtggtgagtgcacatgatgtttgtgtggtgtgtgtagtgagatgtgtgtatgtatcatgtgtgatgtgtatgtatggtgtatatgtgtgttatgtgcatggtgtgtgcctgtttgtacatgtgtgatatatgtgttgtgcgtggggcatgtgtgcggtgtgtgtatatatgtatatgtttgtgtctgtggatgtgtggcatgtgtggtgtgtgtggtgtgtgcatatgtggtatgtgtgttgtgtgtacagtgtgggtgtgtgtagtgtgtgtatatgtgtatgtgcatgtgtggtgtgtgtggtaggtgtgtggtgtgtgtgcattcatgtgaaagtgtgtgcacatgtgtgtttgcatgcatgtgtatgtgtgtgcccgtgcatgtgtggtgtatggtatgtgtgtggtagatgccggcagtgtgttggtcatagggagggaaggtggaggctgcggtctagcagcagagaaacagatgggtggttttttctaaagcgtgggaaatgacacgggggctgtgtggcctcagagatgggtggggtcattggggagctggatcaataatctggacatttgggaagatgtcttgggggccaggtgcccaagctacatcttcaacgatgaggaagacaggaaacggggagggacgtctcaagagagggcgtggcctgagccaaggagttcaggtggcagcttccagaagggcagaggccacgacaccgaggcccccagctggtgcctcctgtggctgagtgatgaggggcactggagtccaaggccctgggtgtgagtccctgggatgctaaaatttaatttcctcatgtgccaaatgaagacaatatagtatttacccctcaggcaattattaggaagattaaatgttaattttagagaaaatgtaaaacataaatgcttttgtgattaattaattcattaattacgtgtggagaacctcctgggtgccaggcacatggcactccagccacaaacaggagaagctggcccgccctcctccagcagccctcgcccaacacacccctcctctgaaaccagcaaggccaggcccaggcacccgtgacaactgcaccccgagccacctctcaggacaggccaggcccaggcacccatgaaatctgcaccctgagcctcctctcaggacagaggccatcagcccacgtgcctgtgggattcttcatttctgccactaagctgccctgtggacaccactggccccagccccccaaacacctgctgggcctgggtccacagtggcccacctgcacccgctcagggtggcctgggcagcccccttcggaagcccagggctctgctgcctgggagctccagcacccagggacgcgctcatttggcgctgggtcttccaaagtgagccctcacccccatgcctcatcagcatggccctgacagggacaggagtgtggtagaggacttgggttaataagtgagatttttaacaggctccgctcagctggctctgtcggctcgagtctgagcccatccgtcagcgtcaattaggaagcctcagctcagaacgcaacaccaggggctgcgcagaggaagaagcgcgagggcgccctgcaggctcacagcgcctgagcacacaccgagcggccgcagcacagccctccctcccgccccaagcacacaccgagcggccacggcacagccctccccgccccaagcacacaccgagtggccgcagcacagccctcccgccacaagggtacaccaagcggccacggcacagccctccccacccctacctccttttggcagcgcaggtgcattcaggggagcgtgctggatgggagggggctccctgtcacgtctcctggaaggatgggatccctctgcacgccccatcacccgcccacccactgccagccatgggcacacacacaatatttgtgtattcatgaacacgcaaaacacactcacacatgcgatcacactgcatgaccccccccacacccacacatgcagtcacacacacgcacacaacagacacatgcttatgtgcacacacacaacacacctgcactagcccaggcactcacacatacatgaacacagcagacccaaacacgttcacacgcacaacacacccacacacacagaggcactccacacacacatgcacacacacacccacagtcacacatgcaccaccacacacatacagcagatccacaatgtatatgcacacacacaacacatccacactcacacatgcactccacatacatgcacacagcagacccccacacacgcacacacatatagaacacccacacttatgcactcacatatatatgaacacagcagacccacacagtcacacaccaacacattcacacatgcaatccacacatgcagcagacacacacacgtgcacacaccacacccatgtcacacacagcagacccacacacgttcacacacacaacacagtcacatatgcactcaaacatacatgcacacagcagacccatatatatgcatattcaaacacacaacacatccacactcacacatgcactccacacacctgcacacagcagatccccacacacatgcacacaaacacccacactcatacacgcactcacagcagatccaacacacgcattcttacacatgcacacagcagacccacacacgtgcacacacacgcacacacactcatacatgcactcacagcagactcccccacacacgcattcttacacatgcacacagcagacccctacacacgtgcacacacacatgcacacacacatacacacaccttcacctgaggccaagccaagggggagtgatctgggaagtggcatctggaggctgaggaacctcagagcatttcttcttttgcatctgaggtttcaaaacccatgagaatgatcttggagttattccttattctctacatgccaggaaaggtgaaatcagaaaggagaggatttgacagcctcacccagagggaaagtgtcaggctggggctcactttttgccctttggagccgaggatgaaggaaacagtaactgccacagggcagcaggagtgcaccccgcagcctggtggagtctcccacgctggaggggaggcaagagtgcaccctgcagcctggtggagtctcccatgctggaggagaggaggatgaggccaggcatactggacagcttgtgtgaccccaaggcaggcatggcaggatctaggtgcagatgacacacccagcatccttgtgccaatgccactcgggtgtactttgctgcctctgctgaatgtaggtggaagaaggcaactcacctgtgaacagtgctgtcctctctcctgagaaccagcacaatcataagtttggagacaacaacaagaattcagttttagttatgagaggcctataagacctctgagtaaagacataactctaggatctggtcagagctataaattcagggtcaattcactccatggctgccatttggagttatacagatgaatgaggtcatggagggaggtggtgtctggagagaagtgtcctgaggaacccagcatttggagagcatgtggggaggccaccattgatgagcctgagaaagagcagccagagacatcggagatgaaggtgagcccagcatggttgacaccaagacaagaggaagttttgagaaggggcttattagctctcaaaagctgatggagagcccacagttgatgaggattgaagagtggccattggcttcagcaccatgaaatcacagctggccttggttggcatggtgggatagaagccactctgaatgagctggagtctgcacctgtggccggggcagaggcagtggctgaggtagatggaggattggggagaatgcaaacaggaagacaaataaaccagaggccagggaaaccaatggttgttgatgtcacagagaatgatgacataggttgtggtgaagataattgtgagagacgtgactaagggggaggagggacatgggttaggaagccattcatccatccaggcactcattcatccatctatatatacactatccatcatccatacacccactcatccacccatccatccatctgtacactatccatcatccatccatctactcatctatccatccctccctctatctatacaccatccaataaccatccattcactcatccatccatctatatactatccatcaatcacccatacactcatccatccactcatccactatccattgtgcattcatctacccactcatccattcatccatctatacactatccatcatccatccaaatactcatccatccatctatatacgatccattatccatctatacactcatccatccatccactcacccactatccatcatccatccataatacactcatgcatccatccacccatctgctatccatgagccatcctcccactcatccatccatccatccgtccatccatctatacactatccatccacctactcatctatccatctatatactatccattaactatccatccactcatctatccatctatatactatccatcatccatctatccactcatccacccatctatatgctatccatcatccatccacctatatattagccattatctatccataatacacttatccatccatccaatcatccgctatccattatctttccataatacacttatccattcatccaatcatccactatccatcatccatctaccctttcatccatccattcatctacccatccactcaccatgcatccatctacacactatccattatctatccatccactcttctatccacccatccactatccatctacccatccacatatcccatcatccatgcgtacatgcatccatccttcctcctatatatccatcagcccatccatccatccatccttatatccatccactatccatctatccatccacccatcatccatgcaggcatccatccttcctctcatccatcagccaatctgtcatccatccatccactcatccatccatttatctatatactatccatcacttatccatgtattcatccactatcaagcattcatccatccacccatgatccatacagacatacatgcacccatccatctttctatccttccatccttctatccactcatccattcacccactatccatcatccatccatgcatgcatccatctatccttccttccatccattctgtccatctacctatggaagcatatatccatccatccatccatccagatttctattgaggacccatattgttaaaaaatagagctaataatcacctaaaatatttaataaaaccttaaaacacataaatacctaaaatactaaagcctggcaaaataacaaattattagaataagttcaagaaattctaattaatgtttgcaagattatgttatcattagcttcaagacactcctagcctcaggctcagggtataggcaaaaaattaacacctagtacttgacaatgagcgtccgtacctgggctgtgattatgagcagctgcttctgattacaatcagtgaatcactaatctgcagtctgctacaaaacagctggactccatctattattcattcttgatgtggagatatccagaatggagagactagaattggactcctaggatccctgttgtcttcatcccccaaggatgttctggtttggaagttgtgtttctgaggcccctgacatccaagactacaggttagatcatcaagttcatatgacaggcaaggactggtgaagttttcagattttctcactcattggctagcattcctttgaactcttcaaaggcttgatatatatagtctaccttaaacatctggggatttgatgtcctgagacttaggttttgatcacatcaagcttttccctaagcatgaaaattttgctcaaataattcagataccctaaccagcctgtgtctctaaggggaatctggagggcaaagtggggaggaggttgaatcagtccttcgttccacagctgggtatgagacagacagagaaattagaagtgttttttcctttttcctccttactctagagatgagcagatggactggctcaaaagtggcctggacttcaagccctcatagagaactgatgcatctcaagtcaccttcgctctgccatcagtaacaatccccctgaacccagcgagagcacacggccccagagctcagaccgtcagtggggtttgtgcacagcctcctgtgaccctcctgaaggtaggagctgaccacaagtcctcctcccaaggcaggggcgagctcagcttgccgacggctgccagagagtcaccctcctgaaggtagaagctgaccacaggtcctcctcctagggcagggggcgagcttgttgtgccgaccgctgccagagaaccacaagagggccttcccctttgcacctgaagccttaattagcaggtttgtcttgggatgttaaggatgggaggcctctgtctggtgccccacctgtccaatgggcagcagcttcccgaggacaagtgcatgctgtccgtggattctctgtgcctgcatggcgtgaggtgtgtcactgacactcagggactctttgctgactcaaggctgccacacaggcccccggaagaactcggtaggaactctggactgttggcaactgagcctcccgcaaaatagggaatggaggctgccccattccggagggacatggtgagacctggctcgacaggaagttctagaggacaggcatgcttttgggtcactggctgtctgttggtgggcagaagagtctttgggtgtgaacctggatgctacactgcagtgacccccaactagtgctgtgccccaaatacttgggcagaaggcaacactcctcagagaaagggtgacctgtttcccgtgaggcagaacccgcctcgccttggctggagcagatgatggaaccacttccacatgctgaatgaagccacaaagcaggcggatcacgagcggcacccagggcccacattagggctgagtcatgctgggaaaactgagggcctggggagtcagccaatgtggccccaaggaccctgcagaccccaccccatctcaaggcagcttggctcagggcaaacgaggattcttcaccatcccaggcctgctggtcttcctctgcttccttggagcctctggtctgtagctggacacgtggatgaagtttctctttcccagcctttcttgaagctggacatgcgactcggttctggccaaggcaacccaagtgagagttgtgtgctgctttcagggagtgtctcatggtgggacgcgcgccctgctcctcttcttcccccttcctgctggctgaaatgagacctggatggtgggatctccagcagccatctgggatcatgaggagcagctcagggctgagggctggagcggcaggagtagaacaccttgtttctgggacctcagaggctgcaaggtcctcagactgcctcccccccagacttcttccacaggaaatgaaagtgcatttccagctcatttaagccacttttattttttattttctgtcacactcagtcacactaatcctgactaatacacacgtgtttgccagtgaacagattatcctctcaaaagtgtcaaaatgccacgtcagtgtatgaatcacacctttgaacaatgaaggctcccgtgttaagaggacgagtgagctctgctgcctggaccactgccctccacatttgttcatgtctgagttcacacctggggctcacacaggtatctctctcgaggcagacctcaggcgccttctctgcagatctgagaaaacctggctggatcccgggggagcagcagcgctggccccagccccattcagcttccaccactcagcttctctgccgagctcccaggcactgttctggagacctcaaggctccaggagacaaaaagtagcatcactgtagagagcttctggatgtctgtggcttaggggtgcttgaaaagttacagatgctcttttgtacactgagtcaaggctttggagaagcgcaagtgctttattcaccactttcactttgttcccccgtgcatgtaaggggtcaggcaatcccctctgctcaagccaccaccagtaaatagaacggcagcacaaccgtgatcaccacagtcatcacaatgagcgccatttccacgcgtgctgtgctgagatgacaacacaactgtgatgaccacaatcatcacaacgagcgccatttccacgcgtgctgtgcaaagacagcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagacggcagcacgaacacgatcgtcacaatcgcgagcgccatttccacgcgtgctgtgcaaagatggcagcacgaacacgatcgtcacaatcgtgagcgccatttccacgcgtgctgtgctaagctgtatttcaccctcacgccaggcaacaaggtgggcattactcttcccagttcacaggtgagggccctggtaatctcagcggagcctggcggggacttgggggtgtcacaggagcaagtgggagtcctgattgcagagggtggggaccatggcatcccagagggtgggcagaacatggctttaggatgtcaccgtcctcctgtgaggtcatggggcaatggggagccaggaaaggcgcccatatatcctgcgcacggggcagcgaattcatctgcccaggagcacgacttatcccacaggcaccagaggggtctatactgacccggctcctgcacaggaccctccaaatgtcttcaagttgtcctgcatctccgaccgtgtccccagcagacacattgcactagagatgatgcttccttggtcaaaacactaggttctctggtcctaacacaacactgccagacatctgaagttactatattttctaaccaagcagactggctatgagtttttctaactgaatgtcatccaaaacctaaccctaactcctgtataaacattgttttcaaactcatgaagcatcaaaggcccttgtggttttctggagtttccattctctagagcttttcgacaacaccctgcatttgggttttcatcttgagccctcatattatctcattcgattcctgcagcggttttgagaggtgggcacccatttatggatgaaggaagccagagaccacaacacaacacaacacaacacaacacaacacaacacaacacaacacagtgtgggccgtggctgtctggaggccaagctcgatcagaatgtccctgggcactgtctgggggcctgagaaagcgttcgggctgtgtgggtggtgggggttggacctaagacctccagtgaggcgtgacgtcctccattcaattcacttatttcccccatgggggctgagttgtccttcaaacccagtggcccagggagtgggcactgcgtccacaaaggacccctccggcatttgggggaacccagtgtgctctgcagatgttccttgagcgaggactgaggaccaggtgctggggtgccttggaggagggcggttggtggtgtctccactacgactcaccgtgccggggtggatgtggcccctgagctgccggccccgccctcgccggctgtgatgctttgactcagggacggccaccgtgtcacgggctgttcccagagtctcagtgccttcctcgggctgcacgttctgattttgtttttttttgaaaaggtaaacataaagaaaatgcttgaagccccaggacacagttgggctgacaggtctccgcaaggcagctgccctggagggtccctcagacggcagcttggggtgcagctctgggcgtccccaccgtgggacctgcctgccttcacggccacggaagtacatttcgtaagttctggttttcctccttcctgacattaattttccccacatgcagatggagctgggaccagcctctgggttaaaattcagcatcacgtcttactcagaggaagatggtgggaggtcctcatgcttctctgagccccttccacgcgtgtggtcaccacagtctcccttttccaacctgtccggatgcccctgctgtaggctgtagacagactgtccaccttgctacagactgtagatgctgagctgtgtcttcacgagcaaccacagaagaggccacgttgactacagagcccatggacggaacagcgatcggatacaagacttgcccccacttccgcaagccctcggcacccacagctgtgcccctcgggaccacttccctgccccagagccatccgtgtcatcagcaccaagactatatggtgaaggaagagtctggaaagtggcagcagctcacagcaagaccctgagagacgtcctggttactgcaggtatgatcacagcaagaccctgagagatgtcctggttactgcaggtatgatcacagcaagaccctgagagatgtcctggttactgcaggtacaaacagtcaaatcaagtatctgtttatgagacattcaacaaaaccaggtaaactgaaatctatggcaaagtaccaacttcctgccaaacagctgacaagtaagacagggtctgtctgtgttgccgactcccgaaaatgcccactttggctaaaaaggtccagtagtggagaattttaacaacgccactcagttttatttgcgtaaccccctataaaagtgacctccaagggcaagccgtttggagtcaccaattcaggaacgaagatggtgtcactgttttctccaactgtatttctttatgcatcatggtttttataattttctaagggaaattgatgacatccccatcttaaaaccaaacacaatttgaatttcaaatgcacttggagttcttccttccaggacacgtctgcgatgccagcgcggggcgcagccgggcgcgggatgctcgtgagccgtgagctttgattctgaaatatgtaatacatttttaataaggacaactaaatttgtttccctagaaatgtattttgaagagtccataataaactgtcttctacaatgaggagctatttaaagtcaaaaacaaaaaggcaagggtcccgtcttgctgcgagtgttggggcaggtgctatctgaacacggtggcgcaaaagagatgaggcctcgccactgatcaaacactcggctggtaagtagaagtccttaaaaaagacgaacatcaaacaggtcctcatctggggcgctctttttgtggggtcaccctgaccgtgaggccacagatgcgggcccgtgtgcaccgcaggccatacgtggggttaggtaagtttgaaagtctggacaaggctgtcattaaagcgtaggtgatgctaaacggcgtgaaagcctctgctttctagaggctccagcaagactgacacggaaaagctgaggacgaggatgttggtgaagactccttacaaaggcggaaggcgccacactgtgagctgagccatctctgcaatggaaggacagagcatgaccgtgcacccacctgctgagagcccaagtggctgccccagcaccaccccgtccagagggccgggagagcagccgcattgaaggtcgctccaggaaaagccctggcccgactcctcaggcatgatggtacagatgttgacttggcggcaacacgtttgtccctgggcaaactctgtttcaccctgaatctcatgatggtgatgtctcctctgccccatggcagctgcctgccctgcacctctgcagtggcagctccacctgtctgtgggccgtgcttctagctgcactgtccctccatgcttccaaagacattgtgtcctggtcaccagaactcctggtctgcagtatcctctctcccccgtgttaccaccccctcctgccccaccctccctcccactgtcctttctggatggtgtccttgacctcctgtcttcctgctcttggtcccatgggaagtgccaaccctggaagaaaggaggggctggcttctctgtgcctgctcactggcagctgagcacccccaggggcatctggggtccctgaattcacagtcctcatcctcagactcaggggcatccagcccacccttcttccctactcagcccttaaaaagaggcacatggtaaaaggctgctggtaacaagatacccctaagttctcaaggtatcatcctgcaaatcaacgatgaattaccaagggaagaatttacctttacaatggagtgatgtggcaggtgcctcttttaccaaagcgactgcacttggcattgtcccagcagggaggggctggccgtgcacccgctgtggctggaggcacacacatcaccacgcggggaggggttgaccgtgcacctgctgtggccggaggcacacacatcgccacgcggggaggggctgaccgtgcacccacagctgccggaggcacacacatcaccacatgctgaagacctgcatctgaatctagtagtgtggggcaatccaacaggcccaggccacaggatatcccacaggacaagcctggtttctctaacaattgcaatgctagaaaagaccaaaactaaaacgtaaaggtagaagtattctagaacaaagaaaatccgagatgtcacaacaaaacacagcattcacccttgattggaatctggattaaaaataaaaagcaagctattgggacaacgggaaaactggccacatacgaacgtgtgctaagtaacgtcactgcttccaggctgcacgctgggggatgatgcagacactcccttttctgcacctcacggggaagttttgtgatgtctgcagcaacctttgtgacttccatccagacacacaggtaaatgacagagttgcaggcatgactgagagctcaaagttggtgactctggaggaagagggtgcaggtgctcattttactcttctttcaacttgtttgacagtgtggagtttgcaaaataaaattctgggataaagggagaagcacaggaagagggactccttgctgtgagcccagctgtggggaggaactgctcgggccctgcagcatcttacaaggggtgcagggaagtccagagacagaagcccccatggtgcaggcctgtcccagcgacctgtagcctcatccagcactgcggccactcctcctccaggtgtcccgccatgtgcagccgtgaatatcctgtagtctaagccttctctcgttggggttttctgttatttcttcccgaagcatcttaactgatgcgggttctgtgtccagggaagagcagggcagggctgggtgcatttggagttgccctggggctggggctgggagacggagctgccctccccatccctgtccacggcccctctcaccctgcagtactgagcagggtgaggcagggaagaggaggagcagaggagtggctgggagggtctcagtgagcatttcagagccatctccacctgtcagaacgagcaggaagacatccaacccttattgggagtctacacaggtgttctgcactgagctcccctctacttcgggcctgcgagaagcagggaaggtataggctgccgtctccctcccccaggcagctggggctgtcctcacaccagcacagcccagtcctatgacaagcctggccacgttagaccctcacgagacgtcccacgaatggaaccctaggccataaaatatatggatattccagggtttaattcatagccatccttaagctgggggagggcagttatggagctccagagcggggtaagttgttggaaaacggaaagaagtttgtctggcagttgcttcgtctgcatgaggagtgacggctgggctgctgatggccctgaggggtcctcccggagcacctggcacctccgctaattctccggggtggaggcacttgcacaaccatgtgatgaattcttcagcagcgcccggaagctcggaggacatgagaggtggcaccaaggctgtggcagctgctcagccggtctcacaggctcaggactcgagctctgtgttaagccgcactaccactgtgattggcaccaggctcgatgctgcatctcaggctctgtttcataaacaggaggattatttcagaccgatcagaggcggctgcattctgcaaattaccgtgtgctgtggctgcgctcacacattgccaagtggctcctccgacaggcggcactaatccatgttggtctgttcaggaaggttgcctttgtaaactggagacagaatacttttgtttttgttttaaacatacatttgggaaggtggaagtcaagaaatgtagcggttctgttgagttcaaagagaaacacaggattcctaagtttcacccacgctttgcctgactgaccaacacactgaagctcccttcaaacccagagacttactgcacttgcttctagatgccacaaaaattgctgttaaaaagaaaaaaagaaatggaaacacgaaggagctgcacgtgtgggggaggtgagggtgagaaggaaggaaaggcacaatctgtcacagtttccaaacacatatgcttcgcgtgggaatctggggttgattcaaaggctgaatggatcttcagttactggaaggcttggcccaaaatatttcagtatatggagcagttctcttccttctagtagcaaaagcaacagcagagagtgactggatttgtgatcagaatggggacagtgggaaaagttaccaaaccaatttactcaatggagaaaatagccaactggtcaaagaactgtgatgagatggcgggattctccaggaggtgcgtgatgtggctggtgcccatccatcctgtatgatgataaactcgtccaggagcgagatgtggccggtgcccatccatcctgtatgatggtaaactcgtccaggaagtgtgtgatgtggccggtgcccatccatcctgtatgacggtgaacttgtccaggagcgagatgtggctggtgcccatccatcccatatgatcgtaaactcgttcaggaagtatgcgacgtggccagcgcccatccatcctgtatgatggtgaacttatccaggagcgagatgtggccggtgcccatctatcccatatgattgtaaactcgtccaggaagtgtgtgatgtggccggtgcccatccatcctgtatgacggtgaactcgtccaggagcgagatgtggctggtgcccatccatcccatatgatggtaaactcgtccaggaagtgtgtgacgtggggggcgcccatccatcctgtatgatggtgaacttgtccaggagcgagatgtggccggtgcccatccatcccatatgatggtaaactcgtccaggaagtatgcgacgtggccggcgcccatccatcctgtatgacggtgaatttgtccaggagcgagatgtggccggtgcccatctatcccatatgattgtaaactcgttcaggaagtgtgtgacgtggccggagcccatccatcctgtatgatggtaaacttgatggagcatagttccgggagcagctctcctgggttttaggaaattggggagggtgtggagatgcagccgttagtatgatgatcttatccgctgcttcaatttccttccagataaatttcaatattttgcatttcttctggtcacaactctcatccatggacattttaggagtaacaagccgctcatttccataaatcagcattgtggctttctgagtcgaatcggacaggacgtgggcagctggcgctgttggtctccactcctcactgggctgaggcgcactgaacccagaaaccaacactgcagccccagattctctctgacctggtgccgaaagaaggagctggcggatttctcctctgccaacgtccttcgaaactctctgtagtactttctatccgccaatcaatgagccagcagcattccctgtgatcaatccatcaattccacccaccaatcagtgagccagcagcactccctgtgatcaatccatcaattccacccaccaatcagtgagccagcagcactccctgtgatcaatccatcaattccacccaccaatcagtgagccagcagcactccctgagatcaatccatcaattccacccaccaatcagtgagccagcagcactccctgtgatcaatccatcaattccacccaccagtgagccagcagcactccctgtgatcaatccatcaattccacccaccaatcagtgagccagcagcactccctgtgatcaatccatcaattccacccaccaatcagtgagccagcagcactccctgtgatcaatccatcaattccacccaccaatcagtgagccagcagcactccctgtgatcaatccatcaattccacccaccaatcagtgagccagaagcactccctgtgatcaatccatcaattgatcagtcgacccacccgctggctaccaggggcacccagcgcagctgcgctcacagggaagtcagggcgagcgggcggctccagacagaaacgtgggtgtgcttgtgtgtgcagagtgcacgctcgcagaggggaagccacggggctgcgggcccagcctccagtgagcctggagccggcctgcagggaggaccccaggcgggtgtggggacccaccttaggaggacagacgcacatgaggctacggggcttgttgtcatgaaccccaaatgtgttgtcaataagagcaccggacccagctttcaatgcttctcttagcaaaaccagggattttcctgcagctgtgaacattgacctgtccgcctactccccgagccacagatctggggaaagaatgcatgtagcctgctgtgggtggtgaatggagctggggcagtgatgagctacttcttgccttttgtcaggaaaagaagctggatagatttctcttctcttcctttgagaatgagtgaagagggaagataaaagccagcaaccagggacagctgaaaatatggtttcagtaagagacaggccacagcgtcctgagccccctaggacaagcagaccttccaggaggatttcctaaggtggctggaagagaactctgctaccctttccaacgaagatgcaagacacacagcctctctaaaaacaggagcagaaacacacaacacaacgggaaaaacagggtgtcataaaaacagaaccgttaccaagttatgaaggcaaagagctggaactgggagagatgagaaataactgtgaggaaattaaaactacaatagcagagttaaaattcacattgaggcggcagagcagaactgactacagttcacaaccgaacccgcaaagctcttcgagaatcacgagcaaagcacaaaagatgctaaaagaggggatattagagacgtacggcacaggaaagagactcgtcctaaggatgggggagagtttgcaagaagaagctagaatgactagtaggaagaacaggaaacagggatctgcagcaatgcctcggctctcagggcgctcgggagggtgcaggggcgaaattaacaacatagccgaagggtgcactgcaaatgcgtgggaaacaatggcttattcaagaaactagagtttacttgggggaaggtcctagtttatccctcacttcacacacattacaaccaccagaaatgatccagatacattaacacattaatggaaccataaaaataacaaataaaaacttgtgtttcactgatgacaggatgagcaagcactttctaaacatgagagcgattgacaaaatcttaaaggaaacgactgtgcatttgaatccaccagagctcagcctttctgaacttcagacagtacaacaagcaacgttagacacagacaagcctggcagaacattggccaaaagtaagaggcaaaaacaaatatgaagagtactcgtgagtctatttcagaaaattcacactcccataggaaaattcatgaagagattatcccaggaagcagaaccatcaataatcaagtatgataaaatgtttaaatctacaataaatcaaaaactataaattaaaccaatgataagatgctatcgtttgccctaaataattgcatgcacttaaatgaagtcctaacccttggtgttaagtgagtggatgatggcaggtttattggacttgccagatgcacctgcatttgttggagatattagttcaactggataagaggaattgaggtatttagaagagcttgcaccatttcacatagtagttagatttctaggagtgtatcctaaagaaacagtaagccacatagattgaatgtatgcccaaggatattaattgcagcaagacttatgataatgaaatactagaaacaagctaaatgttcaacaatagcacatgggttgaagaacttacagcagaaccacataaagaccaaagtgttcctcagaagcatattttaaagacaatttgataaggcacacatacaaactgaaaagcaaaataaagacacacacacacacacacacatcctaaaagaatatcaaatagtaagcattttctaagttttccacgctaagtgttcaatagacacaaaacaagtattttaacaaaaatatgatttcctgacagataatatagaagaggtttggcctatgtcatgaccatgtcctggcctggaccatttttaattgctccagagacttccaaattgtgtcaccaaatctacaactgtgtgtccattcatccatccatccatccatccatcccccgaccaaaccacccacttactcatccatctacccacccaccctgcactcaccaccacctatccactcaccaccacctgtccactcaccaccacctgtccacacgtctgcccttccatgcatccctccatccacccacccatccacccaccaccacctgtccacccacccacccatccacacatctgcccttccatgtgtccctccatccacccacccatccacccacctatccactcaccaccacctgtccacctgcccacccatccacacatccgcccttccgtgtgtccctccatccacccacccatccacccacccatccactcactaccacctgtccacctgcccacccatccacacatccacccttccatgtgtccctccacccatccacccacccatccactcaccaccacctgtccacccacctgcccatcgacacgtccctccatctacccacccacccagagaattgctcgcttgttgtgtgctgtgggccaggctctgaggtttatggacggctaggacattattaatgcccatgggggatgtagtgtctgatggaagaggtggtggaggggggaggctgttttgatgcagagtcatccgagatggctcagaaggggcaccatgaggagccagggccatgtaccacattctgtggaggtcgactccccagcacacgcacccaggaacaccctgggcttgacagcctctgctgggtcatgccctcttgctctgtgcctgagtccttcgcactcctgccgtctgcaaggacacggtgcatccagcccccgcagggcagggctcacatcctccatgaccctcacaaggacacagtgtatccagcctccacagggcaggactcacatcctccttcactccatgacccttccttgttgccgccacacgtctgttgcacctgttagacacggagccttggactcaggggtgggtcccgtggatctcacagccctgctgcccagcataggacacacaagtgactcagtggagtccgacacttgctgagtggatggcaagggagaaagctcctctccaccgtggctactccagttcctctcacagtggatggcacgggagaaagctcctctccactatgcctactccagttcctctcgtagtggatggcacgggagaaagctcctctccgccgtgcctactccagttcctctcatagtggatggtacgggagaaagctcctctccactatgcctactccagttcctctcatagtggatggcacgggagaaagctcctctccactatgcctactccagttcctctcatagtggatggtacgggagaaagctcctctccactatgcctactccagttcctctcatagtggatggcacgggagaaagctcctctccgccgtacctattccagttcctctcgtagtggatggcatgggagaaagctcctctccgccgtgcctactccagttcctctcgtagtggatggcatgggagaaagctgctctctgccgtggctactccagttcctctcatagtggatggcacgggagaaagctcctctccaccgtggctactccagttcctctcatagtggatggcacgggagaaagctcctctccaccgtggctactccagttcctctcatagtggatggcacgggagaaagctcctctccaccgtggctactccagttcctctcatagtggatggcatgggagaaagctcctctccaccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccgccgtggctactccagttcctctcgtagtggatggcacgggagaaagctcctctccactgtggctactccagttcctctcgtagtggatggcatgggagaaagctcctctccaccgtggctactccagttcctctcgtagtggatggcacgggagaaagctcctctccgccgtggctactccagttcctctcgtcttccctggggtggctacagtgttcttgtcttcgtgaagttgcctctgattccatcctctaaaagccaatgacttatatttggcacaagacagattaacacgtaattgttctttactgaattggtatctgactgtgtgagttgactgaagcatgtatagtcgtatgtgtatctgagtgtgtttgaatgtatgtgcatgactgtgagtgcatgttcatcactgtcagtgtgtcactgtgtccatatgtgtggctgcatgtgagtgtatgactgtgtgtgtctgtgtggctgtgtgggagtgtgtatgtggtggagtgtgtgtggcgtgtgtttgtgtttgtgagagagactgtgtgtgtgtctggctgtgtgtgtggttgtgtgactgtgtgggagtgtatgtgaatgtgcatgtgtggctgtgtctatgtgtctgtctgtgtgtgtgactttgtattactctgtgtgtctgtgtgtgtgtgagagattgtgtgtgtgactgtgtgagcatgtggctatgtggagtgcaagggcctgtgtgggaatgtgtctgtgtatgactgtgtggctatgtgtagtgtgtgtgactgtgtagctgtgtggaatgtgtatgtgcaactgtgtgggagtgcatgtctgtgtgactgtgtgactgtgtggctgtgtgaagtgtgtgtggctgtgtgcgtgactatgtaaccatgtgtggctgtgtggccatatgtgactgtgtgaccaggtgtgactgtgtggccacgtgtgactgtgtgactgtgtgtgactgtgtgaccgtgtggagtgtgtgtgactgtgtaaccatgtgtgactgtgtggccatatgtgactgtgtgactgtgtgtgactgcgtgtgactgtgtggccacgtgtgactgtgtgaccacatttgactgtgtggccgtgtgtgactgtgtgtgactgtgtgactgtgtgtgactgtgtgaccacatggagtgtgtgtgactgtgtaactatgtgtgattgtgtggccatatgtgactgtgtgaccgcgtgactgtgtgactgtgactgtgtggccgtcactgttaccacatgtgactgtgtggccctgtgtgactgtgtgaccgtgtgtgactgtgaccgcgtgtgactgtgtggccacgtgtgactgtgtgactgtgtgtgactgtgtaaccgcgtgtgactgtgtggccgcgtgtgactgtgtgaccgtgtgactgtgtgactgtgtggccacgtgtgactgtgtgaccgcgtgtgacgtgtggccgcgtgtgactgtgtggccgcgtgtgactgtgtgaccgcgtgtgactgtgtgaccgtgtgtgactgtgtgactgtgtgtgactgtgtgaccgcgtgtgactgtgtgaccgcgtgtgactgtgtggccacgtgtgactgtgtgactgtgtgactgtgtggagtgtgtgtgactgtgtaaccatgtccaggcagggtgtgggagtggagagggtacgggacgggagctgcagacaacatccgagccggctgaagcccacagagcaggccccgtgttggggggaagttggaatttagggagtggtgctggattctggacagtggatgacccgatgctgacgctggcacctgatcactcacagccgccaccaggcagcatccagagcctccagcgttttcacccagtgggttgctgctgctcagcagtcagggggacaggttgtttcttcctggtctcaggccacaggacccctgaagaggagccccgtcctcagacccctccaggagccagaagtgtttcttcttggagaggtgaggggctgggcgccctctcaggcagtgcccagggagaagcaccggcgggggctggagccaccacctcaccgcctgcctgccccctcctcctctctcaacgtccagtctgcagggcaacctgcaattcacaacggccgctgcctggcctgggagctctgcagtgccttctgctggaagtgccagccgtgtccgccctgcactcgctcccagcacagggcagaggcggtcgcagagctgcatgatctacttttaagttctgtgaaagtccttctgcagtaacagttcatgcgctggccacgatggcagcaagggcagctttaagttaattcaggctgtttttggaacaggctatggggtcttgaaagcttcttcaccgccttcactccccacacgctccctgtcactggctgaacatcggtgaagagacaaaactgtgaacgaggacattatctaaagtgcagagccccacatggtgggaagctcaaatgctcactaacaggtcggccttccttttcctgatggtttttcaaacttaccgtattgtacgtggctttaagtgaaacttgagtgaaggatcctccccttcccaccccacccgcaggtgatgattttgaaaagctcccccaaaggaaccctaaattagtcttaaacacacacacaaatctatctgaggcagggaaactgcccattaagggccagtaattacccgaggctgctggggtgcctgcctggaagggcccccaccacggggcctttgtgcttcctggcctggcggactctgaggctcatgcattattcaggagcacgtgggacaataaggaagccttccatagaaagagaagcaaagctgggggtaaataaaggttgcttgagaaacactactattttttctacatttatgaaaatattgcagcgttcggggtgctggggacgtcctctctggttatcaggagaacaccctggattctgcgctttccttcctgcgggcctgcagcctgcaggggcccacaggacagcatacagtacccggggactgtgtcttttttcctccctcctctccctttctctcccccataatgcaaagctttgtcaagctaatactttaaggatcaacatcaaaattggaactttctctttctatagccacatccaattgaaagtatcttagacctcccagtggcttccctttcggggaggcctggctgtcagagcactggaaccatgcatccattttaaataacaggaaggtccccaacccatacacaacattagaaacggcattatttgctggcccctttgtgcgtggggctgtgaatcggtgctgctgcatcacatggtcaaaccaggcctcccccacacattcctgctttatggggtcatttcagcgcgctccaatcagccgcctcgtccacctgaccatctcttgattactgatctatctgctcttattttccctgggggaagggaggagatttaaagtgcaaatggtacaaaaggggctcaaatgccgctttgtgtgcagattcaggagacttttttttttttttttttttttgagacggtgtctcgctctgtcacccaggctggagtgcagtggcatgatcttggctcaccgcaacctccacctcccgtattcaagtgattctcctgcctcaacctcctgagtagctggaattacaggcaggcaccaccatgcccagctaatttttgtatttttagtagagatggggtttcaccatgtcggtcaggctggtttcgaactccagaccttgtgattcgcccacctcagcctcccaaagtgctgggattactttctcatctggcctcacaagggcacgttaagaatcctgtgcccctgtctccgccacagtgcacacccagccctttgatttcagatcagagggaatggaatctccaaggaacttcacataggaaacccaacagcaccaaatgctttctaactattcttgggaaagaggcaaggcacaagtaaattaaatatattaacaagtcggagtaaagggtagagtgattaggaatatcttcctcagagaagggatgtgacagcccaatccacaccgcagacacagatccattggacccggcctcctcccatctctaaagtcatgctctgtgaacatcgttatgacagtgaaaaccacgacttttcccctgtaaaattaaatgtcactcttgatagcataatatctgaaacatcatcttcccaagtccacaccaatactttacacagaaaattaaactctctctgtttattgagtggataatgtagccttcaaatgtgtgagaacccctgctaggtgagaaattacaaaagctgtaccataaagcctaatggtatgtatgaaatacacaaaaaggtaacctaattggtaatcagaaatcataaaactaatcatgcaattaatgtcttcaaaagcaagcatttgaggtgtgtataattacaagaaaacaatgcaatggtggtttccagcattaatgaattaattgtggtggtaggggggccggcgtgggggtttatgggctggtttcagtccatgcccactgcctggctgtgcgttctctgccttcctccacctggagctcctcagcaaaggactgtgcctctgagcctcccctggagaagtcaagaggtcccctccttccagacccaacttccctggccactgactgtcgggattccctgggggagggcaggtggagagacggctggtgcagaaaaacacagaaggcccagagccgctcattgagtgcaggtgtcggaaaaaaatttgggaacacacattaacctacgcaactctcttgctttctttccagcgtgccacacaatatcatgatacttacggttctatgattcacactcgcagtttcgaaggaaacctctgctctgtgctgattattccaggaccaaggcttaatgcgtgggatgttaatttgctgatagaaaggggaggaggaacaggtcggggctgcatggcattccttccagacaactggagcaaacagggctccacattggggtcctttcgatgtggtgccgtcaccagtgccaccccactgcaggcaccgggagctcttccacggagaggaaaggtgcagagaaagactctgaccccctgcacggaggagggggcggcgcaggcccctccacgtcatcggtgtggaacgcaggcccctccacgtcgtggatgtggaacgcaggcccctccacatcgtgggtgtggaatgcaggcccctccacgtcatgggtgtggaacgcaggccttttgaacataggagtgtgcaagccccacacacaggaggtggtgtgcagcacgtgtctctgcaggaaagggaacaggagggactggccttggcgggtggtgagacggccacacactctctgaaggagattctacattcccacttctctgtagaagccgtccaggccccagccccatccccagcctgcaccctccaggcagctgaaggcctgggcacagctagcgaggccactggcatgtgggagatggaggacagtggggagaagaaagaacactagagctgaaattcgaggaagaaaccggacatctggggcagaggaacgacccaaagccactgaggaaactgccaggtgagggccaggaggagagggtgaggctgacacggggacaggagcccagcgtgaccagcctggggtcctgaagcaatgctctagaaagagaaggccttccacagcacgaccccagggtggtgatgagggcacactgctggagatgaagaaagcattattactcctccacttctagtacgagaggcttgttcacgtcctaagttgctctgtgttcccggcaacgtacccggcactgagttctcaggactggtgcaggtcagcggctccgcaggggtgagctgggcgctgcctgcatctgacgagatagcagtatgttagcatctgtggtgttctgtctaccgcagagtcctgtgagcctccgggtgctcgtgtccgtgcactgtgacggcctttgtctcttttgttttgttatttcaggggcgtttttcttattctggcctgtgggaagatgccctggagccctggacactggttttccagcaaaccctacagatcggttgggatccacctggtgacacctgccttatcttccagggtttgcccttggtgtagagatagacaaagggagaggtgagcacaaggtcacagggacgcagccctgacctcacgttggtccacgacgggcagagagcaacttggatggctgcctttgttgtttttcaaatggactattttattcctagaaaaagatacacaggctaatgtaatgaatacactagcacccttagccagctgtaggaaaaaaatgcatggcagatactcgatggcctttctgtcctccctgcaccacccagaggacatacacagagtgatccgccctcttttccctggtgaatcacgcagcctaactcaccatgttcccggccacgccacagtgaatcacgcagcctaactcaccaggttactggcctaactcaccatgttcccggccataccccagtgaaccacacagcctaactcaccatgttcccgaccacaccctggtgaaccacgcagcctaactcagcatgttcccggccacatcccggtgaaccatgcagcctaactcaccacgttcccggccacacagggccaagaacagcccaggcaatgttaaggagcattgcatggaggagccacttgcagatgcggtaacccactgtgcggcacagaacctccccgcggggcaggtgggtgcacaggaaagaaaccaacatggagctgaggccccagagaggtccctgtgctcatgactcacagagacggggacggcagcaaggacacagcagggccatgggcagaggaaggacaagcaacgtggggccatggggagggacggaagacagaagtggatcccggctctccacaaaacacaaaaattaaccccaggcagattaaagcctaaatggggggaaaaaacctgtaaatgttttgaagaaaacatttgagcctctctgaactcagggcagaaaacagtttcctcaaatcctttcctcaaacaacacaaactacggaggaagggagtggtaaaatttgatcaaatcaagtgaagcagcttctgtgcttcaagaaacactattaaaaagtgggaaaaggtgggggtgagccacccgccaggaagcgagattcacggcacctctgtcagatgaaagggctgggtctgcgtccagccaggcaatgaagatgagccgccaatattctaggaagaaaagcgggggtgggagtcaccaaaacaagtcttctgaaaactggccaaggtgtgatgtacgtttgcatcctaggaaattaaagaggtaaaaaaacccatctggaaaaccaagagctgcttgattctatgaacctaagaacagtccgtttctccttcagagacgtattgagagaactcggtatcattatgaaatctctcaggcctccaggaaatgacgctctaaaaatgcaaagctctgaaccaaccaccgagaaacaccctttcccctcccctgggtgatactaagctgctgtggggcgtccccacaattttggggccggaacggagggggaacaggcaccagtttgtcactgccctgagtgcgctgccccaacaccctgcctgctgctgtctgagagaaaatcgtgtcatggatcatcatccctgtgctgcaggtgtgtctgatgtttacagagacctctctcgctccatcatgcgtgcccgatgtctacagagccctctctcactccatcatgcgtgcccgatatctacagagccctctctcactccatcatgcgtgcccgatgtctacagagccctctctcactccatcatgcgtgcccgatatctacagagccctctctcactccatcatgcgtgcccgatgtcgacagagccctctctcactccatcacgtgtgcccgatgtttacagagccctctctgactccatcatgtgtgcctgatgtttacagagccctctctcactccttcatgtgtgcccaatgtttacagagccctctctcactccttcatgtgtggccaatgtttacagagccctccctcactacatcatgtgtggccgatgtttacagagccctctctcattacatcttctgtgcccgatgtttacagagccctctctgactccatcatgtgtgcccgatgtctacagagccctctctcactccatcatgcgtgcccgatgtcgacagagccctctctcactccatcacgtgtgcccgatgtttacagagccctctctgactccatcatgtgtgcccgatgtttacagagccctctctcactccttcatatgtggccaatgtttacagagccctccctcactacatcatgtgtggccgatgtttacagagccctctctcattacatcttctgtgcccgatgtttacagagccctctctgactctatcacgtgtgcccaatgtttacagagccctctctcactccatcaggtgtgcctgatgtctacaaagccctctctcactccatcatgcgtgcccgatgtctacagagccctctctcactccatcatgcgtgcccgatgtctacagagccctctctcactccatcatgcgtgcccgatgtctacagagccctctctcactccatcatgcgtgcccgatgtctacagagccctctctcactccatcatgtgtgcccaatgtctacagagccctctctcactctgtcatgcatgccggatgtttacagatgtttacagagcgctctctcactccatcatgtgtgcccaatgtctacagagccctctctcactccatcatgcgtgcccgatgtctacagagccctctctcactccatcatgcgtgcccgatgtctacagagccctctctcactccatcatgtgtgcccgatgtctacagagccctctctcattacatcatgtgtgcccgatgtttacagagccctctctcattacatcatgtgtgcccgatgtctacagagccctctctcactccatcatgtatgcccgatgtttacagagccctctttcattacatcatgtgtgcctgatgtttacagagccctctctcattacatcgtgtgtgcctgatgtttacagagccctctctcactccctcatgggtgccgtatgtttacagatgtttacagagccctctttcattacatcatgtgtgcctgatgtttacagagccctctctcattacatcgtgtgtgcctgatgtttacagagccctctctcactccctcatgggtgccgtatgtttacagatgtttatagagccctctttcattacatcatgtgtgcctgatgtttacagagccctctctcattacatcgtgtgtgcctgatgtttacagagccctctctcactccctcatgggtgcagtatgtttacagatgtttacagagccctctttcattacatcatatgtgcccaatgtttacagagccctctctcattacatcatgtgtgcctgatgtttacagagccctctctcactgcatcatgcgtgcccaatgtttacagagccctctctcactctgtcatgtgtgcccgatatttacggagccctctctcattccgtttgatttgcaccactgctgtgagatgggcaacagttcctggctttacaggcaacaaaatgctcccaccagtcaatgaagccacagagcttgccaggagtgaatggggccccacctgacagaaatgacggcttccgcgggatcccatgaaggttctgtaagccagagctgaagtgagtggggcccctgtccgcaggctgccacctctggcaggtcgtccacaggaacgcttgtcctgaatggtggcccgcaccctgcagtgagcccacggctatagtggtgcagccagcagccccgacgcctctgcagtcccagacccagggaagccccgtgtgcaccacggtgtgccctggaccactcacttggccgctgccaccctgggaggatcacaggggctgccttctggacatatgtcaggctctcactgccccagtgagaggactggctctggtcctgatccacaagctctgaaccaatagcgggtcttgggatgacgtctgcggagcccctcggtcccagcgtggctggcgtccaggaccccagcacctctacacccaggtccttctcagttcccaccggccgggctgacgctggtctccagggtgatggagctgattcttcgggtttccctcagctcagatcaaatttaacacagcaagaggacacccactgttcccaccgaagaggcagaaagctggagttcgcggtgcctttctcccccaggctgggatggaggaggcagcatgaggccaccgtcattcccagtgtgtgagctggggccatccggaagttgcgattcatgtcagacactacggggccgaggctcatgtgggtgtgcgtcctctcagggtcacacctcagcaaggaagctcagcagaaggtctcccaggtccctgagccaccgttcctctgactgcttgtacccttcccgagatgctgctgcagccccacgccactcagagtgaccagcctgggccaacccctgggttctgacaagatgtgctgtttaggactaaattcagctgcatataacagaaaacttctgacaaggttggtgtgaacacctgaggcttttcttccctcccacacaaaacccatctaaatgggcagtctgggtcccgcatcctggccagggacatttacgggaaccacatcagcctaggatccactatccaggtggccgtcatttcccatcaagaagcctttctgcccagagtactgtacagccacagctcatggccaggtctcactcagtgaccacatctaagcacaggggaggccaaacgtgttattttagctaaacttagggttcgatcaccatggaggaggggaagacggcacagacccttcaccgctggccctgatggcagctggggcccgtgtgtgccgtgtcctggggacgacatgagatagccaggctccccgtccctcagggatggtcttccaaggattggagcatcttacacgttttttatttcagtttaaaccactttctactcatatgcttttggtttaaataaattgccagataaaatttgcttgaaaatcttttatgggaggaaaagagaacattcataacaaacagagctcaggttatcccctctccacccaacaccagcatttccaggcctttgaggaactggggagaaacatgatgtggtcagattccaaatttccgaagtgcggagcctcaggctcacataagggatcccaggtctccaaatttccgacatggggtgcctcaggctcgcgtaagggatcccaggtctccgaatttccgacgtgggtgcctcaggctcgcgtaagggatcccaggtctccgaatttccatttccgacgtggggtgcctcaggctcgtgtaagggatcccaggtatccgaatttccgacgtggggtgcctcacgctcgcataagggatcccaggtctcccggggcctggtgtgtgcaccacagactacatattccacaaggaagctgtgagaaagaagcacagacagtcctgcaccatctcacatccaccaaatccagaattctcctttctcaaaccatccacagactaacttattcagctccccacaatatgagtctgttttgaggccagggggtgggtcctggaccctccaattccttgacagacaaaaggtgtagaatagcctgggattccaggttcctgggagtcctgcagggcaggtgcaggctggggcatggaggcggaagcttcttcacaccacaagcggccacggtagagttgacgggagaaaccaactttaaattcatgcaggatcaggaatgctgtgccacatcaatgtgtaaaatacaatcttcatgtgggagaacgaatggtcatctctgaaatatgctttgcacattaggatttttcagatcttccctattcttggtttacccaaagcaaagcgagttcttgctggggtgaagggtggaagagaaaagcagcggaatgggcgggctgtcgaacaaaaggcggcgagggaggtaccgtgcagagcctgctgggccttctgtcccatggccccgcacaccggactcacccagcctccagccgctcctgtgcctttctgcctaataaatatctgtgataattaccaacccccaaaaagggttctctaacgagggtgcattttatcagtcccttaacgaggctgtttgggttcctgcctcctatagagtggcggttaatgcttaatcagcaaatgcactgtttaaataataacaagaatatcagcagagaatctaaattatcccttaacttctcaaaataatcataacaggcatttgaacattcatacaaatatggctcatgaataaaaatgcgctttctttaatacaaatatagtctgatggaaagtctctgaaacccaacctacggaggcccctccctgtcatctcctggtgcatggaacagcgactttgccatcactgaggttccgggcacagaacctgcctcagtccagcgtccctatccgctgtaagaaagggtgaaggatccagtatgggagatggagattgtccatatcccgagggagggactggccagggcacacccgccaagggcaccttgtgtccctgctctgcagagaccgcccagctctaggtgcctgagtgttttctgctctccacatttgaaaccctaacaaaacccctgagcaatcaggccgtgtggaggcaaagagcctctcctgtaacagtgtggtccttccagccttctctcacatgcggaatttggcagacagtgatgtgagacgctcacatggcaaactttcttttctgtttctctttggcacaaagcctcagcgctcccgcgcctgccctaccactgaacaaaacagcctcttccgggcccagctcacttgtgcctccgcccacctcgctgcgggcaacacccgttttcctaaagattgacaagaggacgtgttactcaaataaccacccgctcagaagaaaaaacctctgtgcagagccttttgtgttgaaaacgacaccttcacgttatcagccttagaggcaggtctgtttgcagcggtgcccgctgaggagtctggatttttaaaatacgccagaaatgacttagggtctcagccaacagaaccaaggaaagttatatttatgtgggaattattttgtcaaaaaagttccaaaatgttggcaaactctgctcaattatataagctttcacctgaaggcacagtatttttttaaaagtcagtttgtgtatctctgttgaaaacaattatgaaaacaagcattaaataacctgactaaaaaaagtagaatgaggttcacttccatggaaataattttattaacaaaattcagaagaccaagctgagaatggagatctgcatgttttaatcaaatgctttctaagccaagtctcctaccctctaacagacgaccatttttaaattgaaagtttaaataggttgatcttaaaaacacattcaatggtgaaggagtgtgtgtttaaaataaaagtgtttatatttttcagattttgttttctcctgcttccttaaaaaatacactggccgggtgcggtggctcacgcctgtaatcccagcactttgggaggctgagaagggcggatcacgaggtcaagatgctgagaccatcctggccaacatggtgaaaccccgtctctactaaaaacacaaaaattagctgggtgtggtggtgggcgcctgtaatcccagctactcgggaggctgaggcaggagaatcgctttaacccaggaggcagaggttgcagtgagccaagatcgcaccactgcactccagctcggcaacacagcaagtctctcaaaaaaaaaaaaaaaaaaaatactagcacagtggaccctgaagcgccagcagcaaaccctctgagatgtgcgtccggagtggccatgccaccagctttttctgcccactgttttggaaaagtgttgattttggaatgtggtttcccatcactgtgtggaccatgggtgaatggggagggtggatggtctctggggccgtcctctctccgcctccagatcagcaggcagtggatgggtatttgggtctttcttgtactcacacggatgcgatgtgtgattcctggtaggaaacaagaagcagctcactggcaacaccacactgccccttgcattccgaggagtcatgtagtcatgaggggcatgagcaagatggagacccagaggctcacgctcacatgatgacggccgagccgggcctgcaacggaaaggcctgtggcatggggtaacttcagagccttcttctcaacaggcacggcccgcagagccactggaggtaaggatcctctccagccagggaggaagcatcccgcaccgtgcccactttaaaccctggagaaccatgtttgcctctgtctggccctctccccacccccccacctccctttgccgtcttctttgtgtgtaacctttgtgtacaggctgaagagaaaagtcccaaaatccagcacaagccccgtgaccctttctcccaggcccacggtcttggggcactttctcagggcctgaccttggagcagacaagagctgagcgctcaggaagggaactgtccgaggagcctcctccacggcggaactggtgcatcatgtagaataaccgagccacacgtgcggagatgctccacgccccactgcccgtaggtctgagggagatactccccgtgttttgggatgaattgagttccccaaattcgcatgccaagccctaagcccagtacctgtggacgtgaccttatcggggaatagggtctttgtggaggtaactggctaagtttcaatgaggtcattagggcgggccctaatccaacaagacgggggtccttatcaaaggcggagatgcggacacggggcagccacagggaacaccgcgtgaagacggagacggcacccacaagccgaggagagagatctgggacagattcttctccgagggcctcagaagaaaccagccctgcccacacattgaccctggactcccagcctgtgagtggtgggcgatgaatctgcggtttgcgccgccccgtctgctatgctgtcacagcagccaaggccactggctctgtgcatttccctgcctccgcctccctctcccatcactgacgatgcagcactgactccctggacagggcctacattgggtgctgctgatggcgagactgtcatcccccgacatgaaggcaagggctgggctcagaagcctggataccgtggctgcctctgccccaccctcagctctgggacaaaccttcagtcccagcctgtctgcccacgtctctccagctgtgcaatcggcacacccacgtccacgtggctcctcatggggccaaagagcagccgtggccaggaaagcagtcagagaggcccagggttgaacccaaggtcactgcccttgtggttgagcaaaatgaagacagttcctcttcttaaatccggctctgtgcctatgaagacggaagcagcagcattccgcttgcaggtttttgaaaaaacaaatggggcaagagaggccaggaccacgcctgactcaggcgatcggacgggcagggaggctgcaaggcatggcatgagcaggtggagctgtcaggactgccccagcccctggctcaaagatgcccgaccccaggaccctgcctcgctggatggtgaaggccaacttcccctctgttggagctggcctgggcgttgtgggaagggctgggaggaggcccaggacaatgcagaacagacaggacgtttcacagagcaggctgccatgtccctcggggccttgggggctgctgaggccctgagaaaggtatgcatcggggaggctggctgtgctgttgcagggatgtgtgtggggctggatcggggaggatggctgtgccgttgtaggggtgtgtgtggggctggatcggggaggatggctgcaccattgcaggggtgtgtgtggggctggatcagggaggctggctttgctgttgcaggggtgtgtgtggggctggatcggggaggatggctgtgccgttgcagggatgtgtgtggggccggatcggggaggatggctgcacggttgcaggggtgtgtgcggggccggatcggggaggatggctgcaccattgcaggggtgtgtgtggggccggatcggggaggatggctgcaccattgcaggcgtgtgtgcggggcttgctgactctcgtgctctgcggacgcccagggagcggccccaacccacgcgccggcttctcgagctcggcctcttaagtgacagactcaaacacctgagcaacaagtttcctggggtcacctaataacgattattttaacaacagtttccaaacaacaaacaaacccatggagcacgaaacctctggggaccttttgaagctaaacgctgagtggtgccgcttcttggggagctcaaggccagcagggtccctcctacagcgaccctggacagtggtttggggattcacttgatacaagtaattctctaattaggataatctggatgcggcctgctgtgatgtagtgatggggcttccctggaaggggggatgtcaggaatagccctcactgcatagagcacatcccggcgggagcgttagagctgagggatgcctgtggctgagccgagggagagccggagccaggaaagccactgattgggcccaggggggcggcgatacaaagtcacttttagaggatgaggaaaagatgaaatgaacatctaaaaactaacgccctctatgatttaatgaactttcctctctctaaaagtactctggtgattatttcagggacagccacccaactgcacggcaccatcattttttctgatactgagttgatattttgccctacaggtcactggaggcctggccggaagtgcagggttatctcagtacttgatttaaggctcctgcagctgaaaagctgccccacacggcggaccgggtggaggaagtcagctgtgctgcttaaccgtggagtctccgtcccggtcctgctcaccagctctgcaaaggccttgtcctccctgcctgattctcggcaccatttttaacacggtgggatgtcttggatttttatgataataatttcagtatatgttcaacccatggaaacatttcatttggaaagatgtgaagtgggttagaaaatgtcatttccatgctttttagagtcgtgactgtggatgactttataggagacccagttgtctgaaacatttcacacggcaatgaaactatttccaaatattcattttcaaaatgtgccacagctggctgttttttgttttcgcttttcaagcacacacattttctcacacacagctcagatgtctattttacactgaaggtttattttactggggagtgtttgctggggcgtcccgttcccaccacaggccggtgcctccgaggctcagccttcaaccctcttacatgagtttgccgcagacaaccagcaagccgtgtgtggcacacagttctactggtttctcctggctttattacaaaatgtatcacaaaggttaactcacagtagtgcaaaggtctcatttttataaaatggataaagtgacaaaatacattaaacatacaaaattcacttcttgcacactgagcttcaggtccttgctgtgctgcaatgatgtgtggggtggatttcatatgacctgctggttccctcacctcacccagaatctttttcgtatgtctgtcagtcaaagtggtcacttcatccatagttattccaatttttaaaactttttttgacctgttaagtattgcttagcaatgagtgtacaccaagaaaggtttgaacaacctgtacattcacccaactgtgtagcagacttccacggctcatgatttattctcaaatttttctccaaatttttagcagcatcttctatttatcttccaagcattgctgacaagggaggtggccaggtttgcaaagctgcagtgccatcagcttgggcgccatgagtgggagtcacagccggggccacagcacgagggcatggccatcggcattgctggtggagctggggatgctggagggggagggaggggaacgctggatggggagggagggggacgctggaaggggagggagggggatgctgcaggaggaagctggggctctgctgtgcccaacactgaagctgggcccgtgtggggcggagagttgatttcaccgttcctgttttccctcaagcctatggagaggccacgttgagtccagaggtccgtgcgcctcatggccacatcacggcacccgttcacccacacaagggccaggagcatcccctagggaggaggagatggcagatctgcacaggctctgcgctcctctctctccggagcgtcctctcctctgtgtggcaggctcggcgcgtgatggaggagccccttctgcagggctctgtttagagggtgcccgccccacagcctgtggctgctcctactcatgccaggtgaggctcctacacccaccagtggccaccggggagtcacagctccttctgcatcatccgcctgacctgtttcctcatctgggatgacaaccagatccagctctgaggtccgtgccctgagtagaaaagttcacacagcaaagtttccggagccttccctgacgcgccacgtgtccgtccataactggtcatcctccacatcctgtgaggcacgtctcagcacctcttcgtgcaagcgcccgcactagacgtttgagaaacagatgtgagcaggcgtggtcctgacctccatcccgaggttgggggtggaatcacaaagcaggagtgtctgccaggagcacgtgtgcccacacagcaggcctggccccagtggctcagatcaggaacagacacgtactcaaagacggcgggtatgagaaagccttgtgagggaagggagccctttgtcggggggcctgaaaagaaacacggcctttgctggttctctgagtcagccccccagctaccacccacactcctgcagggagaaccccgtcaccacccacactcctgcagggagagcctcccagccaccacccacactcctgcagggagagccccgtcaccacccacactcctgcagggagagcctcccagccaccacccacactcctgcagggagagcctcccagccaccacccacactcctgcagggagagccccgtcaccacccacactcctgtagggagagccccggccaccacccacactcctgcagggagagtcccccagccaccacccacactcctgcagggagagccccagctactgtacacactcctgcagggagagccccagccactgtacacactcctgcagggagagcctcccagccaccacccacactcctgcagggagagccccccagccactgtacacactcctgcagggagagccccggccaccacccacactcctgcagggagagccccccagctaccacccacactcctgcagggagagccccgtcaccacccacactcctgcagggagagcctcccagccaccacccacactcctgcagggagagccccccagctaccacccacactcctgcagggagagccccccagctaccacccacactcctgcagggagagccccccagctaccacccacactcctgcagggagagccccgtcaccacccacactcctgcagggagagcctcccagccaccacccacactcctgcagggagagccccccagctaccacccacactcctgcagggagagccccgtcaccacccacactcctgcagggagagccccccagctaccacccacactcctgcagggagagccccccagctaccacccacactcctgcagggagaaccccgtcaccacccacactcctgcagggagagcctcccagccaccacccacactcctgcagggagagccccgtcaccacccacactcctgcagggagagcctcccagccaccacccacactcctgcagggagagcctcccagccaccacccacactcctgcagggagagccccgtcaccacccacactcctgtagggagagccccggccaccacccacactcctgcagggagagtcccccagccaccacccacactcctgcagggagagccccagctactgtacacactcctgcagggagagccccagccactgtacacactcctgcagggagagcctcccagccaccacccacactcctgcagggagagccccccagccactgtacacactcctgcagggagagccccggccaccacccacactcctgcagggagagccccccagctaccacccacactcctgcagggagagccccgtcaccacccacactcctgcagggagagcctcccagccaccacccacactcctgcagggagagccccccagctaccacccacactcctgcagggagagccccccagctaccacccacactcctgcagggagagccccccagccaccacccacactcctgcagggagagcctcccagccaccacccacactcctgcagggagagccccccagccaccacccacactcctgcagggagagccccgtcaccacccacactcctgcagggagagcctcccagccaccacccacactcctgcagggagagccccgtcaccacccacactcctgtagggagagccccggccaccacccacactcctgcagggagagccccccagccaccacccacactcctgcagggagagtcccccagccaccacccacactcctgcagggagagccccagctactgtacacactcctgcagggagagccccagccactgtacacactcctgcagggagagcctcccagccaccacccacactcctgcagggagagccccccagccactgtacacactcctgcagggagagccccggccaccacccacactcctgcagggagagccccagccactgtacacactcctgcagggagagcccccagctctgcagcacagaccccagagacagcatgcggcttcgtgattcctgtggagcagagtggggacagcctgctatggagcagcagcccactgggggagcctcgagacttgcaacgacccagacccaattccctgaggccccagcctgtggtggcagggcccacagcctgcgatctctgcataccctggatttcagaggtcactgcagtcaggccacctgaggacacacacctgagggtggtgcccaagccaagactctctctagggatgtccacgtgaccccagagaagcagcccaccccacagtccacccacagccttcgcgcctctccaggagctgggccacttttcacacacaggatccacgtcttggttattatcgaacactcttggagcttcccaagactgcagttttaaaagaaatggcggagttggcagtatttggaggtagtaatgaattttcatctttgttctcctataggaacgtttcagagctgagtccacatatctaattgagtgctgtgtgaacgcgtttccacgctggaactagataccactccatgcaaatctcatttctgttctttaacgatgccttttaatatctaatctgggccttaatatctcgctcactaaacgtgttgagataattagatgatagagctagacaattactctgtgggtagagagcagacagtttcttatatttatacaaatacacatagttaaaatgaaacagaactggcagcattcacggtccgtccaaccagggaaggccactgacggccggggctggtcagctcaggcagcagctggccgggtgcatttctatttctagtttttcacggaactgaccaggcaattcagtcagtagctgtcaaaactggagtccagaacaggcacagatgggctggcccaaagttaattaaaaaccaagaagaggataaagaaatgtggcccagtccagggagctgtggagaggtggggggcagggtgaccttctctttcttgtgggggttggaagaggaaccccacggcacagcggacaccatgtgggaccccagcacgggcgctttgggatgtcggcagaggcacgcatgcctccagggatgtgccagctcagggaggcaccctgtgcgtgctccatggtgacactgccccacggggtccaaatgctgaattcctgtaccttttacatacgtgaagtctatacaataatggaaccgaagccctctgtggggaatccgtgggaggatgagaggcctggattgcaccggaagcacctccggctggagctcggccaaggagcccgggtcccttcagtctgcgctccctgcggtgggcagtggcttctgtgttttgccgtcgaggtgcaacatgcagctggtgatgccctgtggcatctgcctcctgccctcggacatgctggcccgccctccctgagtcttgcagggcccagccgctgtgcctctgtgtggcctccccaccttacctgcagacacgctccctgtactcaaagccgagctgtgtgaggcttttggggctgccagaacaaaggactccagacggatgggcttgaaacagtggatgcctgcagtctcacaggctgggtttggagaccttgcttggaggtgtctgcagggccttgaaggggacaccgacccttcctgactcccagcctctgcgttgccagcagccctcggcccacagacacagcgcttccctcctgcctccgagccacgcagacggcttccctctgcatgccggagtctgtcctctccgtcgcagggacacggatgcttcgaggactctgtgtgccggagtctgtcctccccatcacagggacactgctgcttcgaggactctgtgtgccggagtctgtcctccccatcacagggacactgctgcttcgaggactctgtgtgccggagtctgtcctccccatcacagggacactgctgcttcgaggactctgtgtgccggagtctgtcctccccatcacagggacactgctgcttcgaggactctgtgtgccggagtctgtcctccccatcacagggacactgctgcttcgaggactctgtgtgctggagtttgtccttcctgtcgcagggacatggccgcatcaaggacctactgcagcacggtgcctccttcaccaagcgaactgtgtctgcaacagtcctatgtccacggaaggtcccattctgagctgccgaggtccaggacttcaacatatctttctgcggagacagttcagcctatagcattagctcatgtgccctctgttaggaagttccctgacagacttgagcccacggctaggggattcccttctgaacacagaatgtcttgcttatttcacacgtgtgctaatttgctgtacaccaccggcttatttaattgttgtgcatttattgtatttctccactagattatttactaactggggtcaggatccatgactttttaacattgatattcatctctctttttagaacagaaatgggtgcccagctggtcaacatacatttgttaccttgctttaaaatgccttgagagtggaaccaccggtgcaggcttggctggtcaagaatcatgttctagaaattatttccagtgctgagcacagtccctgagatttaaaaacgcttatgggatgaatggaaaatagcagggcctcttaccggcctgcaacgcctttagaggcacggatgccacgtgcacagacccagctccgggaagcacaagcctggtggtgtgcgggaagcggcgaggtgcgcgggaagcggcgaggtgtgcgggaagcggcgaggaccggctttaaagtcacagcagtttcctgaaagatgagggggaggaggacagtgacgctcacagcacagccacttgtcaacttggacatgacacacacaaagcccagagctcggacggcaccgcgaggaggctgggattcacgtcaggcggcacttggtgggcagttacaagaaaggacggcagccaagccagtgcctcctgtgctccggctctggggccctggacacacctggggattcagttttgcatggaccagcattctccaagcgctctgatcagtcttacaggagaagtaggctgtgtggtctgggagccttgagaaggttccgctgtaatctgtcagacttttggacaggatttttctgccttacgtggctgatgtacgtctgcaggagggtagcacacggcaccctctcggcctgctgtgccacaaaacctttgcttttacaggtctcacggagccagtgggctgcccaatgccccagtgcagagtggagacgaggtcttcccctccttcccagcttgcctgggcggcgacgcgtctcagagacctctgccagggtcaatcctggcccatgctactagctcggggtgtgaagtcacagttgatgctgaacacctggctgggccagacttgtgcccaagaaaccttataccaccaactggttttcaaaagaaaaaaattaaaagtaattcaaaactttgagatataaatataattctttaaaaactgcagcgtggttcactggccctgtgatgggctgaatgcgcccccaagttcatgtggcagccttgacccccaggacctcagcgtgtggcgtcttggagacaggggctttacagaggcgatgaaggtaaaacaagctcttatggcgaccctgacccagcaggaccggtatccttatcagaaagggatatctggacacagagacagacgtgcacgtgtggagacacctgaagatgaagatggcatctaccaggcgggggagtggcctcaggagaaacgggctctgcccacgcctcgacctcggacttccagcctccagagccgtgtgaaaagaaacttccatcatttaagctgccctgtctgtgggactttgcctcggcagcctgagcagacagtacaggctccaaaaacgctctctgcatgtgtgattctggccaggaccaccctgcccgaagccacggctatgtcgaagctaattgtgcgatttctgccggccacgtggttttgatccaaaagcatttgaaagctgctctgaagatgcagaaaagctgagtcccggcatcgctgctccttccaagcgactgttcacacacagggtgtgagtgcgtccccccatccagggtccagcctggcctaaggctcactgggcaccatccagatctgtgactgggtccccccatccagggtccagcccacccgaggttcactgggcaccatccagaggccccagatgccgacacctggggacgggctgtatcaggcagatgtttcctcccgggctccacctggggacgggccccggatgctgacacctggggatgggctgtattaggcagatgttcctcccgggctctagttttccaggccgacaggaggaagtcctgttggggccaggggaggcattggggatgagattgagaggatggtggggtcgcaaaggtttacattgcctgtgccactttctccaaggtctggggccgccaccctgtggtgcctctggaagctgccatgtggggctggcccacggtgactggccacggcggggctgtgtgtggtatgcacctgtgagctgctgaaacgcagcctggcggccaggaaccagctgccccatcctctctgcaggaggtcaggtttgagcacgtattccctcaaacgctcatagacgtcagtatctcaggacaaagtgcttgtctgagacccaggtttgggccccaaggtggtaccatcgagggaggcatgttctggcaggtgacagcccctcctctgtgcctgaacctgcagtttctgcccccgcataaaatgccgccatctcaggccctccctgacccccaacctgcacaagggctcacagctggcaggcacctgtgtggggtcgtggtaggacctgtgtctctgaggtccagcccaaggctgtgccacataggcccaaatccaagcactcccctcctgggcacgtggctgtgtgtgcatgtgtggctgggtgggcaggggggttgactctggccaccgaaatggagaggagcggtgcactccctgggtctggcccacgcaggctccttcccaagtgctgctgccgggaaatggaggtccctaggtgagacgggagccgggcactgtgggggtggcccctgaggggctgcaggttggcactgcccagctgacgcattccgcagtcctgcaccaggggatgaacgaggaatcggcttctgctctgctgaacatcccactggttcatgtccacttgtttgggtgatcctaactgatctgctacctgagtttgaatctcagcgctattattagtcaggggtcctggaggtgggtgaccccacctcacctaaaccacagagatgctcatcctcatgcatgcacacgtccatctcagcttcagctcgcaagcaggaccctcaccgtggggccacgacggaccctgcaaagctggtctgactgtgccgagcctgtcgggggttgggggaaggaaggcgggagctcggcatctggagggcagtggagaccctcagcgagtgccaggaggatctgctgtcttcccagtgttgtcttcacagtggagagatgagttcacacagccttatctgtgtttccagtggcctctgtgtgcaagacgggccacgggttttgtgcggtatttgcctgtgggtcacagccaggtgaatgggccctcctggggctgcagccccaggtcctgatgttacttgtgccagcctggccacagtgcccggcctccagaagctgctgtcagaggagcagacgggagggcagggtggacggttaacagggtcaaggccccagagccccacaccctccccagcagccagcacaccctctgttctgtgacctcgcccctgcattgcggcaactgacagatgctccccggcctccttccccgctgccgcgcaacctctgacagccacgtgtactctcctgctttagaacaaggacctttcccttttgtgcatgaatacgctctcagcagatgcgagaaaatgggagtcaaatgcacctttgtggtttcttttccttctacacaaacaccacttgagtgaggcccgggttctgcaaagggaaagtagtcgtcactttctaggccccaccatgagccggggctcaaatcccatcctggcctgctgggcatttgtttcatcaattaagagtcagtgagcaggaaacaacattgcatattcacacaaacacacgtgcatatccaaatacacatacacacacatgcatatgcagagttatatacatatataagcacacacatacacatgagcacacacacgtccacatgtacacacatacatacatatgcatgagcacacacacgaccatatgtacacacacgaacatgcacgatcacacccatatccctcgtgtacacacacacacacatacacacagtgctcatgacctactaaacagcgcatgtgcctctcagcccttgccatgacaaccatgaggtctgcaggaaacacgtccatagaggtggagctgaggctggtgtgcattctcccaggcacccagcatgagtgcccagctcagggtctgcaccgaggctgtctggcccgagtcccaggctcgccccagtgcttgccacacacaccctggggtctcctcagaagcagtgcctgtgccccgagatgcacggccaccaccccgcccctgaggccctggatacacggccactaccccgcccccgacgccctggatacatggccaccaccgcccccccccgacgccctggatacacggccaccaccccgcccccgacgccctggatacacggccaccaccccgcccccgacgccctggatacacggccaccaccccgcccccgacgccctggatacacggccaccaccccgtccccgacgccctggatacacggccaccaccccgtccctgacgccctggatacacggccacctggatacacggccaccaccccgcccctgacgccctggatacacggccaccaccccgcccctgacgccctggatacacggccaccaccccgtccctgacgccctggatacacggccaccaccccgcccctgacgccctggatacacggccaccaccccgcccctgacgccctggatacacggccaccaccccgtccctgacgccctggatacacggccaccaccccgtccctgacgccctggatacacggccaccaccccgtccctgacgccctggatacacggccaccaccctgtccctgacaccctggatacacggccaccaccccgcccctgacgccctggatacacggccaccaccctgtccctgacgccctggatacacggccacctggatacacggccaccaccccgcccctgacgctctggatacagggccaccaccctgtccctgacgccctggatacacggccacctggatacacggccaccaccccgcccctgacgctctggatacacggccaccaccctgtccctgacgccctggatacacggccaccaccctgtccctgacgccctggatacacggccaccaccccgcccagactgaagggtgacaccagaggcaaaaagagtgaactagattcacgtaaatcaacatgaataaacttcaaaacagaacagatggaaagactggaaaagtccacgcactaatgttcattcaggcagaaagagtgagggtccctcccagaatccagtccagggagactccttctcttcctttctgcatgggcccgaggagctggtccctagactgctcagatccaatccacagtccgtgagcaaagggccgcaggcgtggtggaggtgtgcccaggcccagcatgcccccagagtccacaagagcaggactgggggcaccgtgcctgcgccagcccaagctgcccagacttcctctggacagcaggcctcctgagccctggagattaactcactgccgcaggtaggatcacctgagtcctctaggaacccagcccgcatcctgggcaagaggcccacatgcaccttagaaagggcccgaaacagttcacgagtggggtgtgggctgtgggtccagacacagttatcctaaggccaggcacaggaagggttcctttcccgatggctccgacagcccagtggtgcacctacaactgcttcccatcgaggtggtgggctgggactcggcaagcccatctgaacagggctctctgcaggcagccccaggcctggagtttgccaagtgatgagttttcctgtctgagcttgtttccatcatctccacgatgaacgtaggacaccaggacattggatctctgcggggcagcagctcatggcccagctgtaggaaagcagacccagcctctggattaaaaccatgcctggaggaaactggccttgtgagtgtcagggctgcgctgctgtcttccaggtcctccctggtttaatttagcaaaactaccaatgccaagaactggttaaattttttaaagggaagaaagtatgacacatggagaaaaaggtgcagcccatttcccagcctgaggactggccggggaaataactctgagccctcgagatgaggggctatgccttcccttgctcactccctccctcacccacctgcccactcgcccatccactcaacagcggtcgttcttcattgtattgtgagctccctctgggctgtgcactccgggccatgcgtggctggtaactgggaaatgctcgacatggaaaattctgcttgatcatctgagatgccacctcagtcttggggaactcaaggccaggagggtcacacaacccatttagcattgcctagcaccagtggtgaggccaggcctcccgcgccctccatctttctgccaccacagtcgtttggggactcagttccatgtagaaccagatgaagattcataaaggccagtgggataaagacttcccaatgtcccgaaacaccctgacacgtgtaattccaaatctgtaagtactaagttttaaaatgcgtgtgagcaagtcaaatttctgatgtttccctggatgacaagatgttttctttattaaaatatcaaggtctttctacaaatctttcctgatacctcaactttgccagggtcctaagcgtgtgcttaggtacttgcagagcctcccagcatgggaggtctgggtagggccttggaggcctgctgggaggtctgtggactccaggccgctcacttatccccatgcatataaaattcctagggataatttcatttgatgacagagttacacttaatgccaaagtaaagaaaaagtttacatttttcctgagttagcagacaaatataaggggacttcaaaaagttcacagaaaaattggattaaaaggtaaaaataaaaatataaactttatttctcaacataatctccaccagggccaagacacttttgcaagggatcaaacccaccatttagtccattcccaaggcactgaggaccttgggaatttagccacatcaatgcagtctttttcccattactatctaaggaaaaatgggtaccctctggatatattttaagaatggaaaacaaaaagaagtgagaaggagccaaaccaggactgtagggggatgcctcatgagttctcatcggaactcttgctaaattgcccgtgtttgatgagaggagtgagctgaagccttgtcctggtggagaagggctctctggtgaagctttcccaggcatttttctgctaaagtttttataactttctcaaaacacccacataataagcagatgttatttttctctggccctccagaaagtcaacatgcaaaatgccttgagcatcccaacatctactgccatgacctttgctcttgatcagtctgctgttgcttcgatgggaccccttccgcctctcggtagccactgctgtggttgtgcttggtcatcaggatggtactggtaaagccatgtttcctctcctgttgcaattcttcaaggaaatgcttcaggatcttgattccgctgttaaaaatttccattgaaagctctgcccttggctgcagctcatctgggtgcaatggttttggaacccatggagtggaaagtttgctcaactttaattttccagccagaattatgtaagctgaaccagccgagatgtctatggtgttggctgctgtttctgctgttaattgttggttctctccaattaggatataaacaaggttaattttttccttgcaaattgatgagggggtctgccactataggattcatcttcaatatcatctcattctttcttaaaatgagttctccatttgaaagctgctgatttctttggggtgttgtccctataaacttttcataaagcatcaatgacttcatcattgttccacccatgtttcaccacaattttgatgtttgttcttccttcaattttagcagaattcatgttgctctgataggggctcttttcaaactgatatattctcttcctagccttaaactagatcctgttcagacatgttacaacaagttagtatgagtttattttggtgcagaaagatttttgaaatccatgcatagttttccatgatccacattttccatggaccttcttcagaatctcttccataacaagcctgatggctgcttggggtgctggctgaactcagagtaatgcctgtgagccgccaggaatcctgctctggggccaggagctgcatggcctcgtgccagcctcccgcacctgcacccccaccttgatcccccagagcacctgggttgcgtaaggggctgcacaccacagtcatctgtttcttaaagtactttgatgttgatctttctgtgagactctggaagtggagatagctttgggtttattgggcgttcgatgttggggattggatggcctggctcagagatgttgaaatgtccccgacctgaaggctcttgcagtgctggtgctgggggcgctaggccatgagctgcacagctggggtaggggcctcagggctgcctggacttccttacgaagaagctggctcccagagcttccaaagttgacggttctgaactaggcaccaatctttcctcttttctcagctggggaggcccagttgctcaaagctgtggttctcaaagtggggtccccagactggcagcacccagggagcttgttagaaacacagatccttgggccctgcctcggaccccctgagtcagaggttctggggtgaaccagcaacctgtgtgtttacaagccctgcaggtgattctgatgcaggctgacatatgagaactgtgggcctgggggatttgggttgttctgcttatgggaaagggcaggcgtgacctctgagagaacttgtaagatgtgagagtccaaaagcttcctctaaattggactcaaggtcgcgttcatcggcagctgtgatgtaggaggcaccctaggtgtttgccaatggcatttgtctctattggccgacaccaccccagggcccctgaagagcaaccgggactcactggcacaacttcaccctcctccttttatttttttttgtaatacaaaggcttgaggtacagtattatttttggagggattttttcctattataaactagtaatgtcttagggttaacatttccctaacacacatatacacatacatacacatatgccttcccacacatatgcacacatacacacacacacacagacccctaaatacctacacacccacacacccacaaaaatgcacacacacccatgtctacacatgtgcactcagctccagaacacaggatgtggccacgcatacccagcacctccccacacacaaatacccagcgtccttcccatacctgcatacccagcactttcccacacacatacccagcgcttccccacacacacatacccagtgtcctccccacacacacatacccagtgtcctccccacacacacatacccagcgcctccccacacacacccagtgtcctccccacacacacatacacagcgcttctccacacacacatacccagcgcctccccacacacacccagtgtcctccccacacacacatacacagcgcctccccacacacacatacccagcgcctccccacacacccatacccagtgtcctccgcatacacacatacccagtgtcctccccacacacacatatccagtgtcctccccacacacacatacccagtgtcctccccacacacgcatacccagtgtcctccccacacacccatacccagtgtcctccccccacacacatacccagtgtcctccccccacacacatacccagtgtcctccccccacacacatacccagtgtctttcccacacacacatacccagtgtcctccccacacacgcatatccagtgtcctccccacacacgcatatccagtgtcctccccacacacgcatatccagtgcctccgcacacatggatacccagtgccttcccacgctatgtcctcacagctgtttcccctacccaatgcccatgtaactgtgtcctgacacttggtggcctccttggtttcccggtataactaagcactgagaggcgctcttgcgcccaggccgcctgtccaactggggcaggctccatcttgcaggaggtagaaggagggtgcagagtccctgaggccctcagtccacatgcccctccttggagtgtcccctccccgccctgtcagggctcctgagagtttcctcagcttcctggcggggtagaggggtgacgggtgctttctgtgtgggccctgtctgctgctgcctctccacagctccccttcaagggccacccatgtccgcaggccacctccccttgctgggagcactcatttcccaggtggtgcttgtcctcttcctgggacacttttctgtctgcactagaacttgacagaggaagccacaaagcttcctggccatggaaagtgggaactggccacggaacaggggaactgcccctggccgtgtatgtccctcacccgagccctgtctcctaggctctcgcttccattttgcactgagacctctgcctcattccctctgaccgggcctcttgcctgccctgaagtcctgcttcctcgctgcttgtgggagggggaggctccgactgtctctcctttatccaccaatgtttccgccaccagcgagtgctgagcaagtatctgttgaataaatgaatgtgcaccaggaaagaaagcagccgcctggcctgacctcgtctgaggctctggatgggatacgcttcccagtttgctcgcttccctggagaaacccccggagggccgcgccccgaggctttgctccgacgtgtgccaaggacatgtgctgggagcgtctgcaaggtccgtctcgccgtgggggccgggaggagaacgtaccgtcctcaaggtccgtctcgccgtgggggccgggaggagaacgtactgtcctcaaggtctgtctcgtcgtgggggccgggaggagaacgtactgtcctcaaggtctgtctcgtcgtgggggccgggaggagaacgtactgtcctcaaggtctgtctcgtcgtgggggccgggaggagaacgtactgtcctcaaggtctgtctcgtcgtgggggccgggaggagaacgtactgtcctcaagcagaatttcctgcgctggtctctgggatgggcagagggccctgctttcaggtactgaggagagcgcagcactcggcatcacactgggggcacaggtcagcagggggcacctgggagagaagaggaggtggaaagcggaggaggagggatggacgaccagctgggcacaagaggggcttcagggcacggcaggagggccgtccggggaaagttgtttcctgtcccactgactttgacggctctaggtctgccacaactccggcaaagtcccaggaccctgagcagcctcgggaagagctctcgggacctcgggggagtgaggtggcccaggcctggcacagctcagtggtggcacgtcacatcacacatcttcagaccaggccttctgcaacgattctctggcctctctgctgctctgcctagctccagccttgtcctgcggaaggtgctgaagcggccctcagtctgcctctggcctccctctgtttccccctccacaactgggcaggctgctcccttcaccccaacactccatggctccccatggcctgcaaatcagatcacagcccctaagcctggactgcagtgctccacttggcctcgcccacctctcagcccattttcaacgtgacacacgcaggtgaagtggacctgacccagctcctgctttctgccccctcctgtcccctctctcctgccctgccccgatcctgcctctgcttctgtccacatggccccagccacagtgccttcctgccagccaaccatgttcacaaggaagttcatgtcccccttaactcgagcttttatttcagtgaagcttcggggtcacctgcacggcctctcgtgagtagggggatttcctactcgctccacagacagctcccggggtccggggagaagcggaggggggcagagaaggccgtgccacccagcagcacaaggcaggggtttgcttgcaggtagcaaagtaacccaagcagacacacactcatgcacacacacacagagacacactcatgcacatacacagacacacactcatgcacacacacacgaacacactcatacacatatacacacagagacacactcatggacacacacagagacacactcatgcacatatacacacggagacacactcgtgcacatacacacacggagacacactcgtgcacatacacacacactcatgcacatacacagagaaacacttgtgcacggagacacacttgtgcacatacacagagacacaggcacacacaggcagacgcaaacgtgcatgcacacagacacacagacacacgcagacacacacacgcgcacacacagacacacacacacacacgctcactcacaggcaaacagatgcccttgggtagacttgtggtctgacagccgtacaggaagtatgtcccaggaggagcccaggctgtgtcggggtcaccttgacttcactattttcgaaatgctgaattttgctgcaaagttttcctaaagggcttggaaacggtccagaccgtgctgtcctggaagtctcctgggggctccttcttcaaacaagagaaagctggggagtttccaggcgttccgtgagagccgagggagcgcgtgagggcttcctcctatcagcgtccgtattcatggtgggaggtggcaaacctctatcggcagtttctgataaccttgctccgggtcacacgttatcttcctgaagtggcagccacggaagctgcaattcaggcaccaatatcagaaaatgagtcattgccgggaacttcactgtgcagtcccagaagtcttaattccagcagacagggtgactccaaagggagatcgttccagccacttccaaggtgtctctttctccatctcttcttgcagccctgattgtggggccatggcctgtgcaggaggcgagcaagtgtgacccctggtggctgcagcagcagcagcaccttgggcctcgggggtcaggaggggctgagtccccaggtcaggcatccccaggggggcacggggctgcagagggtcaggaggggccgagcccccaggccaggcatccccagggtgggcaccgggctgcagagggtcaggaggggccgagcccccaggccaggcgtccccagggcaggcacggggctgcagagggtcaggaggggccgagccccaaggccaggcatccccagggtgggcaccgggctgcagagggtcaggaggggccgagcccccaggccaggcatccccagggcaggcacggggctgcagagggtcagcagggcaggtatgccttggccatcaccactgcagtggcctagaggtgttcctggctgtctccatctggggcagcacctgcagctccttggacagtgtcagaattcacgactccttgcaaacaatgcagtccacgctcaccctccctcctctccacgagacctcagtgccctggaccatggactgggtgcccgagtgggctcatccaagccctgtttttgtgttggtctcctgttgtgacccatcccctgctatttctgctgggcctgaggtaaggcggacagggctgaccctgaaggcaaagcatcctgggggccactcttctggaagcgaattcccagcatggagaagcctgaattaaccagcagcggccccaggacagagtctgtcaccagagcctggagacaggatgggtggctgtgtctaaagccacagcattttcttttcctgtggcaagttatccctttccttagaaaaaagtactgttggatgctgacaccaccacaaataatctagttccttggcaggtcctctcatgagtaaacggccctagaagacgtttctcccaggaagatgcacagacggccaaggcaggcagacggcggcaatcagcagcttccacgtccaccagggtggccttgggaagaccagcgcccccacgtggggctgggagaggccgcactgcaccccaagagtgaggatgggtcgggggcagcgggaatggtgctctatggggcttcacatggcccctgcaccccagggcggagaactttctaagagggaaggtcggggcagctgctgtgtgggtgccagcagccacctggggacagtgccagcacgggggcatgccgggggagcctctgggagccgcaggaggcactagggacacgcagctcgccggccctccaggaggacgacgttctgaaatgggccttgatgccctggacggcctcgctagcctttacccacaggggaaggtgcaggatgtggcagtccctggaggaaccccaggcctgagtgtggcaccagggtttcctcggggaccccatatctgagtgcagcaccagggtttcctcggggaccccgggtgcaagtgccatggtcagggtttcctcggggaccccggctccgagtgccatggtcagggtttcctcagggaccccagatctgagtgcagcaccagggtttcctcggggaccccgggtccgagtgcagcaccagggttttctcggggaccccgggtccgagtgccacactagagtttcctcggggaccccagatctgagtgcagcaccagggtttccttggggaccccgggtccgagtgcagcaccagggttttctcggggaccccgggtccgagtgccacactagagttttctcggggacccgagatctgagtgcagcgccagggtttcctcagggaccttgggtccaagtgccatggtcagggtttccttggggaccccagatctgagtgcagcgccagggtttcctcggggccccgggtccaagtgccatggtcagggtttcctcggggatcccaggtccgagtgccctacccagggtttcctcggggtcctctctcctcccctccgtgcaccccgcccacgtcacaaagaggaaggtgatgtctctggacccagcatcaaagcccgggtcttggtgggtggtgcagaaggtgttcctaacagtgggctggggaacagccaaccctccctgtgggcctcagagccaggtctcaggaacaggcactgcacagctgggagcagcagggacaggagaggagggagtctgctcagagacgtcttcttcagaaaccacattccccaagcccttcgccaaaatcatcaaaacatcccacgatcagctctgcttgaccggggagaagaggaacaggaaatatgtcaggggtgagattttaaaatgtgtgtgaatataaacattcagctctgtaacataattaacagcgccccaaggaaaatcccgcgtatgtcagtaggaagcgttcttgatgcggagcgaaggctacttggcggtgttccggctctctgactctgaagggcctgcccgtgttccttcctgaggctcagacaagcccatctcagctttgctgtctaggaatttataagtgtaagagagcaaagattcagttccccaaaagataccctcttggtggcctgtggtccacgggagacctcatgcaccagggatccccgtgctgggccggccagtgctcaagagcacggaccctgaggctccttaaaggggctggaagggtcagtgtgataccgtgcacccacacttactcaccgaggagctctcggattccgtggggctggaagggtcagtgtgataccatgcacccacacttactcaccgagaagctctcggattccgtggggctggaagggtcagtgtgataccgtgcacccacgcttactcaccgaggagctctcggattccgtggggctggaagggtcagtgtgataccgtgcacccacgcttactcaccgaggagctctcggattccgtggggcttgacgggtcagtgtgataccgtgcacccacacttactcactgaggagctctctcagattccatggggctggaagggtcagtgtgataccatgcacccacgcttactcactgaggagctctctcagattccatggggctggaagggtcagtgtgataccatgcacccacacttactcactgaggagctctcggattccatggggctggacgggtcagtgtgataccgtgcacccacacttactcaccgaggagctctcggattccgtggggctggaagggtcagtgtgataccgtgcacccacacttactcaccgaggagctctcggattccgtggggctggaagggtcagtgtgataccatgcacccacacttactcaccgaggagctctcggattccgtggggcttgacgggtcagtgtgataccatgcacccacgcttactcactgaggagctctctcagattccatggggctggaagggtcagtgtgataccgtgcacccacaattactcaccgaggagctctctcagattccatggggctggaagggtcagtgtgataccgtgcacccacacttactcaccgaggagctctcggattccgtggggctggacgggtcagtgtgataccgtgcacccacacttactcaccgaggagctctcggattccgtggggctggaagggtcagtgtgataccgtgcacccacacttactcaccgaggagctcttggattctgtgttttcaagcctgcccatgtgtaggaaaagcacagcctccatgagaacagcaggaacacaccccccaacacgcacacccaaacacacacgcatgcacgtgcatgtgcacacacacacactcgtgcacgcacacgtgcacgcacacacacacagagcaacgtcctgcagctcccatcttttctttttaaaatcatacatatttcattaagctccatgcagagtgtcttctgatttatggtaattgtcaacaaaagcaaaaacacagacaattttaaccctgcagtagctgggagttaaccggcatgaaatcatattttttttttcctttaaaaagggagggggctccaagcactcccttgcattaaactctgaggatgctgaaccaagagagacagtgtgaaccccagcattggtggctgttgtctaagaggcccatgccagaagcgacatctgatagagtggccacctcaccccacgtgagcccggcttactcgtggcctggaggactttgagtgagactaatttccatatcaaacccaatttagatgaaacgtctttgttaaaaaaaaaaaaaaaaaaagccagagcttcaatagccccttgattagattttcatctcctgagcagacaaatatgaatatttattaccatgaatgcatatttttctctttccattgctctgatcttgagtattatccactgctaatttttatgaaaatttgggcaacataatgttttcacataaactgacagtccttgagataatcccgttattgtctggttgaaaatgacagcttccgcttattcatgtgttaacgagggattaaatattgtttttcatccccgtaatctaagacggactggaaattaaaaattgaacattgtatattagcagggctctgaggaccagaatttgtttgcgttcacttagagacgatctgtaaattagcagcttcacaatcaggccctgtgatgttgctgctgaaggtagcatcataaaatgccactgacatttctaaaataaattcattactctacccgccgcacaccaaaatgaaaaggcttctatcaggaaatacatcgcaaaggaaaagacaacactgccaaagaagtaaaattgcaacacaagttatattgcttcaacatcaagaattttttagggtccccgtgctagagggggcaccggcagctcctgggaggtgtgagtcttggtcatcatgtggcgttggcagaaggaggaccctgtacatcctccctgcaaaatcacccaagggacccggcccataggcagatgcagccacgtccttctccagctctgagggcaggcaggccatctccacgctgagcatcgttgacggtgacacatttgtaccatgtggtaatttttactttattgctatggctggatggctcagactgaaccgtggatctgaagggtttttggacaaaactatcctattatccttctaaaaatcgcgctaaattttattcatgtatttattcattaattcactctccctgattgccttggtagaatttttcactttttaatttattgtttgatatggtgcaggaaaatggcatagatgtattcctctgaagctagcttgacccaatgctatcttttggaacaaatgataaaaaggcactctgagttaaatgagacactaacagggtcagagtttagagctgaattgagtctctccaaagtgcctatgggaagctctaatcccagaacttccgaatgtgactgtatgtggagatggagttgtctataggagtcattacggtaaaatgaggtcatgaggatatgtggagatgggggtgtttacagtagtcattatgataaaatgaagtcatgagggtatgtggagatggaggtgtttacaggaatcattacggtaaaatgaggtcatgagggtatgtggagatgggggtgtttacagtagtcattatggtaaaatgaggtcatgatggtatgtggagatgggggtgtttacaggagtcattacagtaaaatgtggtcatcagggtgagcctgatcccatgtgactggcatccttgtaggaaggagatgcagacacaggtgcacacagaggggtgaggacttgaggatgcagagacggcatctgaagcccaggagagaggccttgggagagaccagccctgcccacaccttgatcttggacttcagccaccaggattgtgagcaataaaggtttgtgactgaagccccccactctgcagtattctgttgtggcagccagagaggacgcacatggtcaacatggcaacaccccctcagtacaccctagacatctgaggccaagcccctgtgactgcagggatgcgtctctgcctacgagaaaggagaggatttcctgttttcgtggaacgttaagtccaagtgcttgtcaacagaagaaagttacttcttaagaatgttctttttgctttatgatctcattaaaaaaaaaaaaatagattggcacttcagtaaaagggtttgcacacacacaaccctaattagacttttaatagatcctttgtttcacaggaatgaaagtgaaggtaaagtttgtgcctgtaaactactaaagagctactagggcccagtgtctagggccctccaccatccatcagtttctaatgtaggagatgagaacacatcaccccaaaaatgactgtcatacatcagaacatgccaccccaaaaacaactgtcgaagaacagaacatgctgccccaaaaatgactgtcatacatcagcacatgccaccccacaaactactgttgaagaacagaacacaccaccccaaaaatgactgtcatacatcagcacatgccaccccaaaaatgactgtcgaagaacagaacatgccaccccaaaaatgactgtcaaaggctagaaaacaccactccaaaaatgactatcagagaccagatacaccaccccaaaatgactgttggagaacagaacacgccaccccaaaaatgactgtcagagatcagaacacaccaccccaaaaatgactatcagagatcagaacacaccaccccaaaaatgactgttggagaacagaacatgccatcccaaacttgactatcagagaccagaatacaccaccctgaaatgactgtcagagaacagaacacatcaccccaaaaatgactgtcggagaacagaacacaccacccccaaaatgactgtcggagatcagaacataccaccctaaaaatgactgtcaaagaccagaacatgccaccccaaaaatgactgttggagaacagaacacctcaccccaaaaatgactgtcgaagaccagaacacaccaccgcaaaatgactgtcagagaccagaacacaccaccccaaaaagactgtcagagaaaagaacacaccaccccaaaaatgactgtcggagaacagaatacaccaccccaaaaaactgttgaagaacagaacacaccaccccaaaatgactgtcggagaacagaacacaccaccccaaaaatgactatcagagaccagaacacaccaccccccaaaatgactgtcggagataaaaacatgccacccccaaaatggctgttggagatcagaacacaccaccccaaaaatgattgttggagatcagaacataccaccccaaaattgactgttggagaacagaacacaccaccccaaaacgactgttggagaacagaacatgccaccccaaaaatgactgtcagagaacagaacatgacaccacaaaaatgactgttggagatcaaaacacaccacctcaaaatgactgttgttggagaccagaacacaccaccccaaaatgactgtcaggacaccaccccaaaatgactgtcagggatcagaacacaccaccccaaaaatgactgtcggagatcaaaacacatcaccccaaaaatgactgttggagatcagaacacatcaccccaaaaatgactgtcagagaccagaacacaccacccgaaaatgactgtcagagaacagaacacaccaccccaaaatgattgttggagatcagaacacaccaccccaaaatgactgttggaaaccagaacacaacaccccaaaaatgactgttggagaagagaacacaccacccaaaaaatgattgtcggagatcagaacacaccaccccaaaaatgactgttggagatcggaatgcaccaccccaaaaatgactgtcagagaccagaacacaccaccccaaaaatgactgttggagatcagaacacgtcaccctaaaaccgactgtcagagaacagaacacaccaccccaaaatgactgttggagaccagaacacaccaccccaaaatgactgttggagaccagaacatgccaccccaaaatgactgtcagaaaccagaacacaacaccccaaaaatgactgtcagagaccagaacacaccaccccagaaaagactgtcggagattggaacacaccaccccaaaaatgactgtcagagatcggaacgcaccacccaaaaaatgactgtcagagactagaacacaccaccccaaaaatgactgtcagagatcagaacacatcaccccaaaaacgactgtcagaaactagaacacaccaccccaaaatgactgttggagatcagaaaacaccaccccaaagtgactgttggagaccagaacacgccaccccaaaatgactgtcagaaaccagaacacatcaccccaaaaatgactgttggagatcagaacacactaccccaaaatgactgtcgaaaaccagaacataccaccccaaaatgcctgtcagagaccagaacataccaccccaaaatgcctgtcagagaccagaacatgccaccccaaaatgactgtcagagaacagaacataccaccccaaaatgactgtcagagaccagaacataccatccaaaaatgactgtcagagaccagaacatagcaccccaaaatgactgtcagagaccagaacacaccatcctaataaatgtatgcctttttggcataaggattattttgagaaactgaagatataggagaagctctgaaaacaagttgattctcttctataagagagatctatgtttataaaggagtcctccatttgtaagggtggctcctctctgcacctggaagaggacggctctcgtcactggaaaccccatcaatgcagagggctcgactgagggtgcatgacaggccttgcccttgctgaccggcttctctggtcccctcctgtgttaatctgttctcatgctgctgataaatacatacgggagactgggcaatttatgaaagaaagaggtttaatggactcacagttccacgtggttttggggaggcctcacaatcacaaggcctcacaaggtcagaggcacatctcacagggtggcagacaagagagagcatgtgcagggaaactgccctttataaaccatcagatctcatgagactcattgactgtcacgagaacagcatgggaaagaccagcccccatgattcaatgacctcccaccagttccctctcacgacatgtggcaattgtgggagtgacaattcaagatgagatttgggtggggacacagccaaaccctatcacctcctcattgctcctcctgctctgtctcagcagatgatggtgctgaagcctgagtctacacacctctttgtgattgacccgtttctctgggtatggctcatggatgcaggaggtgcacatgtgaatccacttcggcttgtttatctcttgtgaatcggttttttgttacaggagtccacccctcgtaggaactcagaagaacagagacactactttttcttccccacacagagtagtagcttgaggccactggctcaagcaaaaggggtacctgagttggcctggatgctcagtggctgccctgataagtgattatggaaaatgtgatgccagggcggtctcaaggctggaacgacagcccccaccagggtgggcttggctccatgttcactgtctcgggagcaaggctgcccttacacctgcagcacgttcctccactccacagtgcccaggtgggcctgggctgggggcattggacacaatgcatcctggcagccacccaggcctagcctctccagggcacctgatgcccacctgggcagagaaaggcacctgagcagaagggcatggggctttcagaaggagggtccctgaaggggatgcagatgcacccgcctgacgctggaaacaagccaagttcctcctgctggccccaacaggagagtttcccctgacagacacacctctgggctctgctcatcagcgtccatgtccctagctggacaattccagggttgaaaattagggtttcccacctgtatctcatgaactctgccaggtaaaagtttcatattcatggagtataccaggtgcgaatgtgctatagatgtagctaaggacatttcagctttcaggaatctccatgagaaaaggaacttaatttgatgtggggctcagtgtagggagtgcgacctggcctgagtcaggctgcctggtgctggcaccggctgccggttctgccatgtcacttctcctgcctcagtctcccctctgtgaaatgttgcctcctggggacaagggagatgacatgcatgtgaagtgtggaacacaccccgggagggggcgagcatcacaactgttgctgccactgtgctgctgccgttctgaaaaagctgcagcaggagctttcagggtgcaggatcctgttaattttcttcatctctttaagcaactccaagtctgatgggttgacccactgaaaggggtttctggattattacacactgagggaccttatgaacatccctagagttcagttgtttaaataaaaatgaactttggtgccacgtgagccaggctccctagggaacctgcagggacaatcttgccttccactaagacccaggcacaaggcgggcctccgtttcttcagcgggagacatcaccaagtccccacctcagacaataagccgtgtccctgcgactgaaatctatattatgcatatttttataaaaatgcagctgaaaatgttagaaaagggcacagggagggagggaagcatgtcgagaagcagggactgccgttgccacaggcagacatgacttatttcatcttatgtgactatttactctgatattgaataaaaattgaatgtgttgctatagcaacagccacatcacacagcacctctcctgcctttaagtcacaggaaagtattgagaaggcatccgtgagccagcgcaacgtggaaacctgtgtgccattcacaattccaggaggaaaagatgttgtttcatgatgaactcctatttgtcaatacgtcaagtgcagttaattatatcgaaaatacatttttgtgtttttcttcacttttgagaaatagaaaaagagtgagaagagcagtaagcagcaagcaggctgatggggtgcagctgagcccaccacagtggggctgccccagggccactgaagtccttgtcacagagacaaacccacagcgggtctatcctggggccatcgaggtcttcgtcacagagccaagcccaccacggtggggctgtctgggccatcgaggtccttgtcacagatccaaacccacagtgggccagtcctggggccatcgaggtcctcgtcagctgagcccacccatgacgggcctgtcctggggccttcgaggtccttgtcacacagccaagcccacagcgggcctgtcctggggccatcgaagtcctcatcagctgagcccacccatgacaggcctgtcctggggcatttgaggtcctcaccacagagccaaaccagagaaggggctgctcctgacctctgacctcccaccaaccaaaggcttatctggggtcctcagatgggctgaatgcagagctgcctgggctgggctgatgcaaatattttaatgcaatttcatgcagatttccctttcagacgcaaattaggaatatttaccagtaaacaggcttttcttaggactgaggcacttttgcatttaggagaaaaccatctgtcaactaatgcatattagaataaaatagagtgacagtgcaggaaatgacaaaagatgcccactccccccagtacccacttcccccagtacccactcccccagtacccacttcctccagtacccgctccccccattacctgctgctgccagtacccactcgtcagtacccactccccccagtacccgcttcccccagtacccgctcccccagtacctgctcccagtacatggtcccccagtgcccactccattacccactctcccagtacatgcttcccccagtacccaacccccatacccactccccagtacccactcccccagtacccacttcccccagtacccgctcccccagtaactgctccattacctactccccccagtacccactccccaccatacccactcccccagtgcctgctcccccagtacctgctcccccagtactcgcttccccaagtacccactcccccagtacccgcttcacccagtacccgcttccccaatacctgctccacccagtatttgctccccccagtacctgctctccaccatacccactccccccagtactgccagagcccaccacatgcactgagtgggcaagagcccacacaggcaccaccgccccctgcctcccacccttggcagagcttcccatgtgctcttgggcttctggggtgagatgccacaggctccctgaaacgcacgctgtcttggggggtgtgagtgaatgtttctggagagacagaccctggtttttcttgggctcacggacggtctgagattgctggagtgttacaccccagtcactgcagcctggttctttaggctgagccggcactagggacaagccgtagcatgagatgtagggttcagtggtccccccaggcttctatccttggtgtgacccagcattaccatcaaacgcactgttaccttcgcaagctcagctcagtcaccttacccaaggaaccccgtgaactctgacacctcaggctttttagatccactgtccagagcctcaggagctgtgatctcttccttcagatactgctgaacccaccgctttcgctccattctgacaaacctacctctgaccacgtgagcttctcttcctcctgggagctgctcctccaagctcctgctccaggggccccgtcaggaacgtgtggccgtgctctctgccccaccagcccatcctgcgcccccccaccccccaacatccaatgccccttctcttgaatccccaaacacaggccctcatctaaaggccagcagtgattttaaacctttgtcatgtactggcctacgcgcagcaccatgccacgcagaatcttcacggatgtctgatgactttcgttactgtgagcgtttcccacagcaaccacggtcaatgggtgacgggggccgccatgtcccagatggtggctgctcccctcaggtccccacatttgctaatgtgtgtgtaaacgcctttcctttggttacatattttctctttatttaggttgtaaaaaatggtactaaaggtaaaatgagatagaactagacacacacattgttccaatatcaatctcctggttttgccataattggcttttataattacccagacgtaaccaccaggggaaaacctcactgggtaagggatacatgagacttctttgttataactttgcaattccctgtgaatctataatggtttcaaaataagaagtcagaaataatataaaaacttttggacaaaggaaaaaactcacttgcaattccactgagaaaaataaagtccaaagccccaactgacggaatgacctactcttgaccaagaggaccccagagaaaccttaaaactgagttgggaccgtgacaggatgaaggtcagacccgcctggttacccgcccccatcattaatcatcaccaggcttccttccctgggttcagacccgcctggttaccgcccccctctcaactaatcaccaccaggcttccttctctgagggctgaacagaaaccagcccttttaaaagactccattcctgatatccaccaagtgcctgaaactgctcttccttttatggtttcgacccaacaaccaatcagcattccctcctcataagagaccccattcacggagtgcctctggctagtctgtggaggctgcacagggagggccttcatgtcctcagcttcaccttttgatgcagaatgcctaactgtaatctgtttacatgttaagtctccatgccccagtgaacatgggatgcattttgcaaacattagctgaccatgcatgcccgtgtctccccttcacaaatattcacggctcctcccataacctgctgaatatgtatacttagccacccactcagcataaattcctgttccctttgcctctcactagaagtgcctgtttctggcttctggccggaggctacgcttcccagctggtcaggttggctgtcctgcaggatgcagctctttataaggaataaagctctcctttcccaattacgagcctcgtcattcttctgctgccaccatcaaccccataagagctgctctcttattcacctgttacgtacatgggcttctaacatctctgtgcacacacatgtttacacagctgcctttaagtttagagttctcaaaattttaaatgaaatcacagaatttgatttatttgattgttaatgatgagttaccttgctatagttttatattttaagtcagttttttttttttggtgaaggttttgtttttctgatttccttgctcgatggagtgtcttcttaggatacatttctcggagtttgattactgagccaaaggggaagagtttttgtttgttggtttgcagatgaccactgctgtcctgccttctaaagagttagactcattcaccctgcctaccatggagtgtacgtatatgagttttatcacatttggtctttatttataaaaccaaaactgttgttctcaagcaaccttcagtactaatcttaaaaataagacttcaggctgggcacggtggctcaggcttgtaatcccagcactttgggaggccaaggcaggcggatcatgaggtcaggacatcaaaaccatcctggctaacacggtgaaaccccgtctctactaaaaatacagaaaaattagctgaacatggtggcagaggcctgtagtcccagctactcgggaggctgaggcaggagaatggcgtgaacctgggaggcagagcttgcagtgagctgagattgcgccactgcactccagcctgggcgacagagcgagactgtgtctcaaacaacaacaacaaaataataggactttagacttaggatgtgattggaacatctacggatttctcaccccactgtagctctgacatttcacctgcccccagcaccacagggcctccggtctcacacaaatcattttggctggagagccctttgcaagtggtctgcttgccagctctccacctcacctgttggcatttcccaaatagcatttcttccagccaagagcctcatccatccacctggatccacctgaaacatttaatgtgcctgacaaaggcacggtcctgctgctgggcaccgcagagcaacaacagctgtcaccctgacaagcaggggcagctcctccccacctccccacctccccacctccttactccggctctcttcacctgtgggcaaaggcccccctctgtcccgtcctctcctgggtcacacctgggtgtgcagaaccaggcatctggtgaggcgggcaggaaatctgcatcttgacaagaccccagggagaaggtgcatggccatgtcgagccatcacagctgatatgttcctgctattgatttggccaaagtctgcattcaatgtccaggctcctcttggtaatccccaagcaaccgggtaggagctgtgtacagtagcaaacctctttgcacagacaggaaatgacagggtggaagtcagggggaaatgaagctggtttcgaacacatccgtcacccatctcagttctgcccactgcttgctccctgtgacaagtgctgagcatccccacaccccccgccccccaccccaggtaacaaacatcacacagcaaattcacattattcatggggcggattcccacagccccccaccccccatcccaggtaacacacacatcacacggcaaattcacattattcatggggtggattctcacacccccaccccccatcccaggtaacacatatcatggcaaattcacatttttcatggggtggatgcatgaccataggttcatagacttttaagggacttttgggatccacatattcttggctacagaatcctttcttggaacaaagtctcacccagaagcccagtgagcagcaggcaacagaagcctggaccttgctgagccggagtgtgagggtagcgtgagctgagcagggattcacacccaactgccttggagcccccagggctccttgaataaccatctgaagacctctgacctcatcccacactggacagagagaaggctccctcagcagagatggggggctctttgccacccagacagcccccagtctgagcagctcttcccctcagcttcttctcagattcctcttgttcacgctcctgagcctgcaggggctctgctgagactcagggtcggccacttctcactgacatgctgggcagggcacctctgtgtctatcacgacgcttagaagctagaacgctgggcaggggacctctgtgtctatcacgacgcttagaagctagaacgctgggcaggggacctctgtgtctatcacgatgcttagaagctagaacgctgggcaggggacctctctgctctatcatgatgctaagaagctagaacgcacccctaactctggacacaactgagaaggttggagccatggatctgcctttatccaaattatttttcttccaaacttttgagttttgctttttggtgattatcactttcctttggaaaaaaacatggctttattaatttgaataaaatgcaaatacttttcaagatatcagaaattagattttgaaatacatcaaaatgccacccatctatgaggggtgtgtatctgcactgtaatctgttcatttcctttaaattttgttttgagatatttccatttggcttaaaaggttttaattccactatctgtcatcacttgcattaaacgcaagcgcaggggagagatttagtaaatgctattagatttctgtaatcaaactctgctttatattccagagtcagggattagaagaattttaaatacattaaaaatcagaatcgtcaaattcaggcttaatactgaataaggcaattaaaattagaaaaaaaaatcattagctgttaaataatttatcaacttgtacccctttctcccattttcaccactgcaaatctactccaaatatataaacctcccgaaactacagcagtgaataaaacagacaaacccttccatcacagagctcccattccaggtgaagctggagatgcatccaggaataaggcccattgtttcctctgaaggcagaacccagccgtcacctgcattgctttctgcactcacttggggcaacaggagacacagatgctgggcttgagggccctctgggcacgatgtccgtggggtcaagagctcgagaagaaccatcttttgaaatgtaaaatggccacgtggagaaggataatgctccaggagctggtctccagcatttggtggaacgagaacaaagaaatgtctggagaaggccaggaagacaggcaggtcagggtgaatgagctccttgtggccagatcgtaaccagtgggtgaaataaacactctagcgtttggtaattttctgtcccagggatgacggagcctctgcccctgggaatggcaaggtccatcctctgctcgctcaggggccagagaggacacaggttggatgtggatggaagcagaggtgtggtgctgtgcaggtgagctcctgcctctgccctcagcccccacggtcccccgcagtctagggagaaccttccttcccacatatgagatgggtgggcatcaggagtgggcagaggccaattctttccagagttaaatagtccacttcacagataatctgagcagcaattcagatttccatgcattgaatcaatctacttcctagacagagcttcacaaggagcagtgatgccatttccattaagagataagaaaacctgacgggagaaacaggctgcggcaggaagatcaagagccctgcgtggcccactttaagtgtgaggctcctctacagatctcccaggagagaaaaggaggacacctgtggccatacacacctgttgctcggtgaatgggtcagggctggagacgtaggcttgggatcatcatcgaacagataacataaaaagccagggcccaggtgagttccccacaggagacagcaccggcagaaaggaggagggagccaggccctggagagtccaatctgtagaactcacggaggaggagctggtcgacttgaagggaacagagatggccgtcgcgcccagtgagagcagaaagcaatgcaggggacggctgggttctgccttcagaggaaacaatgggccttattcctcgatacacctccagcttcacctggaatgggagctcgtgatggaagggtttgtctgttttagtcactgctgtagtttcagttcttaaaacctgcctgacgcatataaatacctaggaatgaatgaacgaacagctcactaaactgaggctgagcagggaccctcgcacacgcacatcgaaatcccgcatgacgcatggcatcaactctgaggggcacaaagccgagagcacaggaagaaagtggatctccagactccaaaactgagaggagcaatcaaaaccgggcgtgactgggagctgctgctgaagtggctcctggacgtttggcatctttctgtggatccaagtgtgtggaagctgagagctggggtgtgagttcctgtggaagctgagagctggggtgtgagttcctgtggaagctgagagctggggtgtgagttcctgtggaagctgagagctggggtgtgagttcctgtggacgctgagagctggggtgtgagttcctgtggacgctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctgtggaagctgagagctggggtgtgagttcctatagtcacacgaggacagcccatgtggccttggggtggatggagatggggactccacatgaagcccaggaccttgaggacctgcctccctcaagattgaagcccaggaacagaccacctaccagctggggaagtggggagggggctgaaccccagatctgtgcatgtgccagagcacggtccacactttattgaatgaagcagaaactcccaggtgggcaattgacaggaaagtggatcggctgggacactgagggcagaacttcttatccagaaactctcacatagaaattcacacttcagtatcaccaatccctgctgagggtaagctcacaattctaaaaaaagacttcatcaaccacaaaagaggacccctcccccacaggagggggtcagcagatgtgatgagcaggagctgtagaaagcgaagactaggaaacggccagagggtctgaacgagaccataaaataagccagagggtctgaacaagaccataaaataagccagaggatctggacgagaccataaaataagccagaggatctggacgaaaccataaaataagccagagggtctggacgagaccataaaataagccagaggatctggacgagaccataaaataagccagaggatctggacgagaccataaaataagccagagggtctgaacgagtcaataaaataagccagagggtctgaacgagaccataaaataagccagaggatctggacgagaccataaaataagccagaggatctggacgagaccataaaataagtaggtttaaaatgattgaaaagataaaagaagatatcaaacacataatcaaagtagaaggcaaaataacagatttgataaattactaaataaaaatttttttctaagtgaaaaatacagtaaccaagagaaaagtacccagcatttgagttttacagcagattagacagaggaggaaggaacgtgggagacaatttcaggaaataatctgtcgtgtagcatcgagggagggagaggtgaaggcgcgacagagggtgctgagacagggtggatggaacaagaaggtccaaccctgcctaatcaaatgctgtggaggcgtcaggaccgtgatgggaatgagagtgaatgtttacgcgtgcccactcatccgcactctgccaccccagaaacctgcacacgacccagtggtgcgggtcctgggatgacccccatttgacaacacaggaagcagagtcacagggtgagcacagagactgcaggaggcccgcgtgaaagagatggcgaggggtagctctgcagagtcaagaaggggcctgagtgaaagggagcaccaagtatagcacaaaacccagaccccccgatccaagcagggagtgcctggacatcacaggtgcccaggggaggacgggaggagctgggaagatgaaacccagatcccccaatccaagcagggagtgcctggacatcacaggtgcccagcggaggacaggaggagctgggaagatgaaacccagatcccccaatccaagcagggagtgcctggacatcacaggtgcccagcagaggacaggaggagctgggaagatgaaacccagatcccctgatccaagcagggagtgcctggacattacaagtgcccagcagaggacaggaggagctgggaggctgaagccacagcgaccaggccctgtggctcctccagcgtgggaagagcagctctgtcctgaaagggtggccatggaggtgctgtcctccaggctcaggtgcgtgtgggaaggagctccgttgtgagtggggagccagggaggtgctgtcctccaggctcaggtgcgcgtgggaaggagctccgttgtgagtgggcagccggggaggtgctgtcccccatgctcacgtgtgcgtgggaaggagctccgttgtgagtgggcagccggggaggtgctgtcccccaggctcacgtgtgcgtgggaaggagctccgttgtgagtgggcagccggggaggtgctgtcccccaggctcacgtgtgcgtagacaacagcatctgaccttccatgcttaagaggcaacctgtggcaaggcacatggcagaagccacttgggctggagctgcccagtcagtggctccacctgtcaccatgtcctgcctcttttctggagtggccggagtccaggtttcaatgaggaaggtgtgtctggacaccaggcaccacacttgtcacctcccagatgaaccccagagtctcccattccccgtcccccacccttgcccctccagccctctcagggcagagcctccctcatgtccacaggacccacctccccacccaccacagccgcttctcacggggcctaaatattccacagtacagcagagggtcccagcctcgacgcgttctctgaccaggttacagagatggctctaacctgagtccatctagatttgtcccaaattcctggacaccattatccctctaggaatgacttagcaccaaccaccaccccacgtgatgagctcggaagggagaggaaagacaggaggacaccacagctccttgtacacgcaggagacgcacctccgacatcacatcttccacatgcaggagactcacggcccggtcacagccacccccggctgactccaccttgcaactacttggcccctccgcatcggtcactgcaccttccgtgggatgcaggtggctctcggcagcccccaagactcttggcttctttctcacccttcactgggtgctaaagagacagcaagctcccgggaaagaccagggcatcaccagctgcccaacacctcattcatccggcacgagccaggaaggcatcgagaaacaccaagaacaggagcacctgtccgggacgtgcacgccagtttccatcagtcgccggctgctctcctctcccacaccctgcccgtcatttaacccagacgcagccattttcaaagcccttcaggctattcttaagcaggctctgcatgggaagcgcaagaacctctgtttgggaagagcggccaattaagcagcttcttatttcaagagcccgagtctggggcctggtgaggacgagatttccccacagaagcagcttgtctttaagtggctccgcagagggcggctctgctgtgcagcgagcacactcataaataagcgctccttcacagttaattatctctaatggcgagcgctgtgaaacccgaaatctcgaacgcgggagcgcagattggcttcggtccacactgactgacgagtggccacacgccattcctcagaggaggcgcgtccgcgctctgtgtgcagttcattaagttgtcatgtcaggggacagcggccatcggcgcggtgcggggaggcgcctgcggctccagctgctggaggaggctggccgagcgcctctctgataccagcatggtaaggtttggacacacaggggcttgacagattttcagcgatattatggaagcattgcctctctgataccagcatggtaaggtttgcacacacaggggcttgatagattttcagtgatattatggaagcatttcctgttttatattgcctctcccaaatgtgcgtccttcgatattgaagatacaagtatgtcccactgagtcccaggaggaaagagtaatccctctagcccatattcattttcacacacttggcaactacaaaacagctgaagaaggaaggaagcacctattttctgaaggcttctccgttcttcttagccatgaatgctttttcttgtggggatactaaatcaggacttcaaaggccctaagacatcattgaactcgccaggcacgtttcgccaccgtttcccacccgcagaggatgctcctgctgcagcccactggtcctcccaggaaaacaggaccttggctgaattaacctgcaggtccagcctctgttctcacggtgttcgccagcacccagacagcactgcagatcgcagagcagacggcaccccttctgttactcaccgacccgactccggtttgaagaattttcagtccagaggtttcctccagtttgtctttgttgtcaactgttaggaaaaatcagaaagcacaagagtcaggttggagaggtcctcagtctccgggcacctctgagtattttcctccattgaaaatttcaattacatgactgcttgacccgcctaccttaatggaagggtcatgaacaggcacagaattagaacctgcacgaggccccattttcccactgacccagtgtgcgtccacctcgggccggcacaactgtgcgcttttggtttcatctagaaaggggtgtcccacccgggtccccaggactgctatgaatcactgatgagaaatatgtagagacattctgcaaactgcaacgtcttattttaaaattacgtaatcgtttctagctgtataattactgggaaatatgtttcattaaccagcattaggtgttgataaaagactccgtagaaggcaaagctgaatgtgtgtatttctgccatcagcaccgccagctattttgcagcctcttgttcatgccctgacaggaacatcctataataatttcgctccaataaaagcctcaccctggttttctcctgatgtagaatgaggaagactttcagagaatgaattgcactcgatggcaaaccaagggaaatgagctctggaaacaattagcagatggaaatgaaaccccagtaatcctagcaccaacacagcaaacccacctgccccacttcacagagaggacgggtgtcacaaggcaattgaccttggcttacgactctgtggaaatatgcgtttgcataaagcccttgtcactttggagatgaaaaccagaaaaaaatggaatttcactgcaaaccctatgaatgaagagtgccttgcaattgtgattaatacaggatgagatagcaggaaaatatcaattactctcaccccttattgtaacgcccctgtgttaatctggggtaatgaaattattcctttcggagagggacgcgatgagatcttgttacagcctgccctccctgctgttggggcctctccattgtcttatggaaagtttttccctttgagcaaatgcatactattttctacatataactaattacctactgcgctgaaagaacaagacagacagaaaacagtctgggctaaagcaaaactcctttaatactttatgatggggtagagccccaggggaggggaggacacaaatgtaagccttgggtggcaagagagctataaggccatcggtgctgctgtcctcccgcaaacagaggagacatctgacagattggcaagcttctctcaggagggtaatagtggactcttttaagcaggctgaggaacagaaagtgagtacaaatgcaaccttagaaccaccctggtcactgctgcagaacggtcaccgacgtcagggtcaggaatgaaaacggcagccccagcccatagtaatgagaaaaatccaatctgccggggagcgcccttttcctgtgaagggcaggtaacaactgggtcaggctcggcaggcccacggctctgtcgcagctactcagccctgccttgcagcgtggaggtagctgcagaccacgcctaagtggatggtcatggctgtgttccaacaaacctttatttacaacagcagacagtgggcctgacttgacctgcagactgtggttgccaagaggttgtctggctctagtccattctccacactgtgcccagggtgtcacgagcagtgagtctaagggtgtctgtccatccttgacctcaacatccagacctctggctccaaatccagacacttcggtggcccttcaaagcctttcaatggtgtcccctgcaggcatggagaacttgccttgctggccctgaggtccaggtggcactccttgcccagatattgggcttttcagcacatttcaggcattctccgtcccctgccaggatgctctgagctcctcagtctgacgaaaacgcagtcctcctcccaggaagctcaggccctacatgtgctcaggggcaccccctccctcaacatcctcagcacggccctctgtgtctcacagttcatggtgtgcaggctgcctgtcccctgcataacagaattgtaaattatggcactgggtaatttctgctctgtgtaaatgctcccatcacagttgactttagtgctcatgtgacactactaaagggaatggggagagatactgtcttagtccatttgtgttgctgtaaaggaacacccaaagctgggcaatttacaaggaaaagaggtttatttggctcacagtcctgcaggctgcacaagaagcatggcacaggtgtctgcatctgaggatgccccaggctgcttccacttgcagtggaaggtgaagggagccatgcagtgtgcagagctcacatggggagagaggaagcaggagagggcggagggagggccaggctcttgttaacaatcagctctcacaggagttaagagagcgagaagtcgctcacctccaccctgggagggcatgaatccattcacgagggatctgccccgccccatctgtccctcccccacatccaaagccctcccaccaggctgcacctccaacatggggaccaaatttcaacatgaggcatggcggggccgaaccaaccagatgcagagtcacacatggggaccgaatttcaacatgaggcatggcggggccgaaccaaccagatacagagttgcaggcgtgcggggaagagttcccaccatgcagacgtggaggacagaaataatctcaagggtgccgatgacagtaaaatgtagaaaaccagttataaaatggtgagctttagtatggatcgcctctgctcttaacatagtttatttaagtgcatgtttttatcattcaatgtttcacaatggctgtactgaataatgggctcacaaaattcctgagaaagtaaaattagttctactgagtggatgcaaactgtcccctgtgctggcacagtgctttgtttacacccgaagtggggccttcccgtccgtgtttcctgggtcctgaggtggggccttcccgtccgtgtttcctgggtcctgaggcggggccttcccgtccgtgtttcctgggtcctgaggcggggcctccccgtccgtgtttccttggttctgaagtgggaccttcccgtccgtgtttcctgggtcctgaggcggggccttcccgtccgtgtttcctgggtcctgaggcggggccttcccgtccgtgtttcctgggtcctgaggcggggccttcccgtccgtgtttccttggttctgaagtgggaccttcctgtccgtgtttccttggttctggagtgcacacttcccccagctgaagtggggtcgcagcacgggccagcacggtagtgactaggcaactcccgccaccctgaattggcagtgcagcaaggtgcatccttggaggccttggggagggaatgagtccttgtttgtacttaagcactttccactgggcctcctgtgaggccaggaacgcgctgcagcagaacttccggaaagggcgtcagctgcggccaatagtgactcagaggatgatcttgttggctgcagtggaacactcatgagaagtgtggtgccgccaaccctgcagtggcctggagagcacgtggggaccagccccgcggtggcctggagagtacgtggaaatcaacctcaccgtggcctcaagagcacgtggggaccagccccgcggtggcctggagagcacgtggggaccagccccgcggtggcctggagagtacgtggaaatcaacctcaccgtggcctcaagagcacgtggggaccagccccgtggtggcctggagagcacgtggggaccagccccgcggtggtctggagagtacgtggaaatcaacctcaccgtggcctcaagagcacgtggggaccagcattgtgctgtggaggcactcagtggaggggttccgagtgtgacgcgcgtcaggattctttaacccattgatcactaaaactccttttagatgccgatgcgagagtgaggctgataaacgagtctgagagagtttgttcaataaatacaagatcatctgaggtgattccaaagcacgtgctgtggttcaacggcaccgtctctgctcttcagtggacctgagctgagaaatggcttccaagtcagtgaaacaggcatcgtggtgagctcctagcagagctgcctcccaagctgattgtgagcctctccaggacaggcaaggttcttcagggtctatgactgcactttgatgcttaggggcctgtgttctttcttcaacaaatacatccacgttgctgcaaaggacacaatttggggccaccatcctaagcaaattaacgcaaaagcagaaagccacacgctgccacacactctcacacggaagcaggaaccagacatcatcagagagccacacgctgccacacactctcgcacggaagtgggaactacactcatcagagaaccacatgcgctcacatggaagtggggaccagacatcgggtacttacagccatagagatgggaacaacagacacgtaagagggaatgtgagagggaatgtgagagggaggtgggagaaaagggctgaaactccctctgggggacgtgctcactacctgcaagacgggagcaagcaagacggtaccccaaacctcagcatcaccagtatgcccaggtcacaagtgtaccccaaacctcagcaccaccagtatacccaggtcacaagcctgcacatgtactcccagattctaaaataaaagctgaaaattaaaaatacggataagtgaacagatgtgccaccgacaaccctcccacatgccccacggtgctgcctctcgaaactgactggaccttttaaaatgtagttcagtcggtttaaatcagcgattgaagcaaacaacctgaattagtgtttggttttttctttttccttttttttttttatactaaaaggttttaagagagtacaagggacagtttcattctcgagctaatctgagactgcagtgtaagtcaaaatcgaagtcacagagtaaaataattgaaaagtaatgaagctggcagtggctacattcctgccacacaccaagtgccggcgcaagcgcttcccacacttcaatccgtctccccatccaggctgtggatttccatgcacgcttcacaagcagctgtgaggaccacgtgggagcctctgagccagcatggcccaggtctcagcacacagcaagcgactaatccatgtgccctcgtgacagcggctgttttgctgcatgtctcatggccgggccactgtcacttcctaaggagaaagtgctgtatctgctgcgtgtctgagactccagtgtgctctggtctcttatgctattaactcgccgatcagtgcttctgcttgtgttttgaacatcaaacatcagctgaagcatcgctcaacgactttgctctgggtgactcagctatcaaggtcttcctcccacagtggaattgctgtgtgccccactaacagcacccacagcaataggataaaggtcaccaggattctcctgatttcttgtttcccaagatagggtctcttccttcccccacaggccggttccttcacaggaggagtcaggggctccgcaggccgcttctcagagcccatatgctcccggtgtcactgctcccctcccgtggccctgcacagggtctgctgagtgatgccctccagcactgtgctgggcactgacatccaacctgccagctcacgtcaagaaactccaccatcctctggaaagcccgacagtgccctgagcaggtgccggggagtctcacaaagcacagaatccgggtcccggagtccccagagtccagcttcttgccagggaaatctctttggagattgctgagtgcttttcgggggcgtctacgcgttcccttggcgctgtggaacgagccagtgtctgtggggcgtcagctgacttcacgcggccctgtgttccggccgctttcagcgatgcctgtccttgctagttcactttctggctttgagatttctcactggcagagagaatcgaaacacagagaggcccgcacctccctcctcctgcatcgcgaacgctgcacaagggcagcctccagggcacaagggcagcctccgcagcacagccctgcggtttgttgcttcagatttttttttaacctcaaatatgcctaaaaggaaaaacaatgcctcgtggtccccggcatcctgtgggtctcagggcacccccgacacctcccgacattattcctgcacccttgatgctccgccggatttctctaaatggccgcgtggattcccttttccacactgttggtggaattgtgacaggtgctgagctctgatcctgacacgtctgcactggggagcccgccgtcctctcgcgggacttttgcccacacctgtgtaactgaggactcacacctactccttttaagtctaaagtaaatacctgctgattctcagtgtccttttgttcctttttatgaactccatgacaatactgccaatttttaagtctctgctgaacatgttgaaggaggaaaagaagaaaaagcctgcttcagccagatgtccatcaaatgccaggtctgagttatgttttgagccaagctctgggcctcccaagtctgtcaggccagggcgtggagacagttggagaagctgccttaataaaggcacagaataacagagaaagcccgtttttatcttcatgggagacaaaaagggtttccaaacacaaaaaagaagtcctttaaaattaaattcactagatgaaggatatgcaaattacctgaagaagcggaaccctataatgttctcaaaattctgcaatagcctatttaattagtattttaatttatcagactaattctttgcacttgacaatttatgcagcattccatataattaagcaggcagctacagtggaataattttgcctactctctttatcctcgttattttaacctgaaagaatgtgcagaagtctcttctgtaatctaaattacaatggggatcacttaatggctttgctccattagaaggtgggaggggagggagagcacccaggcccggggtgaagctgtcacctggagcctggccagctttctggacggcaccactggcttccttaggaaggatcctcctcccttatggggtggagcctggtttctggccgagctgaaacgacgtcccctagggtaagacctgcatcctgtgcctcacagccaccgtaaacaagctgcctcaacgctgccactttccacccagggcccccgtgcagggggtcagcatctccgggtaatttggggacctctgtggactctgcccctgccctgaggtcagccttcctgaaactggaagccactggtcaggattccccgtgcatgtcagcaaggtgcccagccgagggctttccttaaagcggaagtcattcctgggaagaggaaggggaaagagctttgaaggaagttgattcagtgattggagctctggtcccaaccggcacctcctttcctttttgggcatcccagggtggccacagagccactgggagtgcagaggcctcctgggcccaggcgagctgccgtgtcgccgactaacatgaggcccacctggtcgcagggctgatcacaattcctgtaaaggaatcttttaaaaattagcaatgtccatactttcctatttcagcccattctctttccccatgtcgttttctgaaaagaactctagcagggccatacgtgaggcccatgaggggccccaccttccctcggagtggacaatcccggactgggctctcccagtggtaataggtattctatgaaaaaatggggtctttattcatacaaggttaagaaatagcctgccagtcactcaggccaaacctaaaactcctaaaaaaaaaaaggtttaaacattgcaaaccttcttaaagcttctcactcactactgtgcactgtgagcctttcactcaccctctgggcgctggggcacacgctgttctcccaggaccacgggcggtgtggaggatgggctaggggctgagggagaccttagggaggggcagggtaggaaggacccacgtgtcctgagcccctctagactgggggctcgccagggtctgaagcttcctggagaaggccctgctctaagcttctttggttctgggacctctaacatgtcttaacatcaaacacgtgcagtgacacttcagtcttcatttcagaaccaaagactctcactcagcaaatcctgagatcccgagatcctgacaccctgacacctgttggaaaggtttggaagcagccatggaagctgtcaccagtgttttatgctcagatctgtgctgatgtcacactttggacagccaagggggcgggaagatgaagcataaaaccaccttcaaggtgggtgtggtggcatctggggtaccccgtgaccgagcagtgtggcccgagggtgagaacgtgggctcggagaggaccaggccacagctctgtgcggccactggccagctgggcaccacgggaacatttacccctgtgtgtggtgtgtcctgcgtggcagtatctccttgtcccgtgtgtggggtgtcccgggcggtggtgtctccctgtcccctgcgtgtggggtgtcccgggtggcagtatctccctgtcccctgcatgtggggtgtcccgggtggcagtatctccttgtcctctgcgtgtggggtgtcccgggtggcagtatctccctgtcccctgcgtgtggggtgtcctgggtggcagtatctccctgtcccttgcgtgtggggtgtcctgggtggcagtatctccctgtctcctgtgtgtgaggtgtcccgggtggcagtatctccctgtcccctgcatgtggggtgtcctgggggtggcagtatctccctgtcccctgcgtgtggggtgtcctgggggtggcagtatctccctgtcccttgcgtgtggggtgtcctgggtggcagtatctccctgtccgctgcgtgtggggtgtcccgggctgggcctcaggcttctcttttccaccctcttctgcccccatgtgctgtgttcagtcctcaggccctgactggcatctgttcactgatcagagccattttctttcctccagccccatcctttctgtggatctgatatcccacctgtcttcttgccacttccactaggacgtccaatggtgtctccacccaaattcctgacctcaccgacttccccaagcctgtctgtcccccgtgaccccagcctgccaggagctcaggcccacagccgcagagccgcctttattctcctcggacacagcacagcgcgcctggtgaggctgcaggttctggcctcagggtgcacatgggaccggccggcgtctccgcgtggccaggtgcgtccagcatctcattctctgctctggatcttgcagagaccccaactgcgctgcctggctcttccatccatggtgccgggcccggcctgggaggggctgcacaggccgagccgcagcatgatgtcccctgcgcccagcacttctgccatgcgagccttgaaagggcctccacccctgcagcctgcattctgtggaagccacgtgttgcgtgaggcctttcatgcctgggagagggaggtttgaagagcagaagcacttaggcaggagaaaagacaaattaatgaacgtgtcaaatcctgctgttcaggttacagaaaagccaatgatttctgcataaagaagtatccgttcctggcagtgccaggtgcccactcttgcgtttctttgcacgtcggctcacagctctagaagtactcacggacaaatgtggaggcgccccgcagcaccccacaatccctttcacttttccacgtctgtcgagacaggacatgcatgactcacgcaaccagctcatgacatcagcaactgcagggatctcagagccagaattgcaaatgtcttattcttacaaaaatatggactacaatttgattaaattgtcacaaaatacaatttaaaatacagctctatttaaatacttttgattgaaaattttgatattttgtgaattatatttggctttagaattttaataattcacattaaatctttttgaagaaaaatagcttttgaagcatagttttagtttacaattttaagtgcatttttatttttaatgaaaatacttctacatcttgtaccctgtgtgcaattacagttgaatcatttctgtctaaaacaccccaactttatgaagatcgtcattaaacaatctaattagtgacttcatgaaacaaggggaataaaatgcatttacaaataaatatacaataatttacaaaattatgtatgtcattaatttattactcagccaaaccttaccagcccatcgagagaacatcactactcacaggattataatccaatccactgtctttttcattggattaattttcagaaataaaaacaatagctttatgcacatttgaataatttttttcactatgaacatatatttttcaaagtatgaagcatttttttagcggctaatgagcttcacatagacttttaaatgtccagaagcccagcatggaatgccacttgccctctggccttgggcccctcgacagctggacaggggctgactctatacactgggggggggaggatgctggccactcaacacacactcaagcctctcctcaaagccctgcgctggcgcatctcacccacagtgaggtctacagtccaggccacagacacaaggcccttcagaacctggcccttggctgctgccctgacatcacctccaacagccccctcgcccctgctcagccccttcagcgcgggacgccccggccagctcctgcctcagggcctttgtacctgctgtttgttcctgaccctcaaatgcctgcctgcagccatctgcatggtcctcctgttctcacccaacatcgggccctcatcccatcacctgtctgtgccctcatccagcttcattctttcccaaaacatttatcaccctctgacatgatgcatgcttggttattatctattttttctctagaatatcagttccacaaagcgaggatttgccctagtgcttagaacactgtccagcacattagaggacctcaacgattatctgttgagggaatgaataagtgacttataggaagcatgagcaaattaactccctagtggcagcgttaaagcattactatctctaggatgatcatgccaccactgttacctctattactaagaccagtggtggcactcactagtggtgcagggagggagtttcctataccttccacacccacagttctagttttgaactaaagagccaacgataaaaggatatctgaggattcctgatttgcagtctcatgattctcttccaataccggctgccagccatgagcacgggtgcaggatcacgcatgtacgccgtgggaatgcgtgcaggatcacgcacgtacaccgtgggaacgggcgcaggatcacgcacgtacaccgtgggaacgggtgcaggaccacgcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcatgtacgccgtgggaacgggtccaggatcacgcacgtacgccgtaggaacgggcgcagaatcacacacgtacaccgttctgcacagctggcggacgcttcctctttcccacatggtgtggtgtaacctgatcgtttgtatgcaaagcaaacccatgcacagctgactgtgtcaaaacacagccagaaagatgccatgcggcagggcacgtgtgtgtgtgtgtgtgtgcgagcgcgcgtgcgcccctgcgatcagcccagcagacagagcacgttcctgtaacgtgttgtgatccactgcgcggcaacaacacaaaacacaagaaaatgttttgatgttaatcattttacatcaagtcatctgaaagtagcatgttgccccaatgtttggatgtttaattttgctaactgtcagaaggaattaaaataaccctggaacataactgctttcctgacaattatttactaaaaccagagatgccatttaaagcttaattcccagagagggagaagagaaggggggtgcccttgcctgtgcctgtgctggaagtgggctgttcatcatctctcttttcttctttggcggtgaggccaaaggcactgtggcacagcaagccaagaagaggctatccatgaagatcggtctccgtgctatcgtgaacgggggctgatgcctgaccacccgaaggaagagaggaggcaagatgctgtgcccacaagacccaccccatggagaaacgtctgcatggtgactgggcttgcaatgcggtgatctccaggatgaaaagatgcccccttagagatttaccacgatgcaaagacgctcatttctacctgaacagccagggtcccatcctgcttagtatagaaatagcaaagacgtttagggagataaactagatgtgcacctactgacatgtgtataacgttcagtgttttattaaacatgtatatatcacgggctcctggaaatgattcctctcaccaactcagatgactttctcttgaaagttagaagttttggggttaatttgtaattcaaaaatattaatattttatatttatattccattaaatattaggaagataccaaagaatattataaaatatgtgttggttccaaagaataataagacagcaaacatccaggatacctgacactctgaaaagagataaaacattaaaattatctttgatactctctgtgagctcttctcggtcctatcaaagctaataactttcatgaattctgggtgcatagtttctgtatgtagactttttttttcacctatgtgtgtatccctaaacaaaatactgcataagatgacataataacatacacgttctgtgatgtgccttccgtcttctgctaaccctgtgttctgagactcagattcggttttgcatgtcatggtggctcatgcattttcattgctgtgtgactgcattctatacacatggagcatcacgctttatttttccaatcacttacccagtccggtgggaaactgggttcttatttttccctccatatctgaaacagtatagccatgaaccttctcacacgtgtctccaggcccatgtagagaattttctccagtacaatcactaagacatagatgtcccaaagggattctatcaatttacactcctgtcaccaacacacagagttcctagtgctccgtgtgctcattggtttaagctttaaacactttgccgatttggtagatttacgttgtatctccttgggcttccaatgtgcatgtctttgataattcatcagtttgtgcatcttcgtgtatgtttattcatcattcatgcttcctcttacatgaaatttttgttttgcccatttttctactgggttatttgtctttttcttactgctttgtagaagttcttcaaacattctggataccaaaactttgtcagttatgtgggctgcaactatcatatctcagtttgtggcttggcttcttaaagttcctggttttaatacagtctaatttatcattttctttaaggtttgcatttctggcatcttgtttaaaaaattctcctttagctcaagatctaaagatatctatataaagatatctatataaagatacaactctgtttttttcctaaaagatttttgtccttcacatgtaagtctgatattgaagaactgatttttgtatgtgattcaaggtagaggtcatttcatttttttctcattgaataccccatttccccatcaaagtttcttgtaaaggccatccttcccactgatctgtaatgtcaaccctgttatcaatcagttctatttaagggtctactcctgggttccctctgttcctggcccaggtgtctctccgtgcacagatccatgtgatctttcttactttagtgtaagtagtttatgctgtctacacacgaaggcaggtgttggctctttgtacttatacattttggaatcagcttgtcacgtttgtaaatgaatagtttttggatttttgttaaaattttattgaatctagaagtttgattgttattaatagcatcattattcccaatctgtgaacatgtaaatctctccatttattgtcttcaacatcttttaagttttatatttttccccataaaagtcttatatatttaacatatgtatatattcccgggactttaaattttgatgctattttaaatgagtatcatttttaaacagcattttctaactttttttcctaaatatacaaatacagctgacttttgcatgatttcatatacagcacccttcctaaactatctaattccattagtttacctggatcttcttctgtctcttctgagtaaataatgaggccgtctgtgaataatgacaggcttgctccttctctcctaagtgcaccctttatctctccttcctgcttcactgcctgctgaacggatcctcctacaaatgcttgtaagggtgagagcccacatccctgtcttatttctggtgttcaagagaatatttccagtgttttgctgggaagcatgatgtttctgtagggtctttaaaaaatcaaaataagaacaaactagtcttactttattcaacatttttattatgaatgaatgttaatatttagcaaatgtttttacctgtatctattgagataataatttttttctcttttcattaatgtgatagactacattaattacagctttaattgctcatgacattttttaaaaataaattgctggattttaatttgctattatttggcttttacacctatgtttttgaggaaatttctctctaattgtcattccctgtactgtaattactgagttttggtatcaagtttatgctaacctcatgagctgtgtagtctgggatgttttgtgtatgagtgcatgtgtttggatgtatggaataacttgcttataaaatatgtgggcctgatattttctttgtgggaagacttttaactattaactcaagttcttccttggctacagggctattggagtttttcattctggtattttggtcatgttatctaacatttcaaatatatggccataaattgttcatgatgaccccttgttattcttttatatgccaaagcatctatattagcattccaattttaattctcaatattgtttatgattccctcctctcttttttaaaatcacttatgacaaaggaggtttctcaattttgtaagctttttttaaaaagacaaaaaattttgctttttaaacaaacagagagattctctgtctttgagattctccaacttcactgtcaggaatcgaggtgtagagcctttttcactccataggcttctggaatctgagtactggtgtcttacatcagtggtggaaatttttctgccactgtatcttcaaatattacttctggagtgctctgctggaatgcttatgaaccatatgtaagattccaactctgccagaatacttatgaatcgtaggtaatattctaactctgctggaacactcatggatcatgtgtaagatgtgtaagatgatcctcgatggtgatagagtgtgcctcttccccggcaatggctttcccaataaagttggctctcaatgtagctaccttttttttttttaaattagtatttccttaggaactccataggcttctggaatgcttatgaaccgtgtgtaagagtcttctactctgctggaacacttatgaatcgtgtgtaagagttgcctaatctgctaaaatgcttatgaactgcatttaagatcctcctactctactgcaagacttatgcattgtaggtaagattctcctactctgccctctatggctcctacccttactttcatattttcaatttatttgtctctgtgggctgcgttttagaaaatttcttagttctatactttacttctctaattctctcttcaactatatctaatctgctattaaactcatacccttagtttagaatttctattattatatctttcattaaaatatatttcttcaaaaattgtggtctcttttaagactattgatctgtaggttatatttagcttcctcctatgttcctttaatcatattaaaatatttaaatttatgatctatgtccaatagttacaatatctgaggctttcttttgttgtccattctttcaattaacttttgtcctgttacctggtatgttttaaaattttttattgtggactcaaatttcttggaattttacttgcaggtattctttatgagtagaaggggaaagaaaggattcctccagagaggatctgcctttccctctgccaggcatctggaggcccgtgcacctgggagcgtttgaagctgaattccctgcttgagatgttgtggctgtccaggcagcatgcagtgggattgtacatccctgtgaagcttggctgtggttaatgtcctaagggaaaatgccacccccccacccccgccttccccgccacacacacacacatccaggaacagcgctgaacgcaagcagtttaccatcctccagcccaatggagagctgagaagacactctatcatcggtcaccattaccctgcagtcatggttcttgggggtcccagctccatgtggcatgtcttctattagccttaccatatcaggatttcctagtgcctcctgccctctatagaccacaagatcatgaatgctgaagttcaggtttacccggtgtggagaagattctcagaataaaggccaacatcagtcatccactgatgtccccgggttcctgctctcacttggcttgggatctccaataatttaattattgccagatgtctgatgtgttaaaattatctctatgtcctcatattctcgtagttttgtttttggaatgagggtgagtcccaatatttgtttcttccagcgtaccagcagaaatgggaactcccacatctcctaagaaatctctgccccgccccagctgctttgtgcttatgaagtaaaactcattttaattcaggtttgggcaaaacctcaggggaggctaaatatgaaataatctaatgattttatattatgctaaatataactaaacacagatgtgtatataaaattgctaattattcagtgttttatggaatctgccgtgactcttgctgggactgtgaactagaaatggcaacgacaccttttctttgtgtggtgctgcgtgtggacgctggtctctcctcggccccagtccacgctttccccaggttcttcatctctaaccctcctggcagcagtgctgggtcagagggtctcaccccaaatggtcccaggctcctgtgcagggcctggtggttatggtcccagatgggcggctggagcctctgggaggtgttggcccagggctactcagttcaaaatgggggctctgggaaggagagccaggtctctcgagcttgaggtggctcctcatggactgtgaaggggtgcatgttttaacacaacaaactgctctcctctaattacctgtaatccataagacagtgtgaggacagttctgggagcaggtgagttcgagaagcaccaagacgcatcatttgcctgtcctgtgtgtggtctaagaggtgcctggtgcttcactgcagagcacgcagctccttgctccagccacctgcaccacaagcactgcttctgatgtcataagcgtggcctcgaggagatgcttaggagcccccaggccagtgcacgtcccctccccggctgaaggtccccaccatggcaggggctggccacgcaccccggccactccgggacacgtccaacacacgtccccctccccagctgaaggtccccaccatggcaggggctggccacgcaccccggccactccaggacacgtccaacacacatctccctccccagctgaaggtccccaccatggcaggggctggccacgcaccccggccactccgggacacgtccaacacacgtccccctccccagctgaaggtccccaccatggcaggggctggccacgcaccccggccactccgggacacgtccaatacacgtccccctccccagctgaaggtccccaccatggcaggggctggccatgcaccccggccactccaggacacgtccaacacacgtcctcctccctggctgaaggtccccaccacggcaggggctggccacgcaccccggccactccaggacaggctgccgcagctggggagcttctggttccccttctttgctgttgcaaaccgctctctctcattttaaaatgtcctgtatgaagcgaaggcactgaacacactccagcctgcaacgcagaagtgcacattggcgtggagcatttgaaaggcattttctccttggaaactgaaaggtcaatttgtcaaactccactcctcagggttccaagaaaggttcttcagcccttgttttccagccataacagggtaaataaatgagactctcatctgcgggtctcctgtggattctgccggggggcggggcttcggtggaaagggagcatggctgcgcagtaataatagcggcaggctgggaaaagctaatgtcagctccaatttccaagtcatttttcaaattattttaattagatattgtttcaatctcacttacattaatttaatatctgatatcaacatttcagttttcaattgttcaaatgattttttttcagtctgcctggttgcctggagtaatttaaaatacaatgtttatcttcagcaattttcaacgcgtggtcctggacaaactgctatgttcaataaaagtgacaaggaagggacggccccaggtcctgcgtggcgacgaggaaaaatggaaattgtctccttattgttcatctctagacatcagagtcagcaggccgagctggggctggggctgggataataagattttccacccatttcacgatgtaattggctttcccaacgcaaatttcagtgaaatttgactaagatttttttgtattaaaaggcatctgaataaatggccacattcccccatctacacattttctgagaattttcagtcacagccctcaaacctacccctaaaagattcttcctggacgcactgccacaaatagccttaggttctgcgttttcttagtttgtccttttcttcagacattagcacggatgctggtaaagacgtgccttctgaaatggtaaatgtaaagctgaaccaggccttcacctccccgtttataaaatgtgggagaaatgaggtatcctgaagtgttcttctaagacaaggaaattagtattgttcttgaagttgataatgagaaatctgaagatccttactgcttttgaaaagtgtgaagaacttaaaacaaattacctgggaacaacataaaaccaaactataacatcatccacatggcaacaggtaaaccatcgaaggaacaggagggaagctgaggagctggaaggcgtgggccggtgtgattaacgagaaacacacacagtgaggacgacgcgtgggagcaggggaagtcatcttcctaggacaggtgccttcactcgcatcaaactactcattatctacaagcaacatatcgaaaacaacgccgtccagaaagattacaaactgacgcggccgggaaaatctatcagacatacgaatggaaggagagaaggcgtcatggcgtcgacaccaagaaaatgtgcaatttgtttaaaagttattgattaaagtggaataaatagactaatgttagattagattataaaattccagacaacgatatagggttaatgaactggtgtgtgccaagaaataaacatcgaaattaataaggaagaagtgatcacagtacaaagagatgccactcgcagcctgagggacggaagggcctgacggcggccatcctccaccagccacgttccggggctgcgcttggcactttaactgcacccggcactaacccccacaacagccacctgaggtgcggactttaaatgcccccatcttattgataaagaggactgagttttccagggggttaagcaacttacctaaagtcacagggctagtaaaacacagagccttattagaaacaagtctccctagctcccacaagggtcctacagcgggcccgagaacatgacaaagagaattcaatagcgactgatcaagctctatggtctagaaaccagaatggaaccgatcagatattaagcctcaaaaaaggacttcatgttttttaaatcataaaaatcataaatgttgcattctctaagcaaaatctaataaattagaaattaataaacacagaaaacaaaactctctcatcatttgggtattaaaaatattattttcaataattcttaggttaagaaggaaatggaaactaaattacaaaatagttagagaataataaaggctgtgggagataccgaaatgattccccggaggtgggtttcgaatactgagagcttccatgatgataagagagaaggacagtaaacaaagtaggcactccatttatgacgtcaaagtaaataggtaacaaaaaacttgagggaagaaattaagtaataaaaatataaattaaactataaaagggaatacaggattggtgaataaacccaagagcttgattttaggggaaaaaatcataaactcttagaggtaatcaagaaaagtaaaacacctcaaattctaaaattatcaaaaattaataattaggaggacacataatcacagatgcagtggaaatttaagacttataagcccttaagaccatttatatatctatttatagtcatgcaccacgtactaacgttttggtcagtgatgaaccacatacacccacaagtggtggtcccataagagtatgacggagctgacaaattcctgtcaccttgcgacgtcacagccatcgtaaagccacagtgcaaagcattaccttttctatgtgcaaatgatacacaaatgcctaccgctgtgttacacctgcctacagtattagtatagtaacatgttgtgcaggtttgtagcctagcagcgctgtcccatacaacctgggtgtgtaggaggctgtagcatctacaggttttgtaagtgcaccctgtgatgctcgcacaacgacgaaattgccagatgaaacatttatctgaaggcagcctcgtcattaagcaacgcatcgctgtctaagaatttggaactccaagaaattgaactatgaacaaagaaaataaaaattactaacctggctaagaatgaagaaagaaatattaatagatgaatatgaaaatacaaaacgtttttcaaagaaacttccttccagaaaagcacaaggccctaagtgtgactggaaagttctctcaaaactttgaggaataaaagattctcaagtcagcacctcccaggagcgccagcaccaagcgcagttcacagtttacaaggacacgcttggcaatccattggtgggtctgaggatacagcaaaggctctgagcctacaccaaggccccccatgttgtctgaacgtcctgcctgcttcttcttttgaacatgaagttctagccagcgaggacaaatgctgagatgtttgagacttcccaaaccacttgtgttttatcaatacattttataagccaaaagttaagagtcagccgcacaaacagagctgcccaatccttggcaaagcagcaagggaactcaatggggaagggaccagcttttcagcagatggtgctggaccaatgggatactcacatgcaaaaagtgaatccagacatcaaccctataccctccacagaaattaatgcaaagttagatgtaaaatgccaaactatacaacttctagaagatacaaagaaaatctaggtgaccttgggtttggtgatgactttttagagatacaacaccaaaagcacagttcatgaaaaaaacaactgataggcaggacttcatgaaaattaaaaactgaatatattattagtatatgacccagcagtcatgccctttggtatttgctaaatagagttgaaaacttatgtccatacaaaaatatgcacatggatgtttattgcagcttagttcataattgcccaaacttggaagcaaccatgatgtccttcagtagatgaatggatcaaccgtggtgtatccatataataggatatcattcagggctaaaacggaatgagccgtcaaaccatgacacagggcttgcaggaaccttaaatgcctcttgctaagtgaaagaagccatcctggaaaggctacacactgcatgattccaacgctaagacgttctggaaaagaacaaaggatggagacagtgtaagttgtggtggaggtaatgaggagttgggggaagagagaggtaccagcagagcacagaggctttcatgacagggaaaccactctgtttgatgctatgatgatggatacgtgtcatcatacacttgcccaaacccacagaatgtaccatcctgctgtggctcaaatatggtttataccatctgaaactcatgctgaaatttgattaccattgtggcagtgttggaggtggggcctttaagaggtgattaggtcattaagagggactgatggtttcttgcaggagtgtgataattcttgtgggagtgggctgccgcaggcagggagggctgctgtaaggcgagcccagcccctcatgcttgtcgtctcattatacatgctcattggcccttcttccagggcatggcgcagtaagaaagcccttgtcagagctgctgccatgccctcggacttcccagcctccacaactgtgagctaaataaacttcttttcttataaactaccctgtctcaggaattttattatagcaacaaaaatccacctaagagaacagcaggagtgaaccctgatgtaaaccatggaatgaatgtgggctcatcaactgtgacaaacagaccatcctaatacagatgggagcaatggagagacggggcgtggagtggaaggcagggcacgtgggaaccctctggactgtctgctctatttttctgtaaatgtaaaactgcactaaacataaaatctactaaacacaagtcacaaacaaaggttaaaagttgcttgtttttatttgaagtgcagatgtccctggttagatgttcaaataccttaaaaactgtaggtaaagggcattctccatgtgtacaaagattattactgcagtgaaactttcaggagaattttgaagagagatgattattttctgactctactgaccaggattctgttcaacatcttcatacgggatttttggtttttaaatactgggtgacggggccaaggagtggtgacttgcagaaggaagtctttcctgggcgatggggccagcactgcatcctgacttggaacagagtgcgtggaaagggaaatgggggtctgggtctcagtcctgcagtcctgcagtcctacagtgggtgagaccacacctgcggcaaagctggaattgcactgaaattggaattgaattgaaaattatgcagaattggaattgcattgaaaattatggatggaaaacaagagcaaacttaccactgctaagtgctgatttaaacaagataaatgttctctttagttggacacaaactagcaagaatgactttgttcccatgggtttctcaatataagctccttttgctgggaaggaaaaagggcatctgcagtaaggttggttcttttccttccacatcaccagcggcaatcgtctttattattcattagcaagctcgatgtcacggcacgctgcggcaccgctgaaaccagcctgagttgggaaaatactttcaatatttcaactgactgctttctaagtcacaaataacacagctaatcctgaggtcactcgcttacaaaaacctatttgctgtgcttcagagcaaaatgaaaatatatattacaaatgatgccaccagtggcaagcctgctctgggaccagccatccttccactgtctcctaccactggcagctaaaaacatccctccttctccttaaagccattttaataaagaccccagaggctgtttactcaggtgaacacatttatttgtaaccagtgtttaatgtaaaatttagcctaggctgtgtgtgtcaataaaggtctataaataaaacatcactctgggttttttatctttatcccaacaccctacactgcatgcttttagagacgccgttccactgggcctttttattcttaaccctgacctataaaaatcacttaagtcaccagaagcttttcctatgagccagtcagtgcaggtgaggtgggagcagctagccataagttatgatgcttgtgactgagaaaacaacaggtgggtgtgttctggcagggcaagaaggcagccagccccctgggaccatccaaccatgctccacctgcctgagcctcgggaaacgccacctgcgcgctggcctgtggaggggagctctttcccctcgcgaggcagagcacatgtcactacatcacattgagttggaaaaatccaaagaacatcatccccgtctttccacctgtgtcagttccttcaaagacaggcccgagacctcctttggaagactttgctcaaattatttgggggcaaacgtccaaatgtcagaccattgatggcttccatcccattccctcaactgacggataaaaccccagaaactcagagaggctgtcactgctgcaaatggtccaggaagaaactctgatcccagaaaccaacaagaggaaattttcctgagataaagagaaatctctgcctttagataagaaatgtgttttcaggaatcgacagtgttagtgtaggatgttagcggtcacacccgagatggttcttttgctaaactcagggagattttagttgaatttgcaaaatggttgctaacatatctacctgttcctgagcagaatttaaaaaagcaacctgtcctgaattagaggaggctggctttggtgtgctgtttgggttggaccgtatctcagcactgtgttccattctggataccgctgtttgggagaccccatgggcacccatagcagacggcagggatgggacaatgggggatggcaaggttgtgtgtcacgctggggagctggaggagggggcccggtcctgagtgtttcagaaggcagggtggggccatcacatccatggcctcttcacttggacaggatgagggggcgcggccacaggcaggtagaggggtggcagaggaggtctatgtggcttcctggggctggctccattgaagccacactcgttctccttttctcctccacctgtaaggaaacactgtccattggaacatcagaaagggcggccctgggctcaaagctgaggacgccccctctgacctgcagctggcgaggtgcacagcccctggaggagaaccgaggccaccagccctgttgccagagctcagctgctcctcccgacactggttctgagtcatggaatctccctaccctggacgcctccaaaggccccatccacagggccctgctcaccactggcccaggtgccacccagagtcagagctggttcctgacctctgccagggatagcaattcccattcttgagctggaaaacaggtcatgtggaatctacaggatgcacggggaggacacctcgctttatttcaggtacacagggtaagaagtccgctgcaggtggattaaagacttgccgagtcagccaggaggccactgcctatgccacttggcacggtaccctctgctcacccaactcccatgactgagatgcacagttctcaccagctttaggtgatgaaaacacctccactgaagctcaaacaggcaaatgcagttattgaaatgtagtcaggatgcaggcacctgcatttagcacgtcaggcaaatgcagttattgaaatgtagtcaggatgcaggcacctgcatttagcacgtcaggcaaatgcagttattgaaatgtagtcaggatgcaggcacctgcatttagcacatcaggcaaatgcagttattgaaatgtagtcaggatgcaggcacctgcatttagcacgtcaggcaaatgcagttattgaaatgtagtcaggatgcaggcacctgcatttagcacgtcaagcaaatgcagttattgaagtgtagtcaggatgcacctgcatttagcacgtcaggcaaatgcagttattgaaatgtagtcaggatgcaggcacctgcatttagcacgtcaggcaaatgcagttattgaaatgtagtcaggatgcaggcacctgcatttagcacgtcaggcaaatgcagttattgaaatgtagtcaggatgcaggcacctgcgtttagcacgtcaggcaaatgcagttattgatatgtagtcaggatgcaggcacctgcatttagcacgttgctttagtaggttaaatcccctccagaatcttccagaatccccaaaatctaaatgcccacatttgctacgtccaaatcacggctgtcacaatagcccttcatgggttcaccttcctcgtggtcccgggtcccaacctggcctggcccctctccctccagcttcctttggctgcaggcaaacactgcctgttctgaggtggtcagcagtggactcggtcaggccacgtggaaaccgcatggggccacagagtgatgggcctcagatgggcagcacacccaggagccgctggggaccctgttaaaatgcagaccctgatgcagaaggtccagctgttcaagccagcttgcaggtgaacccagagctgtgggtcagggtcagtcctagagacgcgtcacagagaaacgacgctgaatcaccagccaccgagacaatcaggaaccagtgacgtgatggtaaacagaggaaaacacgggccactcttcaaagcgcggtgcctcagaaaacacttccacagacacctcttcttctgtgtcgttctaaaacccttctcccagagataaggaaactagttccctgcaaaatatattttatggttttgttatcattttcagtatttgcactgtaattatggaaaattagtttagactttattaagcttttgagtctacatgtgaggcgaatggatgaatttaatttttatccatgcattacctccctctgtctatctaccactaaaccacagccacaggaagctgagggtccacgcgttacctccctctatctgtccactgataaaccacagccacaggaagctgagggtccatgcattacctccctctatctatctaccactaaaccagagccacagtatgctgagggtccacgcattacatccttccatctatccaccactaaaccacagccacagtacactgagggtccatgcgtcacgtccctctgtctgtccaccactaaaccacagccacaggaagctgaggatgaaaatcccctttctcagagcatctactatgtgccagttctgtattagaagtttcaaatgcatctcatcaaattctgagtccatgtgagataataattgccaaattaaaaacaatttaaagagcaagaagggattctggagatcatctaatttattttaatattacctaaatgagaagtggaggcagggagggccttgcccacagctgtgtgttcctgagtaactgggcgggactccctgcatcccaggcctcctacgcaccctccagtgccccttcctctaaacactctgtagctgcattcactcacaaacacccacagaccctgtaaaatgctgctcctttgcttcctgcttagacctgagaagtagcctctctccctgcagccctggagatccttcaccctgatcttgctggacactccatggcccccactgctgttgggtaagagtcgcctccccctgcatctggacgtgtggctgcagggatcctgacaccggctcactgtctgcaagcaaagccctgaagacaggaagccccagggacccgtctgagagcagagacctcacgtctgctggggccctgaacacaggaagccccagggacccgtctgagagcagaggcctcgcgtcttctgggaccccaaagacaggaagccccagggacccgtctgagagcagaggcctcgcatcttctgggaccccgaagacaggaagccccagggacccgtctgagaacagaggcctcgcatcttctgggaccccgaagacaggaagccccagggacccgtctgagagcagaggcctcgcgtcttctgggaccccaaagacaggaagccccagggacccgtctgagagcagaggcctcgcgtcttctgggaccccaaagataggaagccccagggacccgtctgagagcagagacctcatgtcttctgggaccccaagacaggaagccccagggacccgtctgagagcagagacctcacgtgtgctgggaccctgaagacaggaagccccagggacccgtctgagagcagaggcctcacatcttctgggaccccaagacaggaagccccagggacccttctgagaacagagacctcacatctgctgggaccccgaagacaggaagccccagggacccgtctgacagcagaggcctcacgtcttctgggaccccaagacaggaagccccagggacccgtctgagagcagagacctcatgtctgctgggaccccgaagacaggaagccccagggacccgtctgagagcagaggcctcatgtctgctgggatcactcagtgcacacgggcatgtgtggtgtgtgggaagcaggagggaagcgaggttttattaaagcacaggtgctttacctccaagcaggagtcagcattttccatggagttctgctgtgaaccctctggggtttgtgaccaggtcaggctgagcagactgggatgtttacgagttcttacgcacacccttcacagctgagggtctacaattcacgcttgtgggcaattcatgaagaagagaggtgcacatcactacctccattttgcaaactagggctggggtcaggagagctgcccgacgcttagagggactgtggagctctgtgggcaatggacacgtgacaggtggcatttatagagcacttactgggaacatgacaggtggcatttatagagcacttactgggaacatgcactgttgcagcactttatgtgaattcacacgtttaactctcaccacaatccagaaggaaggtgcagatgaggactctgaggcccacccaagaccgtaaaaccagggcagggccataggcagatacaggacccgacccagagcccacactcagccatgctgcccccgggactaactgcctggcttgggtggtccttagtagagcgggcggcatcaggcctctctgctcttggtcgcctggagatcccacagccagcaggatgcacccagcctccctgagaaagatagaactggtctggttcctttccctgggtttagggggctggggccaaagagaaaaatggtaggccctgaacactcttcttgtgatggtgggatggacctgctattcaggaaagcctcaactggctcccccaggtccactgtacccaaaggaactggctgcctgaacacatttggtaaaagagattgcgaagccacccaggacactccccgtgtctcagcgtcactaccaggctctcacaagctgatcaatctgagaccacctgagtttgaagcaccagggctgggagtgcaagttccgactatgaagagagggcagcacagagggcgggataggggtggggtggggaggggggcagagggtggaagatgagagggtgggagatagggatgggagagagagcggggcagatggcagggcacagggatagagggcaggagaaagggcagggcagagggtgggagagagggcagtgcagaggataggatgggggggtgggacagggggcaggagggagggcagcacagaaggccaggcagagggctgggacagaaggcagcacacaaggcaggacaggctgcagatgatgctcagaatgcagccaccccacgtccagaacgtcagggcaggaggggacatggagatggtttaacctcacatgcccactttagaggcaggagagtggggtcccggggtgccaggtgtcttgctgaaggttgtgaaataaggatcagtgaaacggtgagaccattccttccacccttgtgtttccctggcatatgtgtcagccagctggtcaacacatgctgcgttagcaaatgctgaaggcagggtcgtccctggcatgaccccctccccataacccacagcccctcttccccagtacgccgtggcagcctgccatccgctctctgctcctctgactaccttcagcaaccctgccttacggtggggatgctggacaggcattcaggagacacaaatgtcaactcctctgtgggttcctgcagcaccgggagaccctggcgcgactcctgagggcttcagtcctcggtttgttccttttaggaggaagccaccggatcgtttcccatgcttaagctcagacgcccacccagcacagcctccgccgcagcctggcagcccaacagaggctggtcatagtttttgccctggaattcccctccttttaccacatttgccacctctggtcccatcttcctttcagggtccaggcagtcttccccctcattaaatcaaatttattcccaatcctctgatctccattcaccagcctcctctgtctctactgtaagacttccctgtccctcgggtgggggcggcatcctcacaggggtgaggagctctgtgctgctgttgagatgaatggtgccagaagggagtctttccaagtgccctgtaatgcagaacctttcccagtgcccactggtggtgttcccgggacaccaggcactggaggtcggcacgcttattgtaatgaatctgaaggcagcccccaccaacgcgctggctgccttggggccaggcatgaagcgaattcagtccacatcagcgggtccaagcctggacctagacacccgtcccagctcagacgctcagctctgggccatcacccgtcgctcagcctgggtgacgcagactgtaataatcatgccatcgtgcacactgtttttcggagcctgttgaatcacatcacaaatgcaatttatagtttgcctcaagatgttttccggaaccttcctgcagagatagcacgaggcccacagaggggtgtcttggggcacctggcaggttccagggtgggagctataaactagaagtcccacgcttctcctcccccaggttcacttgaccacaattctaaaatattaatagcatacagcgtgttaagtgatggcaatgaaagtctggttcactcttattttatcacaaacgttgcataataaaacattcctggtgcccctcgtgattcgcagcctcctgagagggggtctctgttcagggtctctcagctgctgcttttagctcctttgtggggtgcaatcatttcccaggatgctggagtcaggtttctgcactggcaccagctgaagtgttttccatttcctgtgtgaagctcagggggttgtaagcacacacacgtgaccgtcgtgagcaccatcagccctgcctggagcaccggagggtgccaaggggggctttcttttctttgcttctcctgctgcccctggccctgaggtggtgcctgaaatccctgccaataccatccctgttcctgagagcctccttgggcaaagctgggtctggggcaggtaagcgggcagcttcctggggcaccagccccacaggtgagccaacatgggagtgggcgtgccacacttcccaggctgctcacaggcactgctgcttggggatgaaatgtatatttttatggaaatgttaaaaattatttttggctgcctaaattatgtatattgccttccctacattttgataattttttttcgtttttttttgtttttcgcaagaggcagaaccagcttcccgctgtagcagctaagaggctgcactgaagggcagccctctcccctgtctcacctccagtgcacaggcctcctgtggatcagaggctcccacagactctgagtcaagaactccttctgccgctgcaggagctgcagccagacgaggtttctagaagccatggctccagcactgcagcatgagctgcggtgcctggcattgtgcagaagggcacccacgcacggatagggtggctggcatctcccaggctgctctgagctggttccctggctgtcccagcaattccacgagttaactaatacattttcataagcacatttgctgcctaggccaggtttctgtcgcttgctaataagaattaattgtgactcatgcaggattcttggggtaggggtgagggccccagtgggcactgctgcttccaggcaggtccagtgaggaggcgtttggcccgggaaagggcaggcccaatcaggcctgagcagagccgtcagcacaacagaggcacggaacccagtctacttccgatcacacgctgagtaggcactgaaagaaaagtgactgaaatgtgagctcaattcttaatctaaccctgttctcaggaggcacatgccttcgtgtggggctagagcattaactctaaaactgtttcacaagcctctgggggcttcagaggcatctcagtgagtcacaaatgcatcagaaaaatgcaggtaagctctggctcttacatgacgaggggacattttcagtgagttaccgagacagttagaggtgtagctttggtaagctaaattgaataaatgactagagcttagcatagactgcggtctgggcttcagtaggaattacggctgccgtgcagggcggggcaacatggcagagcttctcctgagcatgagcatgtgcacaaaattgggattctaccaccgccaggagaaattattttaggttggtcatggctttctattgttactctaagttgcttcccctcccccctttaaaaatatgttattttaacatacgtcagatttatagaaaagttgtaagactatcatacaagaatctcagacactcgtcacccgattctccaaatggtaacattttaggctttactctcacctgcaaaatctctctctatatttatatttacactgatatttgtgctttattattctgaactatttgagagaaacttatggacatgattttcccttagttctaaatacttcagtgcttatttcctaaaaacaaaggcattctcctacataatgagagtacagttatgaaaaccaaaaattcacactgatatggtactaatatctaatcaacagaacttacacgatttgtctacttctcccaagaacatttctagaacaaaataaatgcccacatgaggccctgcataccgacgtcatgtctctctagcctccttcaatttagaaaatccttcagttcagtctttcttggtctttgtgatagtgacaactttagaatggggtgagtcactttgattgacagtttcagattagaggtgacttactttgacatttttagagtaggggtgactcacttgaattgacagttttagaggaggggtgagtcagtctgattgacagttttagagtaggggtgagtcacttggacatttttagagtagggtgagtcactctgacagttttacagtagggttgggtcattctgacagtttgagagtggggtgagtcactctgattgacatctttagaggaggagtgtcattctgattgacagtttaagaggaggggtgagtcactcggacagttttagaggaggggtgagtcactcacagttttagaagagggatgagtcactccgatggacagctttagagaagtgactcactttgactgacatttatagagtaagggtgagtcattctgattgacagttttagaggaggggtgaatcactccgattgacagttttagagaaggggtgagtcgctctgattgacagttttagaggaggggtgagtcactcattgacagttttagaggaggggtgagtcactctgactgacagttttagaggaggggtgagtcatcctgattgacagttttagtggcggggtgagtcagtctgactggcatttttagaggagggatgagtcactctgactgacagttttagaggaggggtgagtcactcattgacagttttagaggaggggtgagtcactctgattgacagttttagaggaagggtgagtcactctgattgacagttttagaggaagggtgagtcactctgattgacagttttagaggaggggtgagtcactcattgacagttttagaggaggggtgagtcactctgattgacagttttagaggaagggtgagtcattctgattgacagttttagaggaggggtgagtcactctgattgacagctttagaggaagggtgagtcactctgactgacagttttagaggaagggtgagtcactctgattgacagttttagaggaggggtgagtcactctgattgacagttttagaggaggggtgagtcactctgattgacagctttagaggaagggtgagtcactctgacagttttagaggaagggtgagtcactctgactgacagttttagaggaggggtgagtcactctgattgacagttttagtggagggatgagtcaccctgattgacagttttagaggaggggtgagtcactctgattgacacttttagaggaggggtgagtcactctgattgacagttttagtggagggatgagtcaccctgattgacagttttagaggaggggtgagtcactctgattgacagttttagaggaggggtgagtcactctgattgacagctttagaggaagggtgagtcactctgattgacagttttagaggaaggatgagtcactctgattgacagttttagtggagggatgagtcaccctgattgacagttttagaggaggggtgagtcactctaaatgacatttttagagcaggggtgagtcactgatttgcatttttaaagtaggggtgagtcactttgcaccatgctccttggctggtataccgtggctgcctcaggaatagactgggttttgctctttgtcgagaacaccagggacatcatcttttgtgttctttgtgcatcagctcaagggcacgtgtgcggatccatcttgccgctggtgacgttcactggtatcacttgttaagcgctgcctgcctggtttctgcaccgtgaatgctgttttcttctgatcctatcttgtggtgagagctattctgtggttctccagaatatcggccgctcattttagcatcaatgattcttatctgaatcaagtagtactaagaattgatttgactttaacataaagaatttccaatgtgagaagatttcagtattcatggctacagatgccaagtgtgggcaacttatcttttatgcgccttcaacaaagccatgggagcagagagagggaaagaaaatctgaaccagtatgagtcaactggcacatcggctcacctcgatagcatttgcacatttgactggaagcctctggcttgtagaattttttcccactatagtatagaacactccacttcaatttttacttgtttaaaagaatcacatttgtttaatttccactctgacctgatctttgctctgccacagggactcttcacttggcgatgatgagcaaagcatccggccttggacctcctgcttcccagagcctgcagggctgtctcacttcctccagaagctctcagtctgctgccatttcttgggttcttcatccttcctgtggacctgggtctccaactgctgtgatttcccatcagtcagaagaggtccgcagcattttgtacagtgcaggtctaacatggcagattctctcgggatgggctggcacgaaagcaggtttctttcacccttatgctgaaacatgtttttgctggagatagaactctgggcttttgttttctcccttgcagaaccttaaagagttgtcaaattgtctcctggtttctgctgtttctagtgaagaatgaagtcagtcctcatgcatatcattgctcctgggaatgtaacgtctctcctcccagctgttaagattttctatctttggtattttagcaatttgactacaaatgtgcttatgttaattttctttgcacttaacttgcttggggttctctgagcttcttctttttcaccaggtggagggtgggtagggttgctggttttgaatattaattcttctttttttgtgtcccacctttcttggctcatcttctggaactgtcacgtgggtcagaccacttgactttgtcctagaggccacctgggctcttttttgtttctggcatttttctctgtccttcagatgcgatcatttctgtgcatctgttccaagtttgccaattcattcttctgcagtctctgatccgctgtaaagcccatgcagtgaatttcccatcttacaagctctcctttctaaaatctacacgtggttcttctgcacggcctccatctttctgctgaggttcccacgtgtcccctcttctccgtctttccctttacgttcttgaacagatctggaattgttgttaagtccttgtctggttgatttcagtgtctgtatcattgggactttcttttctcttctttatgggtcctaatgtcctgtttcttaacatgtttagcaattttggactgcaagatgaacattggcgggtacatcacaggaacctggtgacagtccactccttgcttttaaaattggagctccctgggaggcatcggcatctgtgtcactccctcaggggggtctagccatcctcagcatctgtgtcactccctcaggggggtctagccatcctcagcatctgtgtcgctccctcaggggggtctagccatcctcagcatctgtgtcgctccctcaggggggtctagccatcctcagcatctgtgtcgctccctcaggggtgtctagccatcctcagcatctgtgtcgctccctcagggggggtttagacatcttcagcatctgtgtcgctccctcaggggggtctagccatcctcatggtgcagcaacgccattctgtcctgtgtgcttcgcaatccgaaagtgaaccgatcgtaggtgtatgactacagcaaatgcagacacattctccccactttccctccctgccatggttctctagtacaagatgcttgaattttttctcactgagcttcactgctgccactggaggtctgaattgattttgcctcaactagttagagaagactgagactgactgagccgaagctctctgctttcttgaggtgacgagatgctatcgattatgggctctgtgcccctgtcacgttcacacgacatcccaaaccagactctactgggctcattcctcccctctgcctgtgtccctcactccaccaggccccgcgagcatcctccctgtagctctctggccaccccacctgtttctcttccacggaggcacctctgtctcctggattcccaccacctctccctgttctcccgagcaccactcaatctcacttctagtgtctcctccactcggaagccagggtgggggtctacagtgcaggtcggacacctcccgtgtctcctccactcggaagccagggtggggttctacagtgcaggtctgacacctcccgtgtctcttccactcggaagccagggtgggggtctacagtgcaggtctgacacctcccgtgtctcctccactcggaagccagggtggggttctacagtgcaggtctgaacacatgtgcagccctgtgcaaagctcttcagaggctcctcatgccctctggagaattttcaagttcgcagggagtgtatgaggccatcctttcggtcattcatgccattttcccacctctcccctgtctttccgccatggccagtcatgggaattttcctaaacatagcctctttctcatctgtaaaaagtattctttctgcaatattctgtaaaaagtattttttctcttgtagaatgtctttctgcctgcccctctcacccgcatgtcaacccccttcactggggcaatttctcttcatctcccagacttggcctgggccaccttctctgggaagccctccggacccctgaacaccgtgggtctgacaatatctttatgctccttctgcatctgggcacctggaacttgccgtgagcatggctgtggtgggtccttagcccgagtgaccacgtgaacttgcagctggcacacataggtgagtaaaggtccacacggggctggaccacctagaaaaacagcttttgcttatttacccaaagtaagctgtgctggggaaaggaagaggaaggttttgaaggtggatacagaatttccgtctaactgagcacgtggggactggagcaattcactgaagaaatgaaaggtgcgggaataggcaagcccttgatgtctggagcagatcgcatcagctactactaagccgctgttgtcaggcacagagaagacactcagcatcggatgagagaataaagccgtgtgcggtgtggcttcatgtctctcacaatagcgctcccgagtgcggccgctccacctttcccacccaggagaagccgcttaaaaagccaggcaggggctcttcagtgcaaaggttctgccccggactctcaccagctgctgagagcgggtgcggcctctctgagttttggcttgagccggggcctggaaaggccaactgcctgttggcctaaagagctagaaaaggatgaatggattcatatttacaaagacaccacagagtctgtctgaacagtcctgcgtatctgcaatctgctcgtcacccatccccttgtgcctagtgacgtgagccccaggacagtctgttcagtagcaccatttgcaacccctgtgatgggaatcttcgtgactatgtgacatgttccccatctctctctctgttgttttattttcctttgacaatgtcaagctggaaattagaagcaatgtggcatgcggagccactcagatctgaagcagagtgcatggtggggccatctaagtatgtttttctgcacaatgtgaaccccggctgttcaaagctaagagccacccactgcagggcacagtgctctggtgagaggaggtcacctcgaagtgggccccccgcatggtgctgccaaatgcacgcacagattacactttatgaaaggtttcctttgctttgaatagttggctgtctcagaaaaactgcagcacccactggttggaaattacatctgaactgcagtggagatgcaggggagacatcgcacaggagcgtcagccatgggacagctgcacatgcctgcagtgtcatccctgccagctctcagaggcacctgcttctgccctggggatcctgctgaaaggttcttgagctgctgctcagcagggacacaggagagggccggatgtgaggggtagacactataagcagacctgcaggcccagccatgccacgtgcagaccactgcccaccctctgcagatgggaaggagaggcccagggaggctgcctgtctgctcagggtcacacaacaacacccaaaggcaagatgtgaacccagatctgctttgcactgaagacctcaatttttactattagtcttaccacatagacaaattaaatgtgacgtgtttaagttgcattaaactgatgagatttgaggaagctcttttccaaaaattctctttaatatcaaagatacattgtccttgtagtacactaagcatgattgtttttgagtaaaaagaaccaccctttggggtgttggtgcttatgtaggatgatccaaccctggcagtaaaagggagggttttaaatctaccggagtggcccacagaaaacaacctgccggtgtcaagatgctcatatcagtgctgaagtaaggagtggggctctttgggagcatcagagcaaacttcttgtccatgatccacacgggctacgagcccctgcagtgccttgtgcatggtggcagccacatcaactcacacccaaattccgaattacagtcagataaagtaaagtaaagcatgcaggtccccacctcaacagcaaggtttccagcacccaaattccgaattacagtcagatacagtaaagcaaagcacgcaggtccccacctcaatagcaaggtttccagcacgcaaattctgaattacagtcagataaagttaagtaaagcacgcaggtccccacctcaatagcgaggtttccagtatccaaattctgaattacaataagataaaataaagcacgcaggtctcctgtctcactagcaaggtttccatcactgagcggccacaggggctggtggctgtcctgcaggacagcacacatgtgggccattctgttgccacagaaagtgctagaacagagctgctctagagaccaggcctctggctgcaggagaggagagctggacagccatctgcagaccaggtcactctcagtgctgtgtgttgtgggtggagctcaccaagtgccaggattcaccctgtggacacagccacatccccagtggggccatcatctgcatatgaacctaatttgccaaaacccataatgttgggttagcaaaggtgaggccctgaggcctcaaccccatcgtccagtgtctactgaaactcagcaccagacagacagagttggcctcagaactcctcagtccagcttccctctggcatatcttacaacctgtgttaataccagggcttttaagatgtgtttgcctagcagttggttttgctaggcccttggataggtgcatttggctgggtactgggcacccgagaaggagaaggttgctacgtatgtgtctacaaatgccacaggtctctggcctgtgagacctcagcacagagcagagtggaggcaatgcttcctgaatgaactaagcaggtccaggaaggtatcactgcacaggcggggaagagcagggagtacccaggtcctggaaggtgtcgccgcatgggcagcagagagcagggaggacctgagtggaggaaggcgtcgctgcatgggcagttgagagcagagaggcccccgttggtatgaccatgagcccctgtcaagagttccagtccaggtcctgagggacatgttctctgcacatttccttctgggcatcatcctcagagttcccatctagtggtctgtcagcgatggtggtgttcagaacttggttataactcagccccggctcctttctgaagcctcagtgcagattcttttctctccccttcctagtgttattattaaattttataaggtctgtgctccttactttcaaagcaaactcttttttgtgccatcaagaggcaaagttataaacagttgactctgtgacattgaaatactgaaattaagaaatgaagaagcctagaaattctcactgttacagaaatctaatgccctcccctgtgacactgcaaatctaatgccctctcctgtgacactgcaaatctaacaccctcccccttgacactgcaaatctcataccctcccctgtgacactgcaaatctaacgccctcccctgtgacactgcaaatctaacaccctccccagtgacactgcaaatctatcaccctcacctgtgacactgcaaatctaacaccctccccaccgtgacactgcaaatctaacactctccccgaagacactgcaaatctaacgcccccccgtgacactgcaaatctaacgccctgccccatgacactgcaaatctgacaccctccccaccatgacactgcaaatcaaacaccctcccccatgacactgcaaatctaatgccctccccacagtgacactgcaaatctaacactctcccccacaacactgcaaatctaacgcccccccatgacactgcaaatctaacacccccccgtgacactgcaaatctaacaccctccccaccacgacactgcaaatctaacactctcccccgtgacactgcaaatctaacactctcccccgtgacactgcaaatctaacaccctccccaccacgacactgcaaatctaacactctcccccgtgacactgcaaatctaacaccctcccccgtgacactgcaaatctaacaccctcccccgtgacactgcaaatctaacaccctccccaccacgacactgcaaatctaacaccctccccaccacgacactgcaaatctaacactctcccccatgacactgcaaatctaacaccctccccaccatgacactgcaaatctaacaccctccccaccacgacactgcaaatctaacactctcccctgtgacactgcaaatctaacaccctccccaccacgacactgcaaatctgacaccctcccctgtgacactgcaaatctaacaccctctcaatcatgacactgcaaatctaacaccctcccccatgacactgcaaatctaacatcctccccaccatgacactgcaaatataaccccctcccccctccgtgacactgcaaatctaactccctcccccatgacactgcaagcgattcttcagtagacccaggtctctgggtacttgaaaccagagcagccacagcaagccactgtgtaagagttagcagagaggggctcctggccatctgtgcagggacatacgtccatgcatgtgtataaaagatctctgtaatttttatcagggctaggaccatcctgaaagtgcaggtctcccagagccagccacactccctatgctgggctctgcatggagtggggtcagcatgtggccagctgctgccaaggtctccctcccaatagccctcccagaggcctctgcccaccttcaccacctaatctccatgctcaagcctcactgtgtggccaggctgagtgcccatctcctcacaggacacagcgctctctgcaggacttttgctaagtggttggtcccctgcagcaacacacaggggtccacggcacaccctccacacacgggggtccccagcacaccttcaaatatgggggtccttagcacaccttcgcacacgggggtcctcggcccaccctccacacatgggggtctgcagtgcaccttcactcatgggagtccttggcctaccctccacacacgagggtcctcagcatgccttccacacgcacaggggtcctcggcccaccctccacacacaggggtcctcggcccaccctccacacacaggggtcctcggcccaccctccacacacgggagtcctcggcacgcctttccagaggaggtgatcttgaggcaccacaaaagcagcacctggcccctggccgctcccagctcagagcccacggtggggtcctcagccttcaccctagttttgctcccgcatctgagggctgcgtgtcacctcactgtgacttctgactgcacagcaggtgttggtgtggggagtcaggcagcctcagcgaatgtcctgaaaatgctcccacagaatgtttatatctttacagacacaaaatgctgctggggtaatactcttgggaagtatgcaaatgagttctttttcagatgtcaagcaggagcgatgatcagagaatcctctcattgagactgggagctggtggaatatgactccaccagctccagaccccaacttctccgcgttcacctgtacatcgcaagtgtctaaaaatgatgtgtatcccctcccagtccctcactgtctttccccagatcacacccccacaaccctgtgctcacggagaactgcccccaccttttctaggaaggagggcttggttatcagtcatcctcctgccatctctgatgacaggcagtggcaggggctcaaccttgtccttccttttcattcccactggtgccaccccagccaccttcatctgcgtagcctgaatcactgtggcctaactgggccctgggtctccatgcttcactcccaaagtcaaacacaccgtctcccatccctggcatttccatgccctcacttgacgaggatctgcaagagccgagctctgtgatgggcagcaggtgtgcacagcaggagggccgggcctggtgctcccagcatcttcaggcttaaaaatttggccccaggaagcctttgcattcataactgtagctaccactattcactgctccaaaattcaaaggaggagttctcgagacccaagaacacacaacacacattccactagcctcgaagccgcatcctcgcacatctcacagcctggggaagcgatgcagaatctcaccagaggataaacaggcaaagaactttggggctttgctaggaaaatgtcttactctgcggacccccagagggtctcagggacttcccatgccccctcccatgccccagacggtcctttctgaatggccgacttagacaaaggctacaccctttaaattcagtgacagccaacagaatcacttcctgcccttgaaatccaacaatgtctccacaggaagcatctgctggctcagcacagcaccagcttcagcccccacctccgccccatccctgctcctggacctgttggttccgaggaggccctggacaccaagacacccaccccagatgcccagactccctcaacatggaggatccccagactgagtcctccacaaatgctgaaaccccctcccaagatgccaaggaagccccccacccccaggatactgaagtcctccccagatgccaaagctcccagaggccaagcgctccctaccctgacgccaaggcccctctaggacaccgaagcccccgcctcctctgctgaggaagtgccattccatggaaggcccggctcagcctccctgggtcaagctcctgtctcctttcaggaagatggaagttcacagaggccgcaggtgtctaagggtcaagttgatcactacaccatccccttttagtgtttttgtatctgttttgactccctattatttttctggtagttcatctttttatgtgtttttaactaaatccattcagacaatcttgttcttcctctgccacttttctccacgttgtaagggttttaaaccaatgtttctaagggagcactgggcttcatttgacatttccagtaagtatcaaaagctgctatcacttcaattacagacactccgagcccaggacaggctccagatgcccggccttcatgcagcaaacaccttcacagggaaggaaggcggaactctctttccttgccacagaaaaggattctaacggcatttgacaaagattgagcatggttcgtcgcgaacgccagcctgcccccacggtcatgtccagcttaaccaacacacggcccagcagtctcggtcagtggagcccaccacccaagcgggggcggtaccactcccaccactgactgaaccttggaatcaatacaatgcagggtagagcaattcatttgaattaatgtgttaagtggcacaaatatgtgtttatcgagagaaacctaagtttgtgagaaaaggatctattggaaaattcttctttttaaaaaagtttcatggaaaaagcttcctgcaagcatccgcactgctgcaaatataataattgtttgaaagcataacatttaaatcagaagcatccctagacatgttgattagaaatagtcttaagagggtcaaactatgtccacagaggctggaacaccaaaatagaggcaaaagtcctgagaagggagttgtttttagtcaccaggccagtgaccactgtccagcaggtccacgtgcatggatgagagctgtgcccctctcttctctaagccaaggggctgttgggacaggcagccgcacctggccagctctgcccttgctcatcagctgggaagcagcatgcttcttggggggcaggcattgtctacaacacagactacacagtccacagtccacaactcctgaatcctgcctagtatttatacagtaaacagagactctgaaataaacaccgtgccgaatggagcctgtgcagctcccagtgctgtgaccccaccatgatcgctcatctgctccagctggagcactctgcctctctacccattttcctgctctcaccgagtcaggcctcggaccagcccctgtgtgagatggagatgtgtttagtgtgggaggaacacggtgagaggtcagagacagagcagggatccgtgcagggatgcggaggccccagtgctgggtgttcagggctgactcctccctccccaggcacctcctgccagagtgacctcatgagccctcatggtttcaaccccacccattcgcagcagccacatccccacctgcactgggttctccttccagactcacagcctccgcctgctagctgctcccggccaacccccatgggcacactgaccccgtgtgtcccgaagaccccccgcctgcctctgaaggcccttccatcctactgctcctccatcctggcgtctgacaaatcaatgtatctttccccgtggatgtttctccaacccattcactcttctcccgctcagtgacctggcccctgaacctgccgttcccaactcagacaaagccgtctccaactcggacaatggcgcctccaactcgaacaatgccacctccaacttggacaatgtcgcctccacctcagacaatggcgcctccagcttggacgatgccgcctccaagtcagacgatgccgcctccagcttggacgatgccgcctccagcttggacgatgtcacctccaacttggatgatgccacctccagcttggacaatgccacctccagcttggacaatgccgcctccagcttggacaatgccgccttcccacctccacaaagtctgcttcctaaagagcaagtccagccacaccacttcctggcttcagttgtcccatcagacgacgggtcaccaacagctggggcattctcaggagccaagctgggtgccttcccccttcctggacatccctaccctgcttgctgggcccagtccaggttctggaagattctgcctttctgttcagctgtcccacctctcagttccgacagtgtgagcctggtggctaaagattcctaatctggcccttgaagactcaggcaaacttagaagctcctggtttcaaacttctctttcccactttgcctcttgtcttgaggtggcagaaacagctgatggtgaggcaggataatacggtctggaggcaagaagcaaccacacttttctagtcttgtgaaacaaccaaagcaactgtctgaagcctcttcagctggcccatgcctcatgggagttttgtagctctttctgcgtttgagaagacactaaaaaaaaaaaagtaaaatccagctggtcctgagagacaagagtttcctcaatcctggaaattcagcaggaaaaatactgtttatgcactgaatgaaatcactgaggccaagaatagttatttgttcacaccatttcatggatgcctatttttgtcccaaaataaagactctgcatgtcaccatgttgatgcatctggaaacaagtgagaggctttgttatcagcatgcagcccagatgtgaaggcccacagcagctcctgagggcacgtaagcttgcaggaacaggatgatcctccaccggctgcctgggccatctgtgtaagggccctgtggactgagccatttacatcagttaggccagcagccacagggatggtgtcaccactgtgggattcaacactttgaagaattaaggcagaggttacttttgtccacaaaatcacatcctgcagtaaggatgtgggtacaagtaatttatttggaggatgatcccagaagccaagtgagagaacgggacagtaagcctgagaagggcggaagccatgaagtacatgcacaaaccaccagtgtggacggccggggcccgacactgccggagaccctctgagaggcatgtgggatgtgccttgaatcgtctgagggtcaaagaatcaggggtctctatccattgactcccatcccttgctctctgaagaggtgaactcctgagcagccctggcctgccctgggtgtgggctagtgtgctgcttagctcagacagaccaaggcaggtgcttaaggctggagccatcagcatagatgggagctgccctgcagagctgaagggaggcacagggtgggcaactgggatgtgggcaggatgcgaaaaggtctgtcaaaggggtacttcttccaagtgggccaaagactccatcaggtcgagtagtgacatggaaatcacagagcaggtggctccaaggatctgtccctccactgaagtaacaagtaagctgacaaaaatggacagaagtgactgttctgggattctgtagtctaattttaaaaatcagcagtaaccagggggtgctaaattgagaaagagaatgctaaattttggttaaaagacattctgtggtttttgcttgcccacctattattccccattccccagttcaacagcagctacaggattggtggcctaagttcctggtgagatgtggtggtaccagggggcagtatggatcttgttttcaaaaaactgtggctgtgtgttttgagctgtctggtggttccttgagaaaccagtgcaaagaggaaccctgttttagcacctttgggcgagactggctttccaggaggaagctgacgaaatcatgtatagagttatactgaccaatactatcccaaatttgatgaaagacatgaatatacatatccaagaagctcaactaactccaagtagaattgattcaaagagatccatgctgacatattatcatcaaaccatcaaaagccaaagacagaaatttgaaagcagcaagagagaggcaattcatcttgtacttgagatcgtcaataagatcaacagcagtttttcaccagaaaccatggaggcctgaaggcagtgggatgatgtatttaatgtgctgaaagaaaaataactgtcaaccaataattctgtatcaggcaaaactatcctttgaaaatgaagccaaaattaagacatccccttagaagcaaaagctgagggagtttgtcactagtagacaagctctgtaagaaatgctaaaggtgacaggctgaaatgcaggtcattgaggctgaaattctaaacagtaaccagaagccatacaagaaaataaagaacttcagtaaaattaactacataggtaaatataaaacccagtattgtagctttggtttgtatctcctccttttgtcttctatatgatttaaaagacaaatgcataaaacaataattataaatctatgttaacagcatacaatgtaggaagagataatttgtgacaataacaacataaagctgggaaggaagctattcagaagcagtttttgtgtgcttttgaagctaagttggtataaattcaaactacattgtgataaatgtggggtgttaattgtaattcccatggtaaccactaagaaaataacaaaaagaaatgtgcaggaaaagaaaatgagaagggaatcaaaacagtacactaaaaattaaatcaaagaaacaaaaaaaggcaatatttgaggaactgaggaggaaaaaaggtgtaagacatacagaaaccagcagcaaagtggcagaagtaaatccttccttaacagaaattactgtaaatgaaaagggatcaaactcaccaattaaaagagagactgacagaatacatttttaaaagtatgaccaactacgggttgaatatccctaatccaaaagtccaaaatctaaaatgctccaaaatctgaaaatttttgagtgcctacatgatgttcaaaataaatgcccattgaagtattttggatttcatatttttggattatggaagctcaactggtgagtccggttggccttaaaacaagatgtgtttgaatcatgcaggtccacttatatgcagatttttttcaaccaaatgtgaattgaaaatatagtactcgtgggattcaaaacccatgtatacggagagctgacttttataaatgtgggttctgcagggccaactttgagacttgagtatgcgtgaattttggtacacattgcagggggcgggtgtcttagaaccaatcatctgcatatatgagatgaccacaaatgttccaaaatttgaaaagatccaaaatctgaaatacctctgtcccaagcatttaagataaggtatactttgtatgtaagataagggatatatgctgtcggttagggactcacgtaggatccaaagttgaaagtaaaatgatgcattttgggatggtgaaaatgttacatacaggtggcagttgcacaatgttgtgaatgtaccaagtgccactgaattgttcatttttaagtggttaattttatgctatgttaattttatctcaattttttaaaaagactccctcaatttagttttgtttcattcatctattccctatttatttgcctctctagattataaaattgttgagaacatggacaggagtttattcctctttgtgctacccagcacagtgcctggaataataaatatttactgaaggcatcactaagcatggagttgaacatcattgaggggctcagacactggcggctgagtcaatgccatgcttgctgcaggacagcctgcccaggccatctcagtctcaggtatttcttcatagcagtatacgaatggactaatacaggcccatattccaagacccttaggaacaagtggtaattgtttactatctagacgggactctcctacttgataaaagtctcctgctctatagctccacaaacagtaaatttatttgaaatcaataaatgaatgattaagcactgtgactggagagggccgaacagggttccatttccagatgtttcccaggcactgatgattcacttcctggggccgggcaagttccgaggctcctcagggtctcctcaaacaattcaggcttctttaagcctccagcttgcaactatctgactcattaagttgaagttggcaggaaagttataaaggttgtacttgaatcacagtcctgagatcttgggttgagatgctttttatttagcttgtgcatcaccaacttgtaaaaaatatcttggtaaaaaaatttaaaataaaactttaaagtttgtgttatgacagattaaacatttaatgccacatggtgtgtatatctcaatggaaacactgttcttgtgtgttcagtatctgtgtgcatgttaatcttcctgtgagatcataaagctctgtaagggaaagggtccaattgtctcaccttgaaaattccaaacctagcaaacgcctggtgggaaatacaaacccgcaggcgtttctgagtgaacggaggttgtgccaggtcaaatgctcactgctggtcccgtcctgctctaaaatgttcagatgcataatgggttatttttgttggtatttgggtgggtcgaatgctcactgctggtcctgtcctgctctaaaatgttcagatatgtaatgggttatttttgttggtatttgggtgggtcaaatgctcactgctggtcttgtcctgctctaaaatgttcagatatgtaatgggttatttttgtcggtatttgggtggtatttttgctctatgacctcccatttctctgacgtctctagattcctttgttatttgtgatttctgcttctggtggtgacaacaaaatctgccattgctgtgcagccgcctcacccatggagcaggcttatcctctacaactattctacagaaaagacaagcaaggtctgcgtggagtgaaagcgccttctttccatatcggatgctggaagctgtgatgttggcaaacggctctttgcatgaagtactgtgtactgaaccaggaaagtgaggtgcagacgcggaagtcaggtgcagatgtgttgggcagatgagctatggtgatggcgggtggccattccctataagagagtggctcctctattattaacaaaataaaaattaaagaaggtttccattgagtttgctagttcttcactagcaatattcccagctggttgaccttcatttgttttagtttgatttcatccaacacagctttatcttacctgctgcccacaccctactcttgagagcacgtactcctggcaggaccccaacccaggaaaccctcccatgccccaggtgccgtcccctgaccaaccagcctcactctcagagacaaggatgaaacgcatatgaatatccactctaatacggttcagagaaggatgatctgttatctgaaacttttactgcaaaagctcttttaatcaaaaccttcagaaaatttgaattttactccttgcaaagattatttggttaaaaaaaaaggacactcacaacaattaacatatgactggggatgtgtaagaacagcgaagagaactggacaggctgtgtcctgggaacagcgcccggtgcacacacccctttccatcttccctattggcaccttcagtccccggaggcgctgctgatgctcataggaagggactaaggccttcacagtctgtcaacaggagggtcccatggggctccatcacggtctctgggaccccccttccactgcagcaaagtggacaggtgcactgcatcaacatctcaacaccgggtgaaaagggaaacgccttactaaacgatgttcccgtgatcagaatcacgggctaacgtccctccgcttccgcagtcttcaggcctcaggcactgccagtgacattagctgctgtgcgtccctcctgccggactgcaacaccgtctcaggatccacctcccaccatcttccctgaccatggccctgctccatctgatttgtttgtcctctgatcaggtggggcctgagtccggcagtggatgccagtgagtcagccatggttggcagggactggctggctgcccccctctcttcattggccccgcctgtctggcctgggcgcccactcactcctgctgcacctgccacaactgccggctgatcctgctgctctgatgccccctcacgtctccagcctgcgccccgcactgcgttcgctgcccatcttcctcccaagctcacagtctagctccaggtgcctgctctccttgttctgtgtctgtttctgcacaccctgcggggaggccaggctcacccaagaaaagagtcaaggctgcaccatgaagcctctcgggctgggcagggagtccaggccctgggagccccccagagccccccacagaatgtgcagctagcctcgccagacgcgggcgatggggccgaaccccgcaggacaacttaggaggagtgaagagtggaagagtgcccggtgcagggatgggtgggaggaacctggggtagtgtgcacgcctgagacagggtgggggacacgaagggagacaggcgagggtgggacaggcaagggtgggtagtgtgcatccctgagacggggtgggggacacggggggagacaggcgagggtgggtagtgtgcatgcctgagacggggtgggggacacagggagacaggcgagggtggggagggagacgctgactccgtggtggaacgtgggtaggtgataggctggctccctgagcagcccctcccctgtggtgcagagctgtgggtctaggggtgagggagccatcatctcatctcacgccatggagacacaggtgtggcttctgttcctgtatctctagtaaatgtttccttctgagaaactgggtctgtcagcctctttctcaggcctcttggttccctcagacttgggggtaggtgtgcacaggcctgcctgccaggggacaggaaccccaggggaaataaaggtgatgctcaaacccagaccaccgaatgctctgaacacacttgcttgctttcaggtggaaacattcacagtgtccctgggtacagcagacttcatatcacagagacttccctctccaggacgtgaagatgtccatcaccgagacgtcagcacggcaggtgggagaaagccatgcacacagtgaaggggacggcctccattggcccacagggtgagctatccagttccaggagccacctgaccacagggtgagctgtccagtgccaggaaccacctgaccacagggtgagccgtccagtgccaggaaccaccggacccacggggtgagccctctggctcgagaagtcctcagcgacatctgggggtcctgtgcatgcaccatgttgactgtacccgtgtgcagcttgcacagagtccccagcagctctggggagggctccgtgttcaatatgtgatgagctttcgggaaggacaggagagccgggtgtgagaagcctccttcctagggcctgtgtctctggagtgcacgaggcagatggatggagacgtgggagcaggggctggcagcactccccgagcacagtgggaactcaggagcaggggctggcggcactccccgggcacagagggaacggcctgggtggcatggagagtgtcctcccaggatacagcggagtgcccgtcaccacctgcccaccttcttcacaccatgaggctgctggcacgggtgcctttgctgccggctgctgtctgtgctgccctgcaacctggatccacatggctggaggtccggtgtccctaaagacttctatgacatcctgacactgccctgcttggacactctctggacaggagacacctcacccctcacagacatctcattttttcagagctgcatcatcagagcagttgggggacaggagggccaagtctgaggactcagacccggggcagctggtggaagctggggttaagagtggaatacatggccaaaggatccctcctgagggtgagggcgaccgagaaaggaatgagggcataagagcggtgctggagaaatgtaagcaaatccgcatttcgaagcagaaatcgctggtttaaatattctctcctttccctcaccatggaatgcacaaacgcttgaagatgcatgtgtgttagagtctcttccacagaactctctggaaaggccgttccaagagcttcaggtgttcaggttcgtatctgaggctgcaacaggcagagccacttccagtttcctgactaaaaagtgaaagttccagaagcattcctagatctgtggtgtgtgtggtgcacgtgtgctgtgtggtgtgtgtagtctctgtatgtgtgtccatgtgggtggtgcctgtgtactgtgtgtgctgtgtggtgtgtgtggtacatgtgtgctgtgtggtgtgtgtagtctctgcatgtgtgtccatgtgggtggtgcctgtgtactgtgtgtgctgtgtggtgtgtgtaatctctgcatgtgtgtctatgtgggtggtacccgtgtactgtgtgtgtgctgtgtggtgtgtgtggtgcacgtgtgctgtgtggtgtgtgtagtctctgcatgtgtgtctatgtgggtggtgcctgtgtactgtgtgtgctgtgtggtgtgtgtgtggtgcacgtgtgctgtgtggtgtgtgtagtctctgcatgtgtgtctatgtgggtggtgcctgtgtactgtgtgtggtgtgtgtgtgtggtgcacgtgtgctgtgtggtgtgtgtagtctctgcatgtgtgtctatgtgggtggtgcctgtgtactgtgtgtggtgtgtgtgtgtggtgtgggttgtggtgcctgtgtgagaggagtggtctcagccggggtgatattaaggcctgcagtacagctccagaccccagagcgaggccccgcctccctgccgagccccagaaacccccttttcaggggtggaagtgggggtggcctctcccatgcagttgagtgtcctgggagggaaagcacagaagttctttctggtatctttagaaccaaatcaggtgaggtgtttaagtatctcatatgttttttggtcatcatttctatttactcctgcaaaattattttttaagataaattaaaagaataataaaccgaaatactagacttaaaatttaaaaatttagaaattgctggcaatctttttgtttttacaaaatgccacttcctagtttgtttctgggtagtgtgggagtgaagcgggtggggtggagggtgctgggccagtgtgcctctcaccgtccccaaggagccccctggagatgcagtccagaaagacggatccaccggccatcccaggtaccaggagcagcacacacgaatgctggatttgtgcctcacactaaaaagcagcttggtgtagctgcgaattttctatccaggcacatctcttcactgctgattaagctacctctttttgccaaacatactctatatttgtgctggatcacaggtaatttggtggagaaaagcaattccaaggaacacaggggagggtaccatcatgtttgtgatgcatggaattccttgcagctgggagacctatctagaatgctgagccgggctcacatccccctgggtgggagctatttctaggtctcatcagcagccaggggagggcttaccagtaatttttaagccatttcaacttctctgaaggcaaaacctgggaaagcaccgcaggcccatcacagatcccctgagagaagcaactcctcaattctgcacctgcgtctgcttccagacagcacacagcaggagggttatccaagcatttgaagaaatgctctccaggatcaactctcttcttcagacaactcccaaccattgtggttttaagtggcagggcacagctcagaagagaaagacaaggagggcaaggcggcaccgcagctcagccccgcagggtgctagggcggacaccctgcggggtttgcctgggctctgcattcccatcccttcattagcccaggggtgtggaacagtttgcacccagctctgggtcttcatacgtggaggtcaggagagtctcaaatagtgcatctgagaaaacccccaaattggtgcgatttccaataatacgtagcctttgcatatttctaaagagagtcagaggttggaaggaacccaggagaccaagggagaaacccgcacattctgacaggtgcgttttctcatcaggatgtcagctgctgggacactgccccaggccattcgtgtgctgctgaaactaggatgtgtttctcttgtgtttggatgagattttattcttcctacgtgctggcatttagtacactgttgtttatggctgtttgatgagaaaagcctagggacggctggtttaaggtaagaacattcacagtgtgttatctgcatgcccagggctgtgagggagcagaagacacagggttggctccctgacgtgttggagacagcaagagacgtggagcacatctggagggggaggctgggctgctgctgtagccgtgatcgctccggtccacatctgggttcatttggtgtgtggacacaggtgtctaccgagagggttttacctaagttagactaaacaaggctgcgagccagtcccagtctgtgactctaccagaagaggctgggtccctggctgaagaaatgctgaaaaatcctcagacacaaatgaatctgttcgactcaatgtgcactcaacaattgactggctatccctagccctctttgggtctaccagttgctatttcttgcgtgggcatcagcctgcacacagtgaacaaaagcagctggttcagagctgccagtgctccccaggggaaggactgacagagtgatgccaagacagggctgccctcctccctagggaatgtccaatccatgcatggccaccagaatcaagggcccacagaggaatcaagtttcaggggtcatggtgggaacctcactttcccagaggataaactgttacacagaaggcctgactgcttttggtttcttagcctgtgagttggaattcatttgtgtgactaattcatgtttggaatttacaaaaagaagttgtttcaattgccaccaagtaaagggttcatttaaatctgcaaccttgctagaatgcctggctcatgccactatgaaaacctgcatctgagcccattctgttttgaatggtggacacctagagagtaagaaggaaaagggaaggaaaggtcctacccaacatcagaaccacatgagcgaatggccacttgggaaatggaaatacatttgacctccatggctcagagaggttcagaagggttaataaacagctcaagcacttgcacctgagagcccactgttactctagagcaggggacaagagtcacccaaggtgactataagtccccacaaattcatctgatgtgcacttcccagaatctgcagcaccctgtaccaacccccatcccctctccacagcaacagtgcatcctaactgtgagcttaggagacacgtatttttggcatctaggacttaagtattaatccctgggggggtgaattccataaattaaggaggggtacagtaagaggatgagatgtttaaagagaagcatatccatggaatcaaaatgcgatcagagcattatggccaaataatccctaagaaaaacactgatggtacacacaacagatacaagattcaaaataaatcatcaattaatacttttaaatagtattattgtattctttttatttatctattactattaataattattatttgatggtacaaagtgaaaaggattataagtgagtgtgatgagcatttgcacacctacaaacaggataacacaagaaatgggaaaattcctagaaatacgcaacctactgagactgagtcatgaagaactagaaaaccgaccccaccaggagtgagtaaggagactgaaaccgtagtcaaaaacctcccaaagaaaatcctgcagtcactggtttgatggataaattttaccaaacatttaaagaaggattagcaccactcctcctcaaacttttccaaaatattgaagaggaaacaatttctaactaatcctgtgagtccagcattactctgacacgaaagccagacagacactacaagcaaacaaaactaagaaccagtatcccttataaatactgatgcaaaaaatcttcgacaaaatactagtagacaaaattcggaagttcagaagcatattaaaacgattgctgtaccatgaccaagtgggatgtattcctagaatgcaagaatggttcaacacataaaaaataataaacgcaatacaccccactaacagaatgaaggaaaggacccatatcatcatctcaactgatccagaaaaagcatctgacaaaattcaaccctctttcatgataaaaacgctcaacaaactaggagtaacagaaaatcacctcaacataataaaggccatatatgaaaaatctgcagctaatgtaacactccagggtaaaagatggaagacttttcctttaagactaggaacaatatgaggaggcctgctttcaccactgttattcaagacagtattggaggtgccagccacaggaattaggcaagaaaaataagtaaaaggcatctaaatgagaaaagaagacataaaattgtttctgttcacttatgatatgatcctataggtagaaaatcataaagattttacacaagagatctgttagaacttaatagaatttattaacaaatttagtaaagttgcagggtataaaatcaatatacagaaatcatttgtacttctatacactaaaataaacaatgccaaaaggacatttaaaaagcaattccatgtacaatagcatcgaaagaataaaatatttagggtaggcttaactaaggaggtgaaggacatgtacactgaaaactacaaagtgttgttaaatgaaagaagacacaaataagtggaaagacatcccatcttcacgtattataaggctcattattgttagcttttaatactacccaaagtgatctacagattcaacataatctctaccaaaaatattgatattttttcagagatagaacaacccatccaaaaatttatatggaatctcatgggaacccaaacaaccaaagcagtcttaaagaaaactggaagacttgctgatttaaacttacaacaaagctatagtaatcaaaacagcatggtcctggcagaaaggcagacatatagaccaatggactataaaacggagcccagaagtaaacccttttgtgtacaaatgctttttgacaattgtgccaagaccattcaatgaggaaaagaataggcttttcaacaaatggttctcagacaacttgcaaaagaataaagctggacctgtaacttacatcatatacaaaacttaaaactgatcaaatatctgaatttacaagatgaaactataaagctctaggaagacttagggggaagcttcatgacactggatttggcactgatttctcagtatgacactaaaggcacaggcaacaaagaaaaataaacaaattgcactttattgcactttatcaaaattaaaaccttctgtgtattaaaaaacattatctaaacagttaaaaagtaacccaaagaatgagagaaaacatttgaaaattacatatctgattaggagtatctagaacatatgtaagactcctacacccaacaacaaagaagcaaggattggaatagacatttctccaaagacgacgtgcagatggagagtgagcccatggtgagctgttcaacatcaccagccattaggcaaaagcaaacaggagccatgagatgccacttcacactcctcaggacggccatcctcagaaaaccagaaaacaagggctcatgagggtgtaaagagactgaaactcgtgtgtactcctagtgggaatgtaaaatggttcagccacactgggaaatagcttgagaattcctcaaaaaattaaacatagaattaccatttgaccccacaattccacgtgaggtaaacactcaagtaatgcaaaagcaggaacttgaatggatatttctacactgacatgtatagcagcactattcccaacagccagaaggtggaagcaagctgagtgcccatcaggggaagaacagataaaaaacatgtggtctatacacggcggggtattattcagccctaaaagtgaaggacattcatccaagctacaacacgggtaaaccttgaggatattatgttaagggaaatgagttgtatatataagaggacaaatattatgatcccacttctctgaggtccctagggtcatcagatccataaagacagaaagtggaacggtgggtaccaggggccgggggaggggttgaggagttcttgtttagtgaatacagagtttcagtttgagaaaatgaacaagttttggagatggatggtggagatggttgcatgacactgtgaatgtacttaatgccactgaattgtacaggtgaaaatagttaaaatggtaaattttactttatgtatattttaccataacaaaaacatcattgcaaaagaagcatgggaagaatcataatcaggtgctgttttaaactgtaaatcaataaaacctttctgaaaaaggagttgggtggcacatgtcaagaacagataaaatatagatacattttaaccatctaatttcaattttaaaaatacatctttaattctttccatttaaaaaatgtgcagtaaacattagatatagaaataaaagctctaagaatagggaaatagctaagtaaatatattttcatggatgaaaaattattcatccgttaaaatgatattacaaatgttgaaaagaccaagatatttttatgatacaatgataaatgaaaaacaaaaacaaaaacaaaaaaacatggtcaggcatggtggcttacgcctgtaatcccagcactctgggaggctgaggcgggtggatcacctgaggtcagaagttcgagaccagcctggccaacacagcaaaaccccgtctctactaaaaatacaaaaatcagccaggcatggtgatgggcgcctgtaatcccagctactctggaggctgaggcaggagaatcacttgaacacaggacggggaggttgcagtgagccaagaacatgccactgcactccagcctgggtgacagagcgagactccgtctcaaaaacaaaaacaaaacaaaaccaaaacaaaacaaaaaacaagcaaaaaccaaaaccatggaagtgaaattctcaattatattaaaatatgtatctgtaacactcttgaaggaaatatgccaaaatattcacagtagttatagtttattagagagattatgaagaaatatttttctttcctcttttgattttttccaaaaatttcacaatggcacacaatatagatattaagaattattataaggtcaggcgtggtagctcatgcctgtaatcccagcacgtcgggaggctgtggcaggtggatcacttgaggccaggagttcgagaccagcctggccaacagggtgaagacccatctctactgaaaatcaaaaaaattagctgggcatggtggtacacacctgtaatcccagctacatggaaggctgaggcaggagaattgcttgaacccgggaggtggaggttgcagtgagttgagattgtgccactgcactccagcctggatgacagagacagactctgtctcaaaaaaaaaaaaaattataaaaagtcgattaaaacaacaacaattttaaaaagagggcaggaaagtggtctagtgcccaagagacctgtctcagcattaaagcatccatttaataacggtgtaatcttggctttgttatttagtttctctattcttcagtttcctgatttgtaaaatgaaattttcaggtgactgcctttcagcactcacactcgaaggcacttagtaaattcggcactcatattctaaggcactaaacacatgtgtctacttatgggagcccgaacatgagcctctgtcaggtttatggaggatgagttccagtgggaaagaggcttcctgagtcacagtgagcccaggagacccggcggcggccgcaccgggacccggggtgtgtggagacccggcggccacacctggacccggggtgtgtgggaggctctggaagagccactctgtgtcccaccctctcactttccctcctgctgaagaggcctcagtgcccggcgggtgcacacaagcggcgcagtccctactctggcgggaaacacaggatgtgaaagtattttatgaaacagtttcagtgaagaagaaagtgggtcattttctaatttgaaaaatccagagtcttctatttttctttgaaatttaaggagaagcaaagtgcttttaaaatgtttgcgtattagcataaacgattacaaatatttgtgtgtttcctggtcgatgaaaacacgccgctgccagcaggatgagatccgaatgtgaatggccacacttcagcaggagtgttattccaccagcgggagcgttattcccccagcgggagcgttattccccttcccgtttcctgttccttggtgttgactttaatgcatatgttcagatacacagaggaatagaattgtcaaactcggtcaccagcaggtctctcattattagaggacaccctgatccaggacagcagaccaagggtgcttagtttttacactatttaatacacagattattttcatcaatgttaagactacagcttcctgaagtcagaccccaggccttttattggtacctacacacccggggtcaggtgcagcctgcacatggcaggtacttgaggaacacctgtggacaagctggaagagtccggtgggaagggttttcagtgacaagcataggaagggttcgtgacacctgttcctattacagacatggggaggttcaaagtgaaccagtcaggaataatctcagcctcaccccagaaggaatttacaaatgaggaccatatatggcatggactagagggtcatatcaacccacagactgtggcattcttggttccattccccactatttggataaccttgagcaaggtagtctttgagccctgaaatggtgaggaacatgcccttagccatgggatgctggcaggtcattgatactgtcctatctatgaacggggttttcctgtctttaaatggggtgatgaggccacctcgcaaggcagcatgcagagaagcaagtccacacggcagacactcagccagcgcagcgcccagcacagacgtgctcagcagacgcacactctcagctctgacagccacggtgcaagtcagatgcaagcctgcaggctgagccgggcagtctcctggcctcaggtggacctgcagtcagagacagtccctcccttctgcggcatcctttccttcctgtgtgcacgctgtagaatagcgggctgggggtgtttaagaccagaagcagaaaactgacaactttgttgcctggaaaaaataaggtggacaatactggaactaatggcagaaacaaggttttggagcaatctacaatttattgaaagcagccctgagtcccaggactaaaataactaagaattggtttggttttattatttcttgttaagcaccatgtctgaggttaagacccagttcttaaaagtaatcacatagatacgtgttacacacatcagttcagttgctaaccagcccatcagcttggatgtaattacttcacacgttctctgagaatgtgttccacacataaagaatttccataatggccaggcagccttgagtggaaacaggccacagttcgggcctgggagagaagtctgcaggggggagatctgtggtcatgccctcaccccatccccagggcagacgatgccgcttctcagtgaggtccccttggcttcctgtcacagcacctcggtgctagtccacccgggagatgccagaacagggctaactcgttcatctttccagtccaatggccggggttgctacatttctcaaacttaatttctatcattaaatccttttgttttgttttatttttggacagacgagttctccctatgttgctcaggctggtctcaaactcctggccttggcctcccaaagtgctgggatttataggtatgagccactgcacccagtcattaagtcctaattacatgttatttgccctgttcaagttcaagcagtattttttttaataaagattattcccaatagatcttagtcttcatctgtaagaggctgttgagggcacgaccacctcgcagtgacctccctctgtgtgggacccccgttcccactggcacaccatggggacagctgggtggggtagtgttgagttctggtcctggtcccaccgacctgggctggagctcccagatgctccacacacccacgtctacagaaacactaggccagactggggtccgccccacacgcacagaggatcactgggggcgatgtagagatgtggaagctggaccccaccccccaggctaattcatcagcaagatgttggcaactgctgggctggatggttattagcatattaggatgacatttgaccctaacattccagttttgtgctaccaaaaaaaaaaaaatcacctgaatgagtcaagacagttaaacttgagggtgatttgggaatgaggggaattcatccatttgaggttaaatgtttgccaatctaatttggtcaaaacagttcatccacaaccccgtgcaggccacaacacaggagcaggtgcagcagggcccttgagtctgtctcacgccattaacaccctgtgatggccttacttggcgtgtggagctgtgaccaccagggccaacctgaggcagcatcatggacttgaccgactcacctcagagcttggcactgggtgctctgattcccttcctcaagcttcccacttgaaggttggtgtgaaaccccaccccactcaaccctggctgatccccatggcctgttctttcgacgatcctcctcttgccccaatttctccaccgcacagactcgccagggctttggtttgtgagtgccctgcactctgtcagttgggccatggtataatttatgttcaacagagacctttgggagtgagtgtcagtgccgtagcggaacacagggatctgaggcacaaggcagggctgtcccaggcaaacagggacaccggccccttcatcagtaggtgacatgctttcattcaataggaaattccagaacaccaagaaagggatctccagacagggacctgaaaacaggatatggaggtagatttgtgggagagagttggaaagggagctagcactctttgagtacccactttgtgctaaatacttagtttttgactccatatgtatgaagattaccatatttcatcaatttcaagacgaaccctttttcacagtgtaacccctctgaagtcaagatgcctcttatgaacactggcaagagagtttagctggagcatagccctttcctgatagcacataaagagacggtgcccctcaccagggttcctggcttggactggacagacgacagcaccgcaagcatctcaccatcgagagactgagccttcccaacaccatttggcattcccagcttacacagctgagggggtgaagcaaggttcaaatcaaagtcagcactaataaaaatttctaggtttccaaccctacacacccatttgggtcccactcaaacatcaccacagggtggctctccccagtcacccctcaggcctggcccagtgccatgagaactgggacctcaggagggtcagagccccagcaggttccagctctcagatcaaggtgttcttttcttatcatcttctttcttctctttcccctctcctaaatcactgctcactctctgccccacacccaactcaacatttagatgctcagatagcatttcagagtcttattttatgactttctgaagaattgtgctgcttcaaaaataagagccccctcattaccaaaaacttaacccaaaagtgcacttcccaaaatgcctccaaataagtgtgggaaatccaggaagccctcgagagccactgaacgcctctgtgcccagcactttgaccagcaccgtggaatcagcttcccaaagcatgcatggggcactggaatcccagtttcacagacacagagacacagaaagcttgattcacaggcaggtgccaggagaactgcagttttatccctgtaaagtctaattccaacaggagtactcagccacattgaacttcttctcactaagaaaagttatctcggtggcctataaactctttggaaattgctttgaaaacatgttctaggctggtgttttattatttatgaagcaacactgctgtcctggtttaactgccttcctgtgaaagaaaaggcttcctgttttgtttcctgagactcctctttctccttcatgtcatcaccatcaccaccatcatcttcattaccaccatcatcttcaccaccaccatcattttcattatcaacatcttcatcaccatcattaccatcatcttcatcactatcaccatcatcgccatctttatcatcacctttatctttattatcaccatcaacatcttcatcaccatcatcatctttatcatcacaatccccattatcaccatcatcaccatcatcttcatcaccaccatcatcttcattatcaccatcacaattatcactatcatcatcaccatcatcttcatcattaccatcactactatcaccatcaccatcatcatctttatgatcaccattatcttcattatcaccatcaacatcttcatcaccatcatcatctttatcatcacaatccccatcatcttcatcaccaccatcatcttcatcaccaccatcgtcttcattatcaccattaccattatcaccatcacaatgatcactatcatcaccatcatcttcatcaccaccatcatcttcattatcaccatcaccattatcaccatcatcacaatggtcactatcatcagcaccatcactgtcatcaccatcatcatcaccatcatcttcatcaccactctcatcatcatttttaaaaaggattgcattctaaaaagttctgtgtttgaaagtatatttgttttctttggctgctgttgtaacaaatcaccacaaacttagtggcttaaaaaacccacaggctggctgggtgcagtggctcatgcccataatcccaacactttgtgaggctgagacaggaggattgcttgagaccaggagtttgagaaccacctgggcaacatattgagatcctatctctattaaattttttttaaaaattagccagatgtggtggctcacacttacagtcccagctacttgggaggaccccttaagcctaggaggtcgaggctgcagtgcactgtgattgtgccactgcactccagcctgggcgacagagtgagaccctatctcttcagaacaaacagacaaacttattgttctgcaggttagaagtccagcccgggtctcactgggctgaagtcaaggtgtcggctgagctgcactcctttctgaatgcggatgacggtaaatgggatggaaggtgcaggtagagactctgtgtggcaggttctatctcatttacgtggctgggagttgtaaatgccatgagtttcttctgtttgttggaccgtaaagcaatggaggagtgggtgaaatctgactgtgggctgagagggctgtgtgtccccgtcctcactcagaggcagacaaatactccatgacatggggaaaaggagaacgatgctgacccattccacaagtcatcaactcgcacaagttatgtatgtgcagtttactgagagtcagtcatacctaaaaagagaaaaactcaacaaacaggagggtggacattgaaaagtatctggctgaccctctgtgagtgaagatgtatttaccttgggatgaatgatcaggaaaaataaaggctgaatccagggagaaggggtctgggcagccacaaagctatgggacacaagtccatggaggtccaatgagctcatctcatgcacggttctctttttgtgatgaacaccagtgtgaccagtgtaaatacaatattagttggatcatttgttagtaacatacctttggacactggcttcattcttcagtatcttccctttatagacttggctttctgggagctggatgtttacccagtaccacctagcactagtaaattactacagcggagggcaggggaggacccactactccaggatcatttgtgggggtggcacctgactcaatattaaaaaaattcacatggtgttttatggtttacaaggcagccttgaacatctgacaccatgtaacaagcggtaactgtgagaagtggggatacaggaccaggccttctctccaaaccttgaggttacctttcctaggaatgcagagctttcagaatggtgtccattccactcactgcatttcagcctctgtggccttgggcagcacctgtgatgcctgtgctgactggcatcgtctgcagtaagtgaggagggcacagagccttccatcaatctgttcagggcatgatttgctgcaaagtgagttgtgaaaactttcggttttcaagagtttctgggtctcggggttgtgtgaatggatgtgaaccagcctccttctgtttttccaggggatctaacaaggctcgaacgctggagccgcatgtctgcgaccactcagcaggtgccggctggggctgggctcctcagacctgaaacactgacttctctatttggcacatctccagggtcatccttgcagatgaagaatccagcctgggtgtctcctgacccatcatacagcctagaagggtttgtgttttgttttttccaagtaaattcctgctatcattttacttattttattgctgtgtgtagagtgaagaagatgctgaaaaaaaagagtgagagaaaaaaatcccgttgatcctggtagatgggatatatgggaactaattttatatccatgcatgagttaaaacgagcagtaggcacatttcccatgggcgatggaagtgacctctgtcggctcagtggaaggtgccgaagaaacagcaagagacctccttgtccaggtagccacaaaggaatttccttttgaaatgtatactcgttgaaatttttaatccaggataaattatgagagtctgtactgcacatgtcagatgctgcacatgaagggttaacatcttgcaatatccatggcatcaatgtttccttttttttttcatcttgctctgtcactcaggctggagtgcaatggtacaaccatagctcactgcagccaccacttcccaggctaaagcgatctgcctgcctcaacctcccaggtagctgggaccacaggtgcataccaccatgcccagcttatttctgtattctttgtagagacgggatctcaccatgttgcccaggctggtctcaaactcctaagctcaagtgatccacccacctcagcctcccaatgtgctgggattacaggcatgagccactgtgcctggctgccagtatttcctctttgcacacatcctgcacttgtcagtggccacttgcccacctctgatttctcaagtgaaatcatcatgagaagggcatgagtggggagctgggaggtggtggcaggctgggtgctgcctgggtttcatcagaacctcctgaggtgggggccaggggtagccatggagttgggagttgtggaggaggcgagatgcttggaaggaagctgtggacagggtctgaatgggggtggctgagcctgaagctggagttgagtcctggtgggagcagaaaccttgggcacctgggagtttggcttagacagattgggctgtgcatggtggagaaaggcccaagcagaaaagctcctgaacaggcctggagcttgcacaggagaaaggctggagtcacagacctggatgttgactctcctgatctcctaagggagagaggagaggaagaaatgaacggagggtcttgggggaaattccccaagaaataagtgagtagcaaaaacaaacactgccagactcctgaggccaacgggatccctgaaggtgcagggacttaacacagccaccaagaaaatgcaggtgagaggatgagtccaggaaaaacatcactgggctggcctggggaaattggtggccctggcaaggaagttgcagaggctcagttccaggaacacacagggaaaggtaaaagacatttgtttcccacagggccagggctctaccagctcagttttgtattagacactggggccacactgttggaaataataatttagggataactgcacaatatacttgccacctttgccctatgaactccccaagagctcaggacacacattgagaaacaccagcacacaagtacccaaggtcatctgcaggcaaatagaaagcatcgtggaagcaatgctcattagacccacacactgtcccaggtgctctgctcagcagaaccgggggacagagacagcatcccaactagcagggaggtgacaatcccaggggaagaaagaaggggaaagtctctattccagcacaagggtctgaagtcatgaaaatagagcagagcagggagtgaagctgtgccagagccacgctgatggcgtcctcaccattggtgcgggtgggtggccagatgcagctgcgcagatggcaggggcatgtttcctcctctcactgtaactggcagcagtgtgcttcattgtcacgctcagagcggacccccccccccacaggttgcccaccccagggcaagacctagatcctggtgagccttggtgggacctgtgcccagcacaacacacatggacagcccagcaggggtagctgtgcagccagtggagtggcttctgtgcccagcatgccctctctggggctcattctcgtgtttcctaccctaattctaagctcattcttcagagctcacagtgcccctgacactccctggtccccctctctgcccagtgaccaaagctggcttgtccctgcacgcacgaggcaccactccatcacatgacttccatctgcctggcaaatctgcaccatttttggaagcagctgaaatcccatttacccagtaaagtcagctgaaataatcctagagaaagttcaccacctcttcctctgcctgtgcctctatcacagatttaataacacacccttgtaattcatcttgcttatgtgggtgttttctccatgagttcttcaagaaaagagctggattctgttcatctttgttcttacccctgagtatccaactcagagctttgtacatactaaatatttgtacttgtactgaatattttttggaatgaataaatgcatttttgaagcatcagaccttcaataaaaaaggttatttttttcttatccatcacgaatccgtatttgaagatttctggaagaaaaatgaatcagaaaattcagaatatccaggtgagtctggggatattccaccccagtgcagcatagacacacctcaggacagagaaattgaagttggtggggtttcttaaagctcttgctgtaatgagcgccacttggaagtaatggcttaatcgttattaatttctttggtatttcctatgataacattaatcacagcaaactcatttgatgtaatggagaccaggaacccccctggaacgttccccagcaattccgtgctaattaactgaagcatcttgtaaaactgccaccctgttttacgattaagtgcatttcttgcacactttgattaagacacaaatcccaagccaataaaaaaaaaagtgggaaagaaagaaagaaaaaaaacccaccgttttagaatgcagtaatgagagcattggtaaagtaacagagacttcactgccagaggcgacaatagctactacttgaagtgaagcaaaaagaactccccagggatggtgtagactgagaaaccttcttctgtaccttaatttatccactgcatatgtacagaagcaattttaaaatgcatattaaacactccagtgaaagaaaagagaataattcacaaagatgtcagttctgcatacccaagtgagaactatgaaagcagagagtcctatgcaaacttatatcaaggtatggaaaacaccttttaccacttaaggtaaatgttcaatttccagagggcaaatcgtgcgctgcctcattcagcagcagaatttttctccccaatgattggcatttggctatcaaggcagaagaaaatggagcatatcacaagattgcacagcttggaagtgtaaaaggcgttcactagaacaggttctctggcacccagcatgccaaggtcctaacgaaaatcgtgtcaaaactcacgtcagtcattctgtgttttttctccactggttcaaatgcacatcattctaaggatgacagacacatgcagaggcacctggaatgaggcaaatgggacctcgggtcttaaaggatgaaaccagagcacatgggcattaacctgctgactgacagcagctcaggacgagagaatgcctatgtcacccaagagaagggggtccaggccctgtgggagagaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggcactccacaccacgagagcagggcttcagagaccacgggcactccacaccacgagagcagggcttcagagaccatgggaactccacaccatgagaacagggcttcagagaccgcagaaactccacaccacgagaacagggcttcagagaccgcagaaactccacaccacgagaacagggcttcagagaccagagtaactccacaccgtgagaacagggcttcagagaccacaggaactccacaccacgagagcaggcttcagagaccgtaggaattcacaccacgagaacaggacttcagagactgcaggaactccacaccacaagaacaggcttcagagacctcaggaattccacactgtgatagcagggccccactgaagccaggggtgacataagcctgcactctgggctgcagcggcctcactggcctgcaggagaggccccatgagatgccctggagcagcagtgggtgggaggaggttgtgcaggggccttcgagggatgaagcagctttgctggcagttttggggaagacagccctacttggcctgcctttagttcatgggctgataggacagacacaggatttaaaggccaaatagaaccacataaaacctgcagatgtaaaataacaaatagcatgctgtggggaggaatggggaaagggtggggggaaataacagggggtaggctcttcaatatttaaaagttccagacatccacagacttcttatgtcattttcctgatgggagggaaatgaatttccaatatttatatacaccatttaaataattttgctaaataatcagaggtcttagagaaagatgtgcatagagccaaacaagctgtctacatgagacacagccacagccgggtggggcttaccctgtaaagaatatccttctgcacagcagaggatggcctcactggattagatggctctccttgaatcaaagccctaattttcaggtaatggccaagatataagatgtaaagcactgttgtaagatttttaaaatctgtactattttttgtaatggcaatgtaaaatttaaaaagatgaaagcatagcaacaaagataaaataaatagcatgcttttagaagaccacgcggcatggaaagcagtctctagcgctgtctttcttccgttagggtggactggaaccacagggtatgaaaagtggcctctcgcgctgtcctccttctgttggggggactggaaacacatttctccattcattgtcagtggtgttacaagccattggtgagcttccttccagagtgaatgccaaatgatacatttatattagatctctctgaccactgctgttgacgttggcggggtagcaggtgtggccataacatggagcacaggctgagctgcctgacttgcactgctggacggtgggttggcggtgttgacgctgcacaggtcatgagcgccggccctgcggatccggcgatgatcattgtggaaagaatggacagcaccctggttgatgtgcagagtgaccctgcagtcaagtctgtttgcctcccactagcattttctcatctccagcacggtgtcaatggtgccactccagccgggccaccctgcccacaaggtcttccacggggctcctccccagctcacggggaaatcccctttaatttcaaacagggcccttccacctgcccttgattccctgtggcaccttgggagcatggggctgccctactgtggagttagtgggtccacttcgagaagacagagacagagtgaagcctcaagaacagtgttcactggcagtgggaaccgtcggtcctgccatgggacgatgtgactgggggctcgtccatgccttgtcgtggacatctctggtctcagccggcaggggtgggtgggacctcagacctcagcgggtgatggcagtgggagcctgggcaggggcgggcagggctctgtggtaagacacagagggcaggggctggggtgggcagggctccatgggaagacacaggtagcgggtcaggtgctggggaggtgttgctgggcatggtggatttgcaaatttccagggcggtggggggtctggcaagtgtagacacagggcagaagtgggcgcagtgtctgtgggtgaagagctgtgcgggcgggcactgagaagaggtgcccacgtccatccccagcccctcaggcatgttcaccatcatggcgcacatgtctgggagtgagcagaggaccagggtatggaacaagccctagtcagaaatgcctcctgacgcctgtgacctctgggcagggctagtgaggggctggggagagcagagggtgtttctggataagaactcacactaaaggcctggcccggaccctgcctccatcagcagggtgcagcccaggcccagcacattctcctcctcctgggacctcgatcttggcttcccctaggcctttctggggccccccagttcctgccaacactgctgtccacgctggggccctccagttcctgccaacactgctgtccactctcttgtccaccccatgattccaaccactggatccgagcatctgcaccctgtatccgtttctctaacccagatttccttcaagtttcaatcctgtactttcggataaggactggatgccagcccctgtctcctcatgtctgagagcctctccatctccagacaccccaatctcctcgtccctgtgatgtcggctcaggtcaccattgtgtcctcttgctctcctgggtcaggcacctaggagtccctgaatgcaggcaaatcattcctcagctgtcagctattcatattcccacggccccacgaggagacgtgcttcattctacacaaacttgggcgagctccctagacccgaactgtgcttttcagtgagtgtcacagatgtcacatgggtgtcagattcaaggatgaggccagcccttggtgccaggcttggcataaatcagccccaccagcccctgcctgccctccgtgtctggtattcatgttcaaaggagtctaaaacctcactgtcttttccatgtgaatttacctttttttttttccattgcatgtcctttaaataaccaccaggtacctactgtgtgccctgggcactggggatgcagagggtcccaaccacaatgcctgtctgcaggagttcccagggtggaggtccagctgctctgagcctggtccaaggacagccacaaactagagataggctttggacaaagcagtgtggccgaggtggggtgttgtaccccatgcgatgtggagagagggaacttctgtcgaggatggcagagcagagctgggcagcagcccagcacagggccctccctcacctgagtgctcaccatccaagtccttgtagcacaaggtgagctggaagcaaaagccaccccagctcagatgtcctggtgaaacgccgggaaaggggcctcagccagggccatggcagcttagggctggttcccatcgcgttatcagcaaacgaatcttcccagaatcaagctctgatctttcttctctgatgtgaggtgctcggcgattcccaggaggcgctgatgagttgctcagcctggcagccgagttccagcagagttgagacccagcggctcctctggctgttcctgtgttgggcattctcctgctcctagcaccggctggcactctcctctgtggcctctgttctctttattgttcagttatgaggcttcttcctcagttccatgggttaaaatccagatgcaagccccccccaccaattaccccttcattctacagagttcccaggttctcgcccactctgcccagcaccttactggagcctccaccatgaggcctcccgtgctgcctcctgggatagtcacgcatgtgcctgtgcggctgccctaccagaccctggggcctccaagatcgcaaactggtccatccctctccctgcctccagcgtctgccgaccatgcttgcacgtagccgtggacttgtgccgcagattggggtaaataatcctagagcagataactaaggtacactcttcaaactgtaattcatcacaaaactaagtaatattttgtttttaaatgtacctaagcccatgttgtcttgttgatattaaactgtgggggtatagaggtgtggtagcattttactaagtcacagaggatataaacacttctgcttaagctcccaaatcgtcaaagccaggcatagtggaagagaagttgaatcaaatcgaagtttattaacaaagatagctgtcatgccaggaatcgttatagatttcgtcaaatttcagaggtatatgtaattatgaaaagccataaacacagtagtttccatgaaaaactatgagtaggtatggaaaataaaacagatgcaagggtaggaaccacagctaatagtccatgaatctaataattagttaactgattaacgaaatgcatattcattaagcacacctgtagagagcctattgcgtacaggtgccgttccagcaccggggactccctggtgtgacccacaggtagggtggctgtgccccatgaagcttgcatggaactcaccatctgtggtggcactgatccaaattcaatgaacaaggtgatttctgatcagggctctgagctctgcgtcaagtgggaggggttaatgtgctctggagtgacaggggtgggaggggtttatcagagatctgggagccaggaaaggtctcctgaggggatactcaagctgatgcctgaatgccaagagccacctgggcaaatgtgggattgtgcctggcaggtggagggcccagagcgtgcaaggccccaggtgggatgacgtgagtgtgttcatggagtagtgtacaaggccccaggtgggatgacgtgagaaggccccaggtgggatgacgtgagtgtgttcatggagtagtgtacaaggccccaggtgggatgaattgagcatgttcagggagcagagagaatgctgctctgtccagtacctgtgagcaggggaggtgggggcgggaggaagtgagaggtaggatctggtaccatctcgagaggctgcagcagggacacttgaagatctagtgacacctaagagctccctgttgctgctgctgggggagcaggaagggggatcaccctgacaagactggtggcagctgggacaagagtcgtggctgaggaggagggaaggaggtcagcttcccgatgtgtctgtgggccggcaggactcaccgccgcaggcagcaggctcaggcacctttggtaactaggcccacaacagatcctgaactccctgtacgtcgcatgcacatctacagactaaataccaaggagttttctaaaaaggccaatgacaggtcaggtggacctgaattgttaccactaattaggataaaagaggtttacagatgccttgggccagggcagtttcccggaaagtctgaaaccagctctcaggtgtgttttgtggaagacacggctcctctggcacagggctgtgaaactagctctcagacatcggtgaaactctgcctgatctgcttctcaaacagctcccgtgtggtgctgccgccatctccgccgtcaggagtggctttgcaaagacgtcttatgctgaccgcatgtcttttggcctttcttttcaagagccaaacacttcctcctagacaagacacagcaagatactatggcttcacgtccttcctaagcaaagccagggaccattcgggaaattgtttagcaatgctctgagtcttttactcttttgaaagcttttgagctcaagacagtttctggcaaggcaagtccattcattcacacctaaagctacagcatttgtgaaaataatgaaaaggtcttaatgctggcatctttaacaaacccttcaaagtcacaaacactcatgaaagcagaagccagaactagactttgctcagaggtgagcagctgatccagctcaggggtccccagtgatgattctttctgaacaagagtcctcagctcccccacttccctctgggactgcacactttctgttcccttcctcaagggaagccttttcccctgattttctgtcacagtgaggttgcattcgtggtgaagtcggtcctggttttggggccaacctcactgctcgtggggctgacagacgagaccccaggaagcatagcgccatgatgggagaaagacatcccctgggccttcctggcgactcacaaggctggatgttcttgtctacgacacctgcccagcggaaggcccagaggggggtggctctctggagttgactctgcagagcactggcaaggccaggatccagagctgcatacaccaagggccgccctcccccaggcctactgcacctgcttggccttgcctacctgccatctcccatcgcccccgcggccctggcaggagggattgtttctctttctgtgtacaaccagaacctactacagggcccagtccacagcagatggctaatgaatgtctgctgaatggatagaaaaaaaaagaaaaatgttttaaatgttcaaaatacctgaaggagatgagaggacattgcttaagttatcagggaatgaaattcccaatagaaagacatgctaactctcagtttagaaaatattatcctttaatccatggttttctctggaaaaaccaccaaagttaagaacattccacatctgagaaaacacttcacgtcgctgtggctgcagcagcaatggtggtgatgacggtgacactggcaactgcacgttgctgagtgtccgctatgcactggtcatgattctaagttctcacatcacatttaacacatgacagtcctctaatgcagacactatgggagcccacattttgcagatagggaaactgaggcagctggtccagatgacttggtcactacacagaagagccatgcagcccggctccagagcgacgctgcctccggttcctttatctacctctggtgctcccggtggctgacaacgcctgcttatgtattctgctctctgcagggggtgccgctgaatgccggtccttggaggtatgggctggactttatgactcgcatccgttgcatagaatacagtgcgtgatgcacaggcataagaggtccctcagcttcctgctcaatcgcagcccaggccagcaagccaaccataccctcatgtgagtcccagagccagagcccccgactgggcagctgggggatctgtgacaacaggaacgaagctggtgagttcggggtagtgtgttgtatagcatcagataactaatagagtctatttcctcagcaatacaaggatcccccaaaagcctcataaagataatcactgaggactccttagtctttgaaatgtaatcctcatttcattaagtttcagtgaccatcacattttgatgacttggtaaaaattcagtactgatggaaatcatgaccatattattacatcactgaggtttctctgcaaaacaggaacttgttgatcagggtattcattttatgcaggctgagatgcaaacttcataggcaggctgcacaccagagggtaattcagtatctctgcatctgagtaagaaagttcttaaaccactgtctctttttatgtcaacttacagggaagaacattctccaaatatcttagaaattcagtcaagtgtttcaaagccaaactaaattactccagctatttgtcggagttggaaaagaaacttctaggactgagcagccataagatacagccatagataccctgtgattggccgggcacggtggctcacacctgtcatcccagcactttgggaggccgaggtggggagtcacttgaggtcaggacttcgagaccagcctggccaacatggcaaaaccccgtctctactaaaactataaaaattagctgggcatggtggcacgtgcctgtagtcccagctacttgggagactgaggcaggagaatcacttgaacctggctgggcggaggttgcaagtgagccgagatcatgccactgcactccagcctgagcaacagagcaagactccatctcaaaaaaataaataaataaaagatactacgtgattgtattagcatcacatctgcccacagccttggaaagtaggcagacgctcctccctttaagcctgaggaaacccaggcttaaagaagtgacatgatcagccagttcccaccaagccccacctcccacacgggcactggggacaggggagggataagtagccagttcccaccaaaccccgcctcccacacgggctctggggacaggtggggggtaagtagccagttcccacggagccccgcctcccacacgggcactggtgatgccctgcgcactctggctgtgttgtcaggcactcacacagttagatcagtaacttgcagaaaggctcctcatataccaaagttgagtggataaacagccttttaccctaagagtgacctcagagtttgcaagaacccacacatttcttggtccttatacaaattcagaggaactgcagacagtggtgtcaccagaaccatttagacaataatgtgtgtggacgagacatggagaaggcttccatagtcggtgatgctattccaggacaggtgaaactgctcaaactcctgctattccaggacaggtgaaactgctcaaactcctgctattccgggacgggtgaaactgctcaaactcctgctattccaggacagatgaaactcaacttcaactaaaccaatcaatatattcaacacaccaacacacacacaaatttgactccagtcattgataaaatagtaaaaacaatagtttctttcctgttttaaaaggagcttttccctttcattcagttaatttaacagggagtgattccatttttttttgtagtaattcagtttactttattttaaaaaataactcagtgtaccaaatgatttaatgacttcaatgtatcaaaattttattggctcataacctacatctatttcataaaataaggtttgatctaaaatgacccttgggcgtttccaagttaattaattagcaatacttcggaaaggcacaagctatgatgtgaaggctttgagttaatataacaccagttccctatcatatcagcccattcttcaagggctttgcaaagcagcagttctccaaatgcagcccttacgccaggtgccacctggaggttgttagaatttgtagaatgtggggtccccccaaacccctgagtcataaagatgaggaggggaatgcagagtgcagggtaccgcccagaacccctgagtcatagagacaaggaggggaatgcagagtgtggggttcccccccaaaccccaaatcatagagatgaggaggggaatgcagagtgcagggtcccctctaaaccccgagtcacagagacaaggaggggaatgcagagtgcagcgtcccccataaaccccgagtcacagagatgaggaggggaatgcagagtgcagggtcccccctaaaccccgagtcacagagatgaggaggggaatgcagagtgcggggtccccccaaaccccgagtcatagagccaaggaggggaatgcagagtgcagggtccccccaaaccctgagtcatagagccaaggaggggaatgcagagtgcagggtccccccaaaccctgagtcacagagacgaggaggggaatgcagagtgcagggtcccccctaaaccccaagtcaaagagacgaggaggggaatgcagagtgcagggtccccccaaaccctgagtcatagagatgaggaggggaatgcagagtgcagggtccccccaaaccctgagtcatagagacgaggaggggaatgcagagtgcagggtccccccaaaccctgagtcatagagacgagtaggggaatgcagagtgcagggtcccccctaaaccccgagtcacagagacgaggagggggatgcagagtgcagagtccccccaaaccccgagtcacagagatggaggggaatgcagagtaccgggttcccccctaaaccccgagtcacagagacgaggaggggaatgcagagtgcagggtcccccccaaaccccgagtcacagagacgaggaggggaatgcagagtgcagggtcccccctaaaccccgagtcacagagatgaggaggggaatgcagagtaccgggttcccccctaaaccccgagtcacagagatgaggagggaatgcagagtaccaggttccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggagaatgcagtgcagggtcccccctaaaccccgagtcatagagatgaggaggggaatgcagagtactgggttcccccctaaaccccgagtcatagagatgaggaggggaatgcagagtgcggggtctcccccaaaaccccgagtcacagagacgaagagggtgctgatcacatcccaccccagcttccaggtgcttctgacacagctgaaacctgaacccatgactttcagggctgtggcctcccccgcccccgcccacatgtgtccaccagccctgggagtgagtctgaggcagggattctcagggacgctgcctgcatgccccggaggagtagcgtgtgtgtgtgcacacgtgagcttgtgagtgtaggcttgagaccgtgctgccgacccagtccctggaatccctgtgctgagttgttctcatgtggctgctggcccagggaggagcgttacggacaactgttaagtggaaattgtctggacgtaatgcagttcatcagctcaaaagctgtgggtctggctgtgtgagccaacagcgctagtgtcctggtgcctggacacacggatgttctggggctgttgctgaaactgcggcacagtaagccctgcagcctccctggaatccctgaggaggagccggctcacccagcgccgcgagcatctcttcctgactcgcagggggcccgtgagatggagaatctgcctgacagggtgcacttgcacagccaagcaccaagaaggaaaatggcatttcattagccatggagacagccgggaacccagcagccttctttattctggctcatattttctcatcattctcagggagttgtccaggtaacaatgaccttgtgtaaaccagcgtccctgcctgagtcctcttcacctgaaaccaccgccccacgccaggctccacctccccacgccaggctccaccccccacgccaggctccaccccatcccacgccaggctccaccccatcccacgccaggctccaccccatcccacgccaggctccacccaatcccacgccaggctccaccccccacgccaggctccacccccccacgccaggctccaccccatcccacgccaggctccacgccaggctccaccccccccacgccaggctccaccccatcccacgccaggctccacccaagccagcggcaccggttctggctggaaggttcccaaacctaggccagggtgtgaatgccaggggccctgtgagtggtgagtgatggttgctgggtgctgggggctggcgctgttcccgccgcgccctccatgaagctgactctcagtcctgctctctgacaccgggctgtgctcagcagccacgagctgaccacgcggtgaggctgttcacttttctccctgactccagctctccccacatgcagctcatccccgacatgggctcttatcccaccaaccgcttctaaagacctgcagaagctccctagtcacaggacgtggcgagcccaatactcacgtctgcccctgacttctgcactaggccctgcctcagccactggcctcctgcccctcactgtcggcctcaggcccaggctctctgtgtagaggcctcctggcttccccaccccgtgctgctccccacccggtgctactcccctggctgagcgcccacacttctttccccttttccaaatcccacctgcaggtggtggtctctagcactcctcttggttcatgggccttgactgacagctttctcctgcagccatcctctccacaattctgggagcgtcgactgtgctcactcaacactccctttaacaaagtgacatcagatgtttgggccctacttgcatttaagccatccagtgcattccacataaaaagcgtgcacctggaggaaactaaataatcacaaccaatcactctttttttagaaaaaagcagcagctctctcaatgtagaccaatttatcggtctaaactagagagaccgggcaagccacttccatcttgcgagtttagcatatttgcctgttgacacctacacttggaggaagccattctgtgtgtgtggtgtgccttcacaagtaatttctatggaaaacagccgtcagacagtcatcctggcccaaggtgacctcattaccagaatttgttctagttgtcattagacatatcacactatgtcactcaaaatgggaaagaaagagaagatactgacatgccgccccagtgattagagatgaaaatgtagttataccatatatgatccctgcttggagactatacggatagggtttaagattcaggcccccctcagatccatcactgtggtcctgaagcctctgtccttcttctgttcttttaaacttctctgtgtagatacagcaagtgtgttttctactcactgcacagccagcgctgctcttgaacaaactcctgagggaggtgcacggaaaccatgcatccaaatccggagagcagggagaccagccggatagcccacctggctgacgagacccggcctcgctcagaaagctcctccaagatgccaccgcgtgtgaaatgcttggggttgaatctcgagagcagggagaccagccagacagcccacctggctgacgagacccggcctcgcttagaaagctcctccaagatgccaccgcatgtgaaatgcttggggttgaaatgtaacgaatctctcactactgacaagagaaaggccagaacacaaacacacttcctgcttccagatggatggaggtgggaggagggaggggttctgaccatcttctctggtgctcagtgaggcaatagcatgagatagataccctcatctacagccccgctctcgtatgtccgggggaagctatggagagggtgctgcaaagctgccagcaagtatgtctgcctctgacgagtcactgttggatgtgaggcaacgtgaaggctccaccactaggacccaggcaagactgccaagcggatgaggcttcgctttaggaccatggactctggcggcagataatggcctgagaggtcagctagtccaattgcttccttgtagacacgcagaaactgacgcccagagaggcagggcaccccgtgtgtggtcaccgtggtcagtggcagaggtggggctggaggtcagaactggctgcatccgtctccatctccccaagcacaggccatgcctgcctctcccaggtggcatctcctctctgtggtcctttccctcctgcctgcctttctgcgacatctgcactattcagacatcacgcttcctttcgtcctcactcaaaattcccattcactcagcattaccacggtttgatattaggactgcttgattcaagccaatagtgctaaattagaaataatgaaggcttcactcttccacggggttctgcccttggaagaactaatgaaacccaaggaccatccagttggcaggactggaagtaactgggcagaggagacattttggagcaggtggtcggtgcccacccactgacaggagctgccggtttctgacccactccacccctcctccaggaccctccagagtgaatctggagcgagggggcccagtgactttggggtcatttgcacggtatcagctatagccgcagtgagagggaggctgctggacacgctggggttcacctgtgtcccaggagaaccccgctttaggatataacgggttcatgcactggagtagctgccggtacacatctagggagtgatgatccccctccaccagccagtggggaatgagcccgtgaaggtcacagccagccatgaaacagctgcactgccccagcacgccgcccacgcttggtcggcaacacagagattccatttcttcctgggattaggaagcacgaagtgtccagatctgcttctgaaatctcttcctcccttaaggtaaggtgctgtgtggagcttactggaacctaaacgggggcaagatgaccggtcactaaagggggcgaggttaccagtcactaaagggaaagggggcgtgatgaccagtcactagtgggggtgagacaaccggtcactaacgggggcaatatgacccctcactaatggggtgatcggtcactaaacggggtgagatgacaggtcattaatgggggcgtagtgtccggtcactaatagggtgtgatgacctgtcagtcattatctcttgcataagagacttcccaggggcagagcagacccggtggacagcaggagctgcctggtcccactgctgagttttatgtctggatgctgaatagctggaggaagcggcctgctggttttgttcacactgggtgaacagttggaatacaggttcctcgggcctgtcctaaatgctatcagtctttctctagagatggggcagttattatgcagtgtgggatccacagttacagagcggatgggggactaagaacatccattctgcagaaagtgggacattcagggcaatagggaatctgcttttcaatgcagcatcccagtggggtggccccatcacttctgacacctccatcactgatgcccccagctctccccacacctgccattccccacgttaatgcagcagggatccagagaagggtctccggacatcactgatgcccccagctctccccacacctgccattccctgcgttactgcagcagggatccagagaacactgtccggacatgcaggggaccggagtcctcaccactcccccttttgtcttctccaagccagggtcaaagctgcctcatgcagacggagaggagaagctgcgttccctgcctttcccgaattgtttgtggactgtgagtgatgcatgtcctgtggcaccatgggagcaccagggaacaccatgctgtctctccccggagcccccactggcgtcctggccatttccagcttgtctcccaaagacaggcttctttgtgctttggtcacacggagaattatcagtgcagtctctgtctctctctctcatttccccctaaattgccacatgttgcaactcccaggcgtgcccccagctctcctgaggctggtttgcagtggccgggcccagctaaagcaactgaacctccagagcagaggacagtgtcctgcctgcacgtcttgacatggccccacaggagggttccctgtctttcacgtgctgatagaccaaacacaccaaacgcattcccgggcaggtgtgtacatcagaacagtgatgaatcagggacccttcttagtgctactataagtaacaacagtgagtcagacgggtgcaaaccctttggaagactcagtctgcaagccccagggagcacaggggggctggagggaaccgggggagggatgcacaggcgagaaatgcccatgacccggtccacaggtcatgcacgtccacactttctaaaaaaccacctacaagaaaggggttgtttcctggcccccagtggggtgcagaatgtcagtgctgggctgcaccctgggcagggctgctctgggcagcatcgccacacccgtgtcccattcttggggtgcatccccttctcacatctgtgtctaaagccaggaatgggcagtgtgacctgaggaaaatcagggacaccctctgtgtcctcatatgcaaacatgtctctttcatgccagttaaatgaagaaaaaggcaagacctaaatcctgaactcctaccgctataacacattcctctgcgctaaggaactgacattctaaaggtgcagatacccccgggctggaggctgaatgggcaagaagatcccggcacagctcaggctgagtcgaaagaccgtggtttttggccaggcacagtggttcatgcctgtaatcccagcactttgggaggctgaggcaggcagatcacttaagcccaggagtttgagaccagcctgggcaacatggtgaaactctgtctctactaaaaatataaaagttaagctaggcgtggtggcgcatgcctgcagtcccagctactcgagaggctgaggtgggaggatcgcctgagcccaggaggtctaagctgcagtgagccgagattgcactactgcactccagcctgggtgacagagcaagaccacaccttagaaaaaagaaaagaaaagagaaaaagaaaagaaagaaagacagcggttttcataagggggtaagactcagagggcagaagaaagcggagtcttgtggggggcaccatctgtggctgggtcggagggacgagggctgctgtagccctttcctttctgcaccgctctgaccaagtgcgtctaaggggtggagggatgaggggggtgggtgccttcgtggctgcttagccatgattctgctggacaccatggtctgggggaggcagcgggggcgggtgccacctcaccttcgggtacctgacgggccggaatgacacatccttgtcatgtccaccccacttcacagatgggaaaccggggctcaggtaactcaagggaagcagcattgagaggtcagggcaggccttctgcccaatcccccgcctgctggctgtgttccttccacactcggccaaggtctctgcccccgcatcccaccccgccctgcccagggctgcgctgacctgccttctccccctcctcctcattagctgcaaagaaaactcttctgggggctgccaaatgcagagctgcttcgtgtcccttctttgacagtaaaagttgttttcttggaaataaatcaaatttgtatttctcaacaaaacctgccctccatccctctatgaagaaaaatgcaagttgctcttctgcgctccaaatacaccgagacgaaaacaagcccaggtgaagctgcagctggggacacgagttaatgtgagtgcgagcccagggcagagcgggcccagataaataattcatgagcgccaccggggaagaccgggcactcgtggagttcaacagatcataagcaggatccagggtcgtgtagcgacacagcttcccaagcaggcgagtgacctggagcacagaggggagggacggggacaggtgcagcagagattgggcacgggccaggaatgcatcacggcacctgcgcacaggggtggcctccaggggctccaagtcctctgggatccaggttctccttccttcagggcacccccacccaccctctccccaaggcttgggccacactccatgccaccatgcccaacggtccccgccctgcacccacctctggcaagttctgggcagggggagagcgacacaaggcaagggaggagacatcggtggatgggggagcagggcaggctgggggtcagggctcagggcggtgctgacagtaggacatgctggtccccttcccagtgaagtcccaggaaacagcctctcatgttgctgggccggtgctcaggagctggggctgcctggggcacaaagcacgtggactaggacactggaatgtcaccgagcttccctccgatacagtgggagggaggacttggcgcacagtgggtgagtgaatggacaggcaggagtgaccagcccagtcccagcgcttaccgaggaggactggggaggggggccgagtctccagtcaggcagagagagctgctggtgtcaaccctgccagcaagatgtgccccagatccccagagtccagcgaacttccctggccctggccagagtccacgtctgactctgaaggtgtgcggggtgtggacatgagggcactgctcatctccactgccaggctttggggtgtggatgcaggggcactgctatctccactgccagggctgctggatatgctccagcctgtcacaagccaaggcgaccgagcttccctgagaggcacccagcctgatgcagcacagggcaacaggctggggcatgacgggctctgctgtttctcagtctccctgtgatgggagtcgcaatcccatcctcggagggtggctaaggggatccccaagaaagtacccggacaattcctgccacagagacactttaaaaagggcaatggccggcatttctgaggtttccttttcctaaccaggaacagattctctttgacaaatgggtcttgccacttgttatgaacccaatgccgtgggcccggcctgcacttcctggtggagtcctggccccacccagctcctctacacgtcctcttcactgaaggaaactcacagagccctggtggcaccgggtgctgcccgtgcagggcacagaaactcagggccggtttccctctggctgagggagggtgagggagggcgagggagggcggacctgtttcctgttaaaccctggagctagcacagacttgcagcctgcctgggacccagtgaggatctgtggagatgggctacagggagtgttggggtgagagctgcacggggctgttctcagcagatcccagcaagtgacacacccaaggctggggacccaggacaaggccaagggcacctaagcaccaagcaagagtgagattagaccctcccagaagtgatgcacccaaggctggggacccaggacgaggccaagggcacctaagcgctgagcaggagtgagatcagaccctcccggggctcaaaaaaggctcccagcatcggtcacagcccgtgcccctcgcaggcctgcatgacagtcagggcctccatcaccatcaggccagcacaggcacagcccagacatgcaggaggctccagccagtatttgagaacagacgcctgagtgccgggactcggcccacagcccattcgcccagggagactggtggtccccatgtgccacccgagctgtcaggcactcagtatgtttttaaagcctcactttttaattatatcatctaatacatggaaaattgtgtatcactactgtaaatgaaaagcagaatcattgctgtgagaaggccaccctaaaggtgagttccatgaaaacaaaacacccaaattttgttcatttaaacgtgatcaaagactgcatggcgacacgttctctggaaagaggggctgctcatggccccgagtctctcgctctccaggatgagttgggagtggaatcgccatggccacggagtcccttgcagcctctgagcttctgcctgtgggaagagctggcaggttgggggaccggccacacggtctgtactgagtgggtctctcagcaccacctcattctaacaggagggctcctgaaatcagcgccttatggtgctaaggttttaataacacattagaatacacagaactaaataaaaataaaacaaaacaaaataaaacacaaaagctgtagaggattttctgctctggaaaacaccagtgcacacaagcctttatctgggggtcccctggaggggttggggtggcccaacagagagcagggagcagaggcagatgtggggggtcacactccaccaggagcccccaggcaccgtggccacaggacagccgagcttgtggactgtcctccagagtccagctggaatcactgcccacgcctaaatctaagaagaagtatgcgatgggaagaccttttggctccttctgctcaggaagcatagacagtatcttcagttttgcccacgcaggccccttgaaggggacacacagacgccaggagacagacgcgtggcggccgggtcactcccagtggggagctgtggtttgggcgcctgagcctggagcccccgtcttactgggaggtgttcccttatgacggagcccacggggtctgcccaggtcacagtcccctcccacaggccacgcttcaggaggatcatcgcaggtgggtggcctctattgaggtgtgagctgcaactttccattttctgatcacgagctctaactcattttcccacaacatattatgggcggctcataagattttctatcaaaacgtaaatagattcggatttctctgaagagcaggtttcctatatcggtgcgtacctgtccgtgttcacattaagaccaaggacaaaagaggaaaatagattttttcctaggttgtatgactttatgaaattaaaaaaaaaaaccacctaagcagccctgagcctccgcaaaaaaagaccccacggggacatcccgtacctggtcagagccaggacataccccatgtgcttttttttcctcccctttcagaaatgtaatttccatgacgcgtccacccagggccaggaaccacagaagagaaagagcagtgggaagcttccagaaactcccatgagggctcaggaaacatggggaggtggcgatcggaatcatctgccaggcctggagagccagaggtcggccagccgggaggtgtcctgtccctgagtccccgccctggctccactttcatgcaagagaggggcagggtgggccacagagctaggtcctggagagccacccccaacccagcacgggtccaggacagcaggaagaacccatcctaggtcggaagttcaaatctctgatttgagatgagtgttgaccctacgggggttgaaggcctctctggagagcgtcgattgagcagacaggcccagagctggacgatctctccctaaaatgccaatggcctcggaagacaaaacccaaggggggtcagtggccccccatgcactgagctcactgggtctccctgcgcccgtgtctggagtcatacacaatgctgttattttactgcctaatttcaaaatgcacggctgcagtttacaccctgagctgtggcttgaataatttatcgcaaagtccctgtgtcagtgaccagtgtgttgggtgttgctttgaaacccacagagaagacctaatgtatcacgttgttttcctcctctttaaatattattgacacagcgatacttcactacaggccattaatactggtctgcttctagaggagaaaataccgatgcaggtcagggcaggtgactcgctctgagccacttaacactgggtggcaatggtaacccgccactgcttcctttttaatttaatccacgaagcagcacagcaaagtttcctcatatttctcctcttaaagctgacagaaaataaccagcagaaaacaaacaacacatcttagggaagggaatttagacaaggacagagaccagggagcgagaggaagatgcctgtgtttcccacagtcattgggatgaatctgaggcagcgttagagcgagcgccttccactttggcccacagctccttgttcctaaaatcagcaccgcatccccagcttacagctccttgttcctaaaatcagcaccgcgtccccagcttacaactccttgttcctaaatcaatgccgcgtccccagcttacaactcctggttcctaaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacaactcctggttcctaaaatcaacgccgtgtccccagcttacagctccttgttcctaaaattcaacgccgtgtccccagcttacagctcctttgttcctaaaatcaatgccacgtccccagcttacaactccttgttcctaaatcaacgctgcgtccccagcttacaactccttgttcctaaatcaacgccacgtccccagcttacaactccttgttctaaaatcaacgctgtgtccacagcttacaactccttgttcctaaatcaacgctgcatccccagcttacaactccttgttcctaaaatcaacgccgcatccccagcttatagctccttgttcctaaatcaatgccacgtccccagcttacagctccttgttcctaaatcaacactgtgtccccagcttacaaacgctgtgtcacactctacggtttctatctggttttattttcatccaactctctccaggcctgcctgtcactcagggagagatctcaccagtccagccacatctgggagataaaaatgcccaattcaatgagcatttgttaaacacaccccaaggtttgttgccatgaattgtaaattcctggaaggcagcaaacctgcagtcttagagtaggatggggcctttcagcccctgaacgtgcatctgggtgtggaccaagggcttgccagccccgcaaagggcatgggcagcctgctttgcctcagcgtccacatgagcaggcggcgtagcacctcctgtcagaggggaggatccacgtgtgcatgtggaggtgcagaaggaggggtcatccatggaaatctgacttctacggcaaactcaagtttaagcaaaagtagactacccttcggaaatgcacactggaacgatagcaaaacatgaaatcgacgtaagtgtccatcagtggatgaatggataaagaaaacgtggtgtgtccacacaatggaatactactcagctatgaaaaaggatgaagttctgtctgttgcgcacaatggaatactattcagccataaaaaaggatgaagtcctgtctgttgcacacaatggaatactattcagccataaaaaaggatgaagtcctgtcttttgcacacaatggaatactattcagccataaaaaaggatgaaatcctgtcttttgcagcaacatggatggaactggagccattatcttgagtgaaacaatgcagaatcagaaagtcaaatactgcacattcacacatttaagtgggagccaaattacatgcgtgcatggatgtagcacatgggacaatggacgctgcagacccgggacgctgggaagggagaggagggtgagaattcgccgctcgggcccatctatgttattcagtgatggctacactcaaagcccagacttcaccactacacaacagatccacgtagtaagaccgcacttggaccccaaacattcatacagtaacaaatattactaagagaacctactggtcagatagatctttgctttcctgccagtcagtgccaggggagctttggtctctcacacggcttagagcccttccttccaaggcgggcagctcctgcgtgcacatgggggctcccaccaccccgagggccggtcccccatgcctgttggagggtggtgtgggtttgctctggctggtgtggacaagcccttaactgagaacagggtcaggggaccttctagctttcttctctagctttcttcgtctctagcttttctttttttaaggcatttattgctcctgaaaataatctgtgcttgcaaagaaaaaaagtcattttgtttcaaatccagtgataaagaatggatcttttcttctcctagcaaaccattttcccttgccccaggggaccatgtatgacctgagccatcttcccccacgccaggccctcaggagacccaacctccctgacacatcctaggcccggggcgggtgtggggaggcacgagcttctctggaaaccagcagctgtcgcctgcttgcccatctgtcaccaagctctaagtcctgctgtctgctcaacaggcatgaggagcagtcccacagtgcaatgaggccggcacgggggcccagggagggctcggccccaggtcccctgacgtggggtgtctgccctccccaggaggacggggttgggggcacatctgatggggcctgggtcatgcctgccagttctgcacagagctgcctcctgagtgcccacgtgccctgcggggctgcctggcggctccatttgctctgtgtctgtggagcaactgcgcccctgggcccgcctggcctgggctcccactgaggtcacagcacctgggtcattcagctccaaggatggggcaggccccacagggcaggaccccctccagcagttcctgcctgtcctgggaaggccacggagacagacccttgacttcaggacagggggctgctctttccataaatccccctggctggcgcctggagcccaggttcctcccacacagccagtcattcctgccatccacactggccctgcaagggctggaagggccacaggtgggcctcactcaagagggaaggaccagggaggagaagggagccacattagcctggctgggtgggcaaagccacgtcagcagccagaatgtccctgcagataaacgtggggggaggcatgacagaaagccgggtttctacagaaagaggaggccagggaggggcagagcctggggggaggagtgcagggaggggcaggcagagaccagtgggtcatagggaccctgtggagcccccagaccagcccctgcacagaggagaggaatgtggggccggaggaatggagtgcaggggagatgagtgcacgggagaggagtgcaggggagtggagtgcagggctgggggagagtagtgcaggggagagtagtgcagggcagggggagaggagtgtggggctgggggagaggagtgcaggggagaggagtgcagggaggtggggagaggagtgtggggctgggggagaggagtgcaggggagaggagtgcagaggagaggagtgcagggtggggggagaggagtgcagggtggggggagaggagtgcagggtggggggagaggagtgcaggggagaggagtacagggcgagggggagaggagtgtggggctgggggagaggaatgcagggcccgggaaaaggactgcagggccaagggagaggcccagggcccgggctgcagcctggcttcagcttttacccggcagcctcagagctctacttttaattaagtgccttaccaaataattaatttgtactcctctgtggaataggaaaagagccatgaaataattaaagaattaaaacactagctcagagccaggagcagcagtcagggctggcccggaggctcctgggctctgaccacgccatccatccgctgaggacagcagaccacctgcgtgagacgcggaggagcagcagctctgccgtgagaggagcccgtgtccagcctccaacgtagatgctgtgttggacagagtctaaatgtagaccgaataagctacctcacatttcaagctcagtaaatgtaatgtttaatcacacctgtaatcccagcactttaggaggccgaggcaagtggatcacctgaagtcaggagatcgagaccatcctggccaacatggtgaaaccccatctctactaaaaatacaaaaattagctgggtgtgttggcaggcacctgcaatcccagctactcgggatgctgtggcaggcaaatacttgaatctgggaggtggagcttgcagtgagcagagattgcaccactgcactctagcctgggtgacagatactccatctcaaaaaaaaaaaaaaaaaaaactctacttcaagttgtaattctgagattttgaagcacgtttggctggactccatccttcatgccccacgtaagagggttgtgttctgggtagagaagtcatctttgtgcggggtgcgaggcatccgggggccaggggactgtgagctgcagcaacagtgacccctacagtgctgacagtgtggggcggtcccgggtccgatcctggctgttcctccgagcggccgtaggggtccgccctggcccctacactatgcccaccaagaggacctcctgtaaacgtgagcctcatgccagagaacccacagccagcccctcacacccctgcactgaccggcttttatttccagcctaaaagaagagaaggcagatttagttgcctgaacacaaaccctccttctccctcgctcaagccatcagggggttctagtcggcttgtccactctcatctcctttaaataaacagcaaaaccgttttcacaactcagctcccaatgtgaaattagtttcatggtgactgagcaccgtgtgctgcccgaatttctcaccaacctcagacgctctcgttttcacgtgccacggagctacacaaagataaagcagcccaataaagacccggctgaaggcttttgtgttctctcactcttgcccacttaccctgcgttttccaccaacacaggcaggggaaagcttggcctgggaacctgagttctgggacctgctccctggctggacttgctggcacccaccggagatgaggcctccaggaaacctgtcatcgggagactcgtccacacgacgagaccagggggaagaggtgctgtctgcagctgttctccgcgagtccctggcccacctgataacgagttccgtaactggaaacatcaaggtgggggtgtgggtctgagacttcactgcactttattaaatctcagccactcaaaggtggggtgcagactggggttcgcagctccgacataccacacttgatctcagatgtttacctgatgaactttggcctctggtttttatttttactttttttttttatttttcattattattttttgagtcagagtctcactgtgtcacccaggctggagtgcaatggcaggatctcagctcactgcaacctccacctcccaggttcaagtgattctgatgcctcagcctcgcgagaagctgggattacaggtgagtgccaccatgcccggctaatttctgtatttttagtagggatggggcttcaccatgttggccaggctggtcttgaactcctgacctcaaatgatccacccgccttggcctcccgaagtgctgggattacaggcatgagtcaccttgcccaacctagtttttatttttttaattaactgcttgcctcactaataaaacttctcttttgccaaaggatgcttctcaggttgcattccccagtcaggggaataaccagaggattaaaacaaaaggttaaagtgatcacttcaaaaacaattgccaaggcccgtaagagaagggtttaaaagccccagggccatgcttggtttcaggccagagggttctcagctggaatcacccaacacgtgaaagccgtggagaggccgggatgaaagcacctggtcaccactaacgccctgcacacctttccttcttcctcctcctctttatttcttaacaggaagctgcctgacatttcggctttgaggtctactgggaagcatgactgaagttggggtgcagggtgggggctggtgtccggccgcaggtggggagcagggtggggctggggtcgggccgcaggtggggagcagggtgggggctggtgtccggccgcaggtggggtgcagggtgggggctggggtttggccgcaggtggggtgcagggtgggggctggggtttggccgcaggtggggagcagggtggggctggtgtctggccgcaggtggggtgcagggtgggggctggggtttggccgcaggtggggtgcagggtgggggctggggtttggccgcaggtggggagcagggtggggctggtgtctggccgcaagtggggtgcagggtgggggctggggtttggccgcaggtggggtgcagggtgggggctggggtttggccgcaggtggggagcagggtggggctggtgtctggccacaggtggggtgcagggtggggggtggggtttggccgcaggtggggtgcatggtgggggctggggtttgaccgcaggtggggagcagggtggggctggtgtctggccgcaggtggggtgcagggtgggggctggggtttggccgcaggtggggtgcaaggtggggctggggtttggccgcaggtctggtgcaacgtggggctggggtcgggccgcaggcggggtgaagggtgggggctgggatctggccgtaggtggggtacagggtggggctgaggttcggccacaggtagagagcagagggccttctcccacaggcctgctcttggctgtgcatgtcacagaggggaccacactccacactcacagcaacccagaggtagagttcacgtgcaaagaatgggaagctggagccttaaataatttgcctaagttcaggcagcagcaaaagccagagccagaatctggaagcaggtacagctgattccaaacctacctcctatacccatgacccctcaggaccacagggcctgagtccacggctggggacgtgcacagcagggggacctgaggaccgggagggcggcacttcagcctcacgggcgctcccaccatgcagacagacgcaggcagtgtagtagatggtaaaacggccgaaaaccatcagcagcctcaggaccgccctgtcatgatgccaactcccaatccgtgctgagagcccggcactgcctcagggagattagcaaacacttttcatctgtttatacacaaacagcaggcatgggcccgctggccttccaggaacatgagtctgcgtgactggctgttgtgccctcacccggaaccgtgccaggcaccgaggaggtgctcagtaaactatggggttgcatcgtatttgaggtcatccggaggcacccgctgctgcactgggactcctggagatcctcctccagccggaagctggccaagctgtctccaggtcctgggatcacgttgtttcagtggagacgatggccgccagcttcagattcagaaatggcacttagtgcctcttcccttggagtcacctcgggtgacatggggtggcccccatggccagcactgaccagctctgccccccaccgaggcgggagccacatctcaccaccaaatgcccttttatgggaactgaggtgcaaagcgggggcttgaggcaagcagcccccgcgggaaacacggcgtggtcatcaggcgagtgctgccttagagacccgccccctgcagaggctgtgctctggatggtcactcactcacccctttattaagagttggttctacggaggatgagagaggcagggacgtgttttgggagaaggtcatatgaaaaattagtgccacagagtttcggcccctaaaaagcttccagtttcacggtgaggggaaatgttgtaaactaaaacctctggtggggagagtcacttttgttgcccgaatccccagtacagtggacggcgcctcgtgagccggatggcaacctggccagcatgcagtgaaggaacaacggggccaaatgccgcaggtgtggatgagggagaaaacaaaagctcccactgcgcccctccctccctggagcttagggttcatctgaggggtgaagaggaggatgtgaaggacaccacgggggtcagggagcctgggaaatgtccaggaatcctggggccggggcctgctccctggaagcagatctgaggacgtttcgggcaggtcagctgcagcgagagaaatggacttgccggggaggaactcccggctgcctcaaagctcagcaggtccacggagcaggagccacacaaggctcttcaacaagccccgtgaggtggggagctggcctggaccaccctggcgtggacacggctgggctggatctcatctgtggaactcctggcaggagatggagtgccctggtcctggccggggtttggcagcacaagtgggggtctgctacaggccgcttggatccaggggaggaggaaagagcacaggagagggcaggagatgtttggcttctgtcatgagctgacctgtgtcccccaaaatccacaggggaagccctgaaccctcatgtgactgtacttggggacagggcctctaaagaggtaaaggtaaggccgggcgcggtggctcacgcctgtaatcccagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaaatgaggtcctgagggggccccaatccaataggacctgtgttcttcaggaagaggaagagacacacagcctgcatctacacagaaggacagcccctgaggacgtggccacgacgcagccaccgtgagccagggaatgcggccccaggaacaagccctgcccacaggcgtcccagacccaggccttggggactgcagaggatggatgtctgccccacctgtggggcttcaccgtggccacccgagctgactgacaggggtggggaagcacgccatccgggctccagccctgcggttggcgggatccaggtttcttggtggtggcgagcttctcacatgggcttggcggcacctcccaacacgccaaggccagtggtaaaacgggcctctgctttttttaaagaatagcttgtctaatgactctgagagcatctattaatttcatcactgttgccgacttaatcagcaaacttcatttacaattccacaagctacgaaaaatcatttgctactgtcatagcagtataggaaacgtgtcagcaccttgggagcctggccagtgtttcatttcactgagttccagaagactccggctctcggatgggagcagcccccatggctgcttttcggctcctcgtttggaaaacttggtgactctctaaggtgataggaaaagcaaaaattgctctgttaatgcttccagtgcccaatttgggagtaaagaatgggttttatcaccaaaaagaagacttcacatgatgtttctgcctgagagaagtaggcagggtctaggggccatcctagcctcctcccatcccagaggatgagagagggaaccgcccacttcctgtgtggccccaggactcagagctaccctcaatggcacccgaattttattcctaacccctcccagatgcttcctgtgtgtccacagctgggtggtggttctagttttaggttttttatatttaaaaaaccagcagattaaaaaattaaccagcatctatttttaaagaactgcatgcattcctttgctataaataacaccttagtggactctaaaaaaagtaattcaaaacaatcctttttcactgggtttgctgcttgtttacattatatttctctgagataacagaaagaggcacatcttatcactttcctgacagtttcattttcaggatctgataatgctatgtgtgcttatatggaaaatattgatcccactatactctgctcttcctaaatttttcattttttaaaaaattcatgacagtatttgattcccagaggttttacaaaccatctccttcaagcaaatgcatgtaaatttcacttctgtgactctgagttcatttttaaagaatggttttagaaaatcttcttctactttgccaaatttcatctttaaaatgcttgtttctgttcctctcatgataatggtaatgtttatgatggctgattttaaaacctcttagggtatgaagtgtgttgtagaaatgctaaatgctaatagatacataaacagtaagatggaagcgggagaaacacacacctccccctttcctcacaagcctcagcatttccggcttgagaaaatcggcctggcacccatgaagtacctgcggtctgagctgtgtggccactatttttttttttttttcgagacggagtcttgctcttgttgcccaggctggagtgcaatggtgtgatctcggctcaccacaacctccacctcctggattcaagcaattctcctgcctcagtctgccgagtagctgggattacaggcgtgagccaccacacttggcgaattttgtatttttagtagagatggggtttctccatgttggtcaggctggtctcgaactcccgacctcatgtgatccgctcaactcagcctcccaaagtgctgggattacaggcgtgagccaccgcacccagtcgtggtcactcttaaggtgggtgcagcttatggtggcgaatatggaaaggttactattggctttcgctgatttctttaaaaaaaaatgcaaagagaaaggtcactaagcaaaagacctaagctggtttggaattcactaatctaacactggctagagtttaaaaagtaggggctagtaaagcccacttgatatgcacaaaataagattagctgcagcgttttgctgtccacgttgtcttagagagctggaagatggggtgcagggggaggtgcagggcaggaagcatctgcggtgaggcctctggtcagtcactgcacagctggagaaggctcaggtggtgctcgtggcccacgaggggttctccccagaagagacaggaagggcccaccgtggtttcccacagcaatgtcctcatgcacgctgaggcacacatcttacgtggatgctgttagtattcagtacactgcgtctaaaatgcacgtgtgtgcaaatgcgtgtctctagtgcactcagagtgggaagtctgcacggctccttttaactctatgggatcatgaaggaaagtaaaaccttagaggctgaggggtttctgcctgcatctgaatttctttggaatgctcatgtcaaatctgatggaaaggtggtactagcagcagccactgcccaaataaacatgttcaaagctccttttcaccaaggcttctgctgtgaacctctcccttcttggggcacctgctgccccttcctcctgcctctcctggggcagcacaggcacctgcaaccaacttacggagttttgcagatgtgacaccctaagaaagcagccaacactgtgttcctcgtggaattactgagttcacatcccttttcctttttagagagacagatcctataggcagcatgaatggaaatgcaaagactccatcgatttttaccaacttttccaaggaaagtccaaatcatgtttgctcctccatggtggtacagttcagtgccagcctggtctggccctggagccttcttttggcatccagaacatctccctgacaacccagaaacacagctgacctcctgccatcctgagcctcacaagcttgctggacacctgcggtgagtcccagcaagggtgagtcccagcgccaggcaaagatctggcgagggaagagccgcccgggatgcagacacacttatcactcacttgccatttccacaacctcatttctttgcagctgtggacggcaatggcttccttaagggccatcccacccctatggagatagatgccagggcttgggagccacctggtgtggctgtgcacgctgagtgtccttgtcactcagaggaaggtaggcccagggtcccttaggccaagagacttgtttgggtctgactggggccaccctggctgtacccacatttccaaaagtaaacctgtaacgcatcatgtctcaaagacaggaaaccccatggacaccccagctccatcatgcggtcatgacattttggaccaggagggcctcctgtgtggtcctctggcgggaagcctgctagtctccctagggctgccctaacaagcctcacagcctgagcggctcaaacaacagaaatgtactccgtcacagttctgggggctgaagtctgaggtccgggcttcggtttctcctgagactgcgcaggctggcgggcggccgtctcctcctgtgtcctcacgtggcttcttctccagtgtctcttctttcaaggacaccagtcctgctggagccaggcccaccccacgacctcacataacctcaatcgcctcctgaaagacactttctccaaatacagtcgccttatgcggccccgggtgttggcgcttcccaggtgaacttggggaacacacgtcagcccatcccaggtggagctgcggcagtgcggggtgtggctggtgctgggggtgggcaggaagggtaagcaggggacgagggatcagaggcaggaggtgtcctggccctaacatttcctttgcttctcgtaaacctcacctgagcccacccaacaccaaggccacatcaaggagagaggacaaggggagagtgatcacagggtgtgacagtgatggaggggacccagacgcagggactacggagggcagtggggcctcacagggcacctcccacagggagcagagagcggacgatggccggtggtgatgagatgtggccctgctgtggaggaagcgccaggtgcatctgatgaaggcatgaagacacagaaggggacaggaaggggctagaaagaaaagtatcacagtcagcctggtccctatgctgtgtgcacgtgcatgtgtgtgtatgtatctgggtgtgtgcattgcatgtgtgtgagggtgtgtgtggctgtgctatgtgtgagggtgtgctgtgtgtggctgtgtgtgggtgggtgtgctgtatgtgtgtgggtatatacatgtgggggtgtgtgggtgtgtgtgtgctgcatgtgtgtggatgcatgcatgtgcacgtgtgtgtatgtatctggttgtgtgcattgcacgtgtgtgagggtgtgtgtggctgtgctgtgtgtgggggtgtgggtgtgtaggtgggtgtgctttgtgtatatgtggggtatgtacttgtgcacgtgtgagtgtgtgtgctgtgtgtgggggtgtgggtgtgtgtggaggtgtgctgtgtgtgggtgtgctgtgtgtgggtgtgggtgtgctgtgtgtgggggtgtgctgtgtgtgtgggtgtgtacatgtacacatgtgtgagtgtgtgtgggtgtgctgtgtgtggggtgtgcattgcacgtgtatgtgtgtgggcatgtgcatacacactgcctgatgggttctgaggaatgaacggatccatgaatcaatgattacacccaccaaaatttctactgattgcatgatgggaaaatatggaataattgcccattcttattttcattttcaggagaaagaaaacaggagtgagacaccaaaacgcagggctttgtttacagagaaggccgcgggggctccccgccaggtctgtgcatttcaactcagttctgtccttcctcataaacagatgaacctgtcccgcgcgcgtggtggcggcttacacggcggaaacaccctcaggtgctttctcactatcaaagagcagcttagcatttatttcatatttttgtcttccactgattcttatttattttacaaattgcacctgaacaataaaggaagtcattccaaaagcagcagcctgccccccaccagcaggcagcagtgacgtgtctccatggggccttaaaccttcagggccacgttgtgatttatcttcacacagcgcttggcgcatgcgggcctctaacgaatgtttagaatttcagtgactctagtatcaccgttttctttctatcttctcttccacgcacgtgtctgtctttctcatggtctagtcattgtaagtttgttttttaaaaagttttactaagtacatatgctactaaatgtggtgagtaaatgtttactgttcaattttatcacgttgatatactcagacttcttctgaaatgagacacaggctttctcctttcacctttgtttccaagatgctcttcctgcctctagctccccgcactccctgcacttccccgaggtcactgcactcacagagcttcctatgtgatcagttccaccaggcatagcaggaattcttctcatttgtccaaacgaacagagccccaggaggccccacctggtgcccgtgaccgaccccctcagtgaacctgcaaaggttcccatgcacaaggcgacgcttcagacatttcaccatctcactctccaggtcggacttgaaaacgctctgatcaatgatcaaatctgcttccacccaattcaaatgcaagcagttctgaggcacgattatacacaatacgtgctatttattaaccgtcaccactcagctaggttctttgccaagaatttcccaaaagaagtcttcattctacatagcaacttgttcttatccatgggaaagatagtgtcttattttaaatgcaaatgaagccgattcagcatgtacaagcagaacccgcaaatgagagaaatgttggtatatgtgatttgtaaataacagcatattaaaaatataatagataaaatgtttccaatgataaggccaggattcttaataattggataatcttaatcaaaaatcttagatgagtaaaattttcccacttaatataaaaaccacgacatcaagctgagtataaggacacatttaaattctggccaaaaagcaaagcttatcctgggagttccaaacctccttcctgcctgggcacagctctttctgggtatatagcacatgataaagagatcaatctttgagctttgttggaaacagcacacgaggtaacaccaaccaagcatttaaatttctgatttggatctatgagcattgctaatgacacactcactgcacacttgaaactcttggatttccacactcatcatcactgatctacgccacgccattcccagaattccccatgccatcctgccccaccatgggcaccagccaaacccactgagtaggcactgtctcccgcccatccttcaagaccaggctggcctttgcctgccccagaccctccaccctcacttccagccatgcccctgcaggaccccgtagagcacttcatcttgtccctgtccttgtggaggaggcaggggcctgtgtgaactgccctgcttactccggcatccccagcagccctcagcaagctcagcacaaggtaaagcctcaacacgggaggacggagttcattttcctccactaccacgagatcctggggggccaggatcctccaggtccgtcctttccttcctctgctcacccatccaccagctcagcacctacttcaggcctcagacgttgtaggtgctacagagacatctagagagtgaacccacagacacacaaataacctgtgtttaaaagtgtgttaacagcattgggtggttcccagtggggtacacactacatcatttctacacttgaaaaagtaagaattccaagatggatggatttactcaaaacctcagaaacaccactgaccagctacttctacaaacatcagttctgttttgtcctgcccactgtgcatttaggctaacaggcaatgaagaaatcttgaaactatgagaaactatggaaaaaaattcaagttttaaggaagatacagtagcaccccatttatatagcaccagtaaaagttattccaaataaatatattttcagggtaacttaaacttacccacataacaccagtatgagaagtttatatactttaaaaagtctattttttaaaaaagtattgtttatttctctgctgccttacacacagtaaacaaaagttaatttattcctgatgactaagactcctcctttaaatttcagtgaggccttgggccccccatggagcacctcagatgctgcaaagaccagtgggtctgctccccccactccagatggtcccaggtgggcaggggaggaagagccccattttaacaagatctttccacttagaataacaatcgcctccacggagaaggttttagaagttaccagtttgtaaacacagacggaatcctgaaataggactgtcaccttgcaccttgcacagagatcccagcaaacaccacaaaggtgtacaaatgacaggaaggtgtgcagatgacagagtggtctctgctaggatctctgcggtgattttacccacacaaaaccccacctgggtctgtacgtcattgctaaagacatcagatgtgcctgtttgatgctgtgaaagtttttcacatcagcccgtcttctcacaacatagaaagaaggggaaatttacaaaagagcatgccagagtctatgtctcccggtgattgttaaaagttggtagaggcctcttctctatcatctttgtttcaaaatcccttatgattttaacaaataccaatggcctgaatcaaagatgcacaaaagatgcacaggtgtttgatttcattccagtttgaagcatccattcaaccagaagagggagcacatgtttaaaagaaacccccaaaccgtcagaccatcgtcaccgacgatcaccatattaagtggtagaaaatggtacaaattaagaacatatcatgatgcttaggttcttaaggagctataagcaaaggaagatataaaattatataacactgaaagtgaaaatgaaagtaggaaactacactttatattttgtcccctctgtggtttttgggaacttatcctacaaactaataatcggggacaaggggtttgaaaaaactgtcatctaattttctgtctcacagaggagttccctcggacccacagagaaagtgagagcagatatatgcgagatgagttttgtttttaaaaagagaaaaagaacaatcttactcagaaaaaatccagctggattagttggtcatagattgttattttacactgaggtgctttttccccacagttctttcttggtcaaatcatggtttctttctttttttggttgaaaaactacaacaataagagatcaaatattccataactcaccaaagacttcagaatcaacttgggtgagaagagcatccttttctgaatgtggatgaagctgccccgatcccgagtttgtaggagagccattcgtcctgaaattgttggataactgctccctcccactccttggctgagagagtcccacgtgttgggggcaagaaccacacatctttgtgcactgttcttagtgtctgacacgtgcctttcggaagcagatgtttaaaacaatctgctcagtgagtgcgtgaataggtaaaaggttagggaatgaagggggaactgccgggggctgatacatagatgacacgacgctggctttacacaccacatcacggtgagactgactccagcaagcttacatcactcagacggcaaatatttcaaagaaaaaatccatagtgtttagtaagccacagaagaacattttaaagtaaggagtaacaaatctgtatggaagaatttccaaaattcacaaagcgtagaaagaagattgttaaaaagtatgtccagtgattgacttggagtgggtacggaggcatgggcagtggccctggactgctgcctctgctggcaccagctcttattaccaccgcttgaagaacatggtacatttgtttctcatataaaaatgtgaaagcaggcaggtcggggctaatatggggactcatccatgaagccctcctttctcccctcttgaaattcccaggtcacctcttggaccatggtgtagcatcagctccggccatcacatctgcattccaagagcagggatgagaaagagaaatgaaggagcaaaggcacatacctaaccttctagctgagatccactggccacacctagatgaaagggagctggcaaatgcagattttactccaagtaggggtgactgtgacccaaatcaaaccctcagttctatctctccagaagaagaggaaagtagaccttaggctcagccacatctccatggagagtggaggtggtcagacagaagtagagatttagaaaagttcatgtgcccatccttccacccacaggcgggatgccaagcacttccatgtttgtcctctcatatatgactcgtaaggccagtgaacacctgtaagaatctgaaggaaaatcaaccataaaggagaaaagttaatgttaccccctcaagcttaggagggcttccataagctgaagagcaggctccttgagggagatactgggttccttgaattccacttcagaatcatggccctgtgccttcttttcctgcttagccaggcagctccctgcacagacttggcaagtttccaagagagtgttcattaatcagagctattgcaattgctgaatattctccagcaaaccattcatctatatatccatccatcatccacctacacatccttccattcatccatccatttctccatccatccctccagcctgccttccttccttccttccatccacccatccacccacacatctacccatccatatatctatccatcctccaattcatctgttcatccatccatccctctatctattgacctaccatctatccaaacatacattaatctaccaattcacttgttcatctatccattcattcacccatctatccatccatcatacatctatcaatccatctatcatccatcattcatcatctgtctatttacccatccatctctccatccattcacccacccacccatccatccatccagccagccacccactcatccacccacccgcccatccatccatccactcatccacctatccatccattcacccacccaccccatccatccacccacccactcacccacctacccatccatccatccacccacccacccacccactcacccacccatccttgcatccacccaccagtttacctgttcatccatccatctatccctctatccatccatccaatcacccacccattcatccatccaccaactcacctattcatccatccatctaccccatccatcatttgtctatgcatccatccagccagccacccatccatccacccacccacccactcacccacccatccttgcatccacccaccagtttacctgttcatccatccatctatccctctatccatccatccaatcacccacccattcatccatccaccaactcacctattcatccatccatctaccccatccgtcatttgtctatgcatccatccagccagccacccatctattcacccattcacctgtccatccatccatccctccatccacccatctattcactcatctatgcattcatcaaccagcatccatccacccatccatccctcatccatcattcagcatccatctacccacacacccatacatccatcactttacctgtttgttcgtccatccatccacccattcatcaaacaatccacctgctcatctattcatccatccctccatccatctacccatccatcaaacaattcacttgttcatccagtcatccatccctccatccacgcatctttccaactacccatctatccatccacctacccatccattcaggaagccagccatcttttcacccattcacccgttcattcctccttccacccatccctcatccatccacccacctatccatatccatcatccatcattcatcatccatccatctatttacccatccatttctccctctgtccctccattcatccatccatccacccatccggccagccagccagccatctcttcacccattcatctactcacccaaccaaccatccctccacacattcatccatccacccgtccatatacccacacatccatccaccacacatccatccatctacccacccattcacctgttcattcatccatccatcccctacctatctccatctgtctttcctcttgtttcaaaaaagatttgattgtttttatcaagtatttttagtgcaaaagcttactttcatttcctaatttttaagagaataagaacttctcctgaatatcatcttttccctttttgctctctcatttgtctctctttttcttcccttgtatcttgcaaatccctcagataaaagtgggttgctgaaatgagaggctcagatagagcagagggaaacaattcagctccagatacccagggggtctaggcggtcagctgacctttcttcatgagcactgcagagtgccagtctgtgcctcatttctactccacgttgaatctttgaatctagtgatttggttgttgatctttgaacttctctaagccattatacctttagttccctcttccccacttgttctctgattgttcattttgtttttaacctaaaatgaacaaatcccctgtctaccgattaaaaactctgaggtctttttagttaatgtgtgacaaatagagaagagatggggagagagagggaaaaagtgagaggaggggtggtgagagagagagagagaggaagagagggagagagggagagagggagatagagggaggggtgggaggaagacagaaaggtcctcaccgcccccgcccctcacccctgtatgtgcatctggaatccactttcaggggaaagcagagccctttctctttactcaccagcagttcatattgttaatttttaactaaagacaactgatttttgccagtagcagagaacgtacgaggtctttcttcctattttctgcaattaagcaaccagctattattaggagttcaaaacaaatcacaaacatgtctgtctattacaattgtctaatggtcccaggtccaacactaagggaaacacatccattcactacagcctagtaattaagacaaaaatagacacggaagccgcgatcgaggaggagggggaacaaaagggtcagcttccgctaagaaagcctcagccacgtccctggggaagtttcatgtctttcctcacacgtggcagggacggctgtggggtcccagtgtgtcacctgcgtggccttttcaggttctgggggcctcggtggaaaacacgcacagtgcatggcctgacacccgctgtttttcctcgttcagggaataagagccactcccaagaactctcattcagactcgtaatcagcaaatcaacacggatgcctctcagagaaaaaacgatgcttccgatttcaggagccccctgatgattccgagtctctcatacaagggaggtggggaggatgggcagggctcgggaggtccggatgactttccccacggacacgggcagagtgtcacacttcacaagccacagatgccttgcgtggcctgtgtgtgtttagaccccgtcctgtgccccgccgggcccacagcacagacgcgcctggctgaagggcgagggggagtgggctgtgagtgtaagaaagtcaccagagaagggccgagtcgagaaggggccactcaggggcctccctgtccgaggcgcggagcccagcatggctgacttcctctctgaaggtcattagagatggatcccaataaatacacacacacccatcagattagcagacccaacggtctccatggcaacaattggacaagcaagtcgcctgcaattggcattaatttaaaatatttttccccgagtctccttggagtcagttccgtgaaacacaagtgcttgccagctctctaatctgcggcgtcctttgaaattccatccagcgtgtgctgaagctgagccaattaacgtggagagaattgggtggatcgcagagaagctggcaagaccgtgtttaccaattaggttttttttatgatgcaaatgttgcacaccatgcggcaggaataaaagctggctacgctgaatatgaaactgttaattgcattttcagagacatagctacaaggtgaaactaatcatacacatgataaccgggcttcaccacctacagtgccctgctgctgcactctcactaatctgtattaaaacagccccacacatccttgcaggaaaggaaaacattgcgtttggtataaccttccaattttaaagagaaaaaaagtgtgcctatgtgggaagcaatataaaggataattttcatttaaatcagattaataacgttaacaaacgccatggcaaagggcccagtggtgcttcttgaaatgcattttttgctttaaaacgatagcaaggtgcatttgcaaatgaacgccagcacatgctgacaagagtggctcaaaatgaaggagcttgtttcagaagaaagggccatggtaattatagaccttggctttcccagctaggaacatcaaagaggccccgctggaatcactagagagaggcttcccagggagtccagtgctcctgaggttcccagtgcccagcccctccctggggaggggaggatgaggcccaggagcagggagaagggtctaggctccaggctccatcccagtgcttgggggcagagaggggtgcccaggagcacctgtgtgcagggagtccaggcctgaactagcagaggcatttctgaaatggggtgtggctactttaaggggtgaggtcagctttcaaaatgccccatgagaatttatgtctttttcctcatttctatgttaaccacacagtttcagcattgatgctgacgttgactaactcagcagccgagaacagggctgggaacaggagggaatgactgactccccagcagcagcccacgtggggacccttgtcagaggggtctggggtgctacaaaggaggagcacccagccagggctgggcggccagcagggacagaaggacgcaggactctgcacggctccacagctcacacctcaggatttcacacacgcacaaggagcttccgagacagaagccacctgaggctgtgcccatcggggtccccttcttttaattttgcattgcagtcagccccgggagttccaatggaagcctctgctcagagatggtcagaagagcctccgagcccatcactgtgggctggggcctggatgtgcactccccagtgttgtgaacactctcggattccatgtgtccctgcacctcacagtttctggggccaagcgagtagtgggtttgaaagttcccagagattctgagccaagatggggtatgtgttgcggacttctaaatggctagggaagggaatttaaaaggaccagcctgattcctcttcaaggaacgtgtggagctggagctaggccacatgcgctgctgaagtggtgggtaactggaacagtctgtgtgcttgttcacaggcgccgctggccatacaaattagcacaacaggacaggacgctgtctgcagaaggaaaaggctcttgcctgtatgatgtttctaacacacggctaaggtggccagagaagacaggcgtagcgtgcatgctctgatggaatttataaccgggagcatataaatccctgtttgtgacgtagaaaaccgtgaagctggatctgcctggaaatgctaacttctgggagcttcacatttttagcctatactagtgacgtgcacttaactttgaaatttgtttcagaaaatgaggcctctacaaggaaaatcatctcggcttgaaatggatctcttgtcccacagtggctgcctcggtgtactgttaccgtatgtggtagagacggttcctaaccaaacgttcagtttgtttctctttaagaatataagaaagtaggccaggcacagtggctcactcctgtaatcccagcactttgggaggctgaggcgggaggatcacctgagatcaggagtttgagaccagcctggccaacatggtaaaaccctgtctctactaaaaatacaaaaattagctgggcgtcgtggtaggtgcctgtaatcccagctacttgggaggctgaggcaggagaatcatttgaacccaggggcagaggttgcagtgagccgagatcatgcgactgcactccagcctggcagacaagagggagactttgtttcaaaaacaaaaaaaaaaaaaaaaaaaaaaaaagagaatataagaaagtataaacagagtgaaattaattcattaacattaggaagtagaaactcactctaacgtgacccacgctagcatgagataccgtgtaactgtactgggtctggatcccccacggaagcacttgcagccggaccaccgaagggctcacgcaggcccatcctcccaccacgggctcccagcactggcaaaatgccactcagaccacagctgcaggggcctccccgatcctggggctgtttctgtaatagagtgtgttttgtcaccaaatgatatttattttgtttcaagcattatttccaatgaacaaatatatgctaaatcaatcggcatgtaattaaatagcacatggataggacatgcgatagaaggagggggcagaggccgtggtgtttctgacgccgcctctctttaagggtggctacaaggacgtgagctggagtgaccgtgtcagacagcgcggtagaggccagggatggggctgcacaggatgcccacaaggcctcgtgattaactgttttttatttgtgcaattacttcttttccttccttagtatctttcttctaaaaaattcaaagaatgaaagagggcgcttaaattattttaaatcagcaggattttttgaggtcccatcatagacaagacctatattgagcaaaccaggctgtagagttagtgttcagtggaagatggtgagcgggctgtgtcccctccaagtcccacctggtctcagggaccccacatctgcaggcctggctgtgcctggcaatgccgggggagccgcgcagcatgaaacggaccctgtgctcggtcttgaggccacagctcggccttggtgtggctggggccgcacagacacagcacagcggcccccggcatccgcaggacacggttttccactgttttaccagtccctcagcttcgccagacatccctggatcccagaccctgctcctcaggtccagccattggccgcggtcctgctccaaaccacaccggccatccaggacccagattcaatgcccagccctgaggcttctgcactgcagctcatcctcttggtgagagcccaagctggggccctgtgtccttgttgagcatggtttgaactcaggagcatctgtgtgatggccagagcccaggtggggtgaccccagccccagtgctgcccgttattgctgccactgtcattatcactgtggctctgtgagttacacctgtgcttctcagctactgcaacttacctccttcagccaacactacacatacatgagctccagggagggtggccttgtgcagccatctgggtagagacgcagaaagacttcttacagtgagtgggctttgcctgaactgagctctcagagatgagggggtgagggggtgtcccaggaacaggtgatgcctgggcagaggccacctgcagctctgggttgcggggaacgtgagggacaagaggagagggaggggcgagggcacagaagtggggtttggcctgcatcctacgtcccgaggtcactgtgggcttgatagtgggtgcggagaggagaggccggcccggggtcatggtgaagccgtcaggacagaagcagtcaggggctggggcagccttgcccaccatgttgggggtaaaatgcaccatgtgctcctcctctgacgtggctgtctcagctcccaaagcccaccagccaacacccaatgattatggtagaaactgatacagaaacggaataggtaagaaagacaaaagtagggatcctgtgtcaagtctaagggagtgcacaggagttgtgttttgctgaataaaaagggaagaagcctgagccactgggatcactgcaataaccttcttcttccaaggccctggtcctgccggaagtgtggatgccgtcctcactcaggctcccccgacagccggagccccctctatagaggaggctgttcctagacggacatcgggtcagacggtttttgcttaaggtaattaaattccctctaccaccctaaaaataattccctctccttgagatttctatacttaaaattcttaaaggcatttattgccctgccttagttgctgctttaccaagacaaacacacttagttcctttccacttttctcacaaacaaatccttcagtctcttaatcatttatgttgcttttctctgaatttcctccaatttgttgacatcctctggtttctaaggttctaatgcctatatttgctttgttagaacacagcaggtattaggaaagaattggatgctattcaagccacagtaattataagggaaaacaagttcaaaagccttgagtgaaagcagcaggtaagagggaggaaacatggaagataatgaccaatgcatataatgcttttctaattcaggacaagaccatgagaaacttcatcagtgatgccggcaaaaaccaaatacctaaatagatacataaatgtgtgtgtatgcacccacgcacacgcacacacacagaggatatcattttaaaaagaagggaatatatcggtaattagcacagaatataaatctccccccgagagatgggtgcagaaggacagcactgtgaggacacagccagaaggcgctgcccaccagccaaggatagaggcctctggaagagccagccctgcccacatcctgatctctgatgtccagcctgccaaccaaggagaggggcctcgggaggagcagccctgccccacctcgatctctgatgtccagcctccatagtggggagaggatgaactcctgttgctgaagctgcccaggctgtagcattttagtccaccagaaaagaccactacatcggccaaccctagtttcaataaaactttatttactaaaacaggtggggctgtccatgggttagaatctacccacctctgtcctagtaagtattaaaataaaaaatgaggtgacctcacaaggtccctgtggagaggcagagaaatggctgctgctactgccctggctgagccgggcagcctcgcccatccaccatgaggcgagaccccacactccagctggcctcctccctgaagggccagatgggtgacaggtccccagaagcttcggtcttgggcttgtcctggtaggaaaggttttcccagccaagtgcatcctctgcttgtcagcagcttccacagacatggtgagaggagacattcaaggatgaatttaaattgtgaaactcaaggggcatcacctgagtgcttttactttccccattgctgaccctacagcatgatgactccgtttcctacacggttccgagcgttttccatccttcctgacggcctccaccacgagacttcaggtcatcctttaatgagggcccaaggaagcacccccactctccagttccatgatttcccacggtgattactgagggaagaccagcgcagcccatgatgtgttcacagccaaggccccggcacctgggcactctggggcagcccgtaatgtgttcatagccaaggccccggcacccgggcactctgtctggggcagcccgtaatgtgttcatagccaaggccccggcacccgggcactctgtctggggcagcccgtaatgtgttcatagccaaggccccggcacccgggcactctgtctggggcagcctgtaatgtgttcatagccaaggcccaggcacctgggcactctgtctggggcagcctctggcttttaatgatgcagcaaagcatcaggctgcccacgccagaaggctttcccccacggaggcttccgccatgagtctggaatgcgttctgagcacccctggagcagggcactgttgggttacttgaaaaataggaagaaaaagaagacaatatccctggaccttagaaacctcaatgatcaagagtagcgtttccctccacggttgcccaatttcaccttgttctgcaggggatggcaagagcagggtcgccctggtgagtctgaactctgtgcactcctgtttagtcctcaatgggaaatgggaaagggctttgttttcagtgtgcatttatccctgataaacaaaaatcacggcacaaagcagaacggtggctgttttcttgtgactcattattaacaagttttaaactcattcatcttggaaaactctcaacaatttagcacagaaaaccactttaatgaattcacctaagcccatgtcgacaaggagtagccagaagccaatcctggtttatttctccaacatctcgctaaaggaggagctcaccacgtaagcgctcccaggcctgtgtcctgggaaacactgacagacagctctctcagaccccaggtgagtctctgctctctcagtccccaggtgaggctctgctcccatggctgcactccgtggccagtgctgctcccaatatctgaagacatcttggcctctactgtggctgtgtgtatttttctttgcggtaattaacactctaaaaaaaatttctctaatctatattttgaaataactcaagcagaagttttcaaacacgcacattctgcagcactgtcccatccactgcaaaggagaagagccgaggagcgagttccttgttctgctcccttcttgcggtgtcccccactgcctggactacagtatttcctgaaactaaggaagacagttgcgtagagaccctgagcttgcattcagcagacacacacattcttaacctatcttgaaatgagtaaacaaatcttcatgcccagtttgtcatctcctccttacccttgccctcatcaagccactcagtcatgtcagtccctcctgagtcatgcacatgcatgcaggcacacacaagcaggcacacacatgcaggcacacacacgtgcaggcaaacacatagggcctggcacagacatgcaggcacacacacgcaggtaaacacacagggcctggcacacactcgcaggcacacacatgcagacacacatgccggcacacacacagggcctggcacatgggttctatatttggtagataccaccattacctccaaacagagctgctaaccactggtatctatcagcagtttcaattcctcttgatgtgtgagggtcattttgtcttctatgacaatgccaaacacaccccagcaaagctctggggtagtgtgaacatgcccagtgcaccccaacaaagctccgggatgttgtgaacatgcccagtgcatcccagcaaagctctagagcggtgaggttccgagtcctcactgctattcagcacttgcacatcagaaacccaggcatctggatggccagtgctgacttaattgactggtcagtctcagcaaacctacagtcagttccttccaagaagcaaatcaatcagaagaacacaggttccctgagctgtccactcagctgaaataatcgctctgcagccctccgtaacttcaagatctctagtgaaacacacacatttagatttttaagaggaaaaaaatgccaaaatgattgccaagacatgcactgggcattccctgggcacacagggcacccgtgcagctgtgattctagggacactcgctgcccacgtcctccacaaggtcataggcattgtaagccaggagtgcatcctaggccctccaagaagacgaccaccaggatgtggctcctgaccccatggggctgatctgtggggcagaaactaagacaccttgtgacaaacaagcaatggaagagaaaactgctttaggagcaggaagggggccaaggccagcttggcaggagctgatgaaggctttccagggaggataaggcatgagcaacttcagttgtgctctcaacattgacctcaattcctttccactgcctctttctgctactgcacttagaaaaatgtcatacacacaggaagttttcaataagcaacaaaatttacctaaaaaagaaaaaggaaaacagaaacgaaaagattgagtggggtttggggcctgcagagtccttgtctgcttgattgtgggcagtgggtggtttgtgaatgtcagaataagcttttcttctcagatgggtaagcgggcagctgggctttgcagtgacaggtgccccgaggaaagcaggcaaacatgcactggacaaagacacatgcagccctattctaagaaggacttgacctttgagtctgaaaaacaccctgcactttaggagctcagaagagaaaggcatcatttcagagtgggagagccgcgcctccttgtcagtgtgatggttggtaactagattggcaggtaaagccacaatgcagttgatgtaccctcatctgctctattattaaacatccaaaatacattgttaatattttaaaaagcagacaaaggcccccatggtatgatacaactggatgggtgtttgttctcggccatgctgagagatactgacatccccaagtctctcctggcacccccagcacggccgccttccccagaaaacaatgtcagattttagaggctgaattgtgtggccaacttggtttacttctttaatagccctgtgggaacacaactgcttatatgtgacaaggcctaactccacacagaacaaacacgagtatcaaataacctcacttaagctaaagaaacacacacatatgtgaccaccttgggggatgatggctggtgtatttgtatttccctgctcagcttatcagttggatatcggcaagtaagatttagaagcagaaacataaaatattgaacaaaaactaaaacacttataaaaaggattcgctgtgtggtgtgaagctttgtgcagtaattgacacaagatcagaaagcaaaccctaagaaaagcggcacccacactcccagcgccaggccagggattaacgagcccggcagacaattccaatccggagtgggatttgctcttccgtttacgttctattgtccgggtcttatttttgctttcaattccttttgtaatggaggtagcagttgttattgacaattaataggggcttcaaaggcagtcatgtttggaaggggcagcggcttccctaagacccctcagctgctgctcaggtgcagctgctctgtatgccaagcacggcccatgccgggccccgtcgaggcagcacagatatcgatttagatggaaaccggggtcggcgcggagggaaggagctcggtgagcttcgcatgctaatgtattatttaggctttgtggtttcatccggagtaagtgcctatttaggaaaaattacagaatcagtatctctgctactgatatattttccctaacagtaattcacaggtaaaataccagggatgatggaaggtatttgtgcaaagattcaggaggagatggtctgatctggtgggctgggctcgctgggggggaccataataacgcaaagcaaacaacatccatgtgggaaggtccactggccgaggacgggcaccaaggctgccctcagatgccagccggacagcatggcgtggattttggcgaagctgagtgatgcatgctatatgcatccttattgatcgaaattattctttttactcaaatatttacaatgtaagataattccttgtgttcatagttcttacataatcatacactaaaacaacttttaccaattaaagacaaaaccgagaccctcttccacgtgagatggtacaggagggagctgcagtgggcctggctgtggggagcaccctggccactgtttcaaagctgccccctgagccccacagaggtgccctcaccccacaaagcacttccactcagacgtacaggacaccgggaggaaggcagagtgccctccacgtataccgtgacaggtcaggtgcaaggaggccccatcaagaggcctgaccacacggccctgtcctctgcagggctgcgtgaacacaggacacacagcagtgatggtccagcagccactcggctctgggcactgtgtcagttggcactgccctaggtatgctggtgacaaacggttcaaatgaccccaccatcgtgacactcgacccttttggcccaggaactgccattcacgggcacagcacacctgctcctcccataccgaacctccatcatctccgctgaccaggcaggtccggggtcctagaaccaacagggctcacccaccccagccccaggcagagccggcccctgtggaaagtgcccagccacagccaggactttacccacatgcctaggccaggccctggtcatccttccacaggtacgtgaaaggtaaatgtaagtggcaggaagtcaaatggaactgaaagccacctcgtctcctggcttccactcagaagtggtggaggaaatactctcaaatgaaatcatgtgatcctgtttaaataaatggaaaattaaaaggcagggcactggctgacccttgatgccaggaggggcagatgtggattgacgtggctctcggcccccatgggctggtattgggcctccttgggagcagcctgagagtgctcattcttggccaaatcgtgagttccagagggaaagagatgggaccaaaaaccttagggagaaccttggggccagctgcagtgggaacacatgggcaccctccacaatcctctatcctgacacgatgctccttttgtgtctccactgtgtttttcactcccatattttcacagttgtgattcaacctcaatgcttctggaacccacaagccacccagcctcactttctaaaaatatgattgagaaagcaagacagagtttgggacggaggtttctccagcggagcagagccctggcatcctgtggaacatattgtgagtgttcacagccgagaaagtaagatgactgggatgtcattttcaaagaggaaatgggccccaccccaacagggccaccgagggagaatcgcaggaggcagctcccccaaaactgggagaaggtcaggcctgggttcccccataccgtcatggtcttgagtcagaaaccagagatttgtaaacagcatcaaaagccttcacttccttctgcagccttaaagtttgaactttacatacattttagacatgaaaagtacaccaagaaagccaccatggtgagttttaggcagagaccctcttgtgaataattcgtctatgatccaagatggccagacaagaatcagggcccaagctttttctccccagtgtcacatccacgctgttgtctcctctccagctcagaccaaaattctctggacattttcatggctgaaaaccccaccagaacgctggccctgacaggaccctctcctcaagtcctgaggacccggctgcggccagccagaatgtaaactacagctcgcagaagcagcaggcatggaggaagaggcaggagagcaagagcagaagctcgaaaccttcaaagggagcctgaagaacaaggccaggagaagcagcggccaggccccaccggtttcctcctttccctcctgaatctaggacagaggccatttcagacgagagaggaaagaacaacaaaatgaactgcaggagaagcagccagagcctgcaaggcccagccagagacggcagaggagagaaccgcaagccaggagcaaggaggagacaggtggactccactaaccaaccgacgcagcccagcggagacaggcggactccactgaccaaccgacgccacctggagaaagtaaatatttaactgtcagaaggaaaacactgtttgaacagtagtggccttaggaagaaggccctaatttttttgaacactgaccgggggccattctttacccagagctactatgtcccgcgcaaggcaacactggctgaagcccaggagggcggggcagctgcagaccctcaggagcctctgctggctcagggagcgtggggagagtccagcgtgcaccagaaggagggaggccacctctccttgcggcattaggagaccagggtctctgaaagggcggggaccacggccaggccagaaccaccacatcaccaggctgaaggctggttaacctggtggaatcagctgtcttcatgttcaaaccagcacatggggctattttgctccagtcacctggtgtgacatgagccactgagactcgaacacccctgctctggagcaaagaagaacccacacctctgtcctgcctggcagcctccccaccactcgccgtgggcacggggtccgtatccactcgccgggggcacggggtccgtatccactcgccgggggcacggggtccgtatcctctcgccgggggcacggggtccgtatcctctcgccgggggcacggggtccgtatccacttgctagggcatggggttcatatcctgtcctctgtctcctctaagtgtcccttaaacttaaggccaatcctatgatttccctctaaaagcattcttccgaattctaccccaaagaaaccagtgacatttctcaacatcaggcttcctaatctctgcaggccgcctgaagaaaaagaagagatatgtgtatggccatgccatttggaaatagaagaaaagcctttaaccgccttctaccttcagctgtttttgccaagcagagaaggtccagaaagcaccttcaaaggggctgggagctctggccctgcccatccacacagcaaatacagcaagcagaaataacacgttcacaggggctggaggctcctgtcctgcccatccacacagcaaacacagtaaccagaaataacacgttcacaggggctgggagctccggccctgcccatccacatggcaaacacagcaaccagaaataacacgttcacaggggctggaggctcctgtcctgcccatccacacagcaaacacagcaaccagaaataacatgttcacaggggctggaggctcctgtcctgcccatccacacagcaaacatagcaaccagaaataacacgttcacaggcttctcctccccactcccaactcagctgcaaaacagctgataaaatgaggatgggctctatgtaagtaaacagtactcgatctaccagtttacgacatcatcaaagacatgtagagagaaaatacatacacaggtaataataacaatgataattctaatactattttgttagattagaagcatttttcctggacagaagcaacatcacctggggtcccagtggaaagcacgggccaggcgtgctccctgtgaccaggtcagagtgcagagcccgcctggtgacctcatttccttagggcaattgtaccttctgtctggagccaggtccctcttaaaggtagaagactgcagaaaataattcaccagaagcaggcatggtgcatccccaggacggatccttcaccgcacccgagaacccgcaggatgaggcagctctgcgcaagcacctgaccccctgcagagctgagatggctgctcggggactatgtcccccagcaaagcacagagctgagccagctgcttggggactatgtcccccaggaaagcacgtctgagtcttggctccagctcctgtgtatgggatgtgatttggaaatggtctccgaagagggaagccagttaaagatgaggccatcagagtggctcctaatccagggactggtgtccctaagaaggagacactggacagagacagaagtgcccagtgggaaggcgaggccagaattcccgagaacacctggtgacccagcagaggtgggagggaggcccctgtaagccgaggaatggcaggggtgtcagggccaccagaggctggaggaggcaggaaggaccctctctggagccttcagagatgcacggccccgctaagaccttgatctcagaccctggggggtgcagggcctggagagctttgcactgttctaagcctgccagtgtgcggggctccgttgccaaagccttgggcactgcacgcgccatctcagaccctctggccccacacagccagagctcagcgatgagccaggcccacagctcttcctcagggccctcgttttctctctctgcaagccttctcctttctaaactgttgttgctaagtcagaaagagaagagaaggcatcacgttgaataatatcctcgagtgataaatctgcagtatctgctgaaggtccacagataatgtgtttaatttgacaaaccagggacaagaatgatgaataaaacactacttgctgataaactggaccactgtggcctttaatattttcccagtcttcctgggttttctaaaatgtaaaaacagagctgaatgtctgttctggaagactgtgtgatctgacagacgacctcgatctcaccgtgatggagacatcaatggtgaggtcatgacttttgcaccttcctgaattttttcctgcatccctgtactcactcatttccagtatctgacatttggggtctatttggttttgaaggaaagacaggtctcaccagagggtggagcaacaaataataaagccacagaaatgctcttaattgtcataaaatattcatttataaccaatatgtttgtgccaaattccgtcactctgtgagaatacagtgtacccaagtgagagatttagaaagccctttaagctgctttttacttgttaaatgaaaaaatataatcattaggcatattcaggaattgggaaattaatgcttattagacttcaggaaaaaaagaaaaagataaatggagggcaagcagaggatattctccaggaagacagcctcagccacactttccagaaggcatcgtaatcttcagtggatgttatactcatttatattttaaaaaaagaagaaaggttaagagctggtaaataaagtgacagataaagtcagaaaaacaatttaaatcatcgagtaaaaaaggtgggcggaagtcagacgcgggggctgtttacagcagcctcaggaagatgcattaattacagtcgctgcaaaactacaaagacggtgctgctctgcagccggcgctccgggggcccgcgagcctctgaagtctctgggtctcctttgtttcttcttcatggtgcagaaggacatggtgagcagcccagctctcactttcaagggacctttggctgttttctccagcactgctgagaaagaagagcagccattctgggggctgctcaggccccggcattccagctgctgtgtggagtcttcggcttccctttcggaaacctgcccccacgcctggccctggctaagcaaaaagccaaatggcattgcactcacatccaattaacttcccattttcagcaattattgcttcgccgggagcagcaagatgccctctgtggggaagcaagggcccaggaaggggtggctgatgctctgatgaaggcccctcctctgacctctaggccacattagagacagcacagcccctggccctctcctgcccctccttccccggctttgaaagcagaggtgctgcatttggggcaagttctggtcagttctcatggtggaggagaattaaagttcagaggagggcaaaggcaaacaaaatgacaggaggaaggccggatgcagtgagtggctcctccgcctgagagacagatgccaagagacccaaggcaggtgaaaaagcgcctctgatgcacagagacgttccgtatgcaatagactcgggctggacaccgagaatctcaactgggtcaattcagagcaaaggacgcattgtgcagtgagcagtgaattcatacaacgctaaatgcagagattctaaaatggcttagacctaaaatcacagagcaccaggcatttggctccactgaccactcagagggacacatgcagggcagatggggcttaatgacatgagcagagtaaacccaggaccacaacggccccacgtccagcaccgtgtggaggacggtacatcttccatgcctccaggttttcaggagaggagctctgctgcaccacgctgggagagatgaataggctaagcttattgtcaaaaggcattactgcagaggaagggaaagtctcattatcagaaacctcaatgagttgtttcttcagatgtgcttacccagtaattttttttttctgtaagtcgctcactgatgcaatcagccaacttctgtctcccaggtgctgtgctcagagaaataagaatttgctctggagtcagaatggtttagggctagaggcatgaatctgaaggatgtcagcctaagcggcagtggccaccaagcctgacagagccattgggggccacgaataaagccttggtgcctggtggtggccaccaagcctgatggagccatcagggccacacatggagctgtggtgatcttcttgactacctgggcagtggaggaggatgtgggacgagagaatgaggaagaaacgagtcggtgattagctggaatgataagtcgttttagccatgttgtgtgataaggagtttggctagccttggtcctgttcctggaagcagcctgagtccttgcagcctcctgagtcacgggagtgaggtcatttgtggtgggcccctcggaccacacctgattgtttatgcaaatgaggtgacaggacgggggctgtccacaccaaaaagaccaacaatgtgatgggtgagtgggggctctgagccgtgggatatagtctgatctcaggagaggggagggctggtgggtgggttaaagcttgtggccaatggttcaatccctcacaccaatgtaatgaaaccttgatagaagctctgcatgctgaggcccaggtgagcatccctggtcagcaatgctgtgtgtggctggctgcacactgagacctcgatagaaactctgcactctgagacccgggtgcacatccctggtcagcaatgctgtgtgtgtggctgactgcacgctgagacctcgatagaaactgcacactgaggcccgggtgagcatccctagtcagcaatgctctgtgtggctgcacactgagaccccattaaaaactctgcatgctgaggcccaggtgagcatccctgcccagcaatgctgtgtgtgtggctggctgcacactgagacctcaatagaaactctgcactctgagacctgggcgagcgtccctggtcagcaatgctctgtgtggctgcacactgagaccccattaaaaactctgcatgctgaggcccaggtgagcatccctgcccagcaatgctctgcgtgtggctggctgcacactgagacctcaatagaaactctgcactctgaggcctgggtgagcgtccctggtcagcaatgctctgcgtgtggctggctgcacactgagacctcaatagaaactctgcatgctgaggcccgggcaagcatccctggtcagcaatgctctgtgtgtggctggctgcacagtgatgtggtttggctgtgtccccactcaaatctcttcttgaattgtaactgccacaattcccatgtgtcatgggaagaccccagtgggaggtacctgaatcatgggggcaggtctttcccatgctgttcgtgtgatagtgaataggtctcacaagatctggtggttttataagggggagtttccctgcactttgcctgctgccatccatgtaagacgggacttgctcctccttgccttccaccatgattgtgaggcctccccagccacatggaactgtaagtccattaaacctctttattttgtaaactgcccagtctcagatatgtctttatcagcagtgtgaaaaaaaactaacacaggctgggaggggcccatgctaggccaagatctggaaatcagggcaggtgtgtgagtgtctcaccctgagtccagcacctcagtcccccaaacacaacagggctgagtcgagttgcatcgtagctgaggcctgggccacttggggtgtaagagctgggagctgctgacagggagcagtagcagaggcttcagctgcaagagagtggcctgaattcggagaagcagactctacttttgtggggtaggctttgtgtgtgcacacaggagcctgcctgtcagccaaaaccctatttgcaatgcttccctgctatctgccctgagcaaaacattagaaagctgggatcaatttagtaaattcttccaggctcactctccatttctttaaaactccaaatcagaacatgtggcctgagcttaggaggaacaaaatttgaaattgtactgcccagaaaacccagtgtggatagtcagtgtgtttacacgcatcgtcacgatagtgtgtttacacgcatcagcatgacaatatatgcacttttaaatactctcacttcatagtcaacaagtgtctcaagtataaaactataagaagagaagaaagtctagagatgtccatttcgagcacacattgtaaaaacagcacagaccctgctcccagtctaatgcataaatactgtaaataaaaagggacaggcacaaattttgaagcattagtaaacgtgaaaggaaggaaggagaaatcccagatgccagaacagagaaagcacagagctggggcaaagagcaggcaagggaggcagctgagtgtggcagtggcaggcaggggggtctgttagggcccagcaggctggggttggggtctgcccacaggagggcagggggcaggtgctggcagcgcacccccaaggactgtgcatacctgccctgcacaaaaggaatgccaacaacccgtccacaggcaggcgggcagaagagcctctctttctcaggctctggatgaaaacacaaatgcctctcattagaaatagaagcctgaacctgtatcccacatgagtgtcaaatcctaatataataaaatactcatatatctaacataacacattgatttgaattgctaattataaaatgttggaggaacctttccaacaatgagagttcttgggacttccacaggattctcataagaaaagaaagacatcaaagacaagcatgtaataaaaaattataaaccacgtagaaaacaatctgtaatgagaaagtgtgagcaaaatttaaaagaaaacgcaaactagagaattaaccccatctgacctggagataaaatgatagcctgagacttactggcagaaattaacaaaccagaaagcagcagagagcacagacatgagcagagttgactgtttaaaaatatgaaggaaatacaaagatgtctgtcaaaattatccagaaaggaaagatgcaaaataaataacactagaaatgaattaggggcataacaataacatatacggagatatgcaaaaccacaagaaactgcaacgcacaacagaaacgtaattggaagacataagtgaaatgaatcatttttaggaaaaaaaacaaaaacacaaaatgccagaattgaattgaaaggaatggtatctgactatacttgtaaccattagttaaatcagtattcaaaaaccaactctcataaacagcactaaagccaggtgacttaaacactgttactaaagcttcaagcaacatctgtttcctcctatgcggattttagatttttcagtctaggacacaatttactttatgagatgagtattacttcgatactagcactgaaaaacagtaacacaatgaaaataagggaattccatttctcaaaaaataatagcaaccaaatataacagagggaaatcagtaaaacaaaaagtgaccaaaaaggtatatcccaaaaatgcaaaactggttctactccatgtaattcactttactaagagattaaagggagaaaaagtccagtaatatcttagagattcaagaataagatttggtccattcaaaattttttaaattttaagaaactaggaataaagcatccttaacccaataaaagttatctaataaaatccttcagaaataatcatcctttaacaaggtaaaatgtcaaagacattttcttaatgcttgggatagataatgaagccttccttgacccctttgattcaacactatttggaacaccctagatactcaatgcaatgacaaatgttaagatatacagcattagaaaggaagaaagctgcagatgacatatttgtttacatggacaatctaagagaactgccaatcaagcaattataacaaatataagattccttcaaagatacaggtcacaaggtcaaaatacaaaccaatgtgcctatatgccagcaacaaccaattatataatatcttgaaatagttagaagttaatttaaaaataatcctgatcatgttaagctacttcaaaaaattttaataaaatattttaagaactttacatttaaaaatactaaaagttcattgaatggcaaaggaatatctcactcagcgaagacacatgccatgtaagtacagaagtggatgggaagaccaaatgtcgtaaatacactctcaggtctcctaaccatggggacatgttctgagacatacatcgttagctgatgttgtgccaacatcacagagtgcacttacacacacccagctggcacagcccactgcacacccacaacctgcacggcatatcactgtactgagtgctgtaggcaattgtaaccaatggtatgtatttgcgtatctaacctgcacagcttactgttactgttccgagtactgtaggcaacgctaacacaatggtatgtatttgtgtctgaacacatctaataaaaaaggtatagttaaagtatgtgattataatcttaggagaccaccctcatgtatgcagtcagtagttgactgaaacgctgttatgtggcaatgactgtacttttgtacagttttgtccaaactaaactatacattaaatcgaaattcaacaaaaaacccaatcagtcttttttcataaatttgacaagctcatctgaaaaatgattttagaataagggacatgtagataatttggggaaagaatgggggagggttgcaattcaccttgtcagaaagatttcacattgtcagaacgattgagacaccaagtgtctactctgtaccacagcaggtgagtatcacagatgtatggtgagttagagaagccagacacatggagtgcatgatgtctgaatccgctaacctcccgctttgggtctcacttgggaggagatgctgaggggagggtctgggctgccaagggctctgtctggagctggatggtgactacacagcacagtcaacaggctctgcactaagatgtgcacactttgtatatgttatactccagtagaaattcatgtataaagtaagatgagaaagttgaattgagaaaagaaaatcatcaaggttttggaaagactgacaaacagaaccagtggaataaaactgaggagggagaaatataagtacacacatggggactggatagacaaccaatgtgaagacatacactgcaggagaaagggtatttcaacaattaaatacaagggccaggacaactccctatctaagtagaaaaagataaaattcaacccctgtctcacaacaacaaaaattcctgacagattaaagattctaaaacttcagaagaaaataagggcaaatatttttatgaaatcactagagaaagatgccatgatgaaacccaaagacttcaaatggaaaacactgattaaaaagacaccataaaaaagataaaagataagctatatctctatttttataacatatataatgcactgaccaagaactagtattcaaatataattacatacattttataataaaatactatgctatatataacacatatagcatttctatataaatatggtctacatatatatttatatgtaacatgtatatttatattatataatatgtagtatttatattagataataaagtataaaatatagaaatataagattatacataatatgtaaaatatgtatttctagaataatgacacagatattaagaatccttacattctaataataaaataacaaaaaaaaacacagcatgaaaattgaagtgttcaaacaagcaattcactaatgaggaaatttgaatggctaacagagctatagaaagctgctccaccttatttgtctgccagatacagacaaatgaaaattgtaataagatacaagtttatggccctccccctttggcataaactaaagagaggtctgataacacctaattaaattatattgtggggaaatagaaaaaatgtaaaaactgcctaaatatcctgcagtagaggaagaatgcataaattatactgtaataccatgccatagttacatataaactagatctaaaggtatctgcgtggataaatcctcaaaatataattctgtgtgaaaaacacatcttgaaaggatagctacagcatgaaaccagtcatgaaataagtccagaatgttgtgggatggaaaatacccaattccaacccatctggccttcctttcacttatgggaggaaaagaaaaagctgagaagtcctcttgaggtcacagcccaggtgtgcaggttcaggctgagacagagacctgatcacagggccagaggatgctgccctccttccacaccagaccaccacatcaataccaacagggctcccacataatgacaggggattacagataaaagaactgcacacatcagactttatttaaggagaagtctctagggaaacccaaagaaaagtagggagataaaacaaggacaccagaagaaattttagcctctgacaattacagctccagcaaacagtaaacagcctaactcacagccaggtaaagataaaacctaatgctaaaggccaatctgcctcagtttcttttatccaatacagcatatctaggtttcaacaaaaaaattacaagccatgctaaaagggaaaaaaatcacaaagagaaaaagaatcagactcagatatagcagagatattggaattatcagacaatgaatctcaaatacccatgatgaatatgagaagtgctctagtgagaaaacggacaatgtgtaggaacagatgggtgatttgagagctggaaactctaagaaaaaatcaaaaggaaatgttagagatcaaaatcactgtaacagagatgaggaatgcctttgatgggctcattggtagagcagacatagctgaggaataatcagtgagaatgaggatctatcaataaaaactccccaagacaaaaagcaaagagagagagagaaaaaaaaagaaaaagacaaaacagaatatccaaggactgtgggacaattacaaaaggtataacatatgcataataggaataccaggaagagataaagagaaaagggaacagaagaaatatttgaagtaataatggctgaatattttcaaaattaatgccagacaccaaatcacagatctaggaaactcagagaacaccaagaagggtaaatacaacacacacaaattcacactcacacacacagatgcacacacacggacacgcacacacatgcatatacacatgcacacacacacgtgcatacacatgtgcacacacttcacacacacacacacacaaacacactgcacatgcacacacgtgcacacacactgcagaaaaatcaaagacaggaatttttggacaaagccagagaggggggaaaaaccttaccttacccatagaaaagcacggagagaattatgctggacttctttttaggaagaagcgagtagagaatgaagtaaaatattgaaaatgttaaaagaaaacacccaacttaaaattctatgtccagtgaaataatacttcaaaactgaagaagaaataaagacttttttaggcaaacaaaaattaaaggaatttgtcagcagttgatctgcctttctttttttctttcttttttttttttttgagatggaatctcactctattgctcgggctgaagtgcaatggcacaatctcagctcactgcaacctctgcctcccaggttcaagtgattctcctgcctcagcctcccgagtagctgggattacaggcatgcaccaccacacctggctaatttttgtatttttagtaaagacagggtttcaccatgttggcaaggctggtcttgaactcctgacctcgtgatctgcccgcctcggcctcccaaagtgctgggatcacaggcgtgagccgccacgcccggtccacctgcttttcaagtagtgttaaaagaagctcttctgacagaaggaaagtgacacaggtccgacactcggatctaaacaagacacagcagataccagggaaagcattccaggcaccaccaggaagagccactgcagaggccctggagaatcctgcttggcatgtttgaggaacagcaaggaagccagggtacttggaagagatctactagttataaagggaagttcacagcaagaatacaaatgcatcatctgtattatcaataatagcttattgctttttttctaagtagttcttaacaacattgcaataaagaaacaattgaggctgggcacggtggctcatgcccataatcccagcaccttgggaggctgaggtgggtagatcacttgaggtcatgagtttgagaccatcctggccaacatggtgaaaccctgtttccactaaaaatacaaaaattagcctggggtggtggtacacacctgtagtcccagctactcaggaggctgaggcaggagaatcgcttgaacctgggaggcagaggttgcagtgagccaagatcttgccactgcactccagcctcggtgacagtctaagcaagagagagggactatgtctccagaaaaaagagagagaaaacaaaaagaaaagaaaagaaacaattgaaggctacaaatagtcaatatttagtctcttgaaaaatctatggccaaagagaaacctgcgtgcttgggtccaaaaaagcgaaacgagtattgcatgatcttggtgattctgaggccagctctaagtctttgctgtcattgacatgtgacccttcccaatcacacttcttcctacccacggctgagtctgtggtgaaaggacagacttccttcagccatgtcaggctcctttactatccttgtatcttgcaacactcttagtaatcacatcattttgaattctttatgtaaaaatgtacctgctttaagcctcagcaaagaccaatgtcaaaagaaagatatctgtatcacaagaacgatcacaggcccagtagatcgtgcggctggacacgcactttctgcccacgaaagagcctgtgaggggcctccatctcgtgatgcaatgcaccaagatgccacgggcactgaaacaccagcttttgggtgcatacttcatacccacagaaaccagagaatggatttccaaacgtccagaaaaaagaagtcaggggagtgaaacgcagagaccaggagctcatccgactgccccatcgtgcttgactcttccccagcagaggggtcgggagttccggtggattcagtgttcccatcaatggtgagccgcttcggagcaaagccaaacacagctcagaactgcacaagttcaggcaccagacacagggtaggatccacgtcactctctgcagcacagggtaatgcactctctaccacacgcatgaatcatttattcagaaagagatgagagatccatggaactgtgaactaatcctaaatataacatttccatttactttccccgcacttaacatcttcgcagtatcccgtcacggctgagttcacgtttttgctgtgtgctgctggtatcctgcctgcaagcttcgggagggcaggggcaggccaggcccagggcttcctaagggacctggctgtcctgagccacagccggctgatagacaccatagtgaagaatccgatgggtgtctgtgacagtgtctcagggccagggtgacgagcatctgctgcccactgtgccagggaagaaagggagtactggcttgcagagacttacggctgaaactactagaaaacaggttttatgaactgcctctgaatttatttgtattatgctgttttcataattaaaagaaaagcttgtaacagtttcctcatttataaattccatatttcaatacaaagcaaaacactcttggaggttctggaatccttcagtgtgcaacgcatctgccattccaagacagagaccaaaaaaatggaggaaagtttgggggaagttacagtgaaaagctcctgatgggcgtggtggccatgcccatagttccagctactcgggaggctaaggcaggaggattacttgagctcaggagttcaacaccagcctcagaaacatagcaagaccccatctcatgaagaaaaaaataccaaaaaaaagttcctagtgataaaagtaatgtgccatgtggaggggaacactttcctctaatctaagggagcaaatcccaggttttaatcccatggacagaaaaaagtgtcacctttactaacaacattcttacctattagttaaatcagagatgtgtcctgggtgtagacatgaccagggacaggaggatcagggatcagggatgaacatcagagggactctcatgaccagggacaggaggatcagggatcagggatgaacatcagagggactcccattctcgtcacctgactttaaagggttggtaagtttttcaacaaaaatactcaccaacaataatatctccccagcaccaagctcctgcaggagagaatggcatttgggtggcagacatggccgtgaatgggaaggagaagggcctgacctcactgcaaggccgtctgcattaaagaggccaatttctgagcacaaggcaggttgccaggaaatgcagcttgacatttataaacctactcaccagcctttgttctcaatgccagggcacccaagtaagcaagccttccttcccggcactgcagacacttctggaaagacccaccatttcttcagaaatgacacttcacagtgtggcgagaggggagaagcgcacagaccatcctgcacagttggctcagcatttagcaattacataaaatgtgtgagactgattgtcatttgctcaaaaaatgtgttgagcacctaacgtacgctgaccacgtcactcgacgtggcagagggagcaaagcataaagagaaaggccacacgccgaggctgtgatgggcagtgaggatatgtaaatcttatgcttatggactacatcctgccacacatgattttcataaaagtcattaactcccaaagcaaccctgcagggtgtttcagataaaaaaatttagaatagctttatctgagttacacaattttaaaagtcagcaactgaagaaatgtccagaaagtcttggttaaataaaaaacacttaagtggcacagaggcaggagggggaatcctgaagctggtgcgtctggggagctcacctctggaggagaaaattgaaccagcagactgtgggcggccacagccctgaggcaggggtggggggcgtcctcactgctgctgaatctgtacaggactctggggccccttctccccgcacatcctgcacctgcataggaattcataaaaacaaagcaagcactccaatgtgtgtgtctttctttttcctactaaatgggaacgtgttggagcttggtctaaattatctgcatcaccaaagagagcacagtctccagggctcaggcagggtcagcctctggctctcaggcaggcacagagagctcggggcctcgatcatttgtaaagactctgctgcaaccaaactcaccagcagaggacaggctgcaggaggccacaggggacaaggagaacccgtgctgaagagaccacagctggtcccaggggaccaagatgggagctctgcctcagaaacagtgtccagggctcaagtggcccaggttaacatcttctctgctacttggaaaagagatcttttcctgcaccataggccgacaggtgccagttcggcgatgactaagtacaaaagagtctgctgcaggagcaacatttaattctcaacgagagcacctggaggacaccaggaggagcatcacagacaggaaaaattataaacagtgaagggcagccccaaacaataacaacaacttctcttccttagacacccttgagagttatgtcaataaccactgctcggttatattttacagaaagcctttctaaattaaaatatggtgctatccacttaaaccctactgggctgaacttacacatatgcatgatattgacccctgaattgatcagagattgatgctgaaaccacccaaaagcctccatgactggaagcttgatatctgacccggctttaaagaaagttggtggctttgggacagcagtcatgtggcgcacagcagcccattctttgtttccagcaggcagcaacaaatccgtgaggctgagctagcccctctgtcgggaagctccaaatggctggagaaataaattttttattaaaaaagtaattggaaagatgtttacattaatcagatttctaatttttcacttctccatggtaaagatcccagctatccagataaatgccactcagagcacccacatctcctggtggtcttggccttgtgtcagcattctaaatactcacatccatagcaagacatgagaaacaggaaggagaggaaagaagaatcagagaggtgtgccccaggacgtgggcgcagctggcacattcagagacggtctctgaattgcagatttcagagattgtttagcacagacatcctgttttatcatttgaaacctaaggaacagagagtgcaaagggcttgccaatagttggctagctagtcagtgagagacccaggagcagaacctgtgatcctggcgtcctgacactgccttgttctgtccaggagcagaacctgcgatcctggcatcctgacactgcctcgttctgtccaggagcagaacctgcgatcctggcgtcctgacactgcctcgttctgtccaggagcagaacctgcgatcctgacgtcctgatactgccttgttctgtccaggagcagaacctgcgatcctgacgtcctgacactgccgtgttctgtccaggagcagaacctgcgatcctggcatcctgacactgccttgttctgtccaggagcagaacctgcgatcctggagtcctgacactgccttgttctgtccaggagcagaacctgtgatcctggcgtcctgacactgcaatcctggtgtcctgacactgccttgttctgtccaggagcagaacctgtgatcctggcgtcctgacactgcaatccttgcatcctggcactgccttgttctgtccaggagcagaacctatgatcctggcatcctgacactgccttgttctgtccaggagcagaacctgcgttcctggcgtcctgacactgccttgttctgtccaggagcagaaactgcgatcctggcatcctgacgctgcgatcctggcatcctgacactgcgatcctggtgtcctgacactgccttgttctgtccaggagcagaacctgcgatcctggcgtcctgacactgccttgttctgtccaggagcagaaactgcgatcctggcatcctgacgctgcgatcctggcatcctgacactgcaatcctggcatcctgacactgtcttgttctgtgcactgcccttcagggactgaggcaatcccgcgatttctcatgtggcaggttctcagcaccacaccttccaccatgacctgaggcccagctggtttctaagaatgcactgttatgcagcagctctgggactaaaggatgtcgagactttaaaatactgtggctgcaggaaccaggagaggatgccgggctgggtgtcagaacacagggaaaagccatccctgttagccaccttggcatgctcttgagtttcctgaagcagatttcctaacctgacattttggagacggcaggacgggtttctcagcaataatccctcatctgccattgaggcgccgagctcttgtcttccttcctggtgtgtgtaccgctagctttgcaccagttccgcccactcaccaaaaagtccatctaaatccatccatgcttatttttaatttaaccttaatcctgcaggatcagtacaggggcaggcaatcaggtttacacaagggaggcgagcggctgcgagggaggcctggcctaaaaacgcccccgcccctcgccccggaatggagcctccagatacactcaactcaaaccacatcccattcctctctcatgcaaactcatctggtcacagagcatttgctgagtgcagactctgtgtgacacacactgctactttctgaggaacacacagatgaatacaacagtccccatgggcaggtttagcagggaagaagcacagtcaccgaagtccaaaaaagccaggctggagcccatgggccatgcagaacaggccaggagccgagggcaggtcactcagttccctttctctcaaggagctttcagctcaggagaataaacaaggagtatacacacatcatgtccaagggcaatcttagtaaccacaaccaaagaggctggagccactgcacacctcagggaaggagaggccacttgtgctgtgcgaggcctgcctgcagtcactgagcgtgtgaggcctgcctgcagtcactgagcatgtgagggctgcctgcagtcactgagggtgcgagggctacctgcagtcactgagtgtgtgaggcctgcctgcagtcactgagagtgcaagggctacctgcagtcactgagcatgtgagggctgcctgcagtcactgcgcttgggagaggaggcacggcacatctggcgtttcagagccgatggcatgttagaggccaccggggagggacagctgctgggcacagctggtgcactagaagcagctgaggtccattctgcaaaggagagctgaggctgggttgcacagcaaagcacagagcaacatgcagccagtcttttctcagtgcaaaatgggcaagccgggagctctcaagtgagtcagcaacccaccaatgtggcattacaggaggatgaacagggcagtgcaaggtgacctgggggtaggagtaccgagcacatggaacacacgtaaggcagctccttgttcaggcatgaggcaggaagagctagaatggggccgaattcagagcaacagggacaggggacccgatggatatcgaaggtggccaagaatggtgcatacacactttcttctaaggacactttctgtctagatagaaactcatacatgaatacacatatgtatacacacacacacacacacacacaggtcagtaccattctttcaacttttctgtttgtatattttcatcataaaatattggggaaatggtgccttttcatctctgcaatgtgagagctctatagcatcagaaactctccttatcttacagaccatgtagaaacatgtggggaaaagtcctacatgcatctataaatcaccaggtcctgctagccacgggcatctcctcttggtcctcatgttacattttcttagacttaagttttcttcatagcaagggaacatgacttgactctgaaaacttgaatgatgtattttaaggtgagtaagttacataggaataatgtatatccctatcatcattgttactattgccatcatcaccatcaataagcatcataatcatatcatcccaccagcaccatcatcaccatcactatcatcatcatcactatcatcatcatcactatcatcatcaatcacatcaccactaccaccatcaccatcaccaccatcatcatatcaccatcaccatcattaccatcaccactgtcaccatcacatcacaaccaccatcaccatcaccatcatatcaccaccatcaccatcatcactatcaccaacaccatcatcaccctcaccatcatcactatcatcccaccactaccatcaccaccatcactatcatcatcaccattatcaccatcgcatcaccaccattaccaatatcactatcaccatcacattaccaccaccatcaccatcatcaccatatcaccaccatcaccatcatcactatcaccaacaccatcatcactatggtcccatcactaccatcatcatcatcactatcatcatcgttattaccatcacatcaccaccatcaccatcatcactatcaccaacaccatcatcaccctcaccatcatcactatcatcccaccactaccatcatcagcatcactatcattaccaccatcgccatcatcagcatcactatcatcatcatcatcacatcatcaccatcaccatcaatcatcattgccaccatcgccatcaacagcatcactatcatcatcatcatcatcattgtcatcagcatctccatctgactggtggccctggaactcctcctttgtcctttcagttgggcatctcccatcattcccccagccatctccactcccgattctctgtgccgtcttcctctacatgttcagccctctctgctacactggtgggtgactccaactccgacactacatgctctgccctgtcttccttcctttcacagctcttcatgctcatctcacctcctgaactgctgcctgagcatccacaggcctgaagccaggactcactctttcggactgaccctcagctgatccttgagctgaagttccttgaggaactcggcccaacattatatttttccatggcaccagcctcacagctgatcccacatggtcctcaaagaatgcaacctgaggccgggcgcaggggctcatgcctgtaatccccagcactttgggaggccgaggtgggtggatcacctgaggtcaggggttcaagaccagcctggccaacatggtgaaatcctgtctctactaaaaattacaaaaaatgagccaggcgtggtggcgggcacctataatcccagctactggggaggctgaggcaggagaattgcttgaacccaggaggcagaggttgtagtgaaccaagatcgcaccattttactccaacctgggcaacacagcaagattccatctcaaaaaaaaaaatgcaacctgatagaaatgtggtgctcagttcttatttgttgcaatgtagctattacctttggttcctgaaggagttgaaaggggcagggaatgatgcaggcacacattaattcactgctagtgacccccattttattaggaaagaaataaaatacatgtagggtaatgggcacattgtgatttatataacaagcgtgttcctgaaaaggtacatcaaagtcagaatgcttttgaagtggcctcagaaaggttactgtttaaaacactgttattagaattactttaaaaagagtgaaaatattcagggaatgcagccttttgtagattattcatgttctaaagtgatcatgcttatatttttaccttctgttagaatcaatgaaaaacttaattcataattctactaagctacaatttgaaaatatcttgggtgcaattttccttcacatttctttggctcagtgtcctccagatttaccagtgacaacaaagtcacagcaacctcaatgccttttactgactcccatctgcagagcctcaagccaactccctctggaaactcctcctgctgttcttagaagtctttcgggcatccagacagtcctctggttctctctgagcttccccaagatgcaggagccacccagcttgcatcccacagcctcccggcttccctcagctgcacaccctcccaggtgccaggagcacagctcgggccccgctctcccccgtcacgctgagctctgtgctagggtgggtagggaaggcctccttctctgcagaagactcaggccaggccaggttcccacaccattctgtcccccacacgactcttccatgccagtctccatctcctcaagtacctgcctaccaagaaaataagtcctgttccttcctctgtgcacacctctttatgcaaagaggcactgaaagctcagaggcctcagcagccccgtctgggttctggctgcactcagggatgcttgcccctcccgctggaagtgctctccccacggcaggagtgaggagcactgagacaacagccacctggagtggaaggtcacccaggggcacgccatggcggtggagccaccccggggatttcttcttcctttgccagtctctgcccaaaagatgaaatgcagagatgtggtgtgtacatctgagaagccacagatgctagcagtgcccatggggggcatctgcagggggcatctgttgggggtctggagggcactatgttgtccccaagggccccatccagcacagagcagtgtcagccagctctcagcagtgtcactttgtggaccagcccagctctggaccagcttgctgaggggagacggcacagtgcagagagaggaaactgcctgatctccgttccagatgtaacccagttcttaggctattatgggactgtggggacattaaaggacaggaagcacagccctcccctcaaacatcagaacttcccaagactcccaaggagctgctggccccagcctgggtccctcccaagtctgtctgccagcagctgcaaaggcctcacataccctccctgtgtcaggtgcaccaaggttcctggctgattagcaccaaggaggacaaaagcaggccttttgcagtagctgtgtctgtctgtctgtctgtctcaggaagctggaaaagtggctaactgaattacatccatgtcgtgctcccccggcgagcgcccgccaccttcatcttttccccttttggtgacgttcagcactgattacaaagtgtctcagctggtaatatgttcacttcattttttttagatgtgttttttattcagttcacagatgaatccaattagcatatcactgtgactgattaaatatgcctcatgtaaatttacatgtcaaaatacacactgtacttaaacaagtaggcccggctgccaggcatctgtaaacagctttgcaggcttggccagctcgaaacacaaaagctaagatttaaatgtgcggtgactacctggtagagagcgaggaagagggaaaaggtagtgttactcatgcatgaggggagggaatgaatatagacatttgtctctctttgtctctgaagggaggccattgacaagagagtccccatctgcataggaggctgccacatccaattagctcaccaggcgatggaaattgcgcctctgatccagaaaagtccctgtgcactaaagtcaagactgtttcaaagagattatattatcttagacagcaggattaaattaatatggcaatgacttctacgggaggaaatgtttttgtgaaacgtgctaatgtttattatgcattctccatcataagtgatcgcctttgatgttctattcatttgttgattggtttccgacttcctcttagaagggagtgaagaaacccaggtatgaaaattggattgcgaaagttaaagacagagagaaagccttaattagattcctctagaagcagtgactactggttctgtgggttattgggggaagttcttaaaataatgaaataaaattaagtgtggtttggccaccaagagcatcagcaccaaaggcacccagcctcctggggaagccctgagtctccgccgcatggatggtagaggggtgcggccgctgctttgcctcgtgggggccgtggaggggcgcccttcggacctcctggagagggtagaggggtgcggccactaatttgcctcgtgggggccatggaggggtgcccttcggacctcctggagagggtagaggggggcggccactgctttgtctcgtgggggccgtggaggggtgccctttggacctcctggagagggtagaggggtgcagccactgctttgcctcgagggggctgtggaggggtgccctttggatcttttggagacacctggccacagttcccagccactcggggtccaccacgttccctcgaggccaggctccacccaggctgtccccagcctaggacaaagctccctgggctacagggacagccctccctggccagtgccgcccttctgcgaactgcacctcgggggctcctgctggggtctgaggctctgccgccttctccctgcccaggctggcccccatcgatcccaccctggcgtctgcttcccaagcacccagtgggcacaacccccagaagcacagtctctctcagtcctgggaggggattttttttcaatttcaagtcatgtcaataaaagtgattttcataaactaacctagaggaatttttatggctggggagacacaggcttacctgggaatttctgagtgtgccttcatggttgggccatctgcagctgggaactaaaaggcgctttaaaaatgactgacactgtaggaaaatctcacaactggagcagatgagccatagtgactgagggagaaacatgagctggatgagaaaggagggcctgcaggcaccactggaagggcccagcatcctctcacagcacagcgaactccgatgtggctctgactgtttaattaacgtgtagctaaagatcacagaaaaggggaaaacagcgaagacagaaaagaaaagaattcagaaccagctttagcttctgatattatgggaaattctgaagaggaacgaatggtatgacaaaatggaaagaaacattttcctggtgtgttttataaacacacgtaaagaggttcaataggtttaatgtggtaaaaggagatgtatttaaacatggcaggcatttgcccgaagctgcttgtaaataagctgtgggacagccgctgcggaagatgcagagaccccagagatgcagagaccccagagatgcagagaccctagagatgcagagactccagagacgcagagaccccagaaatgcagagactccagagacgcagagactccagagaggcagagaccccagagatgcagagaccccagagacgcagagactccagagacgcagagaccccagagatgcagagaccccagagatgcagagaccccagagatgcagagactccagagacgcagagactccagagatgcagagaccccagagatgcagagaccctagagacgcagagaccccagagatgcagagaccctagagacgcagagactccagagatgcagagaccccagagatgcagagatcctagagatggagagaccccagtgatgcagagactccagagacggagagaccccagagatgcagagaccctagagagcatgggggccctagagagaagtcactgacacacaggtttcggctaaaagttactattctgattagggcctgtgtgaagtaggaatgtgcctgtggagtgtgatgtgaacacagctctccgaaattttcccatgcgtgggccgattcgactgtgtgcttgtcctgagaccaagaagaaaactgctgaagtcccaaagtgggacagggttggggacaggacactcctcaggaaagaaaggccacaccctttctgcagacactcaaaaagactgctgtgtgggatgggggacagagcaagagaggaagacacgaaggaaaaacacacatttaccggctgtttttgtctgtgagtcgagtctatgaaacatgccgtgagattattttctgcggttgattattcatgcaacgaacacgtcagaacaccttcaggtggcccatgggtgaggtctcgcaggtgcagcctcctctccagaatctggcaaccaggagaggccctttggcgggcccagtaatgggggtgcatgcacctctctgcccatcccacacctctacacggctgctcccaggcaccagagcctccacctaccccaaaccaagtcctgcccatagtgtgccccgtagcaccgtcagccctgccttccatgattgcagctgatgtgcctgggggcgcgggcaccattaattcctgtatcttcccctctgtccaatccatcaccaaatcccactgctggcacctccaagacacctgcagactgcagcccgcacgccagtgcccaaggtcaggccaggtggcccctgcctgctccccatccttcgtgctctgcccagccgtccccttcactgtggtcagagctgtgggcggtaagccacccaggtgccgaggcaagagactgagggcacgaactgttccagtgtaataaaatatgtaaaataagaatagttatactagatctagatcatagatatgattatatatgaatatcattcatcattagtttgtagcaattactctttattccaatattatcatagtctttgctctataatcataacctaggaaaaaccaggccatacagagatagtagctgaggggacacagtgagaagtgaccagaagacaagggtgtgagccttctgttatgcccagacagggccaccagagggctccttggtctagcggtaacgccagtgtctgggaagatgcccgttgccaagcggaccgtggtcaagcggtagcgtcagtgccaaggaaaaacacccgctacttagcagaccaggaaagggagtctccctttccctgggggagtttagagaagactccactcctccacctcttgtggagtcaggcccacccgcagttatccggaggcctaaccgtctccctgtgatgctgtgcttcagtggtcacgctcctagtccgccttcatgttccatcctgtacacctggctctgtgttttagatagcagtagcaaatttgtgaaagtactaaaagtctgatatgcagaaataatggcgtaagctgtctcctctctcctctgcctcggctgccaaacagggaagggccccctgtccagtggacacgtaacccatgtgaccttacctatcactggagatggctcacactccttaccctgcccctttgttttgtatccaataaatatcagcgcagcctggcattccgggctactactggtctccgtgacttggtggtagttgtccccagggcccagctcttttatctttttgtcttgtgtctttatttctatgatctctcgtctccacacacggggagaaaaacccactgaccctgtggggctggaccctacacagagcgacacttctaacggggccctgttccagaccccactgcctgtgggtggagtccgggccgaggccccttcctctctgtctggttcttgctgcttttttcagtctggaatcttcggaggctcttgctctgctctaatgcagaccttctcccacacactccctccacctggaagctcctcctgccttcgtattggccttggtaactcccgcaggtcctgctaatctcgcctgaaaggtcacctctgccaaggagtgttaccctgccccagacaaggtcagatctccttaatggatgccctgagccatcacagcatggccaccaggcactccccggggcctcatccacacagaggccgggagcaggggggcacacctggcttgttctctgtccccatgggggcggcaggcactggatttggtgctcaaacagtgggtgctctctccgtcctcccatgagcccaggggaaagtgttgggaaaaacacatttgtaaaaatcacttttgtgtgcatttttcaacagaacaaaatacttccacatgtgcctgggtttaggatgggcaggagaagcccctgaaagggtgctcggtttgacgatgggatgttttcgtgtgcatcccgtcaccagccacagcagacccgttctccacaaagctcggtcagctgctggagcaggagtgtgctggactcctgctgctgcttctccagcgtccagtgaggcctatttcttatagctacattttgccaatgcttttgagtgattcttgttcagtgcctacaatcaacacagcaggacagtggctctccctggcagtgcctctcattgacccccttggagtccttacagaagctgcacattaagtcccacgcatcatcccaggtcaggggacggtgagtggccatccagcatggtggaagcaggtgcagctgtgccacccacatcgggacgcgtgctccactcgtggcattccaggctcacaatgtcgcccttatccgatgatcagccacctcggatgtgtccatcaagcttttaaaattcacaaacaaaaacaaaagatgcactagacccacccagcgaccccaaggtcacgccctctgtggttattggcaactcggggacgctgcccagctcccgattccgctcagcacctgtggacgcgggagcatctatcatcaatcctctgcaattctattttatgataaatacagaaatgacccttaacccacctttccctcctttttgctttttcctattgacacctgcccagcacatctgcctctcggcaaccacagaatgaaccagaaactttgctcttctgctgtgcccacaggaaactgaatctcctgacagcctcccatgactgttctgctagaatcgtcaaacttggggaaaaacaggatttgagatgaacttccacgttacaggcagcaaagcccaatgatgatggtctctttttcaggacaagcatttggattccataacacagtcagtcacagaccgagcaggtacacccgaggaatagcctctgcagtctcacctgctggccccacaacagagttctggattctttcctagtctgtgtttgggaaacacacgtaacgctgtggcactgtggcctggagtgggtgaggcagacggccagctgccctcccctcctgagcaaagggaagtgggtgcatggaggaccccagagagcccaggccccacttcctcatgaggaaaaggaccacagcaaagtctccaagaacccagcctcagcatccccgccactccccaaagctcctcagcgtggctgcttgggacccctcatctgcccccatctgccatgttcatgtgcacaaggtccacaacggcagccagaccacacctggaaagacacacagcaaaagcttcccaaggaacacgggccgtgaaggagttaaagtcctcaggtctacgaatacgacattatctttttttccttgtttcctgctaatctgtttaatgggaaagtttccctcctcacaacccatatacagaatgcttccttagttgcaggctttacaaataattatctagaaataaataagtacaatgatctattgtaagtaaatctgcataaagaagagttttcttttcttccatgaaaatctagccacttactgcagtagaatcactacactccatctgcgcacggtgacgcatcactgcagccacactccatctgcccacggtgagacatcactgtagccacactccatctgcccacggtgagacatcactgcagccacactccatctgcccacggtgacacatcactgcagccacgccccatctgcccacggtgagacatcactgcagccacactccatctgcccacggtgagacatcactacagccacgctccatctgcccacggtgacacatcactgcagccacactccatctgcccacggtgagacatcactgcagccacactccatctgcccacggtgagacatcactgcagccacactccatctgcacacagtgacgcatcactgcagccacactccatctgcacacggtgagacatcactgcagccacactccatctgcacacggtgagacatcactgcagccacactccatctgcccacggtgagacatcactgcagccacactccatctgcccacggtgacacatcactgcagccacgctccatctgcccacggtgagacatcactgcagccacactccatctgcccacggtgacacatcactgcagccacgctccatctgcccacggtgagacatcactacagccacactccatctgcccacggtgagacatcactgcagccacactccatctgcacacagtgacgcatcactgcagccacactccatctgcacacggtgagacatcactgcagccacactccatctgcccacagtgagacaccactgcagccacactccatctgcccacagtgagacatcactgcagccacactccatctgcacacggtgacacatcactgcagccacactccatctgcccacagtgagacatcactgcagccacactccatctgcccacagtgagacaccactgcagccacactccatctgcccacggtgacacatcactgcagccacactccatctgcccacagtgagacaccactgcagccacactccatctgcccacggtgagacatcactgcagccacactccatctgcacacggtgacacatcactgcagccacactccatctgcccacagtgagacatcactgcagccacactccatctgcccacagtgagacaccactgcagccacactccatctgcacacagtgacacatcactgcagccacactccatctgcacacagtgacgcatcactgcagccacactccatctgcacacggtgacgcatcactgcagccacactccatctgcccacggtgacacatcactgcagccacactccatctgcccacggtgagacatcactgcagccacactccatctgcacacagtgacacatcactgcagccacactccatctgcacacagtgacacatcactgcagccacactccatctgcagtgacacatcactgcagccacactccatctgcccacggtgacacatcactgcagccacactccatctgcacacggtgacacatcactgcagccacactccatctgcccacggtgacgcatcactgcagccacactccatctgcacacggtgacgcatcactgcagccacactccatctgcccacggtgacgcatcactgcagccacactccatctgcccacggtgacgcatcactgcagccacactccatctgcccacggtgagacatcactgcagccacactccatctgcacacggtgagacatcactgcagccacactccatctgcccacggtgagacatcactgcagccacactccatctgcacacggtgagacatcactgcagccacactccatctgcacacggtgacacatcactgcagccacactccatctgcacacggtgagacatcactgcagccacactccatctgcacacggtgacacatcactgcagccacactccatctgcacacggtgacacatcactgcagccacactccatctgcccacggtgacacatcactgcagccacactccatctgcacacggtgacacatcactgcagccacactccatctgcacatggtgacacatcactgcagccacactccatctgcacacggtgacacatcactgcagccacactccatctgcacacggtgacacatcactgcagccacactccatctgcacacagtgacacatcactgcagccacgctccatctgcacacggtgacacatcagtgcagggtagaaactcccccatctcccatgcagcccccagcggccgccatcacaggtctcactgtctcgccgtgtgtgtgtaacctgctttctccccagctcccacggctgtggcggcacctctccgtctctgtctgcgcatggccgctctctgtgtctgtaccttcacgaggtgatcccctcttctgctaaggacacagtcatgttggattgggacccaccctcatggagtctgacctcctcttattgacatctgcaaagatcctatttccaaataaggccaaatccacaggtagcaggggttaggttttgaccataactttctggaggtctcattatccccacagcaggtgtcacccagaaatggttgacagagtgtccactgcacaccaggcagcctgctagagacattgcattcattacctttgcctatttatgaatatgggaaggttttgcaaagcgatgaatggcatggaaagagaccatgtaggccttgctaagaaggatggcctggagggatgaagaaggacctttcaaggctttttgtttgaatcgaaagtttcctttattaagttattttaccaagtgagcttgtatcaaggctgagctttcagcgcagtatttatgagctgcatttctttcaaaacattctatcaaactgacatttccttaaatcagactgaccttccacaatatggaataaatcaggtggtttaactctactgactaaagagtgttttccccaaccctgagccaggcggctttgtccgtgtcgctcagctgccggctcactgaagggtggtcatggaagagcaggccgccgtcgggcggtgactgattacaatcatttgttgtgatgcatcgcaaattaaagggacaagcccagccaagctgctccgctcagagagtgcgcgtcccgcctctgcaattactgatgtgcacaaaggacccagggaccacttaaaacaaggggaggactgagtccacgcagggatgaagccacaggcacagtccccacgtgcttgacagtggccccgcaacccacctgctccagacacctgttccgagggaatctctcccatccacctgccgctgtggctcagaccccaggcacaacacaagcgctcggcagagaaatggaccgtgccgccaatgcactcggcgctgaaccatcattgaggagagaccagctgctgctgtggcccctggggctgcagcataaacagtcgtggtggcaaagtggtgtccacaattacttgtgtcgtccgtgagcacactggctgtggacggaggaaggctgtggctccaggattgtcatttcagcaccgctgcccatggtccaagagccgtagctgagatgcaatgggggtgtccttcatcaccggtccccaggaccacacctgaaggacctaacaatgatcctgatgagaaggttgttaacctgtcaaagcatcaagatgaaacatcacacaagacgctctgagcaggaacccactagtgacagggcccttcgatccatgtggaagtgcctaatgccacttttttgatgagcaaaaatggcagctaataatttaaggcaaaaaaggaacacaatccagtatgacagtttttccccaaccagagggagtgcccatgcgtggtgtcccacgaaggcggagctgggcatgagcacggccatggtcctgctgtcagagcaacctcattccacggggtgagcatctcgcaccttggtgcggaagcccagagcccacgctgacttctgcaatagcctcagtaaagcgacgggcgacggccatggcacagagcactgagcacagaggttatctgaggtggcttcgcatcagctcacagcagaggagcgttggcccagttcacagatggagaaaacaaggctggaggagaccaacgtgtccaacatcacaggtaagtcaaggctatgggactgaaactcagtcctgtggacaccagccagggctgcaggtgctggctgtattcctgctgttacagtcagtgcacatgtgtgtggggctctgcagtttcccaggtactgtcagtggcagtgaaaggtgatggcgtgctggcagcccttgcagccctcgctcactctcagcacctccttggccttggcgcccactctggccctgcttgaggagcccttcagctcactgctgcaccatgggagcccctctctgggctggccaaggcctgagccggctccctctgcttgtggggaggtgtggagggagaggcacaggcaggaactggggctgtgcgtggtgctcacgggccagcacgagttctgggtgggcgtgggctcggcaggccccacactcggagctgccagccagcgctgctggccccaggcagtgaggggcttagcacccaggccagcagctgcggagggtgtgccggttcccccagcagtgccagcccaccagcactgcgctcaaattcttgctgggcctcagctgcctccccatggggcagggcgcgggatctgcagcccaccatgcctgagcctccccttcgccatgggctcctgtgcggcctgagcctccccgacaagcgccgccccctgctccgcggcgcccagtcccattgaccgcccaaaggctgaggagtgtgggctcacggtgcacgactggcaggcagctccgcctgcggccctggtgcaggatccactaggtgaagccagttgggctcctgagtctagtgaggacttggagaacatttatctctagctaaggggttgtaaatactccaatcagcactctgtgtctagctaaggtttgtaaatacaccaatcagcactctgtgtctagctcaaggtttgtaaatacaacatttagtgctctgtatttagctaatctgatggggacttggagaacatttatgtctagctaagggactgtaaatacaccaatcagcactcttgtgtctagctaatggtttgtaaacacaccaatcagcactctgtgtctagctcaaggtttataaatacaccaatcagcactcagtgtctagctcagggattgtaaatgcaccaatcagcaccctgtcaaaaaagaccaatcagctctctgtaaaacagaccaatcagctctctgtaaaatagaccaatcagcaggatgtgggtggggccagataaggggaaaaaagcaggctgcccgagccagcagtggcaacccacttgggtcccctttcacattgtggaagctttgttcttctgctctttgcagtaaatcttgctgctgctcactctttgggtctgcactgcctttatgagctgtaacactcaccatgaaggtctgcagcttcactcctgaggccagcgagaccacgaacccaccagaaagaagaaaatctgaatacatccaaacattagaaggaacaaactcgggacacaccgcctttaagaactgtaacactcactgcaagggtccgtggctttattcttgaagtcagtgagaccaagaacccacccattctggacacagcaggtcagggaatggggtgccctacagagtttccagaaggcaaccacgacaaaacctaataccaattagctaatgaccattctacacacttacacacatatgtatgtgctcagaaagtgagacacactcagtgagagacacacactacatacaatcactcacacacacagtgagacacgggctcatacagcaagacaacacacatgctcagtgagataccacaattccaccagcagggaccatctcagcagaatgtggccatgcaggggcctgtgcctgctgctagaggcgacgaggtctcagcctctaagtacaaaccttcccacatacgaggacagagaaacctggggtgaattccacatagttcatctaacaaacaggcatcccgagcaagttggggtttaaccgcattgactctggcaacctgaacatgtgctgggtgtccaagtccagggctcagaagcagctggagagcccgggacatgcacagcattctcctggggacgtctctcaggacctgttacccagacgaccaagacgagatgcccaggacagccacagcccccgggagagcatgggaggtgcatgagggagctgtggggccagagactggggtcacagccatgggggagccgggggagcctggggagcccagcgctgtgaggttgcttggacacactggtcacgccggacactgccccatggtttcctgtccagctgtttcctggaatctggctgctaaaaagagagccatctacacactgtgtctgagggacgccaaggactccttcctccccagatgctcctttttcttctcctcagggcctctgtcatctcccactcaccaaagccccccctgtgccagtgatttccagaagctgactggtgggggggacattttctacttgcaggggagggaagagaaagggtcaccctccccgcaacagaactgactcctggctcaaccccattctcctccaagtcacagcgtggctctgtgatgactgctgggctgtcgggtgtccctggggaaaggagtgccagggcctcctggggatggggcacagagtggccaattttatggatgatggatgcttcacctgcttccaaaggggctgcaggcagcgcaggcataaacactcagcttaataaagaccaaggctgagaaacaagtaatccaggggaagaaaggcagaaagatggtgctgcgcatctggtaattgactgtaatctggcatacttctgggtgagagaagctaagcaggtgagcacaaaatctgggagtgagattgccgactcgggacgagagaaacgcctgacatggcagtggctctgactgtctggtggcaggaaccatgcagttcaccaggaacaccaacgtctctcctggtcatgggccccaagatgcactcaggcgtgtcctggctgagagacttggcggagcctcctcagcagcttcaggtgagttttctcaatgagtttcttacctcgcacccttcatgaaaaccaaggacataagatcatgggggagtcctgtaaggtctaccgaagacttactccaaaatgcaacgtgcagaatcctgcagtgagcaggggcatggtttgcggaatatgggcctccagaagcagctgtgttcacatggtcatctgaccaagtcagagccaagtctcaggtcagtgctgaaagggccctgggctaacgggctgcggccagaaagacagtggctggcggggcagatggagccatcagacccggggggagggcaggggctgccaccaccacacggcccccacgggtcagaccaaggttttgtatttcacaaccagcggataatgagttgagttgttcactaaactgacgctcagaactcttattcattttcagaacagtaaagtcaaaactccacgaggaccttaaaaaaaaccatattctggatttaattacagataaaagaaatctgacttctattaaaagaggagaaattgcgtatttaaaatggaaattaccccagagcatgggaatggcactgtctttctgtcttattttagaataagaaattatgtggccattcaattcttgaagaaaatgtttttaaaagggaagaggtggatgggcaggaatgcatgcaaagagtttcgttcagggaaagatcctgccctggctctctaacctcacacagggacgggctttctttccatgcctcagtttacctatgtgtcccacgtccctctgacatgacgttgtatgtttccatttatttcctctgaaaatcacataatatgctgctttgtttctctagcaaggaatggctgtgagcttgggggtcttgaggctcggaggcatcacaaaaaataagactccgtcagcaagatggtgtgccccctctgcctccctctccgttcccaaccaccagcctgggatggcaccttccatgaggtggatgagtcccctccattcaaggccttctctgcaaacagccacccttctggctccaggatgaaatgaggctctaaatatgggctgccaggctcagggccagggccgacaggcacactgacctgcagcatggctaccccaggctctctctggcagttttgccacagaatgtgctctaagctgtgctgcttcctttccttcaaccacctcccaactcctcagtatggaagggctctgagtgctcaaaggaacacagccttttcagctggtgtcacaagacatttacaaaacaccgtggagaaattccaaaaccaggcactgtagagagacagaaagtagttttccctacaggagaacgttaacgctaagatcggctttagaaaacacacacctgacacctgagttgtggtgactctcacctggtgaagtcccttacgaatacatccttacccagattgtatactttatgggaaaattaataatgccaagcagacggcaaggctggcaggtgactctggacctcaggatgtgacacaaaggactggtcctcgtgacttgagcacatccctgggacatatggggtggctgagggctctgcagagagaaacacttcctcagtggggccctaggcctgtcaagcgggaaataaagacgaaatcttaagcagattttcaatcatcttccttcaatatcagcaaatcccacaaaaattacagtagggagtagttataggttgaaaggttagagctggggagaaaagcaggctatattttcctgttttcatgaaatttctcttcttacacctggcacctaagcagcctgctgctgtagttactgttcaggttactatggccacaggagggctgaggcatgttagatgggtggagggcaagggaagggttgagatgcaattcttatttccacgtatgtgataatgctgttgcaatgcttttcagcgaagcctcctcctgcacccagggtgtctcctgatgcagaggggccgtttccaatgccttgcagtcgtctaccttccctgccgctgctccggccagcaggcatttgctgagtgtctactgtggaggagctcccagctggcagggggcaggggtttgtcttcaggagctcttggactgcagctgtgagtggtactcggctccagtgccattgaggtccctgggggctgctcccaatggcttgctggccttgcctccaggacatgttctgaacctctggggtggggcccaagagtctgcgtttttaacgacctccagctggtgctcaggggccccgtttgcagaactgctgttctacaatcttgagaaaaggtttctgtaacgggctggagagtgagtgtcggaggctttgtgggtcgggcagtccaccgtgaccacgcagctctgcctgtggcgaaagctgccagagacaaggcgtgaaggagtgagcgagtgacagagtgagtgagtgagcactgttcccaccaggcttccttcccagagcagcacaccgggtcaggccgggccgcgggcagcacaccgggtcgggtcaggctgggccgtgggcagcacactgggtcacgctgggccatgggcagcacactgggtcacgccgggccatgggcagcacaccagggcaggccgggtcatggtgtgcttagaatttggtgaggcggcagggtcggggcagacagggtggggtctgaggacagccgctgaggctcttcctgtggggtggcatggaccttgcagctgggagatggcaggaccgggtatggggaaaggagggaggaaggcaggcatgctgggctggaggagagctgagccagggtgggcaacaggacttggtgggggtccaggctgtgcagtcccaggggaagaacggcccatgccagcggccctgactgagcagagcaggccagagcgtggggacttcatccctcagtgtccctgtcactccttcaacatgaaggagaaagccatgaaacgacgcaggtggctgtctgatcaggcccactgggtgctgagcttgctgtccccgtggggtgcccgtgctcatggcagccgagggtacggtgcagtgcacaggaggcccaggccacagctcccacgccaggaccattagggacccagtgcagtggctggactgcagctggggcaggagctgctgaggaggtgggtgcccagcaccacctttgcactcggcaccacctttgcactcagcagaacggaggccgcgtcctcagggaagcatgggcctgcattggtacggcttcactttaaaaatgcatcatcaaaccccgcaaaccactggaaccgggtgcctattgaatgtgagcactcagcccaaatcatcactgtgaactaaggtatctacacctgcttcattctaaacagaaatgcagatctctctaagcaggaagcaccttaagctcctgccaccagcattcattgggggatgtcattttggtcggtcaagggctgtgaagctgatgggattttcaatttgtaccattttataccacatgaggaaattgtgtaattacttttgcccatgacttctcattcttaacttgctttctcatggattacaactgtaataagacaaggtgttgatagagtgcaaactgtctttaaatttaaaaggtctaattgtacatccacctttaatcagtgctaaaatatcaacacagattgaaacttcccttcccaagctgcctgccagaggatgtgataaccctgctgccgacaccatcttcacgtgctctctgtaagccgtgggctttgcatcatacgaatcatcgcatctcgttagtgaagcggcctcatcttgacactgaagacagtccagggaggagtgagcagcactgcaagaagatgtcttagtgcctgacacggtgggtcttatcagctcaagatcctctcccattctttttaaacaaaatttttagagatagggtcacgctctatcacccaagctcaggggcagtggcatggttgtgaccatggttgtgacagatcactgcagcctggaactcctgggctcaagagatcctcccacctcaacctcctgtgtgggacttacaggtacatcaccacgcttggctaaatttttaaatatttttgtggagatggggtctcactatgttgcccagcctggtctcaaactcctggtaagtgatgctcctgccttggcctcccaaagtgctgggatgacaggcatggccaccacacccccaccttctccattctttaccccccaaagtgctgagatgacaggctcggccgccacgccccacctcctccattcttaacccccaaagtgctgggatgacaggcatggccaccacgccccacctcctccattctttacccacaattgttgctattcttctaaccccatgacatcttactgtctgcttgtagccaagtaaagaacactactgaaaagagagtacttcatgaggatttgccatggcatctttcccactccaggcattcgtgggatgcccaggcacgcaaggccaatggacatcttgagtgagcaatggcaaccaacaacttataaactgctcagactttacattttgctctcacatcaaattattcccacttcatttgatctgaatgcagcctcgcggagtgtaactattggccctagctgacagagaaggcaccctgaggtttgaaaacagtcaatgagtcgtccaaagtcacaaaacaagcaaatagctgggagggtgctgtgaactcaagttctaaactccaagctcttgtttttccttcttccattttgccaacctcaggtgccatgaagtggcacagaacatccaggcagggctggagaggctgatacctgacctagattggtgcctaatccatggggcactgcactatggccaacacagcagacatccaaaagcagggactgacctagagtaaggaggctccattgccctcagcttcagtaggtaagcagccaactgctgtagaggtgctcatggtgatggaggtgctcatggtggaggtgctcgtggtggtggaggtgctcctggtggtggaggtgctcgtggtgtggaggtgcccgtggtggtggaggtgcccctggtggtggaggtgcccgtggtggtggaggtgctcgtggtggtggacgtgctcgtggtggtggtgctcgtggtggtggaggtgcccgtggtggtggaggtgcccgtggtggtggaggtgctcctggtggtggaggtgcccgtggtggtggaggtgctcctggtggtggaggtgctcctggtggtggaggtgcccatggtggtggtggaggtgcccgtggtggtggaggtgcctgtggtggaggtgctcctggtggtggaggtgcccctggtggtggaggtgcccatggtggtggaggtgctcctggtggtggaggtgcccgtggtggcggaggtgcccctggtggcggaggtgcctgtggtgtggaggtgcccgtggtggtggaggtgcccgtggtggtggaggtgctcatggtggaggtgcccgtggtggtggaggtgcccgtggtggtgaaggtgcccgtggtggtggaggtgcccatggtggtatggaggtgcccgtggtggtggtggtgcccatggtggtggaggtgcccatggtagtggaggtgcccatggtgctggaggtgctcctggtggtggaggtgcccgtggtggtggaggtgctcacggtggaggtgcccgtggtggtggaggtgctcatggtggtggaggtgctcgtggtggaggtgctcttagtatggaggtgctcatggtggtggaggtgctcgtggtggtggaggtgcccgtggtggtggaggtgctcgtggtggtggaggtgcccgtggtggtggaggtgctcgtggtggtggaggtgctcgtggtggaggtgctcttagtatggaggtgctcatggtggtggaggtgctcgtggtggtggaggtgcccgtggtggtggaggtgctcgtagtatggaggtgcccgtggtggtggaggtgcccgtggtggtggaggtgctcgtggtggaggtgcccatggtagtggaggtgcccatggtggtggaggtgctcgtggtggtggaggtgctcatggtggtggaggtgctcgtggtggaggtgctcgtggtggagttgctcctggtggtggaggtgctcgtggtggtggaggtgctcgtggttgaggtgctcgtggtggtggaggttctcatggtgcaggtgctcctggtggagatgctcgtggtggtggagatgctcgtgatgatggaggtgctcctggtggtggaggtgctcctggtggaggtgctcctggtggaggtgctcctggtggaggtgctcgtggtggaggtgctcgtggtggtggagatgctcgtggtgatggaggtgctcgtggtggtggaggtgctcctggtggaggtgcttgtggtggaggtgctcctggtggtggaggtgctcgtggtggtggaggtgctcatggtggaggtgctcgtggtgatggaggtgcttgtggtggtggaggtgctcctggtggaggtgctcgtcgtatggaggtgcccgtggtggaggtgctcgtggtggtggaggtgctcgtcatatggaggtgctcatggtggaggtgctcctggtggaggtgcttgtggtggaggtgctcctggtggtggaggtgctcctggtggaggtgctcgtcgtatggaggtgcccgtggtggaggtgctcgtggtggtggaggtgctcgtcgtatggaggtgctcatggtggaggtgctcgtggtggtggaggttcccgtggtggtggaggtgctcgtggtggtggaggtgctcgtagtatggaggtgctcatggtggtggaggtgctcatgtaggatctaaatgccattcagttgaaccttttggttctgctgaccagcgtgcatttaacccactcatcctcacccaaggactcttgtccaataatgcaaatacgtagaatgctgtcctggccgataagtccgaggcctgatggtgtgcagtgccctccttattaagaacgattacagggccaggggactcagatgccagccttgccgtgtgaatcatcatgtaaattttcaagaatgggccttcagagctttggcattcccgtgctgggaggaaaagtgcaaagaatcagatgcaaggcctgagagcccaggggccttgggcaggtgttgaccaggtaagacctgcctgtgacaagcgtccccagcagacaagcttctgagcaattgtttcccaagtgctgaatagcctcatgctggtcccaagtgctcagggacccctccctacccatcccaggcagctctcggacttcactgaacctcccctgccttccaaccaagagctgcttctccggagtcctggtgtcaggaggaactttcctgggctcaccaaggtgactctgtgttagtctgatcaactgtgcactcacaggggacaccaactgccaaggggtttgtgccacacactccagctgctgtgtagccctgtagggtccccaaagcacaaggagacaacaagggagagtttcagatgccaacgggctggcggaacataattttttaaataattgagcccttcagagtctctcaaaagtcataatatttggacaattcatgtctcaagacctgagcttgtcccaaggggcccataggtatggcagagcaggagaaaccctctgccctgcccaagatggcccaggcttgtgacctggtgcagctacagggcaggactcctgggccgaccaccagggacagagggcagtggctcggctgtagctgaggcaggatctgctggggaggtaggtgcccagcaccatctttgcactctccatcacctttgcactcagcaccacctttgcactcagcaccatctttgcactcagaaccatctcggctcctctgcccctactgcttctgtcgagttgccatgggaactgatattggtagaagaactcccaagaagtggcttctggcagacatcggcctcccctcagctcagagacagcctgtgagccgcggctgcaggaggaaggagcatggtgggcacctgtgtgctggctggaagttgtgtctccaggtgcccgggggagggtgtgggcccatgcgttggcttcagggccgcactggcctctccctgcaggctccaagtgcaccttcctcgggcaccccttgctttcctccttcaggtctcaaagctatgccctgcccagctgccctgcagaacacagccctgatttaaaatgagccactttctgctccggtataaagacactaccctttctatgcggagatgaagccgcttcctactaaggtatgaagacactgccctttctatgcggagatgaggccgcttcctactaaggtataaagacactaccctttctatgcggagatgaggccgcttcctactaaggtatgaagacactgccctttctattcagaggtgagggaaagagtggaaacagcattcgcttatggacaaagaggaaaagaaaaggctgtgaaaacaggcatggcagcctcgcatcatggaaggaccagggcttcaacacagcaaaacagagagccaagtggacagcaggctcctccagcaaaacctgaggcctcgtcccccaggcccacagcccagcggcatcttcaccagcagacgcggctcccctgggactcccctccagcacagctcatctccagtgggctaggacggctaccacaggaggacatacgtgtcctggccacagccgccagccatcctgccgtcctcccgtcagtctctaaccccacggggcctggggcagtgaagacagaaacccatgtgcagggaagagtaatacttgggaaactcagcgacgcccacagtgtgctccatgaccgtcacaccgtcagcaaaaccccctcctgcacatccagggtacagggccttctgctggatttcacctgccccggcagccgactgcaccagcatcacagcctcctgccgacgatccctctgctgggaggctgggcgttccgtggagagaacagctgagaccccctcggcagcttcccaggcaacagaaggcgcagggaggtggtggtgattcactgtgtttctaacaggtcctctggccacggaagcctcctgcacatgtgaaagcctgcagagaatcccacgcacttcaaaactctcactcatgtttttcagaagcgggttttacaacttttggcatgaaaaggtcttagtggcatttctatgggtgtttatctaggctgctcccaaaccccagccaactaggggtgagctcccgtggccacctgtgacagtcagcccctcgcagtagacgtgccgacgtggctcccgaggtggaggggaagctggaggccctgggggctcttctccctgatcagggtatgaattctaaatgaacgtgaaagtgaggatgaaatggaacctgctctccccagcagtgagttggaggggggccaggtgctccccagcagtgagtcggaggggacaaggcagcaccctctgccagcaggatcagcattgctcgttcatttgcaggtgagaacgagctgctcccatgagtggtatgtccagtgcataaaccccctctgtgtaaaaataaacacagaaaagtggctgctgagcaacgcagtttcctagcccttggtttagcagtatccccgagtgtcccccacatgcggctcctggcgttccacgctggtagccctgtcgatggcgatgcaattattttctaccacagcgttgtgttgtctgcgctcagggtaaagccatgatgaaggcggctttcgggacttgtaattacagagccatgggtggcctctgtcctcgcagccgggaaggtcagcacaggtcctgggtgctgccagccctgagctccactcctgcaaacacttgtcaaaatgccagaagtaattacctggctgttcagaatggagtcatggggtgcagctcctaccatctccgattccctaaagcctccatccaaaccgaaacttgtttacaacctcctggggctgcagccacagggcacctgctctttggcagcagaacctcgccatagtccttaccaatgttcctgtctgctggtctctccggcagcccaggggaggcgctcccgtgcaggtgggagttcttgttccatgtccagcccacgtggccctggacacaagctggggctggttcacacactgcaggccccctccccgcccccaacgcagcaggtccagcaggagacgggcactgagcctgcggggcccactgtgcagaccccaccagcaccaccggcccacgcttcccacgccgcgccctccacttcttcatctttttctcttagaggctcctctttttagttactcctcatcgtctgtgtctgtgccgtgagtcagggatgttctaagagcaggaggagagcgtggtgcttccctctgagcatctccctcgcccactctgggtgacacctcagccaggcgagctgtgggatcgtcaacctcatggctgcggagcagcaggatgagcacgagccccacgccagccacagctggagcccaggagcccccagcctgcgttgatcctggcagcagctcagctccatggaggacgtgacacagcggcccacgtgcagcggaacctggagccgggctgcccaggccacacctccagtctcactgctctggcgctgtttctcagctgcaccctggaggtctggcgaaggggagcgctgggatccctgtgcctggaagacccttgaggagagtgcaggtccttggagagtcactttcatcagtctgacaggtgtctcattcacctgcacatggaggcaattttctcagcaagtggctgttttgaacatttccaaagcatcctccttcatttctaataagagtgcaacttcccttccacactcatggctcaggagttcctcttgtcttgctccaatctcttaatcatgagggtggtaccggagcacggatgggcttcgggccccaccagtgcacagctccacccggcctggcctccctggggagtgggtgtgtgggagcgtggatggctttaggccccactgctggtgaccagcatgcagctccacctggcgtggcctccctggggagctggtgcatgggagtcagatgaggaacgtctgccgcttgtggaccaatgctgcagcagcaaggcacccctccccctcccccggggccaacctgcctgtgtccacctcagcggagctgattccatcagctgcagtgaaactcaggcccaagtccttcttagtggctgctgaagatgaagttcccacactatgaagtccgattctgaattccaccttgccagcctcttactggcatgtccttggcacactggaccccacatccaggctgcaccattctcattcctctcaccttcagcccctgagacccacgctagtccctgtgctctgcccaaaggccagcttctctgtggagcctcatctaagccctgccctgccctccccgatgtgccatccactgcccctaagaactcccgtctgaacagccctggcaccggggttggggggagcttctggagggcagggccactgacatccagagtgatatcaccttaggaaggtgtgatgcattgccgaagacagaatccgcacggagcggaccagactgtgaagcaccgatgcctgcctggggtcgatagttaaggctggctggattgtaagtatgtgttataaaggaattcacttcactttgccattacgcttttcaaaataagcacgtttgtctgctttatgagaggccagaagcctgggcagcccttgctccagcagagaggcctgtgactaacgcagaacgctgcgggctatggggtccaggcatcggcacagagtccagttctgagccgggattcaagagaggctcacaagagaggaggggagcctcttcctccatgtggacccgctacatatgagacgtgaaacacagacagcagcacagcagacacgaccctgttctgacactcaccagcttcacaaagatgccgaacaggcagaagcaggaggacgtcacggaaagtcaccgtacctctgaatacagaggcgccgctactgaaatgacacggggcgcctctccaacaggctgaaagaaacaatggcagctgaatgccgtgtcttagaggctgtcaggtggaggatgctgaggtcaaagggggaaactgctcaggacaggagccccccatgagcctcaccccaccattcagggtcagcacaggagccccctatgagccacacccccaccacacagggctgagtgccagagacacaccctccgtggcgcccgagagggaatgtttgaagaaacagcctgaactcggcctgaaggaaacggccgagcatgggaggggattcctggcaataagctcataaaccacaggcagccccacaggccaccgggtgagggtctctgcagactgggagccagcaaaagcaaacagtttctaaaggatgatgaatttccttttctttgaaaggagcaatacaaaaattgatcagaaatatactatttaagaagaaactaccaaggaaatgaagaataaaaaggatttttctcttctgccagttcaactatgtgactgagccacggagattaaacgtagctaccagtcatttctatgtactttgtggtagagtaagtgcctccttgagcaaaacccacttatttttaatattcactaataccctgtgctcatacccaaggtcataaattagcagaattcccgggaaagcattgcctacgataaagaggagacgctgagtaatggaaagcagctgcccttctcattcggcatcaataccacgtgacgtttgatggggactaatgtgggattaactacacgcctattcattaggttttgtatcattttgtataaaattagcaaaatgaatgccctttgaattctaccgccagggtgatctccccgcattaataacagcagcctcaggtcctcaggcccttgagggaaccagacgccagcagccattgggcttccaggcagctggcaggtggcaggtgcaggcagcacccagcactcccagtaatttcaacagcaggctcttgagttctgtatgttggtaacacaggcaccaccacacgtccttccataggtgtccgcccatcaccacagggcgtttgtgatgacactattaggattccacatcatcttttaaaacacaaaccataagaaactccttttgaatttgaaattcttccctgctatcatgtcagcctgtctacgtctcacctgaaactcagtaagaggctcctcttcaccgtgctaagcactctcccaaggccaatgggccagtcaccgtgctaagcgctctcccgaggctgatgggccagtcactgtgctaagcactctcccaaggccaatgggcgagtcaccagtcaccaaccgtgctaagcgctctcctgaggccgatgggccagtcaccacacatgggcatgtccactgcctacctgcaagatcttcacagtcacaaaattcttttttataatctcttgggttttttttgtttctttgtttgtttgtgagacagggtctccctctgtggcccaggctggagtccagtgatgcaatcttggctcactgcaacctctgcctcttgggtttaagtgattctcccacctcagcctcccgagtagctgaggtttgagccaccacacccagctaatttttttgtatttttagtagagatggggtttcaccatattggtcagtctggtcttgaactcccaacctcaagtgacccgcccaccttggcctcctaaaatgctgggtttacaggtgtgagccactgcacccggccaatctgtttcttatatagcatcaggcacgttcatgacaccatagaattattcaaaataattctttaaaaatcatgcatgaatgtaaacaattttgcacacgttcaagaagcaagaaacattctgactcacacagccacaggagttaacatggaggcactggtgcaagttagcaaattcaggtgtttagaaagttgtcaatatgagactcaaatgtacatttcctatgtggctcccccttggtgcagcacttcgataaataacatgaacacatttgaaatgactgagaaactagctttcaaataatcaacctcattttctctagagagccataaaataaatcaaaggtccttgtctgtgagtatattgttatgatttttaaaaatataacaagattgccattcctagcatccttgaggtcctgcaaacctaattccagtggcattgctccccagtactggagaaactgccaatcatgggataattatcaatgcatttctgcataatacctgatcacggatttggtcttaaatatctccaataatcacttctgacagggaactagagcaagcgaaacagatgccatggagggagggagctctggcagccacgaggcactgaagccgttgttgggaccccccattcctcttgcgtgggagtgtttggtatggatcccactgacttttcatgctgggaccgcactggaccgcccagctggagtgaggatgctgggctgcttttccgagttgtaccccagctccacaagcctcacagcaaagtatggcaacaaagtgagactggggactcaagtctccacaaaccttaaatcagactgcagaagtttagtacaactttgcaaagcactgtatttcaaccacaaattctcagccccctaaatcaccaccttgagcaaaggagttactgagggcacgaggatatcccataagcaaaacccgcagcagccaaaacagataggaccagcaattcgctccatcccttagaacatggtggctacttcacaccttgattactctcactggaaaaagaaacttcaagtttacagggtgccagtacagtgacgcctcaatcaacgagaactaagtattgaaatcccgaaataaaccagagtattttgctgcattttacactgggaaaaaaagacacaaatttaagcaaaaaaaaaaaaaaaaaaaaaaaaaaacaagttcatagatttagcaatataaaggactggctaaaaccaagtgtcatttcccgctgtggctgggtcagtgtgttccgtcctgtcttatcaatgatacggaacgggagcaccctgcctgcggaatggccctaatgcactgaaaaccatcaggctaaggttctgttatgcttcctgtatttttcttactaggcaggaagattaaacaatacactctacaagagttttcaacaagtttaaaaaaaaaaaaaaaggcaggttgaggaaaatgcaacattgtgtccaccatcccattctgttcttcaagactctggagagtaaagctttgtgtttttcactcaatgacaattattaatcatataacaaagattactcaagctctatctgtaagtacatctcaaaaatgtgtgattcgcaatgcccagaaccctgggctctaaacagtgaaaccgtctggaagtcggccggtttttactgaaacctcccagatactttgtggtgtctctgcccaccgcagtcgggagcagggccggtgtgtgctcctggtctggtacaaaatgaaaaacctcaaagcaaaattgcacgtgctctgcacacactgggattactacaaacaccaaatcttgcttttccaaaagccggatttgttctcggtcacttgcagccctgtgtctcctgccttctatctgagccagttccacacatcagggcagcccagtccctctccacacagtgaaatcccagatggtgcccacggacagccacattgccctgtgactgcccctcgtcccctcactgcacaccagatttccacggaaaccgagaccttcctctgggttgccccatgtgggtagtgtgagtctctctctgccctggctgtgcatgtgcgtgtttgcgtgcgtgtgtgtgtgcacacacgtgtgtgtgcgtgtacgtgtgtgtggaaacagcctcacctgtggccttctccacatcctcagtggtcacgttttggacattggcgctcactttgaaggtcactgctggtccgagaaccctggaagggataatttaaaataagttcataacgaagtctacgcgccacaccgcttttctgaaaacgacatggaaaacactggtgtgtttttaaaaacgcaaacatccaaggccgctgtggctccaggcgtcgactccactggacgtcggttttccttcacaccatgacctttgtttccatttgccaggaattccgtttttgggctttgcttttccaaaacacacatcacagtgtaatatgctatcctaaaaaattcacatcaacctctgaacccagcaacagcaagcagatattcttgctagagaaaaagaaaagttgttattgaaatagattttagtctttggtccccaagggagatgtatgaatctagagcagagaggaaagagactagtattttttaaactcttttgacaggaaccatttaaaaaactaccaaagtcattaagaactactctgtataaaaacaactggcagggaattgctagacaggaattatcaaaattgttcaaagctttttaaatgctatgtcaaccacaattttgaaaaaataccttactttttaaaccatttaattcatctgaagaccccatatgcagtagaaactgattattgtgcctacagccatctcaaaatgaattaggaatccagggtccattcccaaagacagacagactgaccccatgtccacagatgacagccatagatagctcttcctggaacagaccccttaaatgtcttctaagaagtaaatccctggaacagacaggaaatgcgaagaggacccaatttaggtgggagagggcagctaagactgttgcttcctggtccctgggaggtgcctgcactgacatctaagctgtgaaactgggtaccatgtagcccagggtcccttgctgtccccactgcagccacacaccctccaccacaggctcatcccaaggcagcatatgacacccaggctgtggattttgcacccaaaatcctttcaacctcacatgtatttttgattcagacatctctgctcatgatacctcagtcccaacctctggtcttcctccttgggatttttgctcattctcccagccagggccagctcctccatgtgcaagcccttggtgaaggggactgtcgtgccattacgaggcagcacaattaccatcctaacaccatggctgaatattccatgtggacgtcttagcatcactttgaactcaacaaggtctcccttgaatcagcgcctgctctgaggagcaaacagcattctaaccttacggatattccctttggcttccttatgccaggaatatccagctagtcaccaaattctgcggaaacccttggaaaatgcaccatgtccaccactgcctcttggttcccactgtgatcttctagtccaagcctgtgccctgtcacagcagagctgagtgacttcctgcgtccagctctactgcatgcaaaatgtccttggaagccgcctccagggatgaccatggagcaggagctggtgtcttctcgagcccaggccccaggcctgtctacggtgcctcggctgggccctctgctggtccccactatgggccctcagaaaggaggaggccactccctccctggactgcagctctcctgccaacgatgttccactcgctcatgagtgctgagttctaccccctctcaaagccctactcccgagtgagcactgtgagagtggctgattctccctgtctccacagtcttccagaagggccctgagtgcctgatatttagtgctcaaatggcacaccagacgttttatagatgttttccttcttcccgagcacaggatgggctctttgaagcatgcatgatgatttctgccacggcctcacccacgcaggaggtgatcaattcatatttgtgaccggttcaacattttggttgaatggttttctaaaattaagagaaagtcctcattaacacaagcagcactcatgtacccccgaaacaacgctgaggacagagagctcagccacagggcttcaagcttacacacggcatctgtgaaactgtaatctcgaccacatctgaagattccctgacagatgggactggaatatcctaaacctaatttttccctcacgtgctgaaagttttctctaaaggctgtgaggaggttcttggttcctcagagtccaaagacccagacccctatgctatgaagaagcatgtgacccatacatggccccgtatttcacgtgggggccgcaggagaggcccacacagcccgtgtcctttcttgcacgcatgccgagcgtcaccattgcgtggggctgtggtcatcaccagggagtgctcctgacaccctcggggtacatctcgcaggcggtgagcacccagtgaccatcgccgtcaggcccagcgagacccaggtgcctgcggtcacggtgcactgagccctggctctggcccttgtgctctcaggaaccctgtgggaggacggggcatgaggagctgtctccggaggagactcagagggtcggtaacgtgaccccaactgcataaccttccctaacttgaatatgtgcaggctctgacgtgggaagaagtctctatcccgaggccccactacaggtctaactccatgagtcactgttctgtggccctcctgggcccttccgctgggcctcagtttactcagctgtcgagtgtggcaaggcccacaggtcctcttggacttgctttggcctaggagaccctggttttcaataaactctggtggccaggcccagcgggtctgcagtaaacaggggcaacactgggggctccagagctgagctgctggctctgcccccagcaccatcagcagcagagatccctccccacaagaagaacttgccctggcatttgttaccaaccccacccaccaccccccaccccgcccgccacgtctgctgtgcaggtggcagatggctgagtgctgtgtggtccaggtgagaggcttctgggtagggagtgaggtcagccttcccaccaacttctttctaaccagggagccttggttgtctctgccatcttgttcagctttctgtctctttagacatttggggaaaattgaataaatcccatgtgcatattgccagcatcaaaaggggaatttctgtactaatcaggaaataaaaagtaaaacaaagatgcctagagccctgcagagtctcttaggagcaagtactgcacctaatattacagctctcggggagaaaacacccaggacgcccatccacacccacgacactcatccacatcctcgacgcccatccacacccacgacgcccatccacacccaccacgcccatccacacccacgacactcatccacacccacgatgcccatccacacagatgcccatacactccgacactcatccacacccacgatgcccatccacacggatgcccatacactcctacaatgcccatccacacccacgatgcccatccacatccttgatgcccatccacacccatgatgcccatccacatcctcgatgcccatccacacccaccacgcccatccacaccctcgacgcccatccacacccacgacgcccatccacacccacgacgcccatccacacggatgcccatacactccgacacccatccacacccacgacgcccatccacacccacgacacccatccacacccatgacgcccatccacacagatgcccatccacacccaccacacccatccacacccatgacgcccatccacacccaccacacccatccacaccctcgacgcccatccagatacccatccacacccacgacgcccatccacacccttgacgcccatccacacagatacccatccacacccacgacacccatccacacccatgacacccatccacacagatacccatccacacccacgacgcccatccacacccacgacgcccattcacacatgcccatccacacccatgacgcccatccacacccacgacgcccatccacacatgcccatccacacccacgacgcccatccacacccatgacgcccatccacacccacgacgcccatccacacggatgcccatacactccgacacccatccacacccacgacgcccatccacacccatgacgcccatccacacagatgcccatccacacccatgacgcccatccacacccaccacgcccatccacaccctcgacgcccatccagatacccatccacacccacgacgcccatccacaccctcgacgcccatccacacagatacccatccacacccacgacgcccatccacacccatgacacccatccacacagatacccatccacacccacgacgcccatccacacccacgacacccatccacacatgcccatccacacccatgacgcccatccacacccacgacgcccatccacacatgcccatccacacccacgatgcccatccacacccatgacgcccatccacacccacgacgcccatccacacctacgacgcccatccacacccacgacgcccatccacacatgcccatccacacccatgacgcccatccacatacacgacgcccatccacacacacgacgcccatccacatgggtgttttctccgtcaggcacattgtaaccacgtgtcccggcctcacacacagagcacttccttcccattcctgctttggctttgaagcatactgtgaaattcttcgtggctcccttctccaccaggcgctccttacacagtgctcacctatctaattacagacctgcttagaaattccaggggccaattttcaaacagaacaggcagagagactgagctgcagaatcctctgctgagggggagttaggaacaggtagcccaccgctcccaggctgaagccacaatgatagaaaccaggcctctgcacgatgagataaccatcagaacagacacacagcctggcgtccgcctgcaccactccacacagctccatgccttttcctccttaaacccctcactcagccacaaagggggaatggtctgttaaaggcatgagcctggccattccccagctgccagcgtttgattaataactgctttcctctgcccacacctcactctcatgttttcggcctctgagtggcaaacagctggacttgagccagttacaacactaggaacaccagtcagcactcagcactgtgctggggccatttaaacaacaaaaccaccaacgaaaagcacaaaaaatgtggaaaatgtggcactcaatagaccataaagaggagccttgttttacagtatgagctgaaacgagaaggcggagctgtcctctcccacctgagcacaggcatgtcaggcaacctgaactttatggctctgtgtgtgtgcaggaatgactttggcataagcattgatttgggggttacaaattaatttgcaaatacagaatctgcgaatgaacaggatcatcgactgcctagcatctgtgttgaagcgctttcacacacatcaataaccttattatcttcttcacatttttcaattttatactgtagagaggatgggagcactggagcttacaaggcttgagatccaattgtttgtttaaccgccacttcctcgcggggcgattttgcacattacattatttaccctgcaaaatcgggggaacaagacaaacattgcagggcattggaggatcgggcaggatagctgacatgcgacagggttccctctgaaccaaagctgtcagtctgtgccctgctcagtcaggaggggtctgctcctcctccaaattcttccataaaatccactctctaaattgactatggcttgtgtgggttcacacagtccccgcacgctgtactgctttctcagggagcctggttgctttccttcgggaatgacgtggttgatacaagggaggggactgtctctttcccgaccctggaccgtgcagtgaagatctcatgaggaatctgtaaatggccacgtcagggtagatcttgaaagtgtcgtcccgatggtcgtgccaggcacatctatggtaagaagcgtctgatgcaagagcaggaagagtttctgagtcactgttcctgggagaaccatccaccttttgacagtcaaattcacttaccgtgaaaggtgactcctatttagggtggaagaaatgccaaaaaggaatgctgcccactcagatgcaaacgcttcctcccctgacgaaggagggagtcttcacacaaaccttcctcccctgatgaaggagggagtcttcacacaaaccttcctcccctgatgaaggagggagtcttcacacaaaccttcttcccctgatgaaggagggagtcttcacacaaaccttcttcccttgatgaaagagggagtcttcacacacatccttcttcccctgatgaaagggggagtcttcacacaaacccttcctcccctgatgaaagagggagtcttcacacaaaccttcttcccctgatgaaggagggagtcttcacacaaaccttcttcccctgatgaaagagggagtcttcacacacatccttcttcccctgatgaaagagggagtcttcacacaaaccttcttcccctgatgaaagagggagtcttcacacaaaccttcttcccctgaggaaagggggagtcttcacacaaaccttcttcccctgatgaaggagggagtcttcacacaaaccttcttcccctgatgaaagagggagtcttcacacaaaccttcttcccctgaggaaagggggagtcttcacacaaaccttcttcccctgaggaaagagggagtcttcacacaaaccttcctcccctgaggaaagagggagtcttcacacaaaccttcttcccctgatgaaggagggagtcttcacacaaaccttcttcccctgatgaaagagggagtcttcacacaaaccttcttcccctgatgaaagagggagtcttcacacaaaccttcctcccctgatgaaagagggagtcttcacacaaacccttcttcccctgatgaaagagggagtcttcacacaaaccttcttcccctgatgaaagagggagtcttcacacaaaccttcctcccctgatgaaagagggagtcttcacacaaaccttcttcccctgatgaaagagggagtcttcacacaaaccttcttcccctgatgaaagggggagtcttcacacacatccttcttcccctgacgaaagagggagtcttcacacacatccttcttcccctgaggaaagagggagtcttcacataaaccttcttcccctgatgaaagagggagtcttcacacaaaccttcttcccctgatgaaagagggagtcttcacacaaaccttcctcccctgatgaaagagggagtcttcacacaaaccttcttcccctgatgaaggagggagtcttcacacaaaccttcttcccctgatgaaagagggagtcttcacacaaaccttcttcccctgatgaaagggggagtcttcacacacatccttcttcccctgacgaaagagggagtcttcacacacatccttcttcccctgaggaaagagggagtcttcacataaaccttcttcccctgatgaaagagggagtcttcacacaaaccttcttcccctgatgaaagagggagtcttcacacaaaccttcctcccctgatgaaagagggagtcttcacacaaaccttcttcccctgatgaaagagggagtcttcacacaaaccttcttcccctgatgaaagggggagtcttcacacacatccttcttcccctgacgaaagagggagtcttcacacacatccttcttcccctgaggaaagggggagtcttcacacaaaccttcttcccctgaggaaagagggagtcttcacacaaaccttcctcccctgaggaaagagggagtcttcacacaaaccttcttcccctgatgaaggaaggagtcttcacacaaaccttcttcccctgatgaaagagggagtcttcacacaaaccttcttcccctgaggaaagggggagtcttcacacaaaccttcctcccctgaggaaagagggagtcttcacacaaaccttcttcccctgatgaaggagggagtcttcacacaaaccttcttcccctgaggaaagggggagtcttcacacaaaccttcttcccctgatgaaagagggagtcttcacacaaaccttcttcccctgatgaaagagggagtcttcacacaaaccttcttcccctgatgaaagagggagtcttcacacaaaccttcttcccctgatgaaagggggagtcttcacacaaaccttcttcccctgatgaaagagggggtcttcacacacatccttcctcccctgacaaaagagggggtcttcacacaaaccttcttcccctgatgaaaaggggaatgttcacacaaatccttcttcccctgacgaaagagggagtcttcacacacatccttcctcccctgatgaaagagggagtcttcacacaaacccttcctcccctgacgaaagagggagtcttcacacaaacctgtcttcccctgacgaaagagggagtcttcacacaaacccttcctcccctgacgaaagagggagtcttcacacaaacccttcctcccctgacgaaagagggagtcttcacacaaacccttcctcccctgacgaaagagggagtcttcacacaaacccttcctcccctgatgaaagagggggtcttcacacacatccttcttcccctgacaaaagagggagtcttcacacacatccttcttccactgatgaaagagggagtcttcacacaaacccttcctcccctgatgaaagagggagtcttcacacacacctgctgcctagagccctcagaggtgtgatactcgaacaatgtgttcacatgggtcctatgaagaatatattaggagaaacaaaagctatttattgccgctaggagtcatctcccaattgggctggaaataacatgaaaaaatatatcactgagattctacagaattcactgacttaaaactacctttaaccaaaataaggaaaccatatatgttgtacatagataagagatcatttcatcactgtaattttagctatagttacctctattttaaatatcattccatttattcctgagttctttatcactcagtggttccacttgatagtttactatatattgataattgctcatttcttttgatggtcataaaacatgccaacaaagaagagaagtgacatctagcattttaacactgattttattgcttgtgttctaggatactcctatcactcaagacttatgagacaaacataccagccctccatcaaccagactgttgagtgtaagagttctgcgtaaaaggccttttcttaactgaggactatttggaaatctctttttcccctacttttatgagtgaaataatttaaaaatacatataattatctgcctttagaacatcaatatactgatgtactaatatttgttgtcttagcaatcatatatctcaaagtgattttctgaatattagttttcagggcatgacactttaaccacaggaaagaaaacactgagctccatctgttcttagaccaaccgtccggttgagaatgaagaagatgaacaaatctctgacaaaagcttccatgtttcggaaatggttttaaataagaaccgaggcttctatttggttgggttagtctgggggttgttatttctgtatagtaacgactatacagtcgatacataacacaggcttatttgtatcaagtcaacctttaagggctacaataaatgtaacacatttgactacagttttctgaatagacactgcctaagcagtagttaacaagtttgtagtccgtttaaataaagacaggcctcaggtactagattcccttgactttttgtggataaaaagaagatagccaaggcatatatggcaacaaatatagttttaaagttaatcatttaatgttgatgctttacaaccaacataaaagtaaatgcttctcttttcaactggtgaattttcttgaaagttatttagaaatgaaaaaaacaaaacttctgtagactgttttttgtttgtttattttactagcatgctctctgctggcttgacagactgacctgtgctttatctatttgacacctggatttggagtgaagcccataacatgaatagatgggtgcgtgagggataggtgatagatggatgggtagagagatggttgggtgagtgggtgggtgggtgagagataggtgatggatgggtagagagatggttggttgggtgggtggatgggtgagggacaggtgatagatagatgagcagagagatggttgggtgggtgggtgaaagataggtgatggatgggtagagagatggttgggtgggtgaaggataggtgatagatggatgggtagagagatggttgggtgagtggatgggtgagggataggtgatggatgggtagagagatgggtgggtgggtgagtgagggataggtgatagatggatgggtagagagatggttgggtgggtgggtggatgggtgagggatcggtgatagatggatgggtagagagatggttggttgggtgggtgggtgggtgagggataggtgatagatggttgggtagagagatgggtgggtgagggataggtgatggataggtagagagatggttgggtgggtggatgggtgagggataggtgatagatgggtagagagatggttgggtgagtgggtacatggatgagtagatgggtgaatgggagggcagagatatatatacacatatacatgtatatgtgtgcatatatatatatacacacatatatgtatatatatgcatacatatatacatgtgcatatatatacatatatgtgtgtgtgtatatatatgtaggtgagtgggtgggagggaggatgggtggatggatggatagatgggtgggtgggtgggtagaaggatggatggatgggtagagaggtggataagtggatagatatatgggtggatggctggctggatggatggggaggtagacggatggatggatgaaaaattgataggtgggtggtttggtggatagagatatgtatatatttattgcttatattaattcaaacataattagacactttctcaaaatactgtttatagcttaagaatcattttgcattaaacctttcccatcttgtgggctatacatttagtgaattgctcattctgtttcttagtcagtattatgttcagagaaacacagtgctaataaaggtctcaaaattatcaaacaaaatcataatgatttaagagacttactatatctggctgaacataatttgaggccaggtaaaacctggaagagctcactacacacagtacatgttttaggggctccctaaagccagcccctcagcctcgaggtagaggcacaggggaacttccaagaaaccagccctgtgtctggccttgagtaggtgggcgcaaaccaagagagcacgctgctgtggtgctcggtaacaaccacaaaatttgacctaaggcaactcatttggcaatcgctattttatagatgaataagttgaaacccttgtagttttaggtgctagctccaaatagtccaattctaatatcaatgccaccactagaatcacaacttcggcgttcttggctgagagccttctgcgaggcacgagtataagtgtgagacccacacgcaggcctgcacctctgtcctttcctgactctgccgctggaccgacccccacaccatagacccacacgcaggcctgcacctctgtcctttcctgactctgccgctggaccgaccccccacactgtagacccacacgcaggcctgcaccgtcctttcctgactctgccgctggaccgacccccacactgtagacccacacgcaggcctgcaccgtcctttcctgactctgccgctggaccgacccccacactgtggacccacaggtaggcctgcaccactgtcctttcctgactctgtcgctggaccgacccccacactgtttgtgcttttactccctgaattgttcctgatgataacttgcctcctccagtcttgttccttgttcactggcgtccctcactctaggcaagcccacagcttggtgctgggctaatccaagctaccgacagaaaaccaataaaaaaatgagctcacgtctggctgctacagaattctctttgcatgcctcattccagctatgtcttcttacagaggagacatcgggaacataaaactccggaattccacgtggatagcataatgcatacctactttccttacacacacttttaattttaccacatttcctgcacaattgtgtattcctgcctctcgtacatgaggcaataacttcccaaaatatctagcctaagagcttacaaaggaggaagaagagagaaccaattcttatttgaatgtatgaggaaacaaagacacacacagttattgcaagataatttaacatcatgcaagccttaatgaaaacataattattaatgatgctttattttcttaaagcattgagcaactgcatcactgtgcagattgtatcttctttgcaattactttgccattacatgggatttgggaaatcctttctgtgccagggaatgtcttgccgcttacttttctcatggagtatttggaagaaaacagattgttcagtatgtatgctttgcctttgaactttagaagcatttgcctcctttgaagttctactgcaggctgctttcctgttacacctgctgggtggcatgaccagtcccaagagaagacccttgttcccccagcacaggggtgggccggatctcaccaggagcagcagaacgctcgccattcccgaaggaccagggccaccccatctgtgttttttctgttttgtttttgtttttgttttcagacggagtctcgcactgtcacccaggctgcagtgcaatggcgtgatctcggctcactgcaacctctgactcccgggttcaagtgattctcctgcctcagcctccccagtagctgggattacaggcacctgccaccatgctcagctaattttttttttaaaatagagatggcgtttcactatgttggccaggctggtctcgaactccagaccttgtgatccgcccacctcggcctcccaaactgctgggattacaggcatgagccactgctcccggcccccatctgtgctttctattgcagcttcgctctcatgatgcttaaggattaatgagctacacaaacacatgactgaattattagtgactaacatttagaagtagaagcattcacccaagaattaggacccaggctttttcccgaagcctcagcagcttggccacagccttcggtgctgtaggacaggcaggaaaggtgagaactcctccccctgagtgttcctgagggctccactgcgcagtccccaccatccctcagggtctcctgggcactgtggctcactctggttttgtttcttgttttacttttgtttctctggacacgcaggctgctaactcccgaaggcaactgccagccttcaaacaactccagtttgcaatcccaaatgaagtgtaacgcacactcatgggccagcatccgtggtgggaggagccgctgggtcctgtaactggggcaggtttatattcctccctgccctgggttgcaggtctcagcctttcctgcaggaggtgagtcctgaataacctgccccgcccatctgccccaaagcctcctgcaatcagctcatgcgcaacgtctctgactggagagacacattcggaagagtgaagtgatttttatttggtcctggtgagaaaaataagaataacgccaagcagggtatctagtattgacggtgtaggtcataagtaaaatgcatattttaccacagtgtttggtgtcatttctatataaatctaacttgttcatgtgtttacatatttcttggcttagacattttattactttaataatgtatctggaaagctaccctttatttggtgttaagtatctgcatacgcagggcatttaattctacaactctgatgtagacattatcgtctctactccatggaggagcacactgaggccaggtggcttcagtaatctgcccagggcctcacagcaagttgagaaaaacagagtcaaacccatgtgcctttgaattcagtctgcccattctttcgtggaatcattcattcactcattcaacaaataagcccctgttatgggccagaaacactctagtcactgatgacgcatgattgagcaatacagactgaggccctgccttcaaggagcgtaggagtgtatactttctggttctggttttgcagagacgaggtcttgctatgttgccctggctggtctcaaaactcctggtctccagtgatcctcccagttcagcccccaaagtactgggattacaggcgtgagccgccgcaccaggccaggagataaaagattcaagtcctatggatgaaagtgcctttacaagaaaactcagaactgcctgggaaactcttcactacctggtgtccagtacccaaatccagcatttacccaatgcttcacacttgaagtgcattgaaaagtctagagaaaagaatgggttcttcttgccaatctgaatccattaacagtagaaattagagtgttttttttcctaacagcaatgaaatagcgcaattgtccagctaacatgtattgcaaacctccacagcagacgttattctagtttttcctagagtctctccaaccctgtcatggcctcacagccgtatacataatttgtggggccctttgttgaagaattgtaagagtctcaagatggtaccagcaaagcatgaaccatgtgtggggcctctaagagccgggtctcagccacatgcccaggccacctccatccttgtggggaaactgaggctcaggaaaataaggaaactgctctcctcctaaatggtcatatcatttcatactaggaaacaaggctccaccaatattttaaacacaaatatctttaatcaaatcatgggattcacttaacctgagaaatgccacctttcactcaaacagaattattatttgcaaatccacagtggccttcccttgttgtctcatcttaaagacgggacggggagttttgacgtactgtgacatttccttgacattccttatttccaggaaaacctcatgtcactgtctcgagacactagcttgcacctttgcaactgcttgtaatattcagacagggcactgaagacgaagcctgggctccgtttgggaaggagagttacataacatgaggccccattccccaccttcctcacttggcaaatccagaacacaggtgaaacaggtagcaacattgcccgtgagggccggagtctgcaggtggtggatacaccacatccagatgcaaatgccatttacccagaccctcccctggggctcctgggagtttctcactgcgggggctcttggctttgagtgatattactaacgcacagcactgtcgctgcagtggttaatctgcactgccctgatgtgtagacaaaattatccagggctttatagtcatcgaggccacagggaaaaccagagagccaacccagggaatgaaggaccattctcacccctcacaggattcctgctgcctacaacatctttgtaaatcccctatgcatggggacaagactaggggcaaaacaatcacaactctgcccccggaaactgaaacatactttccagaagtttcccggcaaaccccagggacttctcccactggcagggtgggagaggggcaggcactggggaaggaggtggaggggcccgggcagcactggggttgtcacaggatcgagcaggcacaggcacctcccgcgccccgtgcacagagaagaccccaacaagaagcatcagggttgagaattcccactgctgcctcttcggtaataacaccgtattcatcaatccagtaaatcacacagatgagaaagtaaacgcttctcccaccaggagagcacatgaagattgatcacagaattaggctgcgtgccccgaatgccccggcggtcctcgtggctgatgtgggagctccaccgaagccatctggaagagaactgtcacagagcccgtctcactgtggactcaggggctcgtgggaatgtgtctttggcatcctttttcccaggagcactgcccacctccccgagattccgcggaaggcggcctggcatcgatcaccgccgccgcagacagccacaatcacgtcgtaaaaacccggctgcggtcactgccggtctgctggcataattacatcacatgctaatgcagttttaatggtctctaatgatgtcataagaaataatgggatttatgtgacagctacataaccactaacaaaacatattcagcataactagcacttccacaaaaccgcaggagagtctgagagtgacagcttgcgcatcctgtccgcctcttttcctttcccggaacaatgagcagctcccagaacatgctctgacaggcagcaccgcgtggccgtgtctcccgcctgtcagagctgctcccctcgagacaccaacgaggcacagcccacacccccgtccgtccctcgagccggtgcatttgccaagtgtgtgcccgtggctgctgggcccgggtgaggcacaggacgtggaagtaaggcttgcgtggtcccctgcacatgagcacacacgcacgcaggcaccagaactcaagacccagcgtggggcagcctctgcctggccaggactggggacctcggagaagcgctggacgcagcaagaatcaggcttcagctccgcaatgtgggcaggggacccgcaaaggatcctgcgggtgaggccaccgggggggctccctggggaggaggtggagaggtccagattcccgaaggctccgagggacgggcggcgggactcaggtttgactctgtaggaaagagggggccgccagtgtcctaaggcgggagatgcccgagggtgacgcttacccaggactgagcctggcaaagcccagccctgctcccggaatgcggagaagccgtccgtgctcagaatccgtcttccgacagcgaaggcggtggccaggagggccaggggcagggagcaggcacgggcgaggcccagctgctctgtgaaaccagaggctccccgaggcacacgcctccctcgcccgccccggcctggcatctgccagtcccaccattttgctgagactctgtgaaggtgaatggggttgcttgggctcggggactggaagaagaaggacgtttatctcgtgaacgcgggacgctccttatgggagaggagtgggagacatgaagcaaagcgtgaccaccgaggagctggggagaaagcgagaaagcaaggaagcagtgggggacggggaacggggccgcggggagggccggagaagatggtagaaggtgacagtgcggggtgcagcgttcctgggtccttgaggggagccgggcttctcagccttgaagacccacttcttctctggcctcattcctgggttccgcatcccggctgcctccccttcctcccccaacacatcccggctgcctccccttcctccccccaacacatcccggctgcctccccttcctcccccaacatcccggctgcctccccttcctccccccacatcccggaggcctctccttcctccccccacaacccggctgcctccccttcctccccccaacacatcccgggtgcctccccttcctccccccacatcccggatgcctccccttcctccccccacatcccggctgcctccccttcctcccaccacatcccggctgcctccccttcctccccccacatcccggctgcctccccttcctccccccacatcccggctgcctccccttcctcccccaacatcccggctgcctccccttcctccccccaacacatcccggctgcctccccttcctccccccacatcccggctgcctccccttcctcccccaacatcccggctgcctccccttcctccccccaacacatcccggctgcctccccttcctccccccacatcccggctgcctccccttcctcccccaacatcccggctgcctccccttcctccccccaacacatcccggctgcctccccttcctccccccaacacatcccggctgcctccccttcctcccccaacatcccggctgcctccccttcctccccccatccccggctgcctccccttcctccccccaacacatcccggctgcctccccttcctccccccacatcaccggctgcctccccttcctcccaccacatcccggctgcctccccttcctccccccaacacatcccggctgcctccccttcctccccccaacacatcccggctgcctcctcttcctccccccatcccatcagtggtcatgcttcacttcctctccccactcctccctcataaggatcattgtgttcatgaaataaacttattccttctttatttatttttattttccataggttttgggaacaggcagtgttgagttacatgagtaagttctctaatggtgatgtgtgagattttggtgcaccctcctgccacccttttccctgagtctccaaagtccttatgtcattcttaagccttcacatcctcatagctcagctcccacttatgagtgagaacatatgatgtttggttttccattcctgagttacttcatttagaataatagtctccagttccatccagcttgctgtgaatgccattatttcattcctttttatggctgaatagtattccatggggtgtgtgtgtgtgtgtgtgtgtgtgtgtgtgtgtgccacgatttctttatctactcattgattgatgggcatttgggttggttccatatttttgcaattgcaaattgtgctgctataaacgtgtgtgcaaatatctttctcgtataatgacttcttgtcctccaggtagatacccagcagtgggattgctgaatcaaatggtagttcttttagttctttaaggaatctccacactgttttccatagtggctgtgctagtttgcactcccaccagcagtgtagaagtgttccctgttcaccacatccacaccagcatctactgttttttgattttttgattatatccaatcttgcaggagtaaggtggtataacattgtggtttcgatttgcatttccctgatcattagtgatgttgggcattttttcatatgtttgttggccatttgtatatcttctttcaagaattgtctattcatgtctttagcccattgtttgatgggactgtttgtttcttgctaatgtgagttctttgtagagtctggatattagtcttttgtcggatatatagatcatgaagattttttctcactctttgggttgtctgtatactgctgaaagaaatcacagatgacgcaaacaaatggaaacacatcccatgctcatggatgggtagaatcaatattgtgaaaatgaccgtactgccaaaagcaatctacaaattcaatccaatccccatcaaaataccaccatcattcttcacagaaccagaaaagacaatcctaaaattcatatggaaccaaaaaagagcctgcatagccaaagcaagactaagcaaaaagaacaacctggaggcatcacattacctgacttcaaactattctataaggctatagtcaccaaaacagcatggtactggtataaaaataggcacacagaccaatggaacagaatagagaacccagaaataaactcaactacttaacagccaactgatcttcgataaagcaaacaaaaacaaagtggggaaaggacactctagtcaaaaatggtgctgggataattggcaagccacatgtagaagaataaaactggatcctcatctctccccttatccaaaaatcaactcaagatggatcaaggacttaaatctaagacctgaaaccataaaatttctaggaaatagcattggaaaaactcttccagacattggcttaggcaaagacttcatgacaaagaacccaatagcaaatgcaacaaaaacaatgataaatagctgggacttaaactaaaaagtttctgcacagcaaaagaaacaatcagcagaataaactcattccttcttccagtcatctagcccaaacaatcccactgtatacaaagaaagacctcacaccttccattgcaccaaaagagtttaaaacccagctcaccatgaaagccatggagactttaaaagaaatcccacctggtatttaagaaaatctcacccagcacagtagtgcacccgtcagcctcaggtctgctccaatcagtgtggacagcaaagcccctggccaccctgaccgtccagctgttggccatgtggccaaccactcctcccttcttcattctggcccaccctctcccaggggatgttactgggggagggcagagatggccaaagcagtgagcagcggcaggcccatctctgcccgtcactacgccacggtgggccctgaggtcccaggatctgctcacagtgagcagccatggagcttgcagctgaccctggggcccctctcctgtcctgaggatgaagtggttcctctcccaagccccagatcgcaaactggacccatgtggcaggcactgagcccaggtgccaggcagccctcagcccacgccttcaccctggagccatgatgctaacagtgcatggcagccatcagcagcagggcggccaggagggaaccttcagaaaacactgagcccctgtgcgcctgagccacggccttccacgtgctggacagccaccacagaagggctttgccagaggaaaatatggtaaactcaatgcacgcatcccgagctggcccgaggatgctttattccaaagccacctcttgtgactgcctgccctctgcccaattatctcagttatgtgtctgggtgcaacagcttcctccctcccatggctccaggccgccctgctgctcatggaggcacctctcatggtacccaggctgcttcttttccatggccctcaaatgtccctgaggacaatctcacttttaactaaggaggcatccacacctccacacgttcatcagtaattgtgggccttggcagcaacaggtgagtttcccagggctgcagaatcacagagcatgccccatgtatttgatatatggagagaggcagaagggggtgtgggatgggcctgcagctttgcgggtgttggagggatgaggcctttgttgttcaaggactcattgcatcacgcttgaatcacacttgcacttaagatgcaagtgtgcacttgcacacttctctgcagtcactgagccgggttcaggacatagataggcactgaggagctgatggtctggggagaaagacagcacacggctaatgttctgggggccacggtgcagggaaggcactgcagacccgggaggacacacccccaggacagtacctcatgctcctcagcggcatcagagctgagtcctagacagggagcctgacgggacaggagctggggcatcagtccatggggaacccctccttctgaaataagccatcagcaggacccagtaaggcctgggtgtccagacatgcacccgtccctgtctgacagcagaagcaggcgtgagcacctagaacaaagggcctgcggtcattggctgcagtcagtgtgaggctcccacttaccacctgtggcctcatcctccctgtgcgcatggcctgggcccacgatgagttcctgagtcctaaaactaggcgccttcctgggggccatagggagggatagtgccaaagatacaggcctgggatggaatccttcgtggaaaggaatgcagtttgaaccattcaggacacttgatggcaggtggctccttccagttcaaagtaagaggtaaaaagccttaaaataacagcagtaggaaaaagaacgcgaagagccctgcacacaggtgagactcaaagaccatcaggaaaactgcactttctggactaacgtggctgtgcccatggagcagcgatgtccgaggcagggcccactctctgggccccaggagattcccttcctctccagcctcacttccctagcatgagttgtactcagaatgtctgaggtcactggcagttccagaaccttctctagcactgtccgatttgtttgtctcatgagccaggtttcaaacagctcaggggcagggatgagtgttccccttcttacatgtcctgctctgtgccaggtcagtgcaggcccccacttgatgtgatggacaccaatggtgtcgggggccacagcacactgctctttgtaatgcccatgaagtcagatcatcccactcagcccatgatggttagcagcctggacacatttccttctggttcttagagacagattattattattttttttttttgagatggagtcttgctctgttgcccaggctggagtgcagtggcgcgatctcagctcactgcaacaactgcctcccgggttcaagcaattctctgcctcagcctcccaagtagctgggattacaggcacctgccaccatgcccgactaatttttgtatttttaagtagagatggggtttcaccattttggccaggctggtcctgaactcctgagctcatgatccacccgcctcagcctcccaaagttctgggattacaggcatgagccaccgtgcctggcctagagacagatttaaggcaatggagcatcagggcatcctgcctgagatttcttttctgtgcttcctcactatgccctccccagagcagtctgaggcatcagaaggcctgaggaaggccaggatgaagacaatggaggtcaggtgaatctcaggctcaaagactcctgagaaaggccctggaagacacataagaatcaagacaacttaagagcaaagataccgctgtgaaaatcagggatttgtggatggataaaaaagtcatagatgaggaaatagtaagacaccaagatcagcagcagggcccctcacaagatgaaaaaggagatgaagactatagggctcacctaggcagggacagagaggagaacagaagggagaaaagagagagaacaggactgatggaggccttgtcagtagtggaggagagcttgaggaagagccaacaaccacccatgatcacaaccatcccagctccatcccaaaatccatcccagctccaaccagcaccaaccgcagctccatcctcagcactatcccaactccactcagctccatcaaactccatcccagctccatcctcagctccttcccaactccactcagctccatcaaactccatcccagctccaccctcagctccatcccaactccacacagctccatcaaactccatcccagctccaccctcagctccttcccaactctactcagctccatcaaactccatcccagctccaccctcagctccatcccaagtccacacagctccatcaaactccatcccagctccacccttatccaaactccatcagaactccactcagctccatcaaactccatcccagctccatcaaactccatcccagctccactctcagctccttcccaactccactcagctctatcaaactccatcccagctccatcctcagctccttcccaaccctactaagtgtcatcatactccatcccagctccatcctcagctttatctcaactccagtcagctccatcaaattccaccctagcttcaccctcagctccatcccaactccactcagctccatcaaactccatcccaactccaccctcagctccatcccaactccactcagctccatcaaactccatcccaactccaccctcagctccatcccaactctatcccaattccactcagtttcactgaactgcatccgagctccatcctcatcctagctccatcccaactgtgctcagctccgtcaaactccatcccagctccatcccaactccactgagctccatcaaactccaccctagcttcaccctcatcccagctccatcccatctccactcagctacagcagattccatcccagctctaccccaggtacatccaaggcttcaataatccccagctccatgaacttccatccagctccattcctatccatccctactccatcccaagctgaaccaagctccatagacttccatccagattcatcaactctatcccagaccatggagctccatccacctccatcccagctccacctcatctccatccacaaatccatcccagctctatccatctccattgtatctccatccagttccatccagatgcatgccctgctttatccttatctccatcaatttccatcctagctccatcttacgccatgcagccccatccagctccattgcagctccacccagcttcatcccatctccatactactctatacccggctccatcactactccatctcatctccatactactgtatacccagctctatcactgctccatcccagctccatccagttccatcccctccttcatccagctccactgaattccatccccatctctcttctgttttattcccagctccttccatctccattccaactccattcagctctatcctagatcatcactgctccattctagctccatcctgctctgtcctcagattcatctcagctttttttctgagcttcatcccatctccatttccagttccttccctgatctatcttagctctatcccagtccatcccagccccatccacctagcttccccgcagctccctctagcttccccccagctccatttctgctctatctcatttttatccttattccttacaagtggcatctccagctcctttctgagcttcatctcagctcatctccctctctcttgagttccatcccaacctccacctctgctccctcccagctccagcgcagtttcctccaaagctccaccatcacctccatccttggctccagcttctttcttagctccctccctgcctccacacacacacctccgtgtatcatctggaagaagctatttccaccttttctgactcactgtttatcactgctcagaagtgtgccactttgggaatatccaaaacactgataaagaggatgtctccaggggctgatgaaatgagcctctccacacaaacgcctacctgtggagtctgcccttggggatataaccctgtcacactatctgtgccctgctccccgaaggtgatagagtgcctgttacatgattttcactagtgtcccaggtcacaggttcacagaagattaatccttgagtaatcactaaagatgaagtaggcaaacccctctaattttcaaaatataaaactatggcccagagaggaaaagtcacttccccaggatcccataaaaccagattatctaattctccttcagcataaagaggaagattttaagatcctggaagcatctcagctctttcaggtcttgggagcttcttctattttcaacctctgtgaaatctgtcctgtgtggtttccctagagttaatatttcttccctaggaacccaaaacactgactgggagctacctcacaagaaaccaaggtggtgccaacatgcacacttgtctctgttctcacatacacctaagggtccacgtgccccacatcgctgctgccccccttctcttcccttacctccatctcctgatcccatcagaaactgggatcttgctgtccactgtacattaaggttatgtcatatacacctacccagatctgtcccctaagtcacctggacagcaccccttagaagtcatccaggtacctgaaacaaacctatcaatcaaacctgttaggaagctccctcaaaccctcccccctcctaagtccctggtgtgctgaaagccactccatacatttccagtaccctcagtcacatcagaagttaaaacactgaagtatttcctaccaggtgggaaacagctgcagcccctgcccacccgccacctccagaaccccagatgcccaaacatcccaggccactctgggaacaacaggccctccccattgtgagccacagggaaaacacttgactgcccaggggccaccaggacttctgcctgaggccctacttgcctgtttccatgggcaggcatcacactgtgtagatcaacacacactttgcactcagatctaccctcatccttgaagctgcctttctacaattcttcaaatcctgcttcccaggcagaagtcacccagtggccacccactgcagtcacgctgtacctgctctcttccctcacctgcatcttctcgtgtcccctgcccacagcagcccatgaacatgccccctctttcatgtggatatctgcatctgccctgcacctgccccctctcacacatggatccctgcacaccgtctgcccacagcaggcccatgtacctgccccctctctcacatggatctgggaaagtcccctgcccactgcaacttgatgcacctgccccctccctcacctggatctctgcacctctgctgcctactgcaggcccacacacctgccccccaaaaaacatctgcatctcagcatagccccttcctactgcattcaccctgtgcctggtcccactcttacctggatctctgcaaaccacctgcccactgcagccctgagtacgtgaccctttgctcacctggatgtctgcatgagcctgccaattaaagccccatgcacctgccacctctcacctggatctctacagcccactcacccactatagccccacaaatagccccccctcacctggatctctgtgctcccattgccaccacacccgccttgcacctgctccctcctttaccttccccaggtggcctcagggctgctctctctcagctctagtcagaccatctcactgtgttcaccctgtagggtcctctcactctacatactgggtccctaaatggcctctctgtccctgctgagcagtcctacctggcctgcccaccggaccaccccatttcagggaaaccccagcagccctggcatgtatggagccccctgtccctccacatctttcctgtccatggacatttccttgaacctgctcattgcatatgtctgtaccctaggaacggtgtgggccacagtgagcagtgtggagttgcatgtcacatctctctctgggacgcctccatgtgtccttcagatttctacttctagaaacttctgatcccaggctggctggggtgcttctcatgcatgtcccctagtgccctccatgctaatgacccatacactcttctgtcttttcctaataaatggcagaattgaggcagggcccatgtatctcaaaggggatgcccagctcctggtgcgaggccaggttgccacaggtgcccagtgagcatctgctgtgaggagccactgagtgaacgaggtcaacctgtgtgaaggggccagtgagtgaatgacatcaaccctgtgtgaaggagccagtgagtgaatgacatcagccctgtgtgaagagtcagtgagtgaatgacatcaccactgtgtgaaggagacagtgaatgaatgacatcacccctgtgtgaaggagaccgtgagtgaatgacatcacccctgtgtgaaggagccagtgagtgaatgacatcactcctgagtgaaggagacagtgagtgaatgacatcaccccatgtgtgaaagagacagtgagtgaatgacatcacccctgtgtgaagactcagtgagtgaatgatgtcacccctgtgtgaaggagccagtgagtgaatgacataactcctgagtgaaggagacagtgagtgaatgacatcacccctgtgtgaaggagacagtgagtgaatgacatcacccctgtgtgaaggagacagtgagtgaatgacatcacccctgtgtgaaggagacagtgagtgaatgacatcacccctgtgtgaagactctgtgagtgaatgatgtcaccccatatgtgaaagagacagtgagtgaatgacatcacccctgtgtgaaggggccagtgagtgaatgacgtcaaccctgtgtgaaggagccagtgagtgaatgacatcacccctatgtgaagactcagtgaatgaatgacatcaccctgcgtgtaggagccagtgagtgaatgacgtcacccatgtgaagagtgtctgaatgatgtcacccctgtgtgaaaggctcagtgagtgatgtcacccctgtgtgagggagacagtgagtgaatgacgtcacccctgtgtgatgagtcactgagtgaatgatatcacccctgtgtgaagcgtcagtgagtgaatgacgttaccccggtgtgagggagccagtgagtgaatgatgtcacccgtgtaaagagtcagtgagtgaatgacgtcacccctatgtgaaggggacagtgagtgaatgatgtcacccctgtgtgaagagtcagtgagtgaatgacgtcactctgtgggagccagtgagtgaatgacgtcacctgtgtgaagagtcactgagtgaatgaagtcaccctgtgtgaagggaccagtgagtgaatgatgtcacccgtgtgaaggggccagtgagtgaacaacacgtgtaggcaggcacccctcggtccacaggcaggtgggcacacagcccgggccggcctcttgtctcacgtcctctgtggatgtcactctaccctccctcttctctctgacctctccacacccagctgtgcgctgtgggagctcctgcagcttctgcactcagccatctctgctccaagcttcacatatgcacgcatggttcctcaagcacttgtcgtgagacaggtaagaggctgcccctgtgtgtactcacccaccagccctgcatgcctcatgcccacaactctctaaaccaggtcacgctgagaccatggccatgcctgccatggaagctgcagagactcgggatccaaagccaggtctccgaagggcagcgcattttcctgacagccagggacagggccgtgtccacagcaggtgctcatgaacgctgcacagtgttctctggggtgggccctccagaggctcccacacattggcataggacatgtgcagaatgttctagagccttcggtggttacagcaccaaaggtttgacacttggctgcagcgacactgtccttcaggagattttcatccttccccttaaacactggtttccactgcctctaaataacttaccaaagctgctgaaatcacctttcacttctctaaacaggttccctcatgtaattaacaagagccatgggctcgcagctccttccctcccacccagtctctgcgaccaagcaacaggagccaaacagaaaccccagggccccgtacttactccacgtcagcgaacgcactgctgggcacctgcaggaggcgggcgacgtcctccaccagccgccttccttcctcggggcgcagggggctgcggatgacagcagggatggggagcagtcaccacagagccagcagtcctggagaactaaagccctgtggccccacagccccgctccctggtccccacacacaccctgctctcctggcctggggtcagctgccccctcaggcacaaggagtcacctgagtttccagcaacaagacaaacagtgcagtgcggacggggctgtgggaatcgcaagtggcccaccgtgtggagactggctcctctcagccttcagtgaaaatacaataaaggggagaagggagaagggacaggcaggtgcggcggatgctgggactctgactgaggatggggcggatccatggagaaagcatctgtttttaatgggctcatttctgatgtgaaccaggccccagtgaggggcaatttaactacccaatggaagtgtgagcatggaaaccaggcagccagcccactggcagcaactcagggcagggggcgggggcactcccggaaggcactgtggccgcagactccccacaaggccacctggctggggacctgtccgtcaagaggcaagagccgtcaccagggtggtttgcagcttgatgactcatcctgaaggccagcattcaggttgaaagtcacaagttgcctgtgaaatcctgttagtaccactttaatggagtattaagttacaatattatgtaaaagcatgttgtaccgcaaaggctttcaccccagcagaccaaaacgcctgcattcctcatccagtgagcgtgcaggatgcctgcagggcaccaggagctgcttccaaatacagcaatgaacagcaagaccagccctgccctcgaggggttcacattctagagatgctggtgaatagaaatcaatcatgctatgatgggttgaattatgtcacctaaaaattcatatgttgaaatcctaaaacccaaataatgtgaactgatttggaaatagggctatcatagatttagttaagctgaggtcaatagggtgaaccctaagccaatatcactggtgtccgtataaaaggagggtttggactcagagacaaacgcacagggtgtcgcaaagacatggggagaaaccacccacaagctgaagtcatctcaggccagtagcagcaggggcgaggctgggagcagaccctcctcagcctcaggggaaccagccctgcccacacctgggtcttggacttccagcctccaggacagggagaagatggatttcccactttggaagtgtgcgccagcagcccaggcagactagctcctgtcggctgacaagttctctggaggagacagctgggtagagaagtggcatgcagggctgtggagggaagggcagagaggagagactgtcttgtaaagtgggctataggaggcctctccagtggggccccgtttgaacagaggtgaaggagctggaaacagggtatcagacagtgagcagagaaggcaagggggccgcggtgccacatggtgaggaggtgaagtcacagagcagctgggtggacatggcctggagacgagtgcaggaggccgtcagctggggcaggggcctgagctggccaccacggctgtccggtggggagcctggggatctggagggacatctgaggccatgccggtggagtccgctggcactgggaaaacacaagatgggcagaagccccaggaaggcccagctgggagtggtgctgacagagtcaggagtttacatcctgcacacgtggacatggggaccccagcagggcgtccaggctaggtgctgaggggcgacgtgtctgtcagtgcagaggtcaaaggccccagcggggcatccaggctgggtgctgagggcagtgcatccatgtgtgcagaggtcagaggccccagcagggtgcccaggctgggtactgaggggcgatgtgcctgtgagtgcagaggtcagaggccacagcagggcgtccaggctgggtgctgggggcagtgcatcatgaatgccgagaccggggagctgtacgaccagaggtgttcactggcctcaggagggtgactgaagctggagcacctaagacggagccttgccccccagcatttaggatcccccagcattgagggccccccggcatttagggccccccagcattgagggccccccaacatttagggcaatgaggggaactggcaaaagagaatgaaaaggactgtgacagaggcaagcagcgagctggcaagaattccaagaaggagaagggccgggcctcagattggtccagagagatgaggatggggagctgaggccgagcttagcgggtcatgatggctgtgggctgacctcacaggagctcttctgcaaggctgtagggacctgcagcctgttcagcattggagggatggagagtaggaaaggagagatggggccaacactgtaagagctgcccagggttctgggggcaagaggggcagtttctgttaagctggaagacgtctaggatgctagcatagggataggagtgatgagacaaggtgctggatgtagggcatggctgtgtgtgcccagagcaggcagaggccttaggcaggagtaggacaatggtaacagaactggcaccagggctggagaccccaggcattctctatccatgacttacactcagggaccccttggggagaggacctcagcagggcctgcagattcagactcatgagcaggcgcatgccgtgactagtctagcctcagagcgcagctgcactagctggagagagagggtagttcttgggggttatgaatccttcctggggacagagagacgcattgaggtggattctcatgggcctcgcacctgcaacaagaaagccatctgatggcgtcgacgctacaagctgttgttgtggccaccagggacacagcctaccatccttggccaggacttcgaggcacgtagcaatccgggaccagctggggcacaggccgccttccactcagggaggagccacatctgagctcaggggctgagcctgtcccaaaagcccggtacctccagggagaccggtggcccctacatctgggtacccctcagagccacctggggagggtgtccaggcccatgcctgtcctgcccagccagtgtggctgcaactggagcccaggacagtgtatttaaaataaaaaaaccaaaccaaacaaaaaaaccctttgtaggtgaaggtgacagctggtccagtttgggagtggttacagcaatggaaaggtgaggctgcatccacgtaccacaggccttccctgcccagtccagggctctgggacctgagtgggccaaggactcaccaggatgggccaaggactcaccaggaatgcagatgccccagccaccctccagcgtttcggagtcaggaggccacaggtcaggcctgggaatctgtgtttctcgtgggttcccactggtgctgacacttgttcaggcatctgctttgggaaccccttggccaaactcccacaccataaaatcagcaacaaagccacatgacttccaaccctagactaacgtaggtcgctcagcttcaggcaatctacacatcagttgggagggatgtggaagacgtgccgcgggaatgctctactcttcatctaagaaatacttcctgagcacttgtggtaccaggctgagccaggagctatggaagcagagatgagagaggaggaggagccagcggcccccggcagcctctaatctggcaggaacaacggtaaagaatatgcattaaaaaacccatggcaaaccccagggaaaagagaagccaccggccacggccctggggcctacatgggagcctggtccaggctggggtaagggagccccagaagggtccccaagaactaccacagggctgagagaatggatcgtgttactagtctaaggcacagagcgcgagaggcagacgcagggatggaaacagcaagcaaatgccctcgggtagcacagtcactcagagaacttgagagaaggggcaggggaggcacggatggctagaaggaagggagccaactacatgggtgctcctcacccattaagggattggagtttatcccaaatacaatggcgagctatcaacagggcctaggcaagggcactgtcccactctcctggtcccagcttctcagaaggctgaggagccaagatcactggagtccaggagctcaaggctgcaatgagctatgattgcacctgtgaataaccactgcatcccagcctgggtgaaagagcaagaccccatatccaaaataacaacaacaacaacaacaaaagttccctcccctggataaagaacaggttggagaccagaggagacagaagggaaacagctggtggcctccagattgtctcaatgagacatgagctcaagcagcatggaccgtggtaatggtgactgaagtggacatggtcatagactgcgatgtgtcagcgggtaaggtgttcagaactgtgagtgagaaaggtgggctctgcagggttgaagggacagcagagcagatgctgttttctgaagcaggctgctatgaactaattgtgacccctaaaatctgtatgttccaatctttagccccaaggtgaaggtgtgaggaggaggggcctatgggaggtggtcaggtcatgagggtggagtctcctaatgagatcagtgccctctacaagaggctctgtagatctttttccttcatgtgagaaaatgccatctgcaacccagaagtgtgcctccaccaagaacccaaaaatctactggcatctggattccaacccctggaattgtgaggaagaaattcctattgcttctaagctgccccatccatggtgctttgttatagcactgcgagtggactcaggacagccccaggacagaggaaagatcctgaggtcagcatcaaacacacggagtctgtgttgccttcaaggcatcaggtgaagatatgacaagactgggtgggccctcaactgtctgcactgagcccatccctcacactccaccctgtgccaccctcagatggaacagggaaggagcctggttcgctcaggtgagtaactgggaacttgagttttataagacaggcccgctctgcacaccctgcatggagcggtgaagtaaggacctcacccacgtggggtaggctttggctactgcaccatgcacctctccctgcacatggacacaagtactcattccacaagtagattctacattggcattaactgcatgaatgaatgaacacgagaatgtcaaaaacagcaaaaaatccaacattttaaaaatcattaaaatgtaaactattaaatgaaccccactcaatttataaagtttctgtaaaactaaagtaaagcatgaattagttttgggaagatggtgagtaggaaacaccaggaatctgtctcccacctgacaacactgtgctagtaggatctgtctgatgtaactgatccttgaactctgaagcctaatgaaggcctccgacttctagtggaaggtctggatacaccttgcagtcaatgtcagctttcatcacagtaggagctaccgctactcaccttcagccctgtggcaagcagctgtgcacatgttcctggagcagcctgcacacactggcaggagccagaacaggcaatacagatgttgtcctccaaatattgggaatctgcaatctcactgctgattgctgcttctcatcacagaggtgcaggaaaggaggagggcaccattgtttggccacctcctcattgttgttgctcctccccctctggccaaaatgacttacaggggatttaaaatgctaacacccatttttcccaccttcatttttctctttttccgcttttgggagccagaaattaaagaccagaatattcaaaagtaactgaatatacagggaaaattagaaagtcaccacacatgctcagggaaaggctcagataataccacaagtttacacctcaggctgatccttggcacaaagacagcctacaaaaaatttaaaagaaagataaacaaaaaatagcaaacctatggagagacaatctgatttccagagttagattaaaatttctagttttcaacaaaaaattgcaagaaacaagaaacaaagaaacaagaaactacagcccattcaaaggaaaaaggtaagtcaacaataattgtctctaaaaaaagacctgatggcagatgtactaggcaaagactttaaaacaattgtcataaaaatgcttgaagaacaaaagaaagatgtaaagaaagtcagaaaaattatgtatgaaaaatgaaaatgtcaaagagaaaacctaaaatataaaagaaattctgaagctcaaaatacaatagctgaaattaaaaagttcactagagagattcaaaggcagatttgagcaagaaaaataaagaatcagtgaacttgaagataggacaatggaaattattcagtctaagaaatagaaaaaaagattgaagaaaagtgacaaaaccctaagggacatgtgggataccactaagagaaccagtatatgaattgtgagaggaaattgtgcccaaaagaaaaaaaagagataaaggggcagagaaaatacttgaagaacaatacctgaaaacttcccaagtttgatgaaagacatggatataagcatccaagaagctcagtgaactccaagtaaaattaactcagagacacattttaactaaattgttaaaagacaaggacaaacagagaattctcctcttacatttgaaagcagcaagaaagaagcagttcatcacacaccaggctttccaaataatattatcagcagaaactttgcagaacagaaagcagtgaaccaatatattccaagtgctacaggaaaagaaaaaaaaaacctgtcaaccaagaatcctatatccaacaaaattgcacttcaaaagtgaagaagaaattaagacattcttagataaaccaaagctgagagagtttgttatcactagacctgccttgcaagaaatattccaaggagccctgcaggatgaaatgaaaggacactggacaataactcaaagccatataaaaaattaaaatctcaataaaggcaaatatatggtgaattataaaatatagtattattgtaacagtggtttgtaactccttttagttctctatatgatttaagagactagtacatatcttaaaaacaattactagttaaaactagtattataactttggtttgtaactccacattttgttttctacataatttaagaaacgaataaattttaaacaattattagtttatatcctgggacatacaatgtataaggatgcaattttgtgatatcaatagccaaaaagggtgggtaaatagcataaaggagcataatttttgtatgttattgaagtcaagctagtataaatttaagttagtgttgtaattttcagatgttaaatctaatcctctatgataaatacaaagaaaatagctacataatacgtacaaaaagaagaaaggaatttaggcatttaatttttaaaaatctactaaacacaaaagaagatagtaatgcagaaaatgagtggcaaaaaatccataatgcacatagaaaacaaatattaaaatgacagaagtccctcctcatcattaattactttaaatgtaaatagattaaactctccaatcaaaagacagagattagcaaaatatgatattccacagatcttttaaggactatttctatagtacacaacaagggatatctatttgcattaactataagcataaacatgacagtctttgttttcaagcatgtcaataatgtcttctttttttgtcgcccaggctggagtgcagtggcatgatcgttgctcactgcagcctcaacctttccaggctcaggtgatcctcccacctcagccttcccatttgctgacattacaagttcatgccagcatgccttgctaacttttctattttttgtagagatggggttttgccatgttgcccaggctggtctcaagctcctgggctcaagaaatccaccactttggtctcccaaagtactgaaattataggcatcagccaccacacctggccaatatcttcttttaatataagagatagcactgtgagtgtattattgctacatttttagtttaacgtaaaatttctcattttgactattaaaggaaagtaaaatatttacatcactatttaagaaacctcataatgtacctagcgtgtatagagtactcttaaaactcaacaacaaaaatacaaacaataccatttaaaaatgggcaaaggacttgaatagacattttcctccaaagaaaatatacaaatggccaaaagcacatgaaaagatgctcaacatcactaatcattaggaaaacacaaatcaaaactacaatgtgataccacctcatacctatcaggatggccactgtaagaagaaaaaaacccagaaaatagtaaacgttggcaaagatgtggctaaattggaactcctgtgccttgttggtgagaatgtaacacggtatatcaagtgtggaagagtatggagactcctcaaaaaaatgaaaaatagaattgcactttgatcgagtaactccactccttggtatctacagtagtcccccattagctgcagtttgttttctgtgttttaggtacctgaggtacagtacaagaagatatttgaaagagggagagagagagagagagagacaccatatttacacaacttctattacagtaaattgttataattgttctattttatcactactgttgttaatctcatactctaatttataaattaaactttatcataggtatgtatgtataggaaaagccatagtttatatagggttctgcactatctgaagtttcaagcatccactggggttcctggaatgtctcccccttagataagggggagactactttgcccaaaagaattgaaaacagggtctcaaagagatgttagtgcctcacattcacagccgcattattctcaatcactaaagcatgggggcaactgaagggcctagtgatggacaaatggaggagcaaagcgtggcctgcaccaaaagtagaatattatttagccctgaacaggaagaaattcagacacatgcgacaacagggatgaaccctgaaacatgatggtaactgaaataacctgggcataaaaggacaaattctgtgtgtctacccatgtgaggttcctagaatcctcaaattcagagagacacagagtagagtgaaggctgccaggggctggggtagggtagtgtttaatggggatgaaacttcagttttacaggatgaaaagagctctggggatggacagcggtgatggttgcacaatagcacaaatgttaacgctactgaattctatgcttaaacatgggtaagacagtaaactttatgttatctatatgttaataaaatacaagaaattgggaagatgaaacaaggtgattagtataaaagcaccatgacgtgtggctgctccccacatccaaggcagtgtaccagccttcgtccaatctctatttcagcagaacactccttgtggctcacggagaaagctgagccaagttcctgctggatccctggcaaagctcctttctgctccctgtctccaaggaaagcctgtggcgtgttctttaaagtggatttttcaaggctgcattctgtgtaattttacaattgagaaacaagccattttcctttaaagagtggctgctggaaggggaggggtcccagatgtcctctcttttcctgtacattttggatgtctgctctaacccaggtcagctcctgtcccaaaacatcctccagggccatctgaacagcttgtgaagggcactggtgccagaaaaagtgtcagaatggccagatgttgggccagaagggaggcaacagggaagggagccaggcggggctacaaagacaaactcaggctgcagctggacagagcaatgacccaccacagccggctcagctccaccccggctgagaccagcccaggctgctgggaactccagacttgcatccaaccagcctccctgctccaagccaaaccctcctggcaggcaagtgcgatgcttccagatgagcccttcctttttttcgtgtggctgcaggttccttcctcccggctcctgtgctccccagcagcctgggcttttctctctgcctgggcctggtggtgactgctccaaagggccagcctacctgctcccatcgctgacctgccttgcctcagccccctgcaccccagcctccctgggcctccccatccttggagccattaggaagagggcaggtgcagaagggcaggtggagaaggctaggaccgaccacaccactccaatcagcaaagacagaaactgctgctcttcaggctttccctaaaactccctgtgtgctttgatcagcaccactcagctcatgacttattttaaaaggtctccagtactttcatattttaatcctgcctccccctacaaactgcaaactcattgagggcaggagccacgtgtcatctgagtttgtttcttccaagcctactgccccctgcggagcataagccaacttcccaatcaatgtttgctaccaaattccatgagtctccttttctagcatgtttcaaaccaaggggatggtatgaggacatgggaggggctccaccacgaatcctgggcccagccctctgccctccatgctccaatatggaaaccaacagaagcatccacaagactcctacaacaccctgaacacaacaaggaagtccacaagcccagaatgtgtttgtgaacccgctgcctccacaagccaaggtgtccccagttatacaaagtgtacgggacgtgcagtccactcccttccttcctcagcctggcaagggtgacagtgccggccaggtgggcaggggcatcacggctcctctgtaaagcagaagagtgctggctccattctgtaaagcagacaaacaagacagggctgactgtgctcacaatgatcacgcagccattcctatttcatctctaaagccacagccatcatctgtcattccgaggcctgaacttccttagaaagcagttggacgtcatcctgaaaatgagtgggaggatccagcaggtgcgacgtgctgtgtctgcatgtggcggcttccaccctcaatacctggacactaatattgccgtagaagagaaacaggcatgagaacttttatggggtcagggtcagagctaggagtgcctgtgagggcagtggaaaggactttcaaagctgaagatggcgtctcctctctctagagtctttcagttctgaaggacagtggcaagtttgtgacgtctctaagctcaaccacgttggacaagcctgttcctatggatctactgaatcagccacatgggaggccctaaggcctcggcaagcactcactggagggaggctcagagtaagaagtgacagtgtccctcttccacggtgtcctctcagccccggcacagtgctgggtcttccgtgtggcatccacatcaccccgaaatgagtgcacgggtggacgcatgagcagaaaatgactacgggagtgtcacccctaaaaatcagactagtgaaaagtacgtaggggtcggaaatataaagagtagtaaaaactctgggaagctcctgtgctggacgccacactgaggccccacacagcggtgggatctggcattcagcagacccctgaggaacacactattattggcctcatttaaaagagaaaccgaggctagagaaactaaagtcattgcccaaaattacactactaggaaactcccaggagaaaagctcaaacggaacactttatcattcaggctatgttccaacgtaggtgcccagaaaggtggggtgagcccggggacctgttgcgacctacacttgttcttaacaaaaccgaaggaagcctgcataaaacttctccacgtctcattttggcagccttgttactgcctcttccttgtgggccagatgaaatcaagccaagaacaggacccgccatgaccgaccctcctgctgaccatgctctgtgcttctgcagcttcaccagcccgatctgggacattttactatttactgcaaaacccaccaggagctagggagccaaatgtgaagggaaaatgagtcaactttgatataaactcttttgataagacaatactcaaaaccaatagataaacgaggtttcttgggatcaaccaattattctagttatccctgttcatcattaaaacaaaccatgaaatttattctatttaaatcatcttataaagtagttaaaatgtttccagcccacgggaacctcccccatgcagagaagcaacgcttcgagggtggcaaacagtgggctggggaggtgccctgaccaacgcgtggtgactgacaggcgccacagtatcctacagacaccacggtgaccgacgccatggtgaccgacgccgcagtgaccgacaccatgtctgtctccaccctggatcccctgcacgcccactctcttcctgcaggagtctaatgtcagggtctgggagaaggaggttttgatgctttgtgcacccaaactgaaccttcctcctgcggaccgccatgcagccccggagctcgtgtgccgcacccaggccaacgaccctggaccactgctagtggggctgtccacaccatcgactcttccaggcagaaaatcaatagaggaaaaccactgtattctgacaacttattttttggcataaggatgagactgtactgctcactataaacactttttaaatgccagcagctaactaaagatctaggtacggaaggtctatatagcgtcacctttaaaaagtgtgccaaataggatcgggaagtgcctccagcaggagccgtgaacccgtgctgacccaggcagagctggttctctaatctgattggatctcagatcccgtgccgacccaggcggaacaggctctctaacctgatttgacctcagatcccgtgccgacccaggcggagctggttctctaatctgattcagcctcagatcccgtgccgacccaggcggagctggttctctaatctgattcgacctcagatcccgtgccgacatggaccaccaagttaccatgggacctgagttgcccatcatgaactgaatgttttccgacccaccaagccagaaagttgggtgtacacagcagcattccatcatcaaatggaagtggtatgtgtctgggcctaagtaggccctaaaggcacaagttacataaagaagtgccgccaatgccaacggtccccactcccgctatgctgccttctctctcccagcctgcacctacagtctcctggagagttccctaaaatcagctgacggaggaagacctgggcctggtttacagatggttctgcatgatatgcaggcccccacgttagtggacaactgcagcactactgcccctttctggaacatccttaaaaggacagcggtgaagggaaattctccaatgggcagaactataggctgtacatctggtttactttgcttggaaagagaaatagccaaatgtgtgattattacaaattaataggccatggccaatggtttggccagatgctcagagtcttgaagaaacataatggaaaattggtgacaaagagacttgggaaagaggggtgtggacagacctctctgaatggggagaagacgtgaacaggaagctgcctcccagacgggacaggtgcagagctgggaccttctgcaggagcccagctgccggggcggagggagggcctggtggagtgtccccaagatgcacctgcagagctgctggtcagcctgggccacgctggggctggggtctgtatctcaggaccagtggagtcacagccagattccaacaggagagggtgacggggccagatttggttttgtcgagtcctctttgggttcaacgtgcacggcgggtgagaaagaaagagccgtgatgctggtgcgcaagagagaaggccccgcagtgcggaggcaagaggctcagatggcctggaccagggtgggagaagggaagaggggagaaggggagacagcatggatggagccataggaggggagacagctggccatggagggagccgggtggggcacagagcccactgagctgccgggctggcgagacatggctcaggcccaaccatggccacccccctgcctcaagtgcctcccacggccgcctccctgtctcgagtccctcccagggccacctccctgcctgaagtccctcccagggctgcccccctgtctcgagtccctcccagggccacctccctgcctcaagtccctcccacggccgaccccctgcctcaagtccctcccagggccacctccctgcctcaagtccctcccacagccgccccctgcctcgcgtccctcccacggccacccccctgcctcgcgtacttcccacggccgctcccagcaggatgggctggactgtcggggatgctgaggtttgggagagtttttgtttacttcttcttcctctttttcctgccccacccccatgccactccttctcgccttcttctcttctaatgtacaagcaaccgtgaacatgtttacccatcggggctataaccccacaccacctgaaatcttcttaaatgataataaatccatcatgctacagatattcttttaagaccacaaagcaaagaggagcaagtgacaaggcagggcatgtccgccctcaggaggggcctctacagaggtgaggactgcgctttctgaacaggaagtcacaacacagcgtggaggctgaagaacaaaacagaacccctgaaatctgccctggcgccagaaacacagaatccatcttcagcatcctcagggtttcctttactctaacaaggaaggacgagcaggaagcatcagtccggacctcggctgcaccccgtcctggcaccctgctggttctcgtgatgcgctcttctcgctgaacccctgaggggctcctgagcggtgaggcctcctgggcagccactaggattggaacttcctctccaccacaccagccccggagagcgggcggcggaacttcctctccgccacaccagcccccaggacagcgggcggcggaacttcctctccgccacaccagcccccaggacagcgggcggcggaacttcctctccgccacaccagcccccaggacagcgggcggcggaacttcctctccgccacaccagcccccaggacagcggcggcggaacttcctctccgccacaccatccccggagagcgggcggcggaacttcctctccgccacaccagcccccaggacagcgggcggcggaacttcctctccgccacaccagcccccaggacagcgggcggcggaacttcctctccgccacaccatccccggagagcgggcggcggaacttcctctccgccacaccagcccccaggacagcgggcggcggaacttcctctccgccacaccagcccccaggacagcgggcggcggaacttcctctccgccacaccagcccccaggacagcgggcggcggaacttcctctccgccacaccagcccccggagagcgggcggcggaacttcctctccgccacaccagcccccaggacagcgggcggcggaacttcctctccgccacaccagcccccggagagcgggcggcggaacttcctctccaccacaccagcccccaggacagcgggcggcggaacttcctctccgccacaccagcccccggagagcgggcagtggttcctgagcactcggtgggtttcacatttcacatctcacagtgagccgaggaaggggctgggggaacctgcagggccagggcactcactgagggtggcagatggagagaccgaagcccccacctccttccagacttctggttccaaagttcctctccctggccggcggatccctgccttcactggcctctctgaattccacattccaactgaacccccacagaggtgagcacgcagcagcccctaacggtggcccggtaccatctgccattttgctgcttgccttctccgaggtgcaagaaagttttgtcataagaaacacttgaaggaagaaacatttcagctgcagctgtctcccttgttagcattgagaggcatcggagaggtcaacgccgccccatgccactttttgcacattcttccctcagccggcctccccgcaagactcagggctccaacctctccagcttcccctcgtggaaatccattggctcctcctctttcaagcaacactgtgttcttcccactgctgacagaggctgctcatccgtgcacctgtgccctgcgtcctcctctgcgtgcaccctgcgtcctcctctgcttgcgccctgcatcctctgcacgtggcccgggctctgctccacctgagccccgttcatctctccacagtccaggagccacacactgcggctgccactccagagaccaggaaacccaagcacaggggcgtttgccacattctaggtctcggggctgccgtgggaccctgaccctggatgccggacttccgtgggtcaagggcccaggccaccttctccaacagcactgtggccgccaccccagactcaagcctctgcctcagctcccatgttttcctgactacaggtttcacttccccaaaatccacctcactggctcagcgtggtcgttccgcagaatacatcccaatccagtggggtctggggtaggcagagagaggcatgtgtgtgtgagccgtggtctctgaagctcttgcctctggatttagaaggcaggttcctctttgctgagaggtaaggggctccctcctccctatacctggtgtccgtcctgtgattccttctggaaacctaacatgaaatcattttaaagttgtccttggaggactggggcggctgtcctgcccttcgtccagtcttcaagaatccctctagtttgtaaaaaggataaaaatgtaaatggcaaaggattactgtgtccatcagaaaatgtgagagagaaaatcatgcctggaaaagccgagccctaccatcctcccatctgaacctcagcaccaagagcatgtggatgctgaggtgacaccgagttctaaaccacattcctctcctttctgtgggacaaccaaatgtacaaaagtcccccttttttaaagaatgccatctgtgtcttggaaattaatagctgatctgttaaggtttaagctgaaatctggtgaaaacttgcccaagagaatcacaaattattagtctgataatagggcaaaaacctcaatctccttgcaagaagagaggagacctcacctagtgcatcacaccttgctcaagcagtacaaattgctgacaaaaagctgtgctgtcttcaccagatagcttccaaccagttgaagtcgcaaaggaaaagaaaagaagtcagccaagataacatgatgattttttttttctttaacccactgctcataggaggtaaatattccagtccaaaaggcatggccggcaaacccactacaagaaaataaactcgaatgcaaagaaaagccctagcttttttctactggaaagtcacaagcacagacaggaaatgacccaatgtgataggtctccttccccagaaagtgcgaggctgctgcagacaggggccctcctgtccttccctccagggtgagcccattagcagcaatggcacaggattgtcggctctgaaggttccctagcaaaccacaccggcctcctgctctccgggtgaacacctcggcatccatttggaaagcccttaaaatgaccagatcactggttctctggggcactctcctaccccggggcagggatgggcggccgtccccctgcaagggtggctcaagtccccaggacacctgcagggaaacacacagtgtccacgaacacaacatgggggccttcaggagaaaagagggctccagcacagagtgaggagacacaggcaaccaaacacacacacacacacacaacataccccacaccacacctacaacacacaccacaccatgcaacacactatgtgccacacacaccacatatacaacacactgtgcaccatgcacacacaccacaaatacaatacacaccatgccacacactacacaccacacacaacacataaaccacacagcacaccacacactacacacatacactacacaccacacacatacaacacataccacgccacacactacacaccacaaacagataagccacacagcacaccacacacgacacacaacagacaccccacactacacaccacacactacacaccacacacaacacataaaccacacaggacaccacacactacacacatactgtacaccacgcactacacataacacacaccacacagcacaccacacacaaacaacacacaccacacactacacacaacagacatgcaacacataccacaccatgcagcatactacataccacacaccacatatacaacacactgtgcaccacaacacacagcacacacacacaccatgcaacatactacacaccacacatacaacacacactacacacaacacacatgcaacacataccacatgcaacacacaccacacatcactacattaccacacacacatcacataacacccacaccacacacaaagcagtgtttcctagggagggagacgtccacagcacagggcgtttgaccacccataggaatcggtcatgataatggtctgcgtcacccagtgctgaggcaggcgcctccccttggctctgctggtgcagacacgcagcctcagaacacatcacttagggcctgcctgtgattctccactgggcttgagagcaaagaaatgaacagccatgagaagttcctgactctacaaacaggagagcaagggcacagacagacacgtgggacgcctcctccaagcaaagagcctggaaacgggaaagctcatcctgacttatgtaaagcagtcttgagaaaatggagtccatattttagtgtaagcttcaagtttctgctgcttacaacttacctaaagatacaactaagataatcacctacagctgaaaatcatcttaaattttaatttggctttgatacacactctgcggtttgagctcaagataaaatatttctgcccaattatgatatgcagctaattctccctgatgaaatgtagcatctgcagcacagcgacagcaccagcccgagcactgcgaggctcgcagagcccgcaggacagatgggttctagctgtcatgcagctcccacctccagtgcgaatgatcctcaaaataagaggtacttcttcaccaaggaagaaatacccgaacagacgcacatcatactgatacacatctacccgacacacacactcatatacacacatgcacatatgcacacacttctacccaacacacacactcatacacactcacacacacacgtacatacagatacacatctacccaacacactcatatacacacatgcacatatgcacaaacttctacccaacacacacactcatacacacacacgtacatacagatacacacatctaccccacatacactcatatacacacatgcacatatgcacaaaccaatacacatctaccctacatacacactcatatgcacatatgcacaaaccaatacacatctacctgactcatacacacacacgtacatacagacacacacatctacccaacacacactcatatacacacatgcacatacgcacaaaccaatacacatctacctgacatactcatatacatacatgcacatatgcacaaaccaatactcatctacccaacacacacacatacacacacgtacatacacacacatctacccaacacacacactcatatacacgcatgcatatacgcacaaaccgatacacatctaccgacacacacactcatacacacacatgcatatgcacaaactgacacatctacccaacacacacatatacacaaacacacatatgcagaaatcgacacactacctgacatactcatatacacacacttatacacacacgtacatacagacacctgcccaacacacacacttatacacacacgcacatacacagatacacatctaccaaacacacactcatacgcacatacacacatacacacacaaatacccgaagatgcacatcataccaatacacatctacctgacatacacactcatatacacacacgtacatacacacacacccaacaaacacacatacatacacacgcaaatatgcatagacacaaatacctgaacagatgcacatcataaaaatacacatctaccccacatacacactcatacacatgcacatttgcacaaaccaatacacatctacccgacacacacactcatacacacacgtatatacaaaccaatacacatctacccaacacacacacgaacatacaaactgaaacacatctacctgacacacgcactcatacacacacacttatacacacaaaccaatacacatctacccgacacacacactcatacacacacacgggtacatacaaactgatacacagctacccgacatacacactcatacacacacacgaacatacaaaccaatacacatctacccgacatacacactcatacacacatgcacatacacacaaaccgatacacatctacccgacacacactcatacacacatgcaaatatgcacagatacacacacatctacccaacacactcatacacacacatgcacatacgcacaaaccgatacacatctacccgacatacacactcatacacacacacacaaatacgcaaatacacacatctacccaacacacacacacacaaatacctacaaactgatacacatctacctgacatacacacacatgggcatatacacaaaccaatacacatctacccgacacacatacacacacatgcaaatacgcacagatacacatctacccaacacacacactcacacacatgtaaatatgcatagatacacatctatgacatatacactcatacacacacaaatatgcacaaaccgatacacatctacctgacacacacacacacgcacatatgcacagatacacacacctatccaacacacatacacacacacgtacatacacagatacacatctaccaaacacacacacatatacacacacacgcacagatacacacaacgaaatacccgaacagatgcacatcatacggataacacatctacccgacatacacactcatacacacacacacgcacaaactgatacacatctacccgacatacacactcatacacacacatgcaaataagcacaaaccaatacacatctacccgacatacactcatacacacacatgcaaataagcacaaaccaatacacatctacccgacacacactcatacacacatacatatgcacaaacatatcgacacaacacacactcgtatacacacacgcacgcacatgcacatacagatgcacacacatttacccaacgtacactcatatacacacacatgcatacacagacatctatccaacactcatatagacacatgcatatgcacagatacatgtctacccaacatacacactcatatacacagatgcagatacacatctaccctacacactcatatacacacagatacacacacatctacccaacacacattcatatacatacgcacagatacacatttacccaacatacactatacacacacgcacatacacatctacccaacacacactcatatacacacacatgcgtatgcagatacacacacatctacccaacatacacactcatacacacacacacctacccaacatacactcatatacacacacatacaaacgtgtgggtgtgtgtacatccaggcagacacgtccttctctttgaaacaccaattctatcacttgaagaaaacacaacacttgtacaaagcaaagcatcaaatgtcagattcattaacggggtgacctgagaacgggccagccacttgtgccttgctgggcccgtgatgtctgaattctgagactcgttaagttcagatcgacatgagggcggggaaagaggctcgctgctgtgaagccccttcttccttctgaagggcgcccacgccaggatatttgggccactttggtgcaaaacagataaagcacctggagtccttcctaacaggcaggaggagtccggggtgcagcagtttccagggccgcgtcccatcccgcattcccgcgcgggccgtgctcaggctttgctgtacacttacctgccccgagaccccaccctgcctggccgccgctgaaggtgattctgacccgcagagaggcgcggcctgcaggtgaccagtcaggaccaaaaacccaggaagggatttgcttggtttggttttgtttgatgcccttcagagaacggctctccagctctggagcccagctcagaagcatcaggaggagccactgtccaggcacctggctgccctccgcgcctgagactccagggatgcctgcaccccattattcagttgaagacacttaaaagcgtatgcatccgccacagcaaggaggcgccccacctccagcctgctgggacaagccctccctcggcacacaggagcttagccagggctgctactcactctctgtctgtcacgatgtagccccgcgcctcttcctcggaaggctggacctccaattgcaggccgtcgctgagggcctcctgagcacccgctggaaggctctgctcctccttcgagggcccaggcatctggttttggagctccccaaacgcagcggccccgggctccgaatgcggctgctgccccagcagatctttggaatacgtctggctcttgacgttctccactccggcagtctcctcttctgaagacagggaagactcagggtgctcggacttcttcctctccatgtcgaggggccttgcaaaggggagggctccaggtaagagtcgagacccgtggtcctgcaggaggcccccgagtgtggcactcagacgatggacctgacagagaggacattccgtgagggacgtctgcgaaaggaatgctgatgtgacacatgcaatcaagggctgcccgggacagagtcactgtggggatgacatgggcagcctggaaggagagtgtgggaggaaggcgaagtgtgtgcagtctatatttagaatgatgtctagccgagcatgaggtgtgagggcgctgagtatccgaatcacttacgtgctgttttctcctccctcccgctccctctcacacacatgctcacacacacacctctctgaagaatcagattttgtagagtttgtgtaggtctttggcattgatatttttaaaaataaactgtgtgatatcaagatcccaccccagccctctagaagcaatgaacactaaataataataataataataacaaatttgcaacgactgagctcttccagcacacaaaggcactgtactaaatgcgttatctgcatgaacacactgagtcctcacgtaagcctgtgggtggggcaccctcagtaaccccagttcacagaaggggagacggaggcacaaagcgattaacccacaagtgggcacatcacagggatgtgtaattgattctaacgatacctgagggatctgtggtcctcacacgggctacagtctcccagccggatccccttttcctggacaagccatccctcggaaccccctggcacctctgctgactatgcaccgggtacagatttgctttgtgtgggttctcatgtaattactactccaaccccataaataaagggtgagtttcacctttaatttgtagactctggagtttacagaggttaaatatcaaattattggtaccagatcacaaaagtcgtgattatcagatccagaattggaactcaggtctaagggccatcaaagacatgatctccacccctgggccgcactgccctcccaggcaccctacactgcttcctaggaaagaccgggtctgctcctgccactggcacataccaggcaacccacggacacctcctggtgcatgtgatgccaaaagtcttatgtctacttggcagggtttttttccaaccatgaaattatatcttcaatattatattagatgtaaacaggaaaatctgattcactttacaactcactttgccaaaacacacttttaagaaaattaaggaaggactatagaggcaattattcccattttggctacaaattacaacttttccttttgtattttttaaaatttaaacaaaatagtagtgtgataaaaacactgctcaaatttggatcctcaatgacaataggatgtagccgttgacgttactaaacagagctaggaaaaagcataatattgtcacttaaattgtgtttcatgtgagaagaaaaagaaagatgtttttaaataaataagaagtcagaaaatacaacactcacataccctttttgagaaacagaattgcttgaaaatacaccccaaacaacagagaactgagtcagaattccacgcatggaggatgaaaagcctgtggtctaaaagtcagggagtcttaggctaacggcagccccccagagcgctccctgcccctcaggtgggagggctgggtctccccgactccctaaattaggaaatgtgtttctcagccccacttctccctccacagctcagacagcaggtcccatcatttctgatggatattcaaaaccagaactgctgatgttttcttcctgcacttgccaacaggcatggaaccactaaccagtaagagaatctgaggagagaatgactaaccaaagactcttctttctccacccccaaaactgggtttcccagaaccatgcaatgtcactgctgttgcttagaacggttcttcatccttcggccttgtattcacgaccaaaggttcttaaagggagagaaactaagaggctaaaagacttaacagggaaggccagtgtctagctcgtggacatcgcctgcgactgggcccttcttctgactgcctccggagcagcagtgcccacgggggctctgggatggtggaccgtcctcttcctgtggcatccagcgccttggccctgagccacatgcgactaacgtgccgccgacctgaacccagtgcggccaaggcactgcatctttcatttatttaattttattcaatttaaatataggtttagatggccacatgtggccagaggtgccacacgggacagccaggtgtgagtgagctgaacccctcaggaatccgcacatgcaggaggcatcaaatgtgcaaagtgggcacaggctgccgtgtgataatcctggctgggaaattccaggaaaaattaattttcttctttgcatttaccacgactttcatatttctaccatggataaattaggttataatttgaaaagagatatttcgtatccaaatatacacacttttgtatgttctctttatactgtttttcaatttggagattatgaggggtttctccataattttctgggaaaaaaacttttgtatttcataaatgttcccacaccatgaacaaaaagatcaccaacttccacatttaacatgaaacaaacaccagagacgtcatcttacctcttggtaaagtctatcatcgtcgtcctgcactccgtcatctgtaaaagacaccagtgttaccaagaccctcatcaagaatgtcatcacagggtgccacagacataaaaagggtgaccctgcagacccctccatacgaaaggtgaggtgtgatgacgctggcctaagtcctgccatagagtaaaccttttctgtttatagcacaaaatggcattctgtaaacttcgcgagagcggaggggactgaggagctaaatggtagacgtgaaggcagccacaatgacctcacccagctctgggggtctcacgtgatcgacaaagttaactcacggcaaaaaaaaaccccatcgtaccgagcagttcacgtcatgaaaaagcaaagtgaagccttcgccaaaaccacctcacaattaagatggcttcagaatccactgacttaggttatttcactgtggtcagcgtttctctctaaataggtaccccggctgggcgcggtggctcacgcctgtaatcccagcactttgggaggccaaggtgggcggatcatgaggtcaggagttggagatcagcctggccaacaggcgaaaccccgtctctactaaaaatacaaaaaattagctgggcgtggtagtgcacacctgtaatcccagctacttgggaggctgaggcatgagaatcacttgaacccggcaggcaaagtttgcagtgagccgagatcacgtcaccgcactccagcctgggtgacagagagagactccatctcaaaaaataaaataaaataataaataaattaattaatatcctactttcagtgcccaaaggtgcgtgactcatggcacctgaacagtgcccctggagacagcacgcacaccagggcctcctgcatccctcctagccatggtgcgggtcccgattccttcaaccactgggcgaccacctaacacaggccctcccggggtgcagttccactactcccctgcaccctgcctgtcagccaagtcaggcttccagcttccagcaaggccccctctgcacccgtgcagagagaggggcacgtctgtcatttggttttcagcacgtacttgtggggctgccatgtgtggggagctgagctaggtgctttcttgcagctccacgctgtgagaagccatcaggctgcagaagtcctggctgacccatggggcctccacagggctccggatgcctgccggggtagtggtgctgaggggctgccttctgcttccccagcagcctcagaggaccaatgcacgccccaagcagacatttgaatgatcccctctcactctgctattcaaatatttgacaatattcaccggtacacagtccaaacacaacacttcccatcacgcctgttttcctgactcagcctcagcatggaggagtgaaacctcctcgcagagagcaatttgccattcaacataattgctctggtaggcttagtctgttaagaaagcttttagaggcaaaagttcaaacagataaaaatcattaatacagatccccatctccccagcagaaagcccacattgcacttggtgagccagcagtctctgcacagccctgaggcctcccctccccgcagcacccctgggtgtgggcacccatggcgctgcagtcacctggaaagctgtctccacggagggtggccttggggccatccgcctgttctccagactctcccagggccgctctcccagggctgcctcgagctactccatggtccacgccttgcatcaggccagccatcagctcagccatgccgtccagctccaggccactcaggcccctcacctcagccggctgcctctgcaggtccttcaggagggtatgaatccgtgctcctaggggcacacacacaaacacaaggacgttgtgggtggacgaatgcaaaggtgagggcctccagaccataggggtgtggtgggcgtctgcggcgtcccaaggcagtggccacctagggccaggcgcaggccagtgctcagagaagattgggatattggacttgaatctcaaatccacctgaccctgtaaccatcactagttcagttccccagaggtggaaaacccacagaatggaaggacagactcatccacgcgctcaggaggatggaaagcacagcttccagaaaacactggaatgaccaagccaggaagagagatgggctaggcaacttcaccatgtcctccagaggataaaagaatgggatgagctgtgtccccctcacttggcagaaggagaaacaatgcctggcaaggacagcgccctgcccaggacaccctgcccagcacaccctgcccagcacaccctgcccagcacaccctgcccagcatggaccaactctaattacatctaaacacagccacacagggtcaaagcctcgtccaagaaagtaactgctgccggaaaagccccttaaaggaaggtggcagggtctaggcccccacttcacacaagcagcaacagatgcaggaggaggcagaaaaacagaacccgaaattgagaatagggcagtcgatgattagagcgaggagacaaggccatttgtggagctgccataaccgcggagagatgtgtgcacccgctgctcagcagagtggggaaattaaaacagaatccaacacacattctgtaagtgaagagcacggcgtctgaaatttaaaatttatgtccattacgggtggacataacggaagaaacggtttgtgaatctgaagacagatcatagaagcgatcatcgttggaagaacagaatgggagacgttctgcagaacctcagtcacccctggggcatccaagccgtcggagtcaggagggcacgggggggtgggaaaggaaccagaaacacctgaaagaaagcccacaagtctctcaaatctgggaaggattgtcactcagggactcaagacagtcactaagttccacgataataaaatgcaaggagaaccacgccatgacttcagctgagctactgcaagtcagagatggagaagattcctggaaagcagcgggggcggggcggggggaagacacgctccacacatgagaatggaaagggtcccaggagcgcagaggccgccagacaccctgcatgtcctgtaagaacaacgtatttcatacaatgtgcagagtcaggcatttgacgttacagataatgaatgccacatttgaagggttgaaagaaaaatcattcaatccaggagtttatatccaatgacaatatccttcaaacgagagggtaaaggagagacattttcatatcacgtatgtgaacaaagctgagccagtgggtccctgtgggcctgcacacaggctgaagagaaacaccaccacacagaagcccagagctgcgggaggagccaaaaagctcctgaaagggtaaatatgtggttacataaacaagaaagaccgtcttcttttctcctcttactttatctaaaaaacaactgattgttagcaaggaaaaattattaccactttaaggtagggttcataaaacagctgcaggcatgaactggatggcacaagaggctagagggagctgaagcctcctcaccgcgtccaggaagtggcacagtgacaactccgaggagactgtttcaaaggcgccagggcgtttcaacagagaaaggaaagtcttttccaaaaggacatcttccgtattacccagaaattggactcgtaagtatttacccgagagaagtgaaacccgtaaccatgagagttaaatgagactgtgggtagcagcctgactcctcatagttccacagacagagtctaaagtccatgtgcccggcagcaggagagcggataaggaggccacatccacaccagcactgagccagaaggaaccacagagacgagaagggggacagacctagaaccagtcaggctgagtgagagaagccggtcaccagagaatccacagaatcctgttaacagaagatgaagttcaaggatgggcgaggtctgcccagggcaaccagagccgcatcacctgcaggtggggctggggcaggaggaagcgtcgggtgtgagggtgtgccgtgcagcgtggccgctggttccaggcccacatgcgtccaacgcgtcatcgtgtccacctgcggtctgcgcatctcgccgtgtgtatactccccctcaacagcagcaataaagactctgccctaaagaaggttcatgggcccatttccgagctttgaaggaaaacctgactttcttttgtattcagtgttgaaatctctgtcctcataaaggtttatgtaaaatagctcatggccacgtctctaccttcccgaacgacaccggcagagtgacgcagaggggacacagaatgtcctgacctcagtggggtctcaccacgaccctccactgtaggggggtcccgctgccaccctccacgctagaggggtctcaccacgaccctccaccctagacaggtcccgccgcaaccttctgccctagagggatcccactgcgaccctctgccctagagggatctcggcacaatcctctacaatagaagcggaggaattatttctgctttttacaaattaagaaatgtaggcattttaggttttttgtctgcgtcaaatgcatcaccaggcctgggctgcagcctgcagtgtctgcacagggctcgacagtggcactgcctgtggcacccccgttcactcagccgcacgtcccgtcctctctccacagcgcaggctgtgtctagtccatgccgaggcagcggggccggcacccggtccccacgtgccccgttcactgcatacgcaggacaggagtcagtgtctggggccgcctagactcgcatgactttccaaacacaagtgccgatggcctgtggtgggttctttgagtgaaaattttttaagtgcagtctctcttgcccattaattgaagctggttcttcagggggcgtcttgctacacggctgtaaggacacattttttgaagtgttttgcttcatttctgaacactctctgctgcaccccatcccccaccagggtctcgcatggaaagggtcacagccatgaccctctgattttcccctttgaaaacctgagtcctgtcagcgccactccagacttgctgttgatgactaagaccctctgatgtaaaggcctgaacgtccatgacaggcatttctgagacagcattatgtgtagtttagcatgggatgaagcggacagagtcctttaaagtcaatctgtacacgaaatgtgtgacggacacgggcgttctgatcggagcgtgctgggcgttcactgccaccgatgtcccctgctggggtggccgagtgccccgctctggccgacgttgaggcctctgaattgttcggcagacagtggcggcttctttaccttcgggttgaagtgtccgtattaaccccacatttctgatgctctgacatctggggccctgctgaccctgggggctgcccctcccacgaacagccaattcccagatagtgaacagtcacccactccacgcaggctttccacatgcaaaccctgcgatccggagcccacgcccgcctccgcctctgtgggctcagactccaggccgctgccctagtcaccctggggcaaggaccagacacgggcagcccctggccccggagcggctggaactattcaagctgggcagtcctgtccctgacgaccctgccttgccctcgcccagcctccggactgacgctggcgcatccctgtatcgacccatggcgtggcctgccccctcctctcaaaatctgtaagtaacaaactgttgtttcaacagcagctgtacccagatctctcgggcttgccgtcctaaatcataatgaaacctgccgtttaaaacagaagaagggaaacgcagggattggcatggaggccgcgtactcttctgttttttcattagccttgagccttggaggggagggccagcctcccttcgccacacccccagggcccaccaacccccacacatcagccctcaccatgcattcactgatggaatgctaccttcaaagaaagcttccagcaacaaactcaggaaaatacatctcactttctcacaaacaaaaacatgcctaaaaccgcagcaaagcctgccttcaccgctactcctgtctgcaggtgacaaagggctgaagggctggacagtcccaggtcaacggcacccatgccccagctccttccacgctgacaggctcacgttgtttcacagagaagataaaagatgtgctccggaattaaaggtgcgtgtataccacagccctcggtgctgttttgaaaatgtgctgctcattgcagctttcagaatcagaagagccatctcagcctcgcaaccgagccaccgagccacgagcccagagcaaccttttcattctcattcactgcagtctcctcccaccacagatctttttctttcccagcgattatcatcgcgacagtcttatctcgctcgtccacgtccacaggtccaatgctggcaacaaagggctcactcatcccaaagaaaatggaaataaggaagtgcagggatcgggaggaagagctgtgtctggaaaagtaggcggccacaggcaagagcctgagttctgaagggtcccgggctccaccaggcggagcccagaaaactaacagccccagagaactggcaggaggcaccggagcctgcggcaggaaccggcacagctgcagggagacctgaagggccctcggcattgggcatggctgtccccagcagtcggcgtcctccgtgcttaggaggcgagggatgtctccacacatgcctgcactagccaagatgtgtgtcagagtcggcccggccatagctcacggtggacaccagtccccgtgatggaatttcatcggagggaaagaaacagggaggtgaggaatgagtggtggttgctaaggaaaggtccttcctgtggacacgaaccaatgaacacaggctcggctgcccagcggcctcctcatcaggtgagtggggcaggagggccccagagtaacgacctgaccagaggcctcgtctggggcaaagtccattatttctgatgtcacgattcgcaggaagtggcagggcctccaagtgtggtagaacaattcacttccaagtccaaagatcccttctgccctcccaaaaggacaaaaggactctccacacactagcttggcacagcaggcaccacaaggcctgggagcctccacctgcatctgtagacaccgccttcctgagctcccaggcagcagagtggccaccgtcccccccgcagccggagctccccaggactgcagccccgggccaccacctgcccagacgaccccactgcagctccagagaaggtgacgtggtccgtgcggggacaagtttgggacagagttccattaaccgttcttctgcaaggccctgtgtttcctaagggggctgaaaagctggttgtgatattttgacaaatggtgagagaataaaaatcatgtgacttctcaataaagaaggttaaatgttctcgaattcggcatttccagtgaaaatgaatcatgttttgccatactgatccacaaataaacttttctgagccccccaaggtttataaaaatgatgtgcacaggccagggtattcaattcagagtggctacagtgttgccagcaggaaaatgccaaaagaaagagaaagcagacatcagccggacgcggtggctcacacccgtaatcccagcactttgggaggccaaggtgggcggatttcttgagcctaggagttggagaccagcctgagcaatatagtgaaactccatctctactaaaaataccaaaaattagctgggcatggtgtcaggcgcctgtaatcccagctatgcaggagactaaaccaggagaattgcttgaaccttgggggtggaggttgcagtgagctaagattgtgccactgcactccagcctgggcgatagagcgagagaaggggaaggggaaggggaaggagaagggggacatcagcaggcatcccggggtggagcgctcaccctctccctccagggcaggctggcgcttctcccaccaccccgagggaagaggctgcggtctgtgtttctaacagcaaacaccgtcactgtcaacactgatgagtcctgcttaacacaaagacaggtgtgtcgacccaccctgaactttgcaaaatgatgcttattcccctctcaaacccacacagaggccaagtgcctgctctgaaggaggaactgaacagcaagccacgtctccagaatgccacggctcggcaagacttccctcacatcatcgcaagaaggttccagaataccacggctcggcaagacttccctcacatcatcgcgagaaggttccagaataccacggctcggcaaggtttccctcacatcatcgcgagaaggttccagaataccacggctcggcaaggtttccctcacatcatcgcgagaaggttccagaataccacggctcggcaagacttccctcacatcatcgtgagaaggttccagaataccacagctcggcaaggtttccctcacatcacggtgagaaggttccagaataccacggcttggcaagacttccctcacatcatcgcgagaaggttccagaataccacagcttggcaaggtttccctcacatcacggtgagaaggttccagaataccacggcttggcaagacttccctcacatcatcgtgagaaggggcggcagtgcccggtacagcgtggtacagtgagcgccacactcaaccatatgaacagcctacttgtatcgacagagagcagctgggaatgtagagtttggggaactggcaggcatccacccttgagaaactgaggctccatggtggaccaggaagggaggaagaaatggcaacgtgagcagaaaggccatcaggcacggcgggaaagccagagcaccctggccagacgcggccaggcttggcgtggagctgccagtactgaaccaacaggggctcccctgccgtggctgcagctgcctgcacactttctcaggcctgattattctagaatctgtagggtgttagctcacatttctttttccatcattgcagctaggaccttagacacatttaaagttcccatcaatccgatcatccatccttgtgctgccctgccctgggggatgccaggctggactcccatgaagaaaggctgaccatgctcccggagtcttggccccagcgctcatggtctgtggtttggggcaagctcgctcatttcttcatgcctcagtttccatatctgtaaaatggtgacaagtgaggcatgggcccagcatactgtaagtgcttaataaattataactattatcatgaaacaaggagaggatgagaaatcattttagttttccactcttttccccctttcccatccattctgaaaacaaatacttggttctccatgagaagctctcgccacagctcattgtgatcctcaggtgagaagtgaggaacacagtcagagagccccttagatgctcagtcacacaagctgacaggcaccttccaacttgctcaagatctaattcaagattatgcattttgaaactattttctgccaaaatattaaccaaaatgttaacctatatttaaaaaaatatgaacctctcattaaagtcaaagcccagtctccgtccatccctccacccactaacctacccattgattgcaccaacctgtattgggcatctattgtgatcaaagcctgggaacaaacattattctaagaaataataggctgggcttggtggctcacacctgtaatcccagcactttgggacgctgaggcatgcggatcacgaggtcaggagatcaagaccatcctgactaacatggtgaaaccccatctctactaaaaatacaaaaaattagccaggcgtggtggcgggcgcctgtagtcccagctactcaggagcctgaggcagaagaatggtgtgaacccaggaggcggagctagtagtgagctgagatcgcgccactgcactccagcctgggcgacagagcgagactctgcctcaaaaaaaaaaaaaaagaaagaaaaaagaaacaatagaaaattaaaagcttcattttcttgagggctacaacattgttctcacaccagcacagacacactaaaatgttttggaggccagagagacttgaccaatggatagaacaagcaaacagtttacagggaaaatacaccattaagatcctgtgaagagactgaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccttcaatgacaccccatctcacgccacgtgtctttccccttcaatgacaccccatctcatgccacgtgtctttccccctcaccgacaccccatctcacgccacgtatctttccccctcaatgacaccccatctcacgccacgtgtctttccccttcaatgacaccccatctcatgccacacgtctttccccctcaatgacaccccatctcacaccacgtgtctttccccctcactgacaccccatctcacgccacaggtctttccccctcactgacaccccatctcacgccacgtgtcattccccctcactgacaccccatctcacgccacgtgtctttccccctcaatgacaccccatctcacgccacgtgtctttccccctcaatgacaccccatctcatgccacgtgtctttccccctcactgacaccccatctcacgccacacgtctttccccctcactgacaccccatctcacgccacgtgtctttccccctcaatgacaccccacctcacgccacgtgttattccccctcactgacaccccatttcacgccacacgtctttccccctcaatgacaccccatctcacgccacgtgtctttccccttcaatgacaccccatctcacgccacgtgtctttccccctcactgacaccccatctcacgccacgtgtctttccccctcaatgacaccccatctcacgccaggtgtctttccccctcaatgacacaccatctcacgccacgtgtctttccccctcaatgacaccccatctcacgccacgtgtctttccccctcaatgacaccccatctcacgccacgtgtctttccccctcaatgacaccccatgtcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcaatgacaccccatctcacgccacgtgtctttccccctcactgacaccccatctcacgccacgtgtctttccccctcaatgacaccccatctcacgccacgtgtctttccccttcaatgacaccccatctcatgccacacgtctttccccctcaatgacaccccatctcacgccacgtgtctttccccctcactgacaccccatctcacgccacaggtctttccccctcactgacaccccatctcacgccacatgtctttccccctcactgacaccccatctcacgccacgtgtctttccccctcactgacaccccatctcacgccacgtgtctttccccctcaatgacaccccatctcacgccacatgcctttccccctcaatgacaccccatctcacgccacgtgtctttccccttcaatgacaccccatctcacgccacgtgtctttccccctcaatgacaccccatctcacgccacgtgtctttccccctcaatgacaccccatctcacgccacgtgtctttccccctcaaggacaccccatctcacgccacgtgtctttccccctcaatgacaccccatctcacgccacgtgtctttccccctcaatgacaccccatctcacgccacgtgtctttccccttcaatgacaccccatctcacgccacacatctttccccctcaatgacatcccatctcacgccacgtgtctttccctctcactgacaccccatctcatgccacgtgtcattccccctcactgacaccccatctcacgccacacgtctttccccctcaatgacaccccatctcacgccacgtgtctttccccctcagtgacaccccatctcacgccacacgtctttcctcctcaagtgcacgagtgtctgggctgacctgctctccaagctggcaccaattatagtacagggaacccaatttccaaccaaaagacctccaaacttttataaagcaatgtcatcaatgtgtaaatcactgcctatatttaacccctggaaattaacaactacattgacataaacttaaatctaaccagtgtcttttcagtataaactcttaaaacataaaatgtataagatgttaccttttctcaagaggtaaaaaaaaaaaaaaatccttatttttaatctctaacaaaggcaatccaattaactcactgatttttaaaaagataagcccggctgggcgcagtggctcatgcctgtaatcccagcactttggggtccgaggtgggtggatcacctgaggtcaggagttcgagaccagcctggccaacatggtggaaaccccatctctactaaaaatacaaaaatgacccaggcgtggtggcgcatgcctgtagtcccagctactcaggaggctaaggcaggagaattgcttgaacatgggagacggaggttgcggtgagctgagattgtgccattgcactccagcctgagtgacagagcaagagtccatctcaaaaaaaaaaaaaagataaacccaagtgatgtctcttgaaaaaacaaaaaaattactgtggaatttttgggatctaagttatgctgaacaaaaagtggcaagaatatattttaaatttaatataaaataaataaaacatatgaaaaataaaaatagaaagtaagcaacacaattctttgctgtttgttaagcctcattacagacacatcagatttaggtggcgtagtgtggcatcaagggcatgaatgataagaaaacagagtcatctgagggaagaggccgtggggcagaaggctgccgtgggtgttctgctgagctctgaagcttggccggcaacaatgctgttccctgcaggctcctgttgcctcaagcggggcagtgtgtgtgagacccaccttcatgcttcaggaacactggccaaggcagaaaaatagatggatgtattcatgagagatttttaaacaagttgaatccaggctgtttctgctaaaggctaacgtaaccagaacattcagctgacaagcatgttccatttctgagtacctgggctcaccaagggtgtaccccagtctccgccctccacatgcagggctgagatgtccaccctcagcagctcgaaaagtggcagctctgccgccctgacctggcactgacgcagcaggcggatgttcctgtgtcccctgcactgaccttcactgcaaagctaacccaggtgagtcccagtattcaccagctcctggagcccagaaacaagtgggcatttctagaaggtcaaggagcatctatatggaaagaccttttctccttaagatctcggtgtcatctcctgcccctctaattccacccttgtgaacataacccaggggggtcactgaggtgagatctgtcatgcagagggaagaatgtgggtgatcatggtgatctgcaaagctctcttctttcctggtctgtgagacgctgcgtatctgcagcaccgcgacccagcactcctctccctccgtgtcctgtgaactctcccatgatggttgcaccccagccactctggcctcctttctgttcttccaacccaacgtgctggtggaattatcctactggtttgcagcaaatgggccccacacaacaccgagaagctgggaaatattattctgtgcatcccaccctgcttacagcaatgtctgttcctctcagcacctcatgctgcctcctatgcgggaagccaggccctgtcactgtcctgcccctgcctgcccacactgcccgcctttccactcttgcccctgcctgcccaaaccgcccgcctttctgctcctacccctgcccacaccgcccgcctttctattcctgcctctccctgcccacaccgcccgcctttctgctcctgcctctccctgcccacaccacccaccttctattcctgcctctccctgcccacactgctcacctttctattcctgcctctccctgcccacaccgcccgcctttctgctcctgcctctccctgcccacaccgcccaccttctattcctgcctctccctgcccacaccgcccgcctttctgctcctgcctctccctgcccacaccgcccgcctttctattcctgcctctccctgcccacaccgcccgcctttctattcctgcctctccctgcccacaccacccgcctttctattcctgcctctccctgcccacaccgcccgcctttctgctcctcaccgcacgtcctactccaggcgatctgcaggcagcctcttactctgcctgtggtggggtggtggtggtgggtggtatgagccacgccctccccttcagggacagatgagagcttcaggaggtgaaatactcccccgccccctccttcttccctcttgtttcctttcccttctttcttccttctccccaatcttcctccctccctcccttgctagctgcattctttccttccttcctgccacaaatatttactgcacatctcctttgcaccagctacctttgaaggcgcagagataaatccatgagcaaagtccttgcttttgtgtgacttccatctatgttagaaggaacaggaaacaaataaaaaccatgaatgcggccgggcgcggtggctcacgcctgtaatcccagcactttgggaggccgaggcgggtggatcacaaggtcaggagatcaagaccatcctggctaacatggtgaaaccccgtctctactaaaaatacaaaaaaattagccgggcgtggtggcagacgcctgtagtcccagctactcaggaggctgaggcaggagaatggtgtgaacccgggaggcggagcttgcagtgagccgagatcacgccactgcactccagcctgggtgaaagagtgagactctgtctcaaaaaaaaaaaaaaaaaaccatgaatgcacagaatatgtggtggtgattgatgctgcgaagaaataacccagagtatgaaggatcgggggctggagcactgctctttcataccgcactgccagagaaagcctcattgagaaggtgaagtttcagcagaggcctgagggaggtgagcatgggcctagtggggcctgggaagctgtcttcaggcaggagtagcagtgagcactaaggccgtgggcagaagctgcctggcgtgttgggttggaagaacagacaggaggccaaagtgtccagaatgcagccccacgtggagagttcacagtgatatgggagtgctgggaaggggagagctggtccctttaaatgatatagaagtgtgaagggaagtgctgggttgaggaaggcaggtccctggctggggctccatctccacagacctaggtgaggacaggcactcctgccttcaccaccaaatgctgcatttcccaagaccaccctggcccctaccacactcccatcctgtgcctataaaaacccccaagaccctggcaggcacacacacaagtggctggatgtcaagaggagcacgttggcaaaagagcagaccaacagacaccagcatgccagcaggccaccgactggtgggacaagagcagaccgacagacaccagcacgccagcaggccaccaaccagtgggacaagagcagaccaacagacaccagcacgccagcaggccaccgactgatgggataagagcagactgacagacaccagcacgccagcaggccaccaaccagtgggacaagagcagaccgacagacaccagcatgccagcaggccaccgactggggggacaagagcagaccgacagacaccagcacgccagcaggccaccgactggggggacaagagcagaccgacagacaccagcataccatcgaccagcggaacgatgccgagtgtggccggggcagtctgaggagagcccaggccatcaagcattcggactccaggggaaaatcatctcccttctggctcccccatctgctgagagctacttctactcaaaacaaccttgcacttactctccaagcccacatatgatctgattcttccagtacactaaggcaagaacccagcattcagaaagccctctgtccttgtgataaggaaggggtctgattgagctgactaacacaagccacctatagacggcaaaattaaaggagcgaaaccaaaagagcaccctgtaacacatgcccactggggctttaggagctgtaaacattcacccctagacactgccatggggtctgagcccacagcccacccgtctgtcagctcccctagaggtttgagcagcggggcactgaagaagcgagccactcccccatcgcacgccctgtgaggggaataagggaacttttcccgtttcaacaggacacggagggagaggagtggtgggtgggggtgccacagatatgcagggtcttgcagaccaggcaaacagctttgatttttactgagtgtgatgagaagcccgtggtgtgctctgagcagtgggatatcatctgattgacaaatttacaagaaccactctgcaggcctgagacaaggtcagaggcaggaggccaggtctggtcagatctggttaggggtggtggtcggggggacagagagcagccggctggtggggaggagggggcaccctgggtgtgctcgctcggaaggcaggtacagcagggtctgccaacagactggacatggggggacagaaagaaaaggacctaaatggatagtggccccacagccatgctgtaggaaccatgggagggttcgttcaaggtgtggggtccgggctgggctgggaggccctcaggagcccggcaggcacccacactgccatgtttggtcttgtgccagtgcaggtgggatgagagtcctgctggtcacaggcagggaatgtcagggcagaaaccctaaaagattcactgccttccagaaaaggcagcgtaacgcagagacaggtgttctccggagtcagccaaaccgggctcaaactccaccccaccattcaccacagttgggactcggggaaacccatccagcctcttccagcctcatgagccctctgtgtgaaactgaatcaataactcccactcgaatgggttgctgagaaaatgaaatatagtaagtgtgttgtctactacctgctaatgctcagtatttgttgacaggaagttgtgtcccctcttctaacaccgctgtaacatttaacaactcagaaaaactctctcttatggctgctacgcatcccttttcctttgactccctttggttcgagtcttgttaaatggatgggagagcagaaatacaactgccctgaaataaaacttcatgttctttatggtaaagatcagagaacaggaggcattttcagtgggcctcttagaatcactataataggaaacatccaccttcaaaatggaataataaagtacaattccaaaaactacttcccctcatctgaaaaagaaactttttaggttatcattaatgaaaaataactttaaaaaaaatcataagtatataagagaaaattctaagttgctgggcagcttatgggagaacagttaatgcatactagggatcccctcccatgtaacctctacaaaccacacacacagcattttatgaacatgctgagttatctcagaagcatccactacctgccatttgaagatgaagagaaatgaggaagtatgttttgcagcatccagtgagccctggtgggttgaagaagggcggcagcacagagcacagataacaagaatatcaaagtaaaacgttgtgttccatcaactgcaccacgtaattctgcaatctggccagttcataatgacattttaagtagctttcagtgctccaactgggctctcataaggcaattacacaaaatgtcaggatattaaatgtgtaaagcctggagtaagagatcagctcacatgactctgcattctcaactgccacagccaggcctattgaaattatatgtcattgtagggccttccaaacaaaatggtacaagctttaaacaatcagcaacagcctgcagataacctcgccacaacattgttttcacaaagacaatgggaatcatgcacaacagcttttgctcctaagtgcctttacaaccatgtatatatgaaggtacacagttagccacatctgaacacccatcatcaccatcagtagcaccaccatcaccaacaccatcatcaccatcatcatcaccatcaccatcatcatcaccatcaccatcatcaccaatgccatcatcaccatcaccatcagcactatcatcaccatcaacaccatcatcatcattgccatcatcaccatcaccatcatcaccatcatcatcaccatcaccatcaacactatcatcaccatcatcaccaccgtcatcattgccatcatcaccatcaccagtgccatcatcaccatcaccatcagcactatcatcaccgtcaacaccatcatcaccatcaccatcatcaccatcatcaccatcaccatcatcatcaccatcaacactatcattaccatcatcaacaccatcatcatcaccaccatcatcaccatcacccaccatcatggggaatggactgtgctcctttggtttagaggacatacagcccatttaattgctggggtccaaaacttgggtatttgcagaggattcaggtaaattcagtaggagctcattatcgcattctctcctcatttgggcttccacagggagaaactgacataatcatatgccagcatgttgtctattttcactggaaacaacacaagtgtagtaaaatatattctgcttccaatatgagggggtaaggaatcacagctgagtagtgtgcatctctccctgactaatgaaaagtgcccatgctgcagcctgggatgaagcttctcctgcactgtcatgccgcaatattttgcactcacagggctcagcattcacccagtctgacactttctctattgaatgcaatactgaggcaaagaagaaaaaaatatatccaattagctctggcattaatgacatgacttcagtggggtgtggggattggcagtcaaatggctttctaaagactgcttcctttaggttcatgttagtgtgagtttgcacactcagaacgtgaactgacggacgacaggtaacgcagctcaccgtggactgggtggcaggtaagaccagaagagaaaatgttttacagatgtcagagggttgggacttcggagctgcccacattcgctaaatgagctaagccgacatctgcagaaacgccctcgtaatgggaacagttacctcgaaaagttctagaaatgccggtggagagggcaggtgaacacacagctgcagtcagacgctcggcatgatcagacccaaagcaaaccaactgctgcatagaacgccctggggcttcgagcccccagttccagcctgtgacgcactcacccgtgggaaggggaaaggctcccccagtgccttccctacacctgccctgtgccctcagagcggaagcatcaccatgtaatcagcggtctccattaaccaccagcgttcaggttggaactggggagatttggaaaagtgacaggaaggatgacatcatatgcagaggatgcttatacagcggagagcacccctgttccatgtggctctggaaggcctccccattgtgctaacacagcggacagcacccctgtaccatgtggctctggaaggcctccccattgtgctaacacagtggagagcacccctgttccatgtggctctgaaaggcctacccattgtgcttacacagcggacagcacccccgttccatgtagctctggaaggcctccccattgtgcttacacagcggacagcacgcctgttccatgtggctctggaaggcctccccattgtgctaacacagcagagagcacccctgttccatgtggctctggaaggcctcccccttggagccatggcagaaggtggtgggaggaaaacctcaggggttgggcagtgacagtgaggtgcctttaggtgccctgccaattcctagtcagacagaggcaaatttcaacccaattctcaaagtaaaaatctttccagcaaatgcagctggcttacagcagcatggacctggcaggaaagcagtgacctcagaggtgtttaagcagagtctgtaaggacatcagccaaacaccggggaagagatttctcacatgggggcagtttatgactcttacttctcccaaatctgaaagcagtgactctgcactagtgcagaagtcggggagcctcctccccctgggagaagacatgagctgggtggagccgagcagtgcaggtccgggactgccagccacacgcaggtccgaggctgccagccacacacggccgctgccaccccgcactgggcgcatccacgtcagggttgctgagcaggtgggtgtgtcctcaaggtgcagtgagacgaaccctgttcccgctatataagccacagagtgacccccccagcaccccgggtgccctctcctgcgcctgctcccctgggagagagtgcgctgctgctgactccacggtgtgctgacacacaggaagaaaggcctcaggcagtgcacactgagcccgggactgtttcgctaggatgaaaggcactttgataacataggtgccttctcctcctgctttagagggtgctcgtgaactccagccaggggcatggatccgagattaacaatttatcagtggcttcctcctggagcagcctgtgagaggcggcctctgtgtgccagtgattaggtggccaattctcttctaattttttttttttaagccaagaggcgtgcttgggtttagagcactgagcagcactgggatgcattcaaatatgaatgaatttcttcaaaaacgaaaaggcagcaggtgcttcctttcaagtgaaaatgaccccaaaagtgtgggcatattttctccaaagtgacagaagcattggtatcagttatttctgtgttataatctactgctgtcaccgtgaaaagtcaaagctttggttcagtgccctcctgagactgggctgcggggaacacgcccttctctgtgagggttttcaggctgggattcccaccaccaacacgacaaggaagtgggcaccccaccagccaacgcaggacctcagggtcacggaaggctcgaaggagaagaggaccagaacacgcttattttggatgaggggagagaactgggagcggagcccatgtgattggccaggacttcgcaagtgctttctgagtgaatgagtgaactcaggagaatcaggagcccgtgtgattggccgggacttcgcaagtgctttctgaatgaatgagtgaactcgggagaatcaggagcccgtgtgattggccgggacttcgcaagtgctttctgaatgaatgagtgaactcgggagaatcaggagcccgtgtgattggccgggacttcgcaagggctttctgaatgaatgagtgaactcggaagaatcaggagcccgtgtgattggccgggacttcgcaagtgcttcctgaatgaatgagtgaacgcgggagaatcaggagcccgtgtgattggccgggacttcgcaagggctttctgaatgaatgagtgaactcgggagaatcaggagcccgtgtgattggccgggacttcgcaagggcttcctgaatgaatgagtgaactcgggagaatcaggagcccgtgtgattggccgggacttcgcaagggcttcctgaatgaatgagtgaactcgggagaatcaggagcccgtgtgattggccgggacttcgcaagggcttcctgaatgaatgagtgaacgcgggagaatcaggagcccgtgtgattggccaggactttgcaagtgctttctgaatgaatgagtgaacttgggagaatcaggagcccgtgtgattggccgggactttgcaagtgctttctgaatgaatgagtgaacttgggaataaccacgcgaagcgttgcatggctggagagttgcacggccggcagcagaaacaagttcttccagcttccacatgagtttccgagtgcacttcccacatgaacaccacgggccccatcttaggacagaggctggctgggtggagacccgtgattaccttggccatacaagcgatagtataataagacacctgaatagaagaaatatcaggtatgttgggatgaggttgcaatgtgaaattcagaaccaaaagtcagtcgtcatgatgtgaattagggacttgtaattcccatccaggctctggagggcgcagaaccaagatgatgaaagaaagggttctaacaggttggttaccggttttgtttcccgttcagtgtggctggtgtttgatcaatgagcaaggattacaacagtggacaccccacacattatttgtcattggttcatttagaaaacggtgtctgatgcatctcctaaagtgatttccaaaacgctttcgctgtcatcagagtcttgagctgaaagtatggcattacacaagtaccgtatctatatgaaaaaaaactacagcactgatgaaagaaagcaaaagtaaagaaatggagaagcagcgtataaatattacatgctcatggctagcaggacatgggtttggatcataatctcaaaagatacagtcccaattgccataatcccaaatagtgaaatccccaaatatctgaatatcaaaatctctaaatagagtctaaatcccaaaagtctagtgttgctaatgtttaaaatcccctaaatcataaccacaggagagttgcatcctgctgggtggagctattagcttgttattgtctttatttggaaattaagcataacttaaggagttgtgtgtgagtgccaagttgacaaggggtgaaactgtagacttcgttttaagtgtcaacttgactgggttaaggaatacctagaaatccagtaaagcttcattttgggtgtttctgggaggtgtctccagggagattggggtggagtctgagagggctgggggaaggtctgcctcagtgttggtgggcgggcactgtccaaacagctggggcccagagagaacaaacacagagggtgaattaggctccctctgagtgctggggcagactttccttctgctgccctggacatcagagctccaggtttggcggcctttggactccaggactcacaccagccgtccctgggtcttcagactgagagttacatcatcagcttccctggttctcaatgcaaaaacactgcaacttcctcaataaatgaagaatgtcctttttgtacatctgcatttgcgaaagatacaatttcttgagatctcagctcttcgactgtttatgcagcagtgacccatcagggtttttgactcatcttgtcaaaagccttaggttgttcatcagggtatttcagatgcctgcagttatacagctgggtgcacacaattaccaagcagagggacatgcttttatacatctcccttcctgacctatgtcttcataaacacagttcatctgctcataagtgtgatgcccatgcaactgtcgtcaagatatctgagggcttatgtctgcaaaaatacgaatgttattattgcttattttattgtgtaaaatggcctatgaagtgttttgtcacgattttatatattttgcaaataaattcccttttaaaaatgtaaataaatgtcttttaaataattttttccagaattacatttttgggattttgatattttgagactgtgattttcaggattttagggaccttagggattttgatatttcaggatcttaacattcagaactatggcattcaggattgtgtctttcaggattatgactggctcccaaagactcaatattgtcagcatgtcagttctccaacttgatctatggatttaatgaaatcccagtcaaaatcccagcaagtcattttttggatacaagcaagtttattctaaagtttatatgtagaggcgagtgacccataacagccaacacaatactgaagaagaacaaaggcggaggacaacagcacccatcattaggatgcactacacccattgttacgactcactccaactccacaggaatccaggcagggtggggttgatgacacagacaaacagatcaatgaaacagaacagagagcccagacatgggtccacatacatgaggtcagccgagctttgaaaaggagcaaaggtgatgctatggagaaaggatcgcctcttaacaaatggtgctggacaactggatgtccacatgtacagaaacaattccagatgcagaccttacacctttcacaactaactcagaatgggtcacagacctcattataaaatgaaaaaccataaaactccttaaaggtaagagaggagaaactctggatgaccttgggtttggtgatgactttttaaaatccaacaccaaaggcaaaatccatgaataaaataattggtaagctggacttcattaaaataaaaactaatgctctgcaaaagacgctgtcaagagaatgaaaatacaagccacagactggagaaaatgtttacaaaagacatatctgatatctgataaaggaccaatatctaaaatattcaagaactttacaaactcaacaataagaaaacaaacagcctaattaaaacatggcccagagaccaccacagacacctcaccacagaagatacacagatgaaaacaagcatgtgaagatgctctgcttcctccatcatcagggaaatgtgaatgaaaatgacaacgagacaccaccacacacctctcagaagggccggaacccagaacattgacaacacccaatgcaggcgaggatgtggagcaacagcagctcattcaccactggtggcacgcagaatgcagaatgccacagccactggggaagacagtttggtggctgcttccaaaaccaaacattctcttactatgtgatccagtgattacactccttggtacttaaccagtagaagttaaagacttatatccacacaaaaacctgcatgagggtgcttatggcagctttatgaataattgccaatacatggaagcaaccaagatgttcctcagtaggcgaataaactgtggcccatctatacaatggagtgttatggattataatgtaataatacaatactattcagcactaaagagaaatgagccatcgagccatgaaaagatgggggaatcttcaaggcatgtgacccatctgaaaaggccacatattgtaaggttccaactccaggacattcaggaaaaggcaaactatggagacagcaacaaggtccatggttgccaggtctcgagtggggaaactggagacgctgaactagatgagccccaaattccttcaccggccactgcacgtcacctgttgtcctccccgtcaccccaccttagataggccttccactgaacctgctttaaagctctttgaaaggagaccagatgtgaattatgaataagtgaaggaagagagtctctttttaaagcttttaccaggtaaacttttgtcatatgcgttcagcccgcagcctcgttgactgactgcttctttgggagcaggtacgcgtgggtcttctctcccactctctgaagactaaacagcaagggtctcatgttggacccgaccgtgcgacaggagggtggccctgttctctgacctgtaaagaagttttctgttccctggcattatcacagggtcctcccttcctgctcgggtgcagttgctctttgtgtgttgagaatgtctgtctagctagggcctcacatcttcagaaatcattcgatgtctggatttgctttagaatcatcccagggcagagcagggggctgtagtgggcgcagaggagcatcaggaaagcctgagagtcaccacttgtgggagacaggtgatgcctgtacggggttctcaatattctctgtatatttcataggtgatgcctataccaggttctcaattctctctatttcttaggtgacgcctgtacggggttctcaatattctctgtgtgtttcataggtgatacctgcacggggttctcaattctctctatttcataggtgacgcctgtacggggttctcaatattctctgcgtgtttcataggtgatgcctgcacggggttctcaatattctctgcgtgtttcataggtgacgcctgtaccgggttctcaatattctctgcgtgttttgtaggtgatacctgtacggggttctcaattctctcttcttatttcataggtgatcaatattctctgtgtatttcataggtgacgcctgtacggggttctcaatattctctgtatatttcataggtggcgcctgtacggggttctcaatattctctgtatatttcttaggtgacgcccgtatgaagttctcaattctctctgcttatttcataggtgatcaatattctctgtgtatttcataggtgatgcctgtaccgggttctcaattctatttcataggtgacgcctgtacggggttctcaattctatttcataggtgacgcctgtacggggttctcaatattctctgtatatttcgtaggtgacgcctgtacggggttctcaattctctctgcatatttcataggtgatcagtattctctgtgtatttcataggtgatacctgcatggggttctcaattctctctgcgtatttcctatttgccgttttacatgaggcttttctaaagcgcacagtgcagtttggaagtcagtttttatcagaatatcaccagcatcgcagggtagctcaggaagaatgccaagcacattgtgtaactcgtagggatcacgggagagtggagagagcacggtcaggacgcttgttccgaagatccacaccctggggtgtgggaggaacgagaaggcgccaaggcagggaggtgaagctccccggtgcataagaaaggcacacagaacaggagcgcgcaggaagggctcgcagagcaggagcgcacgcgtaggaagagcacgcagagcaagagcgcgtgcgtaggaagggcacgcagagcaggagcgcgtgcgtaagaagggcacgcagagcaggagtggcgcgtaagaagggcacgcagagcaggagggtgcgtaggaaggacacgcagagcaggagcgcgcgcgtaggaagggctcgcagagcaggagggtgcgtaggaaggacacgcagagcaggagcgcgcgcgtaggaagggctcgcagagcgggagcgcgcgcgtagggagggctcagagcgggagcgcgcacgtagggaaggcgcgcacgtagggaaggcacgcagagcaggaatgcgtcctattctctctgtgagctcaccctcacccggctctccagctgggtttccctccctctgatgggggcgacgatgtttattgctttctgttcccaataatgaggacagaggtgaatggggctttttaagctgtgggagatgggataggagagagaaaagggaggttagagaaggaagaggacgacccaaagtgaccccactagaaggagtatagaggtgggagaatgcaggtagaggggcagccggtgccggggaggggcaaggaaggctgagatgagaagctgaaggtcacctcagccatgtattcaccgcctgtggccaagggctgaggccacactgagctggaggagaacaggaagctcggcagctacacggacccaaggtcgcaagtgaagaccccctgatagcgtccaggacctacgagagtgcaggaggcagtgaagacccccgatggtgtctagtacccacaagaggcagtgaagacccctgatagcattcagtacccacgaaagcgcaggaggcagtgaagacccctgatggtgtctagtacacaaagagtgcaggaggcagtgaagacccccgatggtgtctagtacccacgaaagtgcaggaggcagtgaagaccctgatggtgtctagtacccacgcaagtgcaggaggcaggaccatcaaggaaaggggtttctcggagtagagcatggcttagaacagaggagacgtcgtcccagagggagaggtgctggagggaaagtggccactccaggcgggcagctcccgtagcaaacagcaccatcaatgctccagcagcactcactcaagtgcagcatcggcctcctccgccgtccttctcctccaagagaggaacaaggagaaagcatcggtaatggtcacacgtccttccctctaattgcaatttcacattccttctatttaaaaactgccataacggctgcatgaacaaagaaagagcgagggcaggagagctcccggctgcagacagcagagaagctgatgctcgctctcagcggctcccattcagccttcacttaaggagcagagagtgctcacataacgcgatgctcaggcaatgtttgtgaaattttagtatttgttatctccaaaagggaagtcatgttttatcagaacccactgcaggatggtcttgggaaaaggctgttgggaaataaatgggtcggaaccttctccatatcacaaagagtcgcaggaacccgcaaacgcctttctcccctgggcccgccctgacgtggcttaactcaggtagcgacaccggaagccacggtcttggcagagcagtcacctcgaggccgacactgttcagctagtgcatggtgagcagcatgaaatccagacagggggcttcggaggatgtggcaaaccgccataaatatgggctacggtcacatgctgggccacagggagaggtgagttcagcgacaaaggacactggacttaacgtgttcagagtcaattttccaaaacagatatggatgacacaagctgtgggccagacccgtcctgcaagccatgttgcccgccccatccatcagcttcagcagtagaattgtgaaatcataaaatctggggaagggatgaacaagaagtgagaagggaacacacactgtcctcacaccctcaggatcatctcctcctccccctggctgccgcgttccctgtcctcacaccctcaggatcatctcctcctcccccccggccgccgcgttccctgtcctcacaccctcaggatcatctcctcctcccactggccgccgcgttccctgtcctcacaccctcaggatcatctcctcctccccccgggtgccgcgttccctgtcctcacaccctcaggatcacctcccctcccactggccactgtgttcactgtcctcacaccctcaggatcatctcctcctccccccggccgccgcgttccctgtcctcacaccctcaggatcatctcctcctccccctggccgccgcgttccctgtcctcacaccctcaggatcacctcccctcccactggccgctgtgttcactgtcctcacaccctcagcagcgccttctccatcccactgtcaggatcacctcccgcctctcactggccactgcgttcccaggacgtgaaatgaccacatactccttcccagcacagagagggtatgagggccgaagggacccttccctacatggtgccccattcctgccacgcgtcctcgggggagtgcggtgtgcagaccccacgtgtgggaagagcatggtgcgtctgtcactgggaggggctggacagaggacagtcagcaaacaagaaacaccaagcggggctggctcaccatcgcctgtgctggaggggtcttcggaatctcccagaggtgaaggccacttctggggggcggctggtgccagcaaaggcctgggcattcttgagggtgcacgcagaaggtactgtggctccaggctgccctccccggggggagctgggggcctctgggcagcataggcactgagggccgccatcagatggtgtctgtccacaccactgtccaccttagggctgagctcatctggctggagctggccgagggtccgcggcaggaggtcctcgcggagctgggtccgggacccgggagggtaggtcagcgcagacgtgtgggccacataggtcaggatgctctcggagaagcggtcatcaccctgaaggaaaggagagcaaaacagagcaagagtcacatttccatcgtcagctgggggcaccaagatgcccttcagtctcagttttcaaggtcctaaacagccctgggggtacaaagatgcccttcggtctcaggttcaaggtcctaaacagccctggacatctctgaaatgtaaagccaaaacaggactctcattttcacactgaccaacccaggtccctatttcatatttgttcctgcattatttttaatatcagctttatggagataattcacccacatcagcagtttttagtgtattcagagttgtgagacatcactactaagtccagaacatccgcatcacccaaaaagagactttgcagtgttcccattcctccctcccaccctgacactgctcattcgctttcagtctctatggaggagtctcttctggacgtttggtgtaaatggaatcacaccatgtgtggcatctgtgcctggctcatttccctaagcataatgtcctcaggtgcacccatgctgatgctggggcatgggccaggacatccttcctctttcagccaagtactatcccactgcatgtatatcccacattttaaaaattcacctatcagttgatggacatttgcttttttctaccttttggctattttgaataatgctgctatgagtattcatttatgagtctgtgtatcaatgtgttttcaattctcttgggtttattcgaggatattacatggtaactcgacatttaactgactgaggaactcccaagctgttttccagcacagcagcaccacaaacaatctcaccagtaatggatgcagatgccagttcctctgcatctttgccaacacttgctactttccttctgtttttactatggttgtcctagcagttggaaagcaataccgtgctgtgtcacttgcataatgcactgagcctagtatgtcctgcacctggagcctccaactcagctttaactaaaggtcctttgcacggcagctcggagttactgcattcacagcaatgagaggagctgctcccagacacattcatgaggctcggcggtgcctccctggtggctaatgatgctgcatctttgtgtgcccttattgaccactcctacatcttctctgaagaaatgtctgtttgtattttttgcctgcactggtttttattttaaccctgaaaagctgctccccaatagctgaatctctctttcagcaaccctcagcagaggcctcaagtgccttgtctggaggtcttcactccaacttctttactgaagacctgaaacatgtttgctgcctgctcttttaactgcagtgtgctgcagcagggaagatgccagggtctcttgttcgataattacctatcacatcatttactagtcaatgccctggctaacagtctttcatgggatttctgtctatattttctcctcactcatttagtaaaattccgttaagaggacatgtcctcatcacactttgtgtcactagataaaccaaggcccagctgtcctcacctctagggcagctgtaaaaatgtgaaaagtccccacattgtacctctgacttgggcttcatcaaaatgtcatggacaggctgagtatgaataatttccagcttagagactttcgaatcctggacacacaagctgagctccctggaggcgtgcatgggtgtgtggacaccccagtttaaatcccatccgttcatattttctacttgcacctccttggggcacatgatcaatgtcatgtcagtggaggtggacacctcggcactagctaagggtgtgcagccatcactgacagtaaggtaagggggtccagctcctgagtctggctatttccgaaaatatttgggttcatcctctgagttagatttttgagtagcaacctgggagttgggaagtgggttgatagaggttggggttgtttggtttttctgggtttttttgagacagagtctccctctttcatccaggctggagtgaagtggcacaatctcagctcactacaacctctgcctccttggttcatgcagttcttatgtctctgcctcccaagtagctgggaccacaggaacacaccaccatacctggctgcttttgtgagtgtgtgtgtgtgtgtgtgtgtgtgtgtgtgtgtgtgtgttttagtagaaatggggttttactatgttggccaggctggtctcaaactcctggcctcaagtgatccgcctgcctcagcctcccaaagtgctgggattacaggcgtgagccaccgcgcctggccaggttgaattaggttctgatttcagttctcatatatgaacttgggtaaattacttgacccctaaagactcaattttcttctgtcaaaaaaggaaatcggacattatctctaagatttttttttttcttttgagacggagtctctcactgtcgcccaggctggagtgcagtggcacatctcggctcactgcaacctccacctctggggttcaagcgactctcctgcttcagcctcctgagtaactgggattacaggtgcccttcaccacgccctgctaatttttgtgtttttagtagagatggggtttcgccatgttggccaggctggtctcgaactcctgacctcaagtgatgggcctgccttagcctcccaaagtgctgggattacagtcatgagccactgtgcccagccattatctctaagatattttaattattatttctaaagtgatgtgactatagctatcatccaaattgcttaaatttgtccaaggactagctgaaatcaactattcttcccttaagaaagagaatatgtgagagagcaagagcgtgagaaagagcgagagcgagcgagcgagagacagtgaatgccaccacaacaaacagcccctctagcaatttcccacaaattgggtgtaagtgtcaatctccagctcagcctgcactccctcttgcaaaggctgtctctgaacacctggtcagccaccgtgctggggggtggggatctgcgtccaaatccctcgttatgtgcctgcaagtggctttcccctcattgctatgaatgcagtaacctggagcttccacgcaaagggcctttaattaaagttgagttggaagctccaggtgcaggactgactaggttcagtgcattacacaatcacagcagagtgtgatctgtgcagtagacttggataaacaatctatttttggtttatgttctgaatcaaattaaggtgaagaggaaaaagaatatttcagtagttagcacaaacaacagagcctgtagaaataatagcaaacatcggtttttgcaagccactccggctactcaatagatgattgcagacactggggtgtttctcaccaaggtgaggtgaccatcccataaccaagagggcctgagagttgggaacatgggcagtaaagaaaagtattctcacgctgactggctctttcacggtttgaggtccccaaggaaaaggaactggctctggagctgcctgggtttaaactaccaccaatgctacgagcttaatgacctttgcttcagcacactatttaagtaatctgtaaaacaaggataataataatagtatctggcacggaagtgttaatggctatgactactactattattacaattatttactttaccttatccttcatatatatacatacatatatatatacacatacatatatatatacacatacatatatatacacatatatatacacatacatatatatacacatatatacacattatatacacatatatatacacacatatatatatacacatatatatacacacatatatacacatatatacacacatatatatacacatatatatacacacatatatacacatatatacacacatacatatatatacactatatatacacacatatatacacacatatatatacacatatatacacacatatatatacacacatatatacacacatatatatacacacatatatatacacacatatatatatatatatatatatatatatatatatatatatacacacacacatttttttaagacatagtctcgctctgtaacccatgctggagtgcaatggcgtgatcttggctcactgcaacctccacctcctgggttcaagtgattctcctgcctcagcctcctgagcagctgggattacaggcacgcgccaccaggcccagctaacttttctgcatttttagtagagatggggtttcaccatgttggtcaggctggtctcaaactcctgacctcaagtgatctgcccgccttggcctcccaaagtgctgggattacaagcgtgagccaccatgcccagcctataccttcatattctttaaagcagtcaggaaatccacatctcaactgaggagaaactatccaattagactttttcttctactctcagctctgagtttaaaattctgtgactcattttcaaaccccctgttgtgaagatgttttcagtctcagttcaacataccaatgaagggaggtttcctaagacaatgtggaataatttttaagaccgtagctgcccaaacctggaaattagcagcctaacggcatagacacagactaatttccagtacaggcgatggacattcctgtgcatgaagtcttcaaactatgtgtaagagaaatccggctgagcatctctggggtagcccagctgtggatatgaagcattcgagagcttctgccaaagtctgatgatgtttaagctgacatgatattctactgggaatattcttcaacccactgcatttccatatgacgagaagcagaacccactcgcccacacactgaaaaagccagcaggaaagaaggctcactgaaagactggcccaatcctgtcagttctgtgtaacttgtgtaagtttggaccagttatctaacctcttgaagtctcattttcaccacctgcaaaactagaaaaataattctgttttctttaaaagccactgtgaggattagggagagtataggtaaaagtgccttgctcagcacacaactcagaggaggaacttgataaatggcagtcatcagcagtatcattatcaccattagtgtcactgccaccatccacaacagcatccccaccatcatcttcaccatccacagcaccatccctaccatcatcaccctcaccatcagcatcatcccaccatcaatagcagcatccccaccatcatcacttccaccatcaacaacagcatctccactatctccaccatccacaacagcatctccactatctccaccatcaacaacagcatctccactatctccaacagcatccccaccatcaccatcccaccatccacagcagcatcccaccatcatcatcttcaccatcatcatcttcaccatccacagcaggatccccaccatcatcttcaccatccacagcaggatccccaccatcatcttcaccattcacagcagcatcccaccatcatcatcttcaccatcagcatcatcccaccatccacagcagcatccccaccatcatcaacttcaccatccacagcaccatccataccatcatcaccttcaccatcagcatcatcccaccatcaatagcagcatccccaccatcatcacttccaccatcaacagcagcatccccaccatcatcatcaccccatcatcgacagcagcatcccaccaatatcatcttcaccatccatagcaggatccccaccatcatcaccccaatcatcaacaacagcatctccactatctccaccatcaataatagcatcccatcaccaccaacaccaccagcgtccccaccatcatcatcaccccatcatcaacagcagcatccacaccatcatcaccctcaccatcagcatcatcccaccatcaatagcagcatccccaccatcatcacttcctattgggggaaccagcccccaatatttcaacacaggttcttttctattttccctaagtgttggccagtctgagaaataaagagaaagagtacaaagaggtaaattttacagctgggccttcaggggtaacatcacatattggcaggttctgtgatgcccacctgagccacaaaaccagcaagtttttattagggatttcaaaaggggaggggtgtacaaatagggagtaggtcacagggatcacatgcttcagagggcaataaaagatcacaaggcagggggtgaaattagaattactgatgagtgtcccactgggcatgcattgtcttgataaacatcttaacaggaaacagggttcgagagcagacaactggtctgactagaattcaccaggctggaatttcccaatcctggtaagcctgagggcactgcaggagaccagggagaatttcatctcttatcttcaactgcataagacagacactcccagaacggccattcatagacctacccctgggaatgcattccttccccaggattattccttgctgggaaaagaattcagcaatatttctcctacttgctttctgcaagaagaaaaataaggctctattctgcccgaccccgcaggcagtcagaccttaatgttatcttcccttgttccctgaagatcgctgttgttctgttccttttcagggtgccctgatttcatattgttcaaacacatgttttacagtttgtaccattaatgcaatcatcacaggatcccgaggtgacatacatcctcagcttatgaagatgatgggattaagagattaaagacaggcataggaaattataagagtattgagtggggaaatgataaatgtccatgaaatcttcacaatttatgttcagagactgcagtaaaaacaggcataagaaattatgaaagtactaattttgggaactgataaatgtccatgaagtcttcacaatttatgttttgccgcagcttcagccggtccctccatttggggtccctgacttcccgcaacaacttccaccatcaacaatatcatctccactatctccaccatcaacagcagcatccccaccaccatcatcttcaccatcatcatcccaccatccacagcagcatccccaccatcatcatcttcaccatccacagcagcatccccaccattatcacttccaccatcaacatgatccctgccatcatcacctcaaccatcagcttcccaccatcatcatcatcagcagcagcagcaccatcatcatccacaccatccacagcagcatccacaccatcagtgtcacccccgccatcagcatcatcaaacccctactgctgctgtgtgccaagccctggacttctatgaaggaagaataactcagatgtggccctgtcctcaaacatcttgcagactgaactaggagttgagtcatagacattaacaaccgtaattgaaagaatgctattagaaagggtcagaaaagcaatcctggttttggaagaatgtgattctcttcagctggaggaaatcagagctgcttcctggagccagctgatgcagttcacagagccacgccctgcaccatacccctcacctgtcaaacagtgacactgctgaggaagtgactctcctcgctcccaactttactggggccgggagtaccagagctaaaaatcaggcctcttcctttgacaaacatgcctctcctggagatccacccagcccagtcccaaaggcacaattatgagttcaggctgacaggaaggcctggaggtccggggagtcccacatgccgggagactctgggtggaggagactcctgtgtgtgcactggtctctgcccatgctcatcagctattctcctgcaccgaggatccaaaacaaattaggaagcccaagttgggacatcttttgaccacataacacacgttttctccctgtctcactgcccgccggcagcactgacaggcaccttgatcacggcgtgcttgctgccagcctgacaaagcacacagcctcagtgctattcacaggcttcctaatgagccggcaccggatgcggccaggtttgggagctgaggtgggaacgctgcagctccggctccggctcgtgaatgtggggttgggatgacttcactgtgcctttctgtctcgggccttagagaggtgattctggcagctcatttattttctctgtctctctctgtgtctctgtctctctgtgtatctctgcctctgtctctgtcttaacacagtagaaagtgtcagtgtttaacagtgctcaggctctaagtggcccactcgtgtggaggggaaataattgtggtgtcattcttaccaacagtgctgtcgccaagacaaaataacttttttgcattcagggaagcaggggggtctcacacgagcgtatacggtgctatctctgcagccaaggtatagagctctcagactgaaaaataagaccccaaacagttttcagagttcacaaaatctatgaggttgaagaggttaagtcctaaactacttgggatcaacaaatttgtagcgagttgacagtatcacggggtgccaatgtgaactcctggatatctgctaatgatgatgcattctgagagtctggaattatctgaagactcgtgacaccatgaggccagtgctgctctcagtctgccctgctcaagactcgcgacaccgtgaggccagtgctgatctcaccccgccctgctgagactcacgacatcgtgaggccagtgctgctctcagcccgccctgctccgagactcgcaatgccgtgaggccagcactgctctcagcccaccctactttgcccgccactcttccttctgtcactcttctggctcctgtttgcgttttggcctttccagaagctgcacccaaaagcctcctacctggcaagtgaaaagcacagggcatgattaaagcagcgagttccaatccatgtcccgtccaccttggcctggggttagaggtcagttggctcataaccacccagaagatggagggacagtcatcgccacggggctcttattcactgagtgctacaccaggctgttttcggctttacatgccttaattttctctaaccctttcaatgactcgatggtacagacatgattacccacattttgcaaatgaggaaagaagatcctgcagtgaggaaagggcagagctaagatgcagcccttctccctaggctgtgtatgtctgtcgagtgacagacaccaaacacgccgagtgaacagaggaaccgtaagcaggtcggcttccatggagcacaggtctgggtgtggagggactgctagtgcagggtgggtggtagctgtcactgtgagtgttcagtggagggcagggacaggactgtctgggaggaaaccaggggagacagtcaggatgacggtggccagcatgcatcaacctgctctgcctcagatgctactgtgtatgctgggagcagaacaccatgccctggggccaattttccaccagagctccgcttcccaccaaaggtcataagaacaatcacatgagggggcaaacttttaaaaaactcaaatggacatcgtgaatgtggcatccaacatgtggaggccacggtcctcatcgctgtgtgcctccacacctgctcctccaggtggcatggctaagcagagggctgtgagggaagctgtgctatctctgcacaatctctctaggtggccctcctccagaaacagggataggggaaggtgggcttgttgaccacatctgggtggtgacagtttggggctgttctggatagagccactgtgggcagtcatgggccagctttcctgtgaatgcaggcgtccctcctcttggatagacatccagaggggaactgctgagtccaaggacagacgtatctttagcctttaagcagcttccaaatacaggttataacagcttgcattgcattccccctaatttgagaatttctatgtcctcatcaagagttggttttatggatttttttttaattttagccaatctagtgacatgaagtggttgttctttatggttttgtgaataaggatgctaagcacctttgatgccttcattggccatttgtatatctttttatgaagtatccgttcaaagtttttatacatttttgcatgggattgcttgcctcttttccctttggagcactactgagatataattgacatacaataaacagtacaggaggcatgacaatgaacacgtccgtcaccctgaatacattccggtgcccctggagacactgccctctcccatccctgtccacagctccaggcaatcccgaccagctttctgtcccttataacccagtttgcattttctacagctttccaaactggaattataacaatagctcctcttttgtcttttggtcaacagaaatgagactcactgtgctgtttcatgcatcaacagctcactccagtttattactgagtagcattccattttgtggatcaaacaaaatttctttgtccatttctgatagacatttgggttttttcagttgtgggcatttactatgaaagctaccatgaagatacgtgtgtaaatctttgaatgcacacatgctttcgtttgtcttgagtagaagtgggatggagggatcacaggcaagtaaacatttcacttttgaagaaactgtcaagacgttttccaaatcgttgttaatgttttacatttccactggtggcatatgagaggtccagctcctccacctccttgccaatacataggatggtcagtttgtattttgtttttttaaattttagccattcttataggtttgtagtggtatttcactgtgatttcaattttcatttccataatgaggaatgatactgaatatttcacattaaattgtcactcatttatcctctttggtgaagtgtttattcaaatcttttgcccattttttaaatttcaaaagcttttggggtacgcatggtttgggtcacatgtatgaatttaatagtggtgaagtctcagatattaatgcacccatcatccaagtaatgcacattgtacccaatatgtaggtttttttatccctctcccctctcaccctcccgcttctgagtctccaaagtccattagatcactctgtctgcctttgcatacccatagcttggctcccacttataagtcagaacataaggtaatcgattttcctttcctgagttacttcacttagaataatggcttccagctccatctaagtggctgcaagagacattattacattctttttcgtggctgagtagtattccatggtgtatatatatactacattttctttctttttttttttttttttttttttttttaagatggagtcttgctctgttgccaggctggagtgcagtggcacaatctcagctcactgcaacctccaactcccaagttcaagtgattctcctccttcagcctcccaagtagctgggactacaggcacccgccaccacgcctggctaattttttgtatttttagtagagacgaggtttcatcatgttggccaggatggtctcaatctcttgaggtcatgatccacctgcctcggccgcccaaagtgctatgattataggcgtgagccactgcacctttagccactcatcagtcaatgggcacttagactggttccatatctttgcaattgtgaattgtgctgcaataaacatatatctacaggtgcctttttgatatattgatttcttttcctttggatactcagtagtgagattgctggatcaaaagggtagatcaacttttagttctttatgaaatctccattctgttttccatagatgttgtactaatttacattcccacctgcagtggataagtgttcccttttcaccacagtcataccaacatctattgttttgtgactttttaataatagtcattcttgcaggagtatggtggtatctcattgtggttttaatttgcatttccttgatgattagtgatgttgagcatttttttcatatgttgttgcccatttgaatatcttcttttaagaaatgtctgttcacgtcatttgtccactttttaatgggatttttttttcttgctaaattgtttgagttccttgtagattctggatgttggtcctttgtcagatgcatagtttgcaaatattttctcccattctgtgggttttctgataatttcttttgctatatgaagcttttcagtttaattaggtccaatttatttttgttttagttgcatttgcttttggggtcttacccatgaactctttgccaaggccaatgtccagaagattttttcctacttaatcttctagaagttttatggtttcaggtcttagatttaagttgttgatccatcttgagttgatttttgtataaggtaagagataatgaggtaggaggcaggactcaacttcagaggccgggctgggttactgaaccaaattgaggactagttaaaacagggccaaggtggaagcaggtttccataagtctcacccaccaatatgccatgtcagtttacacttgccatgacaacaccaaggagtaactgcccctttccatggcaatgacctgatgacccaaaagttactaccccttccctagatatttctgcataaaccactcttaaccctcatgtaattaaaagtagctataaatatgactgcaaagcttccctgagctgctactctctgcctatggggtagcctggctctgcaggagcagtcacagagctaaaacactgccagagttgtaacactgccttttcaataaggttgctttcttttatctccagcttgcccttgaattctttcctgggcaaagccaagaaccctggtgggctaagccccactttggggctccttaccctgcatcaatagagatccagtttcattcttctacatgtggctatccagttttaccaaaaccatttatcaaacaggtgtcctttccccagtttatggttttctatgctttttcaaagatcagttggttgtaagtgtttgggtttatttctgggttctttattctgttccattggtctatgtgcctactcttctaccagtaccatgctgttttggtaactctagccttgtagtatagtttggagtcaggtaatgtgatgcctccagatctgttctttttgtttaggattgcttttgctatttgggctattttttggtgctatatgaaaataatgttggtattttgataggaatttcattaaatctgtagattgctttgggcagtgtgggcattttcatgaaattcttccaatccataagcatgggatgtgtttccatttgtttgtgtcatctacagtgtatttcagcagtgtcttgtagttctctgtatagagatctttcacctccttggttaagtatattgataggtattttatttattttctgaagccctcgtacaggggattgagttcttgatttgattctcagcttggtcattgttggtatatagcactgctactgatttgtgtacattgattttgtaacctgagactttcctgaattcgtttatgaaatctaggagtcttttggaggagtctttagggttttgtaggtatatcatatcattggcaaacagcaatagtttgacttcctcttttccattttggatgccctttatttccttctgttttctgactgctctggctaggacttccagtactatgttgaatagaagtggtgagagtgggcatccttgtcttctttcagttcgcaggggggatgctttcaacttttccccattccatataatgttggttgtgggtttatcatatatggcttttattattttgaggtaagtcccttctgtgccgagtttgttgagagtttttatcatgaagtgatgctgggttttattgaatgcttttcctgcatctattgagataatcgtatggtgtttgtttttaactgtttatgtgacgtatcacatttactgacttgcatgtgttaaaccatccctgcatccctgggatgaaacccacttgatcatggtttattatctttttgatgtgctgttgggttcagtcagctagtatttcgtagagggtttttgcctctatgttcatcagggatattggtctatagtttgcttttgttcattattttatccctgattttagtgtcagagtgatactggcttcatagaattagttagggaggattctctctgccctgatcctttggaatagtttcagtagaattggtaccaattctttgagtgtctggtataattcagctgtgaatccatctggtcctgggctttttttgttatgggcaatttttaagttactgattcaatctcactgcttgttattagtctgttcagggtttttattccttcctaatttaatctaggagggttgtatgcttgcaggaatatattcgtgtattcatttcttctagattttctagtttgtatgcatagaagtgttcataatagtcgtgaataatcttttgtatttctgtggtatagttgagcttattttaatcttcactcttcatttcttgattaatctagctaatggtccatcaattttgtttatattttcaaaaaaccaattttttgtttcatcttttgtatttgtttctttccttcaaattgatttagctctgttctgatctttgttattttcttcttccagctttgggtttagtttgttcatatttctctagttacttgatgtgtgacattaggttgtcactttgggctctttcagactttctgatataggcatttagcacagtgaactttcctcttagcattgcttttgccatatcccagaggttttgataacttgtgtcactattatcattcatttcaaagaatttgtaaacttccatcttgattttactgttaacccaaaaatcattgaggagcatatttttttatttccatgtatttgtgtagtttaaaaaattccttttggagtggatttctagttttattccactgtggtctgagaagatacttgatataattttaattttaaaaaatttattgagacttgttttgtagcctagtatacagtctttttttgtttcattactttttcttctaaaaagacgggatacacgtgcagaacatgcaggtttgttacctatgtatatgtgtgccatggtggtttgctgcacctattgacttgtcctctaatttccctccactctccccccaaccctcagcaggccctggtgtgtgttgttcccctccttgtgtccatgtgttctcactgttcaactaccacttatatgtgagaacatgcagtgtttgattttctgttcctgtgttagtttgttgaggatgatggcttctagcttcatccatgtccctccaagggacatgatctcattcctttttatggctgcatagtattccatggtgtatatgtaccacattttcttcatctactctattttggagaatgttccatgtgctcatgaggagaatgtatattctgcagttcttgattagaatgttatgtaaatatctgttagatccatttgttctagagtgtagactaagtccattgtttccttgttgactttctgtctcaatgatctgtcctgtactgtcagtgaagtattgaggtcccccagtgttggcatgttgctgcctatctcacttctcacatctagcagtaattattttatgaatctgagagctccagcatttggtgcatataaatttagaattgtaatatcttcttgttggattggcccttttatcatcatttaatgaccttctttgtctctttttactgttgttgctttaaagtctgttttatctgatattagaatgctcctgctcacttttggtttccatttgcatggaatatattttactacccctttaccttaactttatatgcatctttatgtgttaggtgactatgttgagatagcagatatttggtttgtgtctttttatccattctaccaatctgttatcttttaaatggaggatttaggccatttacattcaacactaatattgagatgtgagatattgtcccaatcatcatggagacaggaagtgtggctttcagaccacatctatcccagtccagcagcaaagccaggctcccagatcctgtgtttgtggctgcagcgtgcttcccactcccccctgggttatggccaagggagtttgtccccactcaagattagattgcaaatttcagttgggagcttctctcaacccgtggccactgactgagttggttggcagacttccgcaaggtcccctgtgaggcagaatggcttccccaatccatgctggagactgggaatgcacacagggctctttctactgcttctcctactttatattctccactgctccctaaatcagttccaggacttggtagggttaaggtcccgcccccatgggctgaattctccagtgggggtgcatatcttggaggcagtgtctccccctcacactgtggggcttacagttctttgcttggctcacagtgtaggctgcagcctgccacttctttcaaaggttctgtggtttcttttagttttcctgtcaagttctggtgtcgcttcttggaaaaaagttcacagtgtgaatctttacacactattttgtctttccaagtgggagaggcatgctaacaccgcttctaatccactgtcttgaaaaaaaatgcccatttttaatgtgctgcttttttagtttttagagatttttatacattctgaaattttttatcttaaaaagtgctatttgcaagtatttttctaagtatgtggcttgtcttttcaatcttttgtgtgtctttcgaagaagtgtcttcttttgaagaagaaaatttttaaattttgacaaagttctagttatcaattttttttaaggattgtgtttttgtatcatattgataccaatttggaggtaatttctaccttaacactattgagtctttagacacatgaccatgtatatatcaccattaatttgtcttattgttctcatcaatgtattgtagttttcattgtacattgtcttacacatattttagattcaacctcaattatttcataatttttgatgctactatattttttaaaattcatatttaattgttgctagtatacagaaataaattaatttttgtgtgctgactttgcactctacagcattgctatatttactagttttagtagcttttctgtaggttccaccaaatttttgacaaaggttatgtaatctgaatgcctctcatttcttcttgttttattgcactggctaagatcttcaatgtgacaggcagtggatcacctgaggtcaggagttcaagaccagcctggccaacatggtgaaacctagtctctactgaaaatgcaaaaattagccgggcatggtggtgggtgcctataatcccagctactcgggaggctgaggtaggagcatcacttgaacccaggaggcagagggttgcagtgagccaagattgtgccactgcactccagcctgggcaagaagaatgaacttccgtctcaaaagaaaaaaaaaagatcttcaatgcagtgttgaattgaagaggtaagagcagacatcctcgtctaatgccagattttaagtggaaagcattcagcccttcaccagttgatgtaatcttagatgtaggtttccgtcatggatggatggatgctgggttttgccaaatgctttttccagtatctactgagaccatcacatggtctatgtaactatggtgagttatgttggttgatgtttaaatgttcgatataccctgcatatctgggataaatctgccttgattatgatgcagtattcttttttatatattgttgaatttaatttgataaaaattgtttagaatttttgtttctatatttctgaagaataataatctgcagttttcttttaaaatctttctctgtatgattttgatctgttgacatttattgagacttattttatggcccagcatttgatctagtttgggaaatattctatataacatactcaaaaagaatgtgtgtttagcagtttttaggtgtatcattctataaacatcacttagcttagactggttaatgctgtggttcaaatcttctctatccttactgatactttatctatttgtttaatcagttactgacagaggagagtttcaatcattaatgatcatgatcgacctgtatgttcctctctttagtactctcatatatttcctttatgtatttgaagctctgaaattggttcataacatttttctatagcatcttaatgaattgaccatttagtcatcataaagtgtctctgtcatgaataacacttttagtcttgaagtccactctgtctaatattaacatgaccacaccagctttcctgcctttcgagtttccatcgtacacattttccatcctttaggtctaagttgccttcttcgcccaggcttggatctgggctccagtgagactcgagatccctttatgctctgcactcagccgccaggtttctgaaccatgggggagctctctgctttatggtccaagtgtcagtttgtgagtttctgaagcttctcttccccgtcggtcccaccctggctttctgcacccttagaaagattcaacagatctttttccaccatgctcccttgtccccagtcttcagaaggccacatggggcactccatagaggcctggtgctccttggcaggatttctcccagccctctccctcctccatccctagtgccgcatctcacatactcagcgaaagcccacaggaaagaggcgggggtgcagacactcgctttgcacagcctgtctctcaaatctgttccatgcacctcaagagtttcttaaaatttaggccgaattctccccacttcctgtgactggcttctgcttcttccattccaatgcgcatgaaagaagctgtggtctcctctccttggaatgggttcatccatccctttctggaatgcagttcatcctcttttcctgtgtcctcagctctggcagatttctcctggggctcactcgtgttgttggggtgggagggggatagtctcctggcagatttctcccgggggctcactcatgtggtcggggtgggaggagaatgggctcctgacactctgcaccctacgtccatcgtacacctgcaggaggtgtctcctggtcgtcccccaaggccgtcctcttggaagcccacctgggccacctaccccctctggcatgagtacgcctgggctcacctgccccctccgtcagaagcccgcctgggccacctgccccctctggcatgaacgcacctgggcccacctgccccctctgtcagaagcccgcctgggccacctgccccctctggcatgagcgcgcctgggcctacctgccccctctgtcagaagcccgcctgggccacctgccccctctggcatgagtgcacctttactttctgtgttccctccatcacagcacttgctttaattttttaattatattttttgcttgcttgttttctccctcctacccagcaaaactgtaaaatcctaaaggacagaaactaactttccttaatcatttccttaatctagcaccatttcttgtatgttaaatatgttttttaaacatttccaagataaatcagctagttaatggtattggtaagtaatgaatttctgactaaacctcctcagtaacagagtggacagggaatttatggtgttctgcatgatgagttcaaggactgtgaactggtgctaccacagtcaataaaacaggaagcgttaccaccctcacaatgcagaagtcgtaacgacaccttgatttagtgatcaataagtgctcaattagtgtttaaacgaggagaaagctctgagtcatctcgctaatgaacaaagagaaagagcatgattatattcccagtggaataaaataaaataattctgttatgacgtcaccagcatgaaggccctgaaaggcaatatgtttaggatatttctccatctacgctagagtttcatttttgatgatgggtacatagaaaacaatgatttataaaataattcacaggaagttgattgtaccttcaaagatcgtcagtatataaagcttaaatttccaattaaaatatttcatcagctgagaggggaggggagaagccggggcccagatctctaagtccctatatttacggggcagcaaaatctgcacggcagcgctgcagcctctggtcacgcacttcctgtgcttattcagtctttgttcattagcaagatgactaagagctttctcctcatttaaacactggacagaaaagaaaatgagttctgggttttcatgcatttttttaaatactgagaagcatctatcttaacaaagaagaaaaatacctaagccaaaatgccaccaagtgctcattttctgaataaccgtttgacagctgtgctaaatgtctgtgtgctggaatgaccacggagctcattaattcaaactgggacacctccgagtgggaaagaatgacttcctgataattatgctgagtaacagtagagaccaggactgtgaggccgaccatcgtgtgtaggagattccaaggtgacacagccaaacttatcagaaggtggaccctggctgctggtggaatatttgacatgaccggtgcccacgcccctctcccattcctctttcttgaaatggagagcaggcaagatgggggcagtggtggaagatgctcctcctccatgcacccagcagccctggggagcggcagggtcgcaacccaagagatgaacccccagtggccccgtcacgagctcccaacggaagggatgtcctagtgcagaggcagccaccacgctcgccccctgtactgggaaggccgccacgctcgccccgcgatggggaaggccgccacgctcgccgcctgatggggaaggccgccacgcttgccccgcgatggggaaggccgccacgctcgccccctgtatggggaaggccgccacgctcgccccctgtatggggaaggccgccacgctcgccccctgatggggaaggccgccacgctcgccgcctgatggggaaggccgccacgctcgccccgcgatggggaaggccgccacgctcgccccctgatggggaaggccgccacgctcgcccccgatggggaaggccgccacgctcgccgcctgatggggaaggccgccacgctcgccccctgatggggaaggccgccacgctcgccgcctgatggggaaggccgccacgctcgccccctgtatggggaaggccgccacgctcgccccctgatggggaagcccgccacgctcgccccctgatggggaaggccgccacgctcgccccctgatggggaaggccgccacgctcgccccctgtactggaaaggccgccacgcccgccccctgtagggggaaggccgccacgctcgccgccttgtatggggaaggccgccacgctcacccgctgtatggggaaggctgcttccagagcactccggggcgtgtgttgagaatgctggtgctggaatcctagtgcagtaagccaggaatggaaagacttcagtaaatacaactggttagtgtgacgaggccacgggccctttggcctaatgagcactgagctgctgagtccagcagaaccactgagcacctggaaagcatcccaggacatgcagtacactgtgctcggcctaggaaggcatcctgtctctggcaggaacttgctttccccaggggctgctatgagccatctcatggggcatcactaggatacctcccaatggctcatagcacgaattgctcaatatctaccaaagaccttcactctcaacgagttcctgcaatttgctacggtttgtttctaatgtgtggatgttgcggctgcttggccgacctcacgtctggctgctgagggcagggaagcactgcagccattccatttaccctcgaggcgaatccatgctgcgccttgtcccacaggcaaattccattctaactctgactcttttattttagtgccagggctatttaataaaataactgaaaccgaaggaggagcatgatgatgggttcaaaatggaacaactgaggctcccattgaatgaaaccaaatgctgtttgcaggtgacgactcgctcactggcccatccaaggcacattggacgagcctccaaggctacgctcctgcctttctctattcagtagcccgtgaagagggcccttggacgtcagtctaggtgagcacgccactgtcaagtcaggggggaaagacaggaaactgcttcacagaaaagtgtcaactgatttcccttctctcaaacttcttccgagtctctgaaacttttaatgacgcctcccccttccctcgtatgttactaaaaccatctctggactgcacgtgggttactttactgatcattcacttccagcgtctggggacgtgacgtcacggcgccgttacagaagcctgaaatctcccagcagcagtggaggcagagcacagggccccacagcccttctgataaagacacagcggggcagaggaggaggacaaagcaatgatttcagagctggaggtgctaaattaccaacgttcaagagggtgggagaaatgccagtttccaccgtgctgtgctgagacctgctctgtggtgccgaggcacaggtgtgcggagggaatatgtttgccagtgtcctggcgccctctgattcctctcatcagagtcggagacctccactgagcctggttcagactctcaacctaatttctatttcattttttaaagattattttatcaacgatagttacggttacagctattgctgactgggcactccatgaggagcttcacacgtggctctcatgacacctccagggccactacccctggtttacagctgaggactcgaggcacagaagctgagcggctccccctggccccagagcagtgggtggaggagcctctgacccaaggacagagctgcatgaaatccaccttctgcatccacaaaatccagcaggatgtctggcgcaccagacgtgcttagttgctctcagttaatgaataaaaactttaaatttagcctgtttaaaatagtgttaagtggaccagaccctctagggttaggcccacacagagagactcccacaggctcctggaaggctttggggcatgtttttcaggccagccagtggtcctgatgggaggtgggcctggcacagagcagggctgggactggcctttcattgtgagcctaaccttagagggagacctggggcccacagagccctgtgaccctgtacttccacgagggctgaagacccccaccctccaccatgaggggtgatttcaaccaaccaggaaacacagtccatgatcaggaaaaacacaaatatggcccaggtgccactgggccctcctgagcagcctctcaactgtggcctgtgggtctggcaccccgtggcccctgcatggctctgggccagcatcagggctctgtttggcggccgtggacagactggcttctgcattcaaacgtcattgtgacatcctcctgaagaggcaaggccacagcaaagatggctgcccaggagctgccctcggaaaggctccagagaaccatggggccaaggccgggccttccccaggcaccacctgctaagacacagaagtgcctcagcttcctcacctgcctgcacagaacgtgccaccttgtggggccaacttctgtggaaactcaccctgtggttcccacgcttggtgcaaggttccaggaagcccctaagctggcctgggattgagcttagtggccacgcgtcctctgggaggactctacctttcgaggtctgtgggggttgcccagagttaacttaagtcatttcaatggctcgatggcaggaacataatagaaactgggcccacattgcttcccacacatatcccagggccacagctcctggtgagaccccagtggagtccaagaggatgcagagggtcctcaggctttcctgtctcacaccagcatggcttccatcttagaaaggaaagtgtgtcaaattagagctgatgtaactaacgtttggcagaaaaggagtgtgtgagcgtcgccatcaaacccccaatgtccccagggccatcctgggcctcaacacctggtccaaaatcctatcccaggaagctggcagggctgggctccaaaggtgatttctgcagctcttgtccctccctctttccaggcaatgtgggacctgtgaactctggcctaacaagtcgtcataaaaatcatgcctgcttttccatttacaaaatttactgagattcctaattccgtgtccttaagatgttgagtgggcttcgcatagtgaagggtcttgggtggctctgtgatgcgggtccttgcagctcccactcgccctgcataaacactcctggggttcgcctccgagcctgtctggggtctgtgtgcccagggcatcaccttgtgttttggtgcccagaccctcatgcccacaggcagatggagcccttacgctgccctgggctgcccccggggcaggcttgccggggagcaggagctttccttggatgcagtagttgcacctggtgccccctaattccagccatgttcatggcccctcagtctacctcagtcaggtttcagtgtccactgctgtcccggatcctttctcaaagggtgaagagcagccacctatctcctctacctccctggtgtgcatctgtggtttaaatggtgggctttctggagtcacgacaccttgtcccaagaaagatcctacagagcctcacccagaggactaagcatttgtgggggtggctggactgggagcaggtgtcgctctaaggggccccaggaacaccgaagccctgttcacaggatgcccgctggcccgggaaacaggcgcaaagccaagaggagccagcgactaaggaaacatgcccaggtacctgcaccctgaaggaaaagccaaccccggcccggggaggaagtggaagggtcacctcagcggggggtctgtcctgcgccgtatgggtcctggcgagcacgtctgaggctggggcctgggacagggcctccaggaagggcaggtggcgtcggagggcgttggccagggcagcaccgccctcccgactgtacctcctctcgctgccaacgctgtgttttgagggcctgaaaaagcaaaagaaaccagacatcaaccgcatgtttgctggtgcctggagctgctctgtcccctgtggtgcctgggtgcatgcaaggggctgggagccgggctctcggtggccggcctggccttgctgctccatgaccatgggtttgaacttctcccgggcccccgagcctgtgtcctgcacgaggatggctaacagcacctgcctcgtggttgtggggatggacgattgacccctgctgagagcagaagacaggaagcaaaagcaatacatgggaaacaaggggaggggagaaagggaggaagctgcaggtgttggctgcaggctcagcaggaattctccaggaggctgaggcagccagaggccgggtgggcatggggggcccaaggcttggcatggcttctgctgggtttgtgggtagaccaaggaaggtggcggcccagaagctggaaaaggcaggaaccaggttctcgcctgataaatgtgcattgttttaggccttaggttgatgtacttcgccacagcctcgggacgtccatgcagtgctctcagcccctccgctgcagtccctgctgttaaacagtgattcacgcaccgccatcgcgtgcaccatgcagggcagggacgccggaggctagaaggacaaacacatgggacgcttcccgtgggcagacacatgtggtgcccaccctgctgagggcggcaggggtagggccagcgaggacaaggccaagaaccaggcacggctggccaggggccccatgggacagctgcgtgctgaaggcataaatccaggaggcagctggacgtgtcagccacatgtggcccccactaatgatgctcagagtccctgagaaagcagccacttgccagtggggcccccatcaccagcttgtgcagccacacggaaaggaagagcagaaccagggagattcactggaaaagtcgcggtaacgcccaacaggccccggagagacagagtcaggactccccatgtttatggggagccctggtggaggcctgggcatgcacagaggatgtccgtggccccctgagcctgcgccctgtccccctttaccctcagctgtggcggagagcttgcctgagccacggggcagcgtctcagcctgggacacgatgggcatggcctccctagggatgggcatggccctccctgcccagctcacccgcagactctgccgctggtctctgcacccaggactcagccgcccagagcttcacagcccccacggaggcctttgcttttttgcacatgaccaaaagggcccagagcatgctcctaaataaggaagataattcccataggagacgcctctaccagccaggtttaagaacacctgcgtgagtgactgcaccccacctccacattccagcaaggctctgtctcaaaaaaaaaaaaaaaaaaaaggaatataatgtgaggccggcatgggggctcgcagctataatcctggcactttgggaagtggaggcaggagggtcactagagcccaggaacttgaggctgcagtaagctacgatagcgccgctgtgctccagcctcaggcaacagaggaagaccctgtttcaacaacaacaaaaaaagtgtgtgcacgcgcgcgcatgtgcgtgtgtgagtttgtgtaagtgtgtgtgtgagtgtgtgaggggtgtgagtgcgtgtgtgcgtttgtctgtgtatgtgtgcgcctgcacgcacacaccatgcttctaataaaatgcaaagatttcgtagacatggagtttagacacagaccaaagagcttttaattctggttatttttagtttgtataattaattgagtgcgtcatttatgtccataaaagaacgggcatcaccattaaaaagatgggccagtctgggggcccttgctgtccggctctgctgcccacagacaagggcagggccctctgtgaacctgccgccctcagcaatgctcccaaatccccttcccgctgagagccatgctcagcgatgaccaatcacttcaggtccgacttgtgctgcagtggacggtccagacgccacaggccccggcgtcatgccccactgccagcacaagactcaggcctccctcataacaggctttacaggtgcggtcagctgccatctgcttctctcaggccagggagaggctaggtccgaggtggaggcaggtactttcctgagcgcccaggcactggctgcctcagagccctggggcatggctccaccttcaccttctcaacatctaagtctagatcctcgttagggcaagaagcccaaattacagatagtgtataactgtcacgtttaactgaccacaggttgcctccaagggacatcacaccacttaacatatgaaatacgagccttaaatagatccttgcaattctccctccagctctgatgcggtgttgacatgaattctgttgacagctatgttatcaacctcacaatacactttcatcatttttgtttaatcaacttctttaaatgtgatttaagtgacaggaaaacaccatctatcggtggatgcagttgccttcgcgtgttctctcattggtttccatctggcacctttcccttctgccagaacggcggctttaccagccctggtcatggagctctgtgggtgatgatgtccttcagcgtctgtatttctgagaaagccaataattttacctttgtatctgaaggatacttccatgggatatggaattctgggttgatgtttgtttgtttgtttttcctttcagtactttaaaaatgctttccatcgtcttctggcctggagcattctcaaggagaaacctgcagtggccttcatcatctcatctctctatgaaatgcacctttttttcctctggctgcttttaaggttggctttttatcactggttttgagaaattttattatgatatttcttagtcttcatgtttcttttttagggggcttattgagctttctggctctgtgagtttatcatttttatcatattgaaacaattttcctcattatttcttcaaatgatttttctgttcctgtctctcccgccttgggactccagttatacagatatttggcctttagatgtgtcccatagctcactggtgttttttatttttttttaattatccttccttgtttccttatggatagttcctattgctgtgtcttcaagttcactaatattttctaccacagtgtctaatctgctattcattccacccatgaaattttcctgtctcctacttattgtgtctgtgtcagttctgtgtctacactgatgaattttatgagttgcattttcctgctccttttcatgccagataatccatgtctatatattcacattgtgaattttaccttattgggtgatggacatttgcaatcccataaatattatttacctttgctctggcattcagttaagttccttgggaccagttcaaccctctcggttcttacttttaagtcttgtttggcagtatcagagcagcaattatctatgacaaattactccccactactaagacaggactctgtgggcattctacccaattatctggaaattatgaggtttgcaagtcttgataggtttgaagaagcactatgtcgcaccctgtgtgaatgtcagatactgtttgctctcatttttttggatggttcttttccctcatagacacaaggtcatcagtcatctaccaaatcctcagcagtggctgaaaatctccagggctctctgtgcactcttctcttttatactctgacctgtgaactcaagctgccttggtttccccagaccttcagctctgtctcatcaactctggcaggccactgagcaccactgtccctgaggcagctgggggcaagtgtcatcgccacacagctgcgtcccctcccaaaatggccctccaccatgggggtctgcctcacccacgtttataccccatctagggaggtctgcatcccacactggtccccagcccctgaggaggggtgagggctcctgaggcctctgtcatgaccacactgagtccaacctctcctcggccaaacccgtctcttcacttccccatgaggggtcttcccaagaccctgcatttggacttcaggactacagagtctgctgtccagacacccaaccgagatgtagctccccgggcacccctggggccctgcccacggctagtgaggatcttgggggacttcaatccagtgcccccgatgccagtggaaaggcgactatagatttctccttgagaagtgctccaggccagaagacgatggaaaacatttttaaagtagtgaaagaaaaaaaagtaacccagaattctatatcccatgaaaatatccttcaaatacaaaggtagacttatggctctcttagaaatacgacactgaaggacatcatccccagcagagctccacaatgagggatatgaacagcccaggctccctaggcaggcacaggaggtagatatgagtcaaggagcacctgtatacgtatatatgtatatacatgtatgtgtgtgtgtgtgcgtgtgcatgtgtatctcctttcacagaatttgatgctacattctgaacaaaatcgtattcagaaaaagtctgggtatgtctccaaacacagcactgtggcatcacccaacagcctgagggaggtgcagctcagactttgcaggtgctgagtgaggcagtattacttcaaatagaacatacactttgctaagaacaatttccacttctgggtatcagcaagaagtgtcttctatccaaacatgaccatctggtacttgtatatgggtctttagtgtgatttagaaacactttaggaaatacactggggcttgagtggatgtggaactcattacaaatttcccacatacagtaatggaataggtttccaggtactgtttccatgtaggatgttgattttcaagaacagatcactaacattaggtgtgtgatacctgcatggggcttataaaaaaaatcccatttttgcttgattatctcaattgataaacccaccatgtttttatttctagtgcctttttgtattactttgttcccacactgctcataaagatatacctgagactgggtaatttataaaggagaggtttaattgactcagttcagcatggctggggaggtctcaggaaacgtaacaatcatggcagaaggggaagcaaacacacccttcttcacaaggtggcaggagagagaagtgcaaggagcaaaggggaaagagtcccttataaaaccatcagatctcgtgaaaactcactcactatcatgagaacagcatggagacagccacctccatgattcaattacctcccactgggtccctcccatgacacgtgcagattatgagaactacaattcaagatgagatttgggtggggacacagccaaacaatatcacttttcaagttacactgatacagatgtaacaggcatataaattaccaaggcttttgcagttctttgcatctcaaatcatggctataatttccttggccattttttaattaatgaaatttcatgttctatgttgtcagagtgtaatttaactgcagttaatttacttttctggtattttgtctacttttctcactaattgctaatcaatgcaaatggaaccacctcataaatgtatctttaaattgtcgtattcatctttgcttcgcctctgtccatgcctggggacttgtttgtgatgctgcagtatgttacggcaatgagagggtttatcattatgccgcgtggtgttgtagcaattaacttgcacattgacttttgctctgtcatccagcttgaagtaggtcaaaacttcatacgtatgaattttgtactttaaaaagatgaaaaatgttttacacttagtagctattcccttctccattggcacacactggccttaggctcacgataatatgagatagtctagattgtcacccagtttgttaaaggaaaaaattccacattacaggcccatcttatgttttatatccaaccttcatggccacctgaagttctctgtgaagtcatcggtgctcatatacacagctggtatttgttgtccctgttcctgcctcaggagcatttagcatgatccctggttctctttagccattagcatgatccctggttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcaggtcctccttagcccttagcatgttcttctcaggttctggcttctcagatcctccttagcccttagcatgttcccaggttcttggttatcttagcccttagcatgttctcaagttctcagttctcaggttccccttccttgactctcttagcccttagcatgttctcagctcctccttagactttagcatgttctcaggttcctggttctcaggtcctccttagtccttagcatgttcttaggctctcagttctcaaggtctcttagcccttagcgtgttctcaggttcctggttctcaggttctcttagcctttagcatgttctcaggttcctggtgaccccttaggtgcgagctctgttcctcacactgggcactcatacctactgctttgctgattttccacactgcgtctctttctggctttctctcatggggcttactctgcttaagggacctcatgtgtgggaagagaagaaccagcaggagaaatgagcttgtggttgccactctggtaagcccaaaaacagggctggggattctgaagacttcattctaatgtcgcctttatttcatgaatggatgattggttttcagcaagttactcaatctctggagattaactgccttatgtaaagaacaccagctactatgtcactggcccatggtggattcttgttcagctgtgaagctcagaatgctctgaatacacatggagtggagaaagccaggtgacattcttcgttagtgtagctacccatgcaagaattcaaaggcttgggcagatcacgcattctgtccttcaccaccatttatccaacaaatgctggcccagggtccatctggtgaagggcacaggcaggcactaggggagcctggttagaagcagctcctgggagtggggagtgaggatgctgaaagccaacacggttccttatcatgcagcaggaatcagaacatgatccctttaatgaggaatgaaacaaatccattactataaaatcgcttgaaaatctagaggtgatggccacaaattaaatccaaaataagacaaaattacgaatactaaagaagaggcaaacgagccacaatccacgtatgagaaggcaaacaagccacaatccacatatgagaagaaaaagccccacagaggaatcagtccccttgctgctataactcgccctccgacctgacccaaggggctttggaaacaccacttgatcttataaaagctgagtttcaaacagaaccagtctcaaaggtcaaattctgaagatagccatggattaatcaggcaacaaaaacaaagaggaagcaggaaaggccctactcatttaggaaaatggaatccaagacaacaagcattaagggagatgcaggcaccatttaaacaacaatccactaatgatggacgccgaggacgagctgacgcagcccccgtgtgctaagcagcagagcctcagagcctatgaagctaaacacatcaacccccaaagaaaactcacagattactgtttttgtctgagaaatttcagaaagtcacaatataaataaggacatgttgaagtaatacaattgacacatttttacctaattacacatcatatatatataattataaactatttataaaagtctgtatcctgcaaatagttatacaaatatatttttgaagcgccaattgaagattaagtatggtatcaattaggccaaagaaaacctcaaaattaccaaagagtaaaagttgaacaaagtcacattctgactaaaatgcagtagaattagacactaatttgaagtttaaaaacaacacataaatatgaaaaagtagaaaagcctaccaaacatttattgtttcaaaaggatataaaatgacaattacagataatttagaacaaaagcaagtgagaattcatcagttatagaatgatgttaaaattatgctcaaaagcaaattatttatgtgatttcattatttttttaaaaatgaataaatagcgtaaataagttttactgaagaagttttatttaaaagagaacagcaaaaagaagaaaatctaagagataattctttttaaaaatcatgttacaagggtgaaaaaaaagtggttttttttttttgagacagggtctcactctctctcccaggctagagtgctgtgtgtgatcatgactcactgcagcctcaatcccccgggctcaggtgatcctctctctcagcctcctgagtagccaggcgccaccacacctggctaaagaaaacgtacgtttacaatgcaaaggaatataactacacaagtgctgagtaattttaaaaaccataatagtgagaactaagctctgattttttctcttgtccaaattcctatctaagaggtctgggaagtcataccccacaaaccataaattctcatcagatgggttttatttgaccctatatatcgtgactgacttttcagtctgactctggcagaacattatgagacaaagggaaaaaatcaaaatatttaactctaaaatatatttccttgcaatacctggaaattgccctgcaaagtctcttgtgggaaaaatccacattctatagggatctactttcccctttgttttccttccttcctttccagatccaggagataatcaaccaagagccaggcacccttttaggtccaataagaagcatcttacaacctgctttctctgaagtctgctaactgagagcttcctctgcacaataaaacttggtctccacaatcctttatcttaactggaacattttctattgatcccaggtcttcagataaactcaacgagttgtcaaccagaaaatgtttgaattcacctatagcctggaagcccctgctttgagttgtcccaccttctgaaccaaaccaatgtatttgattgatgtctcacgcctccctaaaatctataaaaccaagctgcaccctgagcaccctgggcccatgttctcagggcctcctgagggctgcatcacgggctatggccactcatatttggctcagaatacatctctaaaaatattttacagagtttgactcttttcatcaacaagagaatagcatccactacactgcatttacaaatgtggaaatcgctattaaaggatagcttataaatatcccaaatcacacaacagtgtaagcatattttaccaataatcgtggaagacaatgaaaatactctataaatgaagaacattcctaaaaaatatactagaaagtagatcaatggtaaaagaagttttccagaaatgttaggaaaaaaagaaaaacgatcacatttccatgaggaaatactgtgggcaactgttgaggaagacgatgggccacactgtttcttattctctcctgggcagggcctcatgggaacctccctcagtaggtgtcagagtcgggcatgaggaaggcaccggcaggactggggaggcctttgggtcagcaggagggacagcatgagagggagtgattgtccccaggcagtcatgtctgggcctggggaagagctggggaacatgcccagactcctctgccctccatgctgggtgcagcttgttccaaaccccaccaaagccagaggcccagaggacccgatggagcttacaggcatgaagcccatagcagggcaggggaagggagtgtggaggaaaggagtctggagaatatccagccaatgcctccctaaatgggcctctgttttgtgggcagggataattgctcttgcctgggttcaacactcacaaagaaagaatttagaaatccaacctacagaatggtaagagctgtttttatttgtaaccatagctagtgccatctacgttccaggctgataaaaatatttttacaaaatataatatgtgaaaagttactagcctgaaatataaagaacctataataaaagaaacaaacagaaaaatacaaaaagtcctttttatacagacaaagaccatatacagaaaattcacaaagaaaattccaatctcggccagatgtggtggctcatgcctgtaatcctagcactctgggaggccaaggtgggcggatcatgaggtcaggagttcaagaccagcctggccaacacggcaaaaccccatctctactaaaaatacaaaaattagctgggtatggtggcgcgcacctgtagtcccagctactcaggaggctgaggcaagagaattgcttgaacccaagaggtggaggctgtagtgagccaagatcgtgccactgcactccggcctaggtgatgaagcaagagccaaaaaaaaaaaaaaaaaaaaaaaaaagaagaggaaagaaagaggaaagaaaaaggaaggaaggaagggaggaaggaaggagaaaattccaatctcaaagcatatgtattttaaacttttaatctcacttataactcataaaacaaagataacataccatttttcataataaaactggcactgttttaaataataaaaactggcaatttttccaaatgaccacatttaacgttgtttagaaggcacaatccaggcgcctctccatggttgttgctgagtttgatttctcagaggcaggtcctccctggattgttctctatgtggcgcccctttcctcccacgtttggcagcttctgtttgccctgttctgcacccccccagagtgaggaggagccatcccttgcttggttttcccaattcttccagccctctattttttgcccttcttggccgtccaacccatccctatacttgatggagttcaaggtcattggggcagtgcacaacgcccccagtggaatttagagaggagtataaggagtttgaacacatccaaaatagaaattcaacacagctcaagttgaaaacattttggtgggtttttgtttggtttcctacagaaaagtcttacagactataacagcacattctctttgataaaggaggtattaaaggtagatacaccaggcacagaagcacaaagaggcagcccctgccctcagtgtgcgccgcgtgctgaagtcgcagcccctaacctcagtgtgcgccatgttctggggaaagacgcagcccctgccctcagcgtgagccgcgttctggggaaagacacggcccctgccctcagcgagcgccgtgtggtgaagacgaagcccccgccctcggtgtgcgccgcttgctggggaaagacgcagcccccgccctcagtgtgtgcggcgttctggggaaagaagcagccgccgccctcagcgtgcgccgtgtggtgaagacgaagcccccgccctcggtgtgcgccgcttgctggggaaagacgcagcccccgccctcagtgtgcgccgcgttctgaggaaagaggcaacccgcgccctcagtgtgtgcggcgtgctgggggacggttaccagttctccacacgttctcactcttgatcctgccaggacacttaactgctttccctatcagatggccatgagcatgaaagcagatatctaaattttgtgttactggaatctttctaaagactatgactctagaattgtctgtcagggaaaaatgaacttttcaaactaaacctttaggaaaggtcattttcatgtttttttttaaaaaacatgaaaaatagcacaatggctcaggaatccgacagtgccagctttcttactgtggtttgtctttagactaattttttaacctccctatgactcaatttcctcactttcaagaatcggtatgacattagtccatggtatgtatgacattaccacatcgtttgtatgacattagtaattaccacatagttttgagtacaaaataagataatatggaacaatatatttagctcagtatacgttgctatgctctgggaaaggatgataaagactttcacaattctgttttttgtctaaagcaaaaataatttcttactgagaaatgagaattctcgacttatctgctttcgaccaaggccttgaagatgcaggatttttctaagagtctcatggaaaaacgaagaacccctgggcatgtctcttactggagggtcaccccaatatcgctttctctcatgggaaccaaacttttccttacagacatcctaactttctgaaacgtctgcaccagaaagatggtgggtgctttgctacattaaaacaaacaaacaaacaaataataagtgtaatggctatggactgtgtcctgggagcaaggagcaacaagccacgtccacacttacctggctgggctggatgcttcaggacgcctcaggtaggttttcgggaggtctgcaagttcctggtccatcacatactgagtatagtcatcctgccacgtgaaacctgtggacaaaaattgcaaaaattatgtcatcattttggaaatttagccaaagctcttgcttcagtctcacaattagttgcatttcagcattaagttgatggtcccatcagcaaagtaagcctccctctcactgcagtttatcaagatctccttacagaaattccagctttctgaaacttctaggccaaaaagaaaactgatgctctgctgcattaatagtaataaaaaggcttgggtgagagtggagaaagctggccaaatagaagcctctaccaatcatcctccctgtaggaacaccaaattgaacaactgtccgcacagcaaagcaccttcatacgaaccaaatttcaggtgagtggtcacagtacctggttttaactccatatcattgaaagaggcactgaagagggtggaaaagatcatttggaattgctgatgtcacccctcacccatccccctgcagtggctgtgtgccccagagagagaacgcatgcacttgggagagagagcacagtgatagtgggacttggtattggaactcggtgctgccctgtcacagtaaaaacaacaggcaaaactcaaccagagcccatggagggaatatttagaccagccctagacagagcagtaccacccatcccagtggtcagaatctgagttctgacaagcctcaccaccatgggctaaagtgctctggggtcctaaataaacttgaaggctgcctatgatggaaggactacaattcctgggcaagtcctggtgctgtgcttggcttgtagccactggacttggggtgcagacaacctagtaaggtactagctggcacaactaagggtgctagtgtcacccttccctcaaccctaggcagcacagctcacagctccaaaagagactccttccttctccttgaggagaggagagggaagagtaaagaggactttatcttacaacttagataactgctcagccaagtaggatagggcactgggcagagtcatgaggcccccattccaggccctagctcccaggtgacatttctagacacaccttgggccaaaggaaaacccactgccttgaagggaaggtcccagtactgaaaggattcatcatctcctgactacagagcctttgggccctgaataatcaacagtggtacccaggcagtaccccatgggccttgggtaagactcagagatgtcctggcttcaggtctgatctggtacagtcctagtggtggggtggccacagaggtgcttgtgtcacccgtcacccagctccaggaagctcggggagggggggagagagagagaccgtccgttcgtttgtctcggagaatgtaagagaaaaaaagtctgcctggtaatccacaaaattcttctagattgtatccaagactgccaaggtgatacatctgtgagtctgaaacagccatgaaattactgggctttgagtggcccctaatgcagatatggctgcagggattaaaaacgtagatcacagaaccaaagtcttttcttttttttttttaatttatttattttttattattatactttaagttttagggtacatgtgcacattgtacaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccgcctatgagtgagaatatgcggtgtttggttttttgttcttgcgatagtttactgagaatgatggtttccaatttcatccatgtccctacaaaggacatgcactcatcattttttatggctgcatagtattccatggtgtatatgtgccacattttcttaatccggtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaaacaaatttacaagaaaaaaacaaccccatcaaaaagtgggcaaagtcttttcaaatacctggaaagccttcccaagaaggatgaatacaaacaagccgagattttagcgactacaataaatacctaactcagacaccaacaaacatccaagagcatcaagactatccaggaaaacatgacctcaccaaacgaactaaataaggcaccagggaccaatcctggagagacagggatagatatgttacctttcagacaaagaattcaaaatagttgttttaaaaaaattcagtgaaattcaagataacatagaaaagacaatcagaatcctatccgataaacttaacaatgaaattagaataattaaaaacaatcatgcaaaatctctggagttgaaaaacataactgacccattgcagaatgcctcagactctcttgacagcagagttgaccaagcaagacaaagaattagtgagcttgaagactggctagttgaaaatatgccgtcagaggagaccaaagaaaaaaggattttaaaaaatgaagcacacctgcatgatctagaaaatagcctcaaaaagacaaatctaagatttatcacccttaaagaggagggagagagagaaagaggtagaaagtttagttgaaaggataataatgagaacttctcgaacctagagaaagatgtcagtgttcaagtataggaaggctataagaacactaaacagattcaacccaaataagactacctcaagacatttaattatcaaactcccaaaggtcaggaatgaagaaagaatcctaaaatctgcaaaagaaaataaacaaacaaacaaaaatacaatggagctgcagtacatctggcagcagacttttcagtggaaactttacaggccaggaaacgggattgttatttaaagtgttaaaggaaagaaacccttttattctgaaattgtatatccaacaaaaatgcatttcaaatatgaaggaaaaatactttcccagacaaacaaaagctgaaggattccatcaacagcagacctgtcctataagaaatgctaaagggatttcttccgtctgaaataaaagaatgttagtgagcagtaagaaatcatctaaaggtacaaaactcactggtaatagtaagtacacagaaaaacacagaatatcataacactgtaattgtggtgtgtaaactgctcatatctggagttaaaagactaaaagatgaacttatcaaataactccaacaacttttcagatataaagatataaatagaaacaacaaaaagttaaaaagtagggggatgaagctaaagtgtagagtttttattagttttctctgtgctggtttgttagtttgcttatgtaatcaatgttaagttgtcatccgtttaaaataatgggttataagatgttatttgcaagccttattgtaacctcaaatcaaaaaacataaacagatacaacaaaaagtaaaaagctagaaattaaaacataccaccaaagaaaatcactttcacttaaaaaaaaaagtaaggaaagaaataagaaagagaagaccacaaaacaatcagaaaacaaataacaaaatggcaagagtaagttcttacctatcaataataacaaatacacatggactaaactctccaatcaaaacacacagagtggttgaatggattaaaaaaaagacccaatcatctgttgcctataaaagacacacttcacctataaagacaaatatagactaaaaagaaagggatggaaaaagataatccgtgcaaatggaaaccaaaaaagagcaagagtagcagtacttgtatcagacaaaatagatttcaagacaaaactagcaaaagagacaaagaaggtcataatgataaaggggtaaattgagcaagaggacataacaattgtaaatatatatgtacccaacactggagcatccagatatataaaacaaattttattagagttaaagcaagagacagaccccaatacagtaacagctgaagacttccacatgccactttcagcactggacagatcattgagacagaaattcaacgaagatatattgaccaagctgcactgttaaccaaatggactgaattgacatttacagaacatttcattcaatggctatgaaatccacattcttctcctcaacacatgaataattctcaagaatagcccatacattatggcaaaaaaatgcatctttaaaaattcaaaaacaaactgaaattatatcaagtatcttctctgaccacaatggaataacactagaaatcaataacagggaaaattttggaaactatacaaacacatggaaattaaacaatatgcttctgaatgaccagtgggtcaatgaggaaattaaggagaaaatttagagatttcttgaaacaaataataatacaaacacaacataccaaaaacctgtgggatgcagcaaaagcagtactaagaggaaagtttatagctataagcaactacatcgagaaaaaagagaataccctcaaacaatctaatgatgcatcttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcctggctaattttttgtatttttagtagagacggggtttcaccgtgttagccaggatggtctcgatctcctgacctcgtgatccgcccgcctcggcctcccaaagtgatgcatcttaaagaactagaaaagcaagagcaaaccaaacccaaaattagtaaaagaaaagaaataataaagatcagagcagaaataaatcaagttggaatgaagaaaacaatacaaaagatcaatgaaacaaaaagttggtttttgaaaagataaaattgacaaaccattttctagtctaagaaaaaaagagaaaagacccaaataaataaaatcagagatgaaaaaggagacattacaactaatactgcagtaattcaaaggatcattagaggctactatgagcaactacatgccagtaaattagaaaacccagaagaaatggataaattcctagacacatagaatctaccaggactgaaccatgaagaaatcaaaaacctgaacagatcaataacaaataatgagattgaagctgtaataaagtctccaagcaaagaaaagcctgggacttgatcacttcactgctgaattttaccaaatatttaaagaagaatcttgctcaaactattccaaaagatagaggaggaggaaacacttccaaattcattccattaagccagtattaccctgataccaaaaccaaagacacatcaaaaaataaaacttcacgccaatatccctgatgaatattgatgcaaaaatcgtcaacaatcgtcaactgtcctggggataggacagtctcttctataaatggtgctgggaagactggataaccacatgcagaagaatgaaactagactcctatctcttcctatacaaaaatcacataaaaatggattaaagacataaatctaagacctcaaactatgaaacgactaaaagaaaacactgggaaaactccctagtacactggatagtgtaaagatttatttagtaataccccatgagcacaggcagccaaagcaacttgagtaatgctccacaagcacaggcaaccaaagcaaaactggacagatgggatcacatcaagtgaaaaaacctctgcacagcaaaggaaacaatcaacaaagtgaagagatacccacagaataggagaaaatatttgcaaagtattcatctgacaagggattaataaccagaatgtataaaaagctcaaacaactctgtagaaaaaaatttcaataatctaactttaaatgggcaaatagatataactctgaatagacatttctcaaaaaagacattcagacggcaaacaggcgtatgaaaaggtgctcaacatcactgatcatcagagaaatgcaaatcaaacctacaatgagatatcatctcacccagttcaaatggcttttgtccaaaagacaggcaataacaaatgctggcgaggatataggaaaaagggaaccctcatacacactgttggtagaattgtaaattagtacaactattatggagagtagtttggaggttccttaaaaagctgaaaatagagctataatataatccagcaatcccactgctaggtttatacccaaaaggtaatcagtgtatcaaattgatatccacactcccatgtttattgcagcactgttaacaacagtgaacatttggaagcaacctaaatgtccatcaacagatgaatggatttttaaaaatgtggtacctctacacagtggagtactattcagccataaaaaggtgagattctttcatttgcaacaacatggatggaactgaaaatcattatgttaagtgaaataagccagacatagaaagacaaactttgcatgttctcaccgatttgtgggaactaaaacttaaaacaactgaacttatagagagtagaacaacagctaccagaaggaagtaaccattgttactgggaaggaaattggcagggggcggggggcaagtgggaatggttaatgagtacaaaaatacagttaagtagaatgaataagatctggtacttgatagcacaacagggtaactacagtcaacaataatttattgtacatttacaaataactaagagtataactggattatttgtaacacaatgaaaggataaatacttcaggtgatgaacatcccatttaccctgacgtgattattatgcattgtatgcctgtatcaaaatatcccatgtaccccataaatatatacacctgtgtacccacaaaaattaaaaattaaaaaaatagacttaatgggtgctgactatggctagacagcaaggagccttacaccaaatacaagtttagttagaagacagatttttatctactatgaaagatggaaacatcttccatctacatggaaatattgtggtcacagcaaagatactcctcatccacaataagcacatagtacccgccactcacccactcctctacctgcccgccaccatatcttaggtattttgttcttcctaacaaaatcttaaaagacagcaattggaatggaataaggggtattgttactgtgaaagcaattatcatggggcttaatgtactgtatccgggagccaattacattatatttatactcaaatgttatgacaaagagctttataacaagggtgaagtagttatgaaggcaaaatccatgtgattatgcattaattacatgcactgtggatcacatgataattatgctcaaaattaccaaataactctcaagaataattattatgcaatttgtacatgttagatcttatggtaacactttagcacttagaactaccccatgcaattatccataattatctaatcactaaatatcatgtaattacagagatatatttttatgccctgtacaaaaacacattaccaaaatcttcaaatcaggatggctctgtgcttgtgtgtgtgtgtgtgtgtgtgtgtgtgtgtgtgtgtgtgtgtgtggcgtaggaagtccagaacatgatgagaaccacatattctggatggaattaaaagagctcagtaaatataagctatcttcatgaacacacaaatatttttttcacatgcaaatctagattttttaaatgttatagacggcaaattaaagcaattgtcatatttctaaatctcaaaagcctaaatggcattacctgaagtgaagaatgataggaaaattcaccattaggatggcctccaacttactctaagctgctctagttggaatatatcacttagagtataggtcgctgcagaaaacaggccccacactcactactatccaatttaagattaaatgtacttaataataatcaagtctatcccatttgccaaagcaacttaaaaacacccactatgaaatgtacttttgtttatatagctatttctgatccattcttgggagtatactcaactgaaagcacatttgcaatgttagtataatatctattattgtggatttagaaataaggatattttaaccacgccattcctaaaagggattctcttaatattaatatttatcaggaaacagaaaatcaatggcacaaaaagaacttttcatgaaaaatatcatttataaaatttaaataactaaaatttaaaaatttttatctaaaaatcatataagtctgagttatgtcaactttgggatctatgataaaggctcagttcttccagaacaacagttggtcaactactcagaatcatctgtactgggcagtctgagaggaccctgtataccttagcccagccatctcagccttcccggaagtcagaagaaactgtgctcttagatataaaaaacaaacaaaacaatgcagaggtatgggagtttaagcatctcctatgaacttctgtccgtggcatatcttggagaaaatataaccctgggaagaaggaatccactcccagagatgacatacgtcttcccactaagtacaactaaaatctctgagcatacgtaaaacaagcataagactctgaaggatggcaatacgaaggcagagcagagaaggacatggtggtggattccctgggttttctttttgcctcaggtacctcagacttggagtcaaagaggccgcaatccggaaacaccagcgtgtacacacacacacacacacacacacacacacacacaactaaagcagcctctctctaatcaaggagtcaggaaagaatcaactcagcaagacagaaaaatattagatattaacagctctaccccagcaaaacaccacagaaaaaagtacagcctctccctacccatgccaacaaaggccaaatggggatctagacttcctctttcatgaggctgtaataaggcctcccctcaggcctaccaggtagtgtcagagaaggccaagtagggatccagaactttcatctccattgggttgtaattaccacaacccctgcagtgccagcagagaccatctgggaagttgaaactcccacccctctccctaaccaatcagtaaaaagaccccaccttcaggtatcaacagaggcctcctggggaatctagacttccatctccctgtcagttacaaggaatcaccaccaccaccccttacccccagaagaggagtgtccaaaaagagacagttaaaatgcaaggtttaaatgagatccagaatcatgacataatacaaaaatgtccagatttcaaaagaaaataactggttatacaaagaacaaagaagatcacaaaataaatagaaaagagacaatccacagaaaccaacactgagatgaccgagatgttaaaattgcctgagaaagattttaaaccagttacgataaaaatgcttcaatgagcaattatgaacacacttgaaacaaatgaaaaagtaggatgtctcagaaaatagatgatgtaaataaaagccaaattgaaatattattactgaaagatacaataaccaaaataaacaacgcagtggatgcacataacagaaggatggagagacagaggaaagaatcagtgaagtgaggataaaacagtaggaattactcaatgtcaacaacacagagaaaatagtagaaaaacatgataaagcttcagcaactgcggggctataaccaaagatataatattcatgctatcagagtttcaaaaagaggagtgaaagaagacaagatgacaggtctgaaaaggtactcagaaaaataatggctgaaaacttctcaattttggaagaaacatgaacctaaaactttaagaagctaagcataccccaaacagggtaaacccaaatctcctccaagacacataataattaagtttctgaaaacttacaaagaaaaatcttaacagcagccagagaaaaatgacaacttacctacaaggaaaacacaattcaaatgacaggggatttcttatcagaaacaatggaggccacaaggaaacagcacatttttcaagtgctgaaagaaaaatatgtcaacccagaatcccacaagtctatcaatccagatacccagtgaagttatccttcaggaatcagggggaaataaagatatccccagaaaaaggaaaattgtgtttttcaccagaccaactctgaaagaattactaaatttatgtctccatatagaagagaaatataaaaaaaggaattttggagcatcaggaagaatgcaagaacatggcaagcaacaacctgagtaagtacaataagcattccttgagttttatgcttgacagttcaattaaacaccatactactgtcttatgtcattttaaatgcacatagaggaaatatttaaacaattataatataaatgaggggcataagtaaaatgtcataaaggaaggtaaagtttctatatttcacccaaactggtaaaattatgacaccagtaaactttaatgttatgaatatgtatatgaatattatatctagaacaataaataaaagaaagctatcaaagacatacactcaaaaacatagataaagtggatttccaaaatcattaaagtaactcaaaggaagggaggaagaaacaaagaaacaaaaaatacaagaacaagtagaaaatacaaaattaaatgagttttaaatcctaacatgttaataattacattaaatgtaaatgggctaaatatgacaatgaaaacactggctgagtgggttttttttaaaaaaagactcaactatacactatatgaagctcactttgaataaaatgatataggatggttgaaagtaaaaatatttttaaaaatatatcatgtaagtattaatcaaaggatggaagcaatagctatattaatatcagataagttaacatttagagtaaagaaaatggctacagagaagggaattacagagttataaataggtcaacccactaagaagatacagcaatcctatatatgaattatatagatagagcaactaaacaaaaaatcaacaaagatagaaaagaactcaacaataccattaatcaacaggatctaatgaacatttatggaacactgtacccaacaagagcagagtatatgttcttttcaattgctcatagaacacaaaccatgatagacttaatgctgggccataaaacaaacttcagcaaaattataatcattcagagtgtgttctctgaccacaatatagtcaaggtagaaatcaataacagaaagataatggggaaatataacaacatgttataaaataatccatgggtcaaagagaagataatacattacatgtaattaaaataaaagcacaacatatcaaaattcatggcacatacagttaaaactgtgctaagtgaaatttttagcactaaatgcttacattaaaaaagagggccctactggagcacttttgccagtggcccccacccaccctgccagggcacttttgccagcaaccaccaatggggcagtttagctggtggcccctgatagagtgctttcaccagcagcctagctgcaccttgacctcccagtgaagctggtactaaagctcaaggggccagaggacaaagccacaggcctggtcccaggtcaccagggttagagcatacagcccaggagttccaagctgaacctcggccctatgaaaaaattcagaaacaaagccaatcaactatatccaacttacacaacagcaaaactcttatgagaaataacgaacataaaaacaaaaagccctatccccaggacagcaacttcaaaaggataaaagaacatcagcactcacagatgagaaaacagcacaagaactctggcagttctaaaagccagagtgtctttttacctacaaatgaacacactagctacccagcaatggttcttaatcaaactgaaatgactgaaatgacagacataggattcagagtctagatggcaaggaagctcaatgagatacaggagaaagttgaaactcaatccaaggaaatgatttgagagttgaaagacaacatagccattttaagaataaccaaactgaacttctgaaatttaaaattcaatataagaatttcataataaaattggaagcattaacatcagaagagaccaagctgagagaagaattttagagcttaaaggcagttctttcaaatcaacacaggcagacaaaaataaagaaaaaagagtgttaaaaaatgaataaaacctctgaaaagtatgggattatgtaaagtgaccaaaactatgactcactggcatttctgaaagagaaggagagagagtaagcaacttggaaaacatagttgaggatacagtccatgaaaattttcccaatctcactagaggttgacatgatattcaaggaattcagaaaacccctgtgagatactatataagatgaccatccccaaggcatatggtcatcagattctccaaggttgttgtgaaagaaaaactcttaaaagcagctatagagaaagggcaggtcagttacaaagagaacccaccaggctgatagcagacatgtcagaaaaaagcttacaagccagaagagactgggggccctattttcagcatccttaaagaaaaaaaattccaatcaaggatttcatatcccacaaaactaagcatcataagcaaagaagaaataaaatcatttttagacaagtgaacactaaagaaattcactatcattagacccgctttacaaaggtccttaagggagtgctaaacatggaaacaagaaagatacctgcctccacaaaaacacaaatacgtagctcacttgcactataaagcaactatacaatcaagtttacatgaaaaccagctaacaacacaaatgacaggattaaatccttacatatcaatattaaccttgaatgtaaacaggctaaacacccacttaaaaggcatagattgacaagttggataaagaggcaagacccaactgtctgctgtcttcaagaacccatctcacatgtaatgacacactttggctcaaagtaaagggatggagaaagatctatcttgtaagtggaaaacaacaaagagcagaggttgctattcttatatcagatgaagcagattttaaaccagcaatgatcaaaaagaacaaagaggggctttacataatgaaaaagggttcaattcaacaagaagacttaactaccctaaatatttatgcacccaacattggggcacccagattcataaaacaagttcttagagacctataaagagacataaacacaataatagggggagatttcaatatcccatttgacagcattagacagatcatagaggcagaaaacaaagatattctggactcaaactcaacccttgatcaactgggtcttctagatgtctacagactacccaacaacaacagaatatatattcttcttatctgcacatgacacatactctaagatcagccacatgccataaagcaagtctcaaaaaaatccaaagaaaattgaaatcataccaaccactctcttggcccacatgtaatataaatacaaataaaaaacaagaagatctctcaaaactatccagttacatcaaaattaaacattttgctcctagatgacttttgggtaaagaatgaaattaatgcagaaatcaaaaaattatttgaaactaatgaaaactgtgacacaacataccagaatatttgggacacaactaaagcagtgttaaaaggaaagtttataacactaaacaactacatcataaagttagaaagatctcaaattaacaacataacattacacctggaagaactagaaaaaaaaagaacaaaccaatcccaaagctagcagaagaaaagaaaaaatcaaaatcagagcagaactgaatgaaattgggacacaaaaacacaaacaaaagaaagttcattttttgaaataataaataagattggtagaccactagctagattaacaaaaatagaagacctaaataagcacaataagaaatgacaacggtgatattacaagaaaaccttttaggttttctgggttttttccatttcttctagaacaccttgaagaaataaataaattcccagaaacatacaaccttgcaatattgaaccaggaagaaattcaaatcctgaacagatgaataatgactttcaaaattgaattgctaataaaaaaaaaacctaccaaccaaaaaagcccggaaccagacaaattcacagctgaattctaccagacatagaaagcagagctagtaacaatcctactaaaattacttcaaaaaaccaaaaagtaggaactcctccctaaatcattctatgacactaaacagaattgaaaacagaaaccatatgatcatcttaatagatacaggaagggctttcaataaaattcaacatcccttcatgttaaaaaccttcaacaaattaggcatcaaaggacaaagataaaaggaatatgcctcaaaataataagatccatcaattacaaacccaaaggcaacatcatattgaacaggcaaaagttggaagcatttcctgtgagaactggaatgaaacaaaatgcccactctcatcactcctattcaacatagtattggaattcctagccagagcagtcaggcaagggaaagaaataaaaggtatccaaataggaaaagaggaagtcaaattatctctcttcatagatgatatactatacatagaaacccctaaaaactctgccaaaagacttctagaactaataaatgacttcagtaaagtttcaggaaaaaaatatcaatgtataaaaaccagtagcatacaattcacttacccttagcaaaccaaaacaaaaactaaaaaactaatatcatttctacacatcaataatttccaagctgaaatccaaatcaagaatgcaatcccatttacaacatgtacaaaaagaataaaatacctaaggttatagctaaccaagaaagtgaaagatctctacaagaattaaaaaacactgcagagataatacaaacaaatggaacaacattccacgctcatggataggaagaatcaatattgttaaaatggtgacattacccaaagcaatttacagactcaatgctattcctatcaaaccaccagcatcatttttcacagaattagaaaaaaaaaagaattataaaattcatatggatccaaaaaaaaaaaaaggctgaatagccaaagcaaccctaagcaaaaagaacaaagctggaggaatcacactacctgacttcaaaatatactataaggccatagtaaccaaaacagcatggtactggtacaaaaacagacacatagaccaatggaacaggttagagaaaccagaaataaagccacacacctacaaacatctgatcttcaacaaagtcaacaaaaacaagaaatggagaaaggactccctattcaataaatggtgctaggatagctggttagccgtatgcagaagattgaaacttgactccttccttttaccatatacaaaaatcaatttaagatggcttaaagatttaaatgtaagacctaaaaccataaaaaccctagaagaaaatgtaggacacaccactctggacacaggccttagcaaagatttaatgatgacatctccaaaagcaactgcaagaaaaaaaaaaagacaagagggacctaattaaaccaaagcgcttctgaacaacaaaagcaactattaacaggtaaatagacaacctatagggtaggaaaaaatatttgcaaactatgcatctgcattagtccattttcacactgctgataaagacacacttgagactgggtaaactaaaagagcaagaggtttaatggacccacagttccatgtggctggggaggcctcacaatcatgatggaaggtgaaaagcacgtcttacatggcagcaggcaaaagagagaatgaatgccaagcggaaagggtttccttcggatccatcagatctcatgagacttattcactaacatgagaataatatgggggaaactgccccatgagtcaattatctcctaccaggtcccctcccacaagacgtggaaattatggaagctacaattcaagatgagatgtgggtggggacacagccaaaccatatcagcatccaaaagaaatttaatatccagaatctgtaaggaacttaaattattcaacaagaaaaaagcagccccattaaaaaatgggtaggagacatgaacagacacttcttaaaagaagacatagaagcggccaagaaacgtaggaaaaatgttcatcattagtaatcatcagagaaatgcaaaccaaaaccaaaatgagatactatttcacatgagccagaatgaatatttttaaaaagtcaaaaaataacagatgttgacaaggttgcagagaacagggaatgcttatacactgctggtgggaatgtaaagtagttcagctggtgtagaaagcagtttggaaatttctcagagaacttaacacagaactaccattcgacccagcaatcccagtatgggcatatagccaaaggaaaataaatcatcctaccaaaaagacacaagcacctgtacattcatcacggtattattcacaatagcaaagacatggaatcaacctagatacccactgatgatggactggaaaaagaaaatacggtacacatacaccatggaatactacacagccataaaaataatgaaatcatgtcctttgcagcaacatagatgcagctgtaggccatcatcctaatcaaattaatataggaacagaaaaccaaatactgcgtgttctcacttataagtggaaactaaacacggagtacacacagacacaaaaatgaggatgacagacgccgaggactatgaaaggcagagggtgggaggaagacgtgggttgaaaagctataagggactaggttcactacctgggtggcaggattgttatcacaccaaactgtaacaacacacaattcacccatgcatatgtaccctcaaaccgaaaacaaaagtcaaaagaaaaataaaagagaaagtctcaaatcaataatctgaattctttaagaatctgtaataaaggagaacacaataaacccaaataaagtagaagaaaataaataataaggataagaaaagaaatcaatgtaatttaagtgagaaaaaaatagagaagataaatgacaatgaaagctggttccttgaaaaaaatcagtaaaattgacaaatctctatcaagactaacaaaaaacaagagagaagacacaaattatcaatataagcaaagaaacaggggaagtcactacagactctgcaaacatcaaaaggataatcagggaataaacaactctacacacataaacctgacaacatagatgaaatggatcgactccttgaaatccacaagttacctcaattcatccaatgtgaaatcaataatttgaatacttctacactattaaggaacttgaattaataattaaatatctacccagaaagaaataatcaggcccagatggtttcaccaaagaattataccaaacatttaaagaggaattaaaacaaattccataaatatcttccagaaaatagaaggcgaggaaacagttcccaatttattttatgtagctaatattaacccgataccaaaagcaaacaaagacagtaaaaagaaacctacagaccaaaatccctcacaaatgtagacacaaaaatcctttacaaaatattagcaaataaaatccagcaatatatgaaaataatgatacatcatgaggtttattccaggaatgaaaggctggttcactatttcaaaacaaatcaatgtaatccaccatattaataggctaaagaagaaaaaaatcacatgattacagcaatcgatgcagaaaagacatttaaaaaattcaacactcattcatgaagaaaactttcagaaaaatagaaatcaaggggcactttatcaagctaacaataaacatctacaaaaccccacatttcactgtacttaatggtgagtaaccatcaaaagctttcactgaagactaggaacaaagcaaggatgtttgctctcaccaatcttattcaacataaagctggaagttccagccagtgcaatagggcaagataaaaaaaaaataaaagatatgcagacacaaaggaagaaattaaactgtacctatgtcctatttcctgattatctacacagaaagccccaaggactctacaaaaaatataaaaacctctcaaacctaataagttcttgtactatatactaacaatgaaggcatgaaaactgaaattaaaatactatttaaaaccactcaaagaatacctaggtgtaaatttaacaaaccacgtacaggacctatgtgctgaaacacaaacaatggtgatgaaagaaaccaaagatcaaaataaatgacagacataccatgttggtagatcagaagattcaacataataatgatgtcaactctccccagattgatacagaggtttcacataattcctataaaaaatcccagggaaatactttgtagatacagaaaagcaagttatatggaagagcaaaggaactagagtagctaaaacaatttgggaaaataaaaataaagtggaaggagtgatcatatataatttcaagtcttatataggtacaataatcaagactgtgtagtactgatgaacagatacaaataatacaatagaatagaaaacccagaaatagatccataaaaatatgtccaagttatttttgacaaagatgcataaacaatttaatggtaggaaaatttgccttttcaacaaatggtcctggagtgattggacatccacaggcaaaaacaggaacctctatgtaagcttcacagtctacacaaaagcaactcatggacataaatgtaaaaatgcaaaactataaaacttttagaaaaaaacaacagaaaatctttggaagctagagctaggcaaaaagttcttagacttgacatcaaacatcttccataaaaagaaaaattgacaaattggccttcatcaaaattaaaaacttttgctctgtggaaaggccctcttaagagctgaaacaatgagcgcagagttggagaaatattggcaaaccacgtatctgacaaaggactagtatcaggaatatacacagaactctcaaaactaaacattaaaaacattcaattagaaaaagggtgagagatgaaaagacatttcgacaaagaggatctactgatggcaaataaccacacgaagagatgctgaccatcatctcatcagggaaatgtcaattacacccacaatgagatgccaccacacacctatcagaaaggctaaaataaaaaatagggacaacatcaaatgctggaaaggatttggattcagaaaaactgtatcactgttacttttttttttcttttttactgtgaatgtcaaattttgttctggaaaatggtttgagagttcctttaaaaactaaacatatacttatcataagacacaaaaattgaacccctgaccattcatcccaaagaaatgaagacttatgttcaaacaaaatcttgtgtatgaatgttcaccagttttatttagaatagccccaaactgggaaccaccgagtccctcagcaggtggatggttaccatgcagcacctctgcaccacggagcaccacttggttatgaaggaaagaacgattagtacacaccacagcctcgctgaatctccccggaactgtgctgaggcaaaaagccaattcaagaaggatagatgctatataatttcatctagacaacacctgcataaccaactcttgtgtcctatgggaggcacatacggtttgagggcagccacagcacccatcttcctcaagtttgcagtctagtgtggaatgcaggtacgtaattagctaagatccaagttggagtgcaatcattatataataaagttatgagcaaactgctaagggaatagagaaatgaagaggtgaatttgtgttggaaagttaagaaagtttcatagaaacaagtggtatttgaactaagactggaaagataaatagaattctaacaggtggggatggattaggggaggaactctaagataacggagtagcatgggaagggacttggggctgtggcactgagtggtgcactcaggggatggtgtatgacatggggagggaggtgggggcagtgcaggaacagagggaggggagttgcatagtcacaggaggacgtcaaagctacatcaggaagcaccggtgcatctgtgcacagtggggagcagtaaaagctctgcatcggacagaaatatcatccaactgtgtcccagaaggaggataaaagtaacaatattaaaattaaaaatttaaagatacatagcagtttctatttgctgagccttaactatgagccagcactattctaagtccttcctattttaatcctcaggatttgtgaataatgaattaaagataatagggagaagggaaggcattcaataagagttacaaaaacggttcattagagagatgataaggttgtaaactcagagaacactagtgtggatagtttgagaagcagaattggtaaaaataatcagtatatgcaggattaaaggagaacaaggtgtcaaggttaactgcaagagaggttggctaggtcactggggaagaggaaatcacaaagaaggaaggctgggaacacaccaggtttgtgggtggggacgacgtttgtttcttctgcaggctgaactgtgtggcagaggagatccccgtgggaggggcaggtggagaatgccagggacagactgctgagagggaaacggaggcggcagagcaagtggtggcagcgtgcatggtggtcccggcttgcatgcaacacgtcaacacttaagcaggcaagggcatagcaaggacagaaaccaaggtgcacgctgcatatgaggaacgaagacagcgcttcccttttttttttttttttttccggtggtatccaagagtaagatatgcatcttgaagtgagacctggggaagtcccacaacacagcacttaccctaatcgcgtgggagcctctcacgtatcactgtgtcctattatatcatatttattctcttctgtctcactttttaaaatttctggctgcaacaccctaaaactctctcagggtcattaatgggctgtggcttgcagtttcaaacacactggatccaggcgacaggctgtttggagggaggagggagccaggctgaggaacagagatgcaaaggtttgggggtgaagctgaagatgactgactgccaagctaggctccagtggcaccagctccaggagaggaccctgggtcacaggacgaatggaggcctcagagctactcatcagagagtgcactgtgcgtggataaatgggaggagggaggtcagttgggagaaggtgtgagaaaatggaacagtagaaaatctgtcaaagtaaagaggatgggatagatcctccatctgttttaggagaaaaacaataaaaaagaggtgctgagcagaggagcaaaatcgacaataaagacagacagcccaaggtcatgtgctcaggagccaggagaagagagagcttcaagggtgagagagaggcggtattcatttcaaacgcggtaatactgagagataaatcagagtgataagaatcagaaatgaaatctattagcattttattttgcctacaggaaagctgtaaatgagaggctgatttcaaaatatgaacgtggtcagggttgaaatggggctgaggaggagcccctgacgtgtgacgggaagaccccaggtggcgaggaagaagtgtcggggaaaggcggtggtcagcacattgcaggatctagattttatgagtagaattcacgactatataaaaaaatacagtggcactctaatcagcagtaaactcatgctcaaaatgctctttacggaagatgaatgtgcagcttgccctcgcatcagcaaggaaagggctggtgagcagagtgtgaaggatgatcccatgcaggaagcctgtaggctttgtgaactgagaggaaacactccttaagaagatgacgtgaagtcaattaaagggatcaggtgggctctccttcccaatcagagaagacagggtcatagttccattcctgggctgctcaactgtgcacagtgggggtgcctgtcccaggcctggtcagggccagcacagactccttgacatggttttaactcacattttcacaatccctggaaaaatgcaaagcatttctataaagtagttaaggctttacatgtatatcaaatagaaatggaacctatacattcaagacattaaaaagctctatgcgtattcaaaggtggtagcattgttggtgatattttatgtctctttggaacacatttacaaagacagtttagaaaccagacaataaatcagtcttgttgttatatgttcacacttcacttttacattgaaaacagtgtgacaatcaacttagtcaatgactgggatgcaaataacttatttatcccacctggtatcaactaactttatgccacatcctcatgcatctgccttcaaaaagaagagtcaccattactgagaatgttcagagatcgccctctaccaggttactgaaggaagatcccaaagaagaattttaaacttttctgagcaacatcagaagctttccaaggtgaaatttttgaaaagaaaatattttctccagatacatttcatattccactacacctgttggaaatttctactaggagggacttctggtcccaaaatggtggtgcagtagaagcaaggtgacttcactctgctccacagagaagcaaaaacacacacagcactgacacaatcccagcaatggccacacactcaaatacaaaaggagacagttcccaggaacacagaaaattgaaaacaccccaagcagacagcaaaagcatcagaccaccatgtctgcaccatccctcctcataatctgtttggcatcaagagtatgggaaatttcccctcaactcatagcttctatgctggaaaaagtgagggtgaggtggacaatcagcttctccaacctcttgggggccctggctggagacctgttcctgcttcaacccatgggaagcgctgcaaatgtgtgaagggaaacatccctgaggacagccagagataaaagggggaggtgggactatagtccccagccccacaaactctactctgcaactcggtcaaagaggcactccatcagagtggctgctcacagcaccaccctgtagcaggaatgctccacaggtcccctcagcacgaggccccagccagccttctcacactgctggcatatcccctttgagacctctcccattcagtacaggcagcactcagatctttaaccttcagtacaggcagcactcagatctttaaccagagccaaggtaaacctgggcttaaggtgccatctagtgccgaaaaggagacagggacctagaagggggagaaaaagaaattccacaggtaaattatgtgactctctaagcaaatgtatccaataaaaactaaaacaagccaggagacaagactggagtaaataaataatccttcagtgcaaggacacagacacacatcaacaagaaacagcagcaaatgggaaaccatggccttctcaaatggacaaagtaaggaactagcaattggccctaataagatggcaatatgtgagttctcggaccaagaattcaaaatagcagttttaaggaaactcagtgatttccaagataacacagaaaagcaattcagaaatttaacaaagagattgaaacaatttttaaaaattcaaacagaaatcttggaactgagaaatacatttgctgaactgaaaaattcattatagcctctcaaaagcagaatggatcaagcagaggaaggaatcagtgagctcaaagacaggctatttgaaaatacacaatcagggatggaaaaagaacaaagaatgaagagggatgaagaccacttgcaagacagaaaattacctcaaaacatcaaatataagaatgattgatgttcaaggggaagctgagcaagaacaaggggtagaaagcttactcaaagaaacaataacagaaaacttctcaaaacttgagaaagacataaacatctaggtacaggaaggtcagagaacaccaaacagatttgacccaaataagactactgtaaggcatataataatcaaactctcaaaagtcaaggacaaagagagatcctaaaagcagcaagagaaaagaagcaaggaatatttaaagcagctctcatttgtctggcaaccaactactcaacagaaaccatacaggccaggagagagtaggatgacatttgcaaagtgctggaaggagaaaaaaatgaaaaacctgtcacccaagaatactatatccagcaaagcattccttcaactataaaggagagataaagtcttacccatacaaacaaaagctgagataattcaccactactagtcctgtgttacaaatcatgctaaagagagttcttcagtctgaaagaaaaaaaagtaacatgcaaaaagaaaatatttgaaggtataaaacacaccggtaaaagtaagcactcaaactaacccagaatactccaatactgtaattgtggggtgcaatccactcataaccgtagaatgaagcccaaaagacaaatctgtcaaaaacaataatagctgcagcaacctattaagagataggcagcatacaaatatgtagattgagacaataggaagtcaaagtgtggggggatggacttaaaatacagaggggttttttttcatttttttctttgtttctattcttttgtgatctcagttatctctttaagataacttgttatatgtttaagttgttttttataagtctcatggcaactacaataaaaaaaaactgtaacacatgcactaaaaataaaaagcaatgaattaaaacatactagcagagaaaatcactttaccacaaagtaagacagaaagcaagcaaggcaacaagaatgaggagttacaaaacaatgaaaaaacaaacaaaatagcagtagtcagtccttactcatcaataataacattgaatttaaatgtactcaattctccaattaaaagatatagaatggctgtatggataaagaattaagacccaactataagctgcccacaataaaccagccatatctataaagatggacattgactgaaaggaatagaaaaatatatttcaggctgggcacagaggctcacacctgtaatctcagcactttgacaggccaagttgagagaattgcttgtgtctgggagttcaaggccagcctgggcaatacagtgagactccatctctataaaaaaatcaaaaattagccgggcatggtggcatgtgcctgtggtctcagctacttgggatgctgaggtgggaggatcacttgagcatggaaggtcaagcctgcagtgagccatgatcacaccactgcactcagctgagataagagaatgtgaccctgtctcagaaacaacaaaaaagatattccatgcaagtggaaaccaaaaatgggcagaagcggctgtgcttatatcagataaaatagactgcaagtcaaagactgcaaaaagcaacaaagaacatcactatatagtgataaaagggtcaatcagcaagaggatataaaattataaatatatatgcacccaacaatggaacactgaagtatataaaacagacattaatagatccaaaggaagagatagcccgcaatacaataatggcagggcacttcaacaccccattctcagtaatggacagatcattcaggcaagaaatcaacaaagaaactttagagttaaactatacactacaccaaataggcttgactgacatttatatcatttcacccgactgctacagaatacccattcttttcatcagagcatgaagcactctccagaatacaccacatcttaggccacaaaacaagtctcaacaaattcaaagcagcagaaatcatatcaagtatcttttctgaccaccatagactaaaactagaaatcaataacaagaagaaccccagaaactacataaacacatgggaattaaacctccttctaaatggccaatgagtcaatgaagaagttaagaaggaaatttaaaaatgtcttgaaacaaatgaaaattgaaatatactacaatctatgggatacaataaaagcaatactaagaggcaagtgtataataataaatgcctacatcaaaaacatagaaagacttcaaataaacaacctaaccatgcacctcaaggaccaaggaaagcaagaacaagccaaacctaaaatgagtagaaggaaagaaataatacaaatcagagcagaaataaatgaaattaagataaaatatacagaaaaatcaataaaacaaaaagttttttgaaaaggtaaacaaaattgacaaacctttagctagactaagaaaaaaggaaagaagatccaaataaataaagtcagaaatgaaaaaggagatgtaacaactcagatcacaggaataaaaaggatcattagagacaattataaacaactgcatgctaagaaatgggaaaacctagaagaaataggtacattcctggacactaccaagattgaaccatgaagaaatagaaaacttcaacaaaccaataacaagtaattagatcaaagccataataaaaaaatttaccatcaaagaaaagcccaggacctgatgccttcactgatgaattctaccaaacatttgaagaaataataccaattctactcaaactcttcaaaaaattgaagaggagggaatacctccaaactcattctatgaggtcagtgttaccctgaaaccaaaagctgaaaagacaagacaaaaaaaaaggaggactataggcatagacacaaaaatcttcaacaaaatattagcaaactgaattcaagaacacattaaaaagatcattcaacatgatcgagtgggattcatcccagggatacaatgacgattcaaaatatgcatatcaataaacataatacatcacattaacagaattaagaacaaaactacatgatcatttcaatagatgctaaaaaagcatttgataaaattcaacatccctttatgataaaacactcatcaaaatgggtatagaaagaacatacctcaaaataataaacgctatatatgacaaatccacagctaacaccataatgaatggggaaacactgaaagccttttctctaacatttggagcaagacaaggatgttcactttcaccatttttatacaacatagcactgaagtcctgaccacagcaattaggcaagagaaagaaatacaggcacccaaattggaaaggaaaaagtcaaattagccttatttgcagacatcatgatcttatcatatttataaaacaccaaagacttcaaaacactgtcagaactgacaaattcagtaaagttgcaggatacaaaatcaacatacaaaaatcagcagcatttatatatgccaacagcaaacaatctaaaaaacaataaagtaaccctatttccaatagctaaacataatataagatacctagaaattaatttaaccaaagaagtaaaagatctatacaaggaaaacgatacaacactgaagaaaacaattgaagacgacacaaaaaactggaaagatattccatgctcatgtatccaaataactaatactgttaaaatgtcgatactacccaaagcaattgacagattcaatgcagtccctattagatgagatggggcttgttcagggtgggcatggctgtagacatcagtgtagtccctatcaaaatgccaatgacactcttcacagaaagaaaaatctctaaaatttacataagctcacaaaagaccccaaatacccaaagcaatcctgagcaaaaataacaaacatggaggtctcatatgacctgacttcgaaatatgcttcaaagctatagtatccaaataagcatagtactggcataaaaacagacacacagaccaatggaacagaatagagaatccaggtataaattcacacgtttataaccaactcatttttcacaaaggcaccaagagcagatattggggaaaggacaatctcttcaataaatgttgctgagaaaactggatttccatacacagaagaatgaaacaagactcctatgtctcaccatatacaaaaatcgaatcaaaatggattaaaggcttaaatataagacccgaaactatgaaaccgctaaaagaaaacactaaggaaacactccaggacattgatcagggcaaagatttttttggtaaggcctcaaaagcacagataaccaaagcaaataaagataaaatgagatcacatcaagctaaaaggcttctgcacagcaaaggaaacaaaaaagtgaagaaacaacccacagaatggagaaaatatatgtaaacgatccatctgacaagggattaataaccagaatatataaagagctcaaaacactcaacagcaaaaaaaaaacaaacctctaatttaaaaatgggcaaaagatctgaatagacatttttcaaataaaaacatataaatggccaacaggtacagtcatcaaataaaaacatacaaatggcaaacagatatagtcatcaaataaaaacacacaaatggccaacagatatagtcatcaaataaaaacacacaaatggtaaacagatatagtcatcaaataaaaacatacaaatggccaacagatatagtcatcaaataaaaacatacaaatggtaaaacagatatagtcatcaaataaaaacatacaaatggccaacaggtatagtcatcaaataaaaacatacaaatggccaacaggtatagtcatcaaataaaaacatataggtggtaaacagatatagtcatcaaataaaaacttacaaatggccaacagatatagtcatcagagaaatacaaatcaaaatcacaatgagatatcatcccactcccgttaaaatggctttttttttcttttgagacggagtcttgctctgtctcccaggctggagtgcaatggcacaatctccgctcactgcaacctccacctcctggattcaagcgattctcctgcctcagcctcccgagtagctgggattacaggcacctgccaccacacccggctaattttttgtatttttagtagagacggggtttcaccatgttggccaggctggtctcgatctcctgacctcatgatctgcctgcctcagcctcccaaagtgatgggattacaggcatgagccaccgggcctggcccaaaatggctcttattgaaaagacagaaaataacaaatggctggcacggatgtggagaggagccctcggacactgtgggtgggaatgtaaattagcgcagccactatagagaatagtatggaggttgctcagaaaaaagtgaaactagaactaacatatgatccagaaattccactaccgggtttgtatccaaaagaaaggaaatcaatatatcaaagagatatctgcatgcctgtgtttattgcaggactagtcacaatagcaaaaatatggagtcgacctaagtgtccatcaatggatgaatggatatagaaaatgcagaatatatacacaatggaatagtattctgccataaaaaagggtgcaagcctgtcataggcaccaacatgggaaactggaagtcattatgtgaagtgaaataagccaaacatagaaagacaaatactgcatgttctcactcatatgtgggagctaacaaatggatctcatgagggtgcctccgttgagattggtggttaccagaggatgggaaggggagctgggaggaaggaaggagagacattgactaatggctacaaatagacagaagaaataaaacctagtgtttgatagatcaacagggtgactagagttaacaataatgtatgtatgtttcaaattagccaaaagagaacagcttgactgttcctggcacaaagaaaagatgaatattttaggtgaagatcccaatcaccctgatttgatctttacaaattatacaatggtattaaattatcacatgtaccctgaaaatatgtacatcgattctgtatcaatatagaaaagctttctagagagcccatttttctacactcggcacctccacaacaagcaggaagcagccggtgtgaccacacctcccaaaaccaccattacgggctgcttagcattctaggacacggagacgtcgtgggggaaactgcagggtgactgaagaaggagaatcccagaactcccccaaggacgacagtgcagagcccacagcgttgttgaaggggctgggtgagctgtgagtagatcccaggcaccatcaccatcgtccttgccattgctggccgtcatctctggtcatcgcaaacagagccccttacggtacgttaggggatggtgtggaaacgcttggctaaatgaagatgctgctgacattgctacgtggtgcctgccacacaggcaggcaatgtcttcagaggagccccagcttctcctctcccttctcctcctcagatctaggtagggccgcttgtgctcccttggggcatgaaggaaaaacttcacgcaggccacccctctagccaccgtgctcattcagaagccacaccagacaaacgttgaggggtgggtaaggctgcctgggccctgggccctcagaacctcaagcaaagctgcccgaaggtggggtctgccctggcgtctgtggggtgggggcacacagtctgatcccagtctgacatgcaccagctgtgagcctcgagatgcctcaagtatgtcttcatggagccgccgtgaagacgtgatggcactcagtgggactccccacagggccagtggaacctgtccctgcctggccccccagttacccagttacccggtgcaacctgtccccgcctggtcacccagttacctggtggaacccgtccccacccagccactctgttaccaggtagaacctgtccctgcccgaccactctgctgtggggaaaagcaagagagatcagattgttactgtgtctgtgtagaaagaagtagacataggagactccattttgttatgtactaagaaaaattcttctgccttgagattctgttaatctatgaccttacccccaaccccgtgctctgtgaaacatgtgctgtgtcaactcagagttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggagggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcactgagatgtttatgtgtatgcatatctaaaagcacagcacttaatcctttacattgtctatgatgcaaagacctttgttcacatgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacactctgccacttcgccgccacccatgctgccattgcactgatgctggcttctcgtttcctgctccccctctttctgaacaccccccggcagacacagcgcttacatgggagtgcacgaaggacacccttccctcacgctgagctcagcacagagcctgcaggagttgcccgcagcccggcggctgccatggagatacacacaggacacaagtgtctgtgatttctgtggccacacctgtgctggctgctcccgacgtccctggaggccagctgttccggcagggctggggcacacacacaatctccacagtgcagccgcggcctcctgctgggaacgtccgccccgtcctgcctctcggggcggctaagtcgctaagtcacgcccgtgtccggctctgattggaaaaggacgccctgggcttggctgggaggaaaggccagagggtccacaggggaaaagctcagctctggggggcatccctccctacagctgggcctggagaggagcccagcacacctgatggccatcgcagatcaggaaaccgtcctcccctccctcctgccctgggccaagcaggtcctgccagttactataaaataaagcggggggtgtgggtggcaccaaaagcacagcaggcgagacgcggggcacaggaaggaaggaagccacagcaaggcttctggtctctgccgctcatcagaaacctttcttccgccctcagccactgtccctcttaatccagccacattcacggtttctgtatcacccaaaacatcatgtttgttggaacttattttattttagattcaggtcttgttaaccattgctccaggatgctttactttccttgtcttaaacgggaacttcccaggtcatgttattaagaagtgggtgcccaggaagcacgggtcgcagctccacacggacagaggctcctgggacctgggactggctctaggtcatgacagctcagcaggattccagggaccgacggattcagtcctgaggggcagaccaggtcctggtaggtacagcaaggaggactcccctgcaagtctggagcaacaaggccccatgaagggagacaaaaccagggaccctgacacggtggctacaagggcagaggtgagagcagaggtgtgaaggccacgcagcccccaggacgcccccaggacaggctggcctatgctaagccacgcggctccccagactcctgaatggagaagagggtgctggcctcagaggctctcgtgagggccgtggaggggagcggaaagccaggcaggcagctgccacccgagcctggtgtttgctcggtcaaggtgccacagcccccatcaccccggggtgggggccaccaccatgccctgaggaccgagggccttctctgaggccagccagagggtcgatgttcctctgcgccttttccaaacagcaggatggtgcagaaacctcaggagggtaaaacccgtcagctattccccttggggcactgtctctctgtgcagggaagagtcagcagttctctctgttggagcagacgcgacctccagctctaaccaagactctcagaccacgttcaagttgcagccagcaaggagcccggagctggtatcccggagcttgttctttcctggggcgctttgtttcagtccacaagccaacgctccgtagcgcggcccccaccctcctgccgtgtggggcaaactattcaaagtcccctggccgtcagaaggttccagagggtgtgcagtcactttcctccccattctcacagcagcaggaccaatggggacgtggctttgtctgcatccctgcggcccctgccactgcactcgccaccatcaaaagcttctcctctcggagctcaaggacacatcaaatgatgtcacaccacttcacgcccttctcccagcagccccgcttcagtgcctgggaagctgcacaaaataagattctgttatcaagcaacgctgcacttcccacatctggatgcacgccaagacaagacgtcagtcatttcctggtgaaatgaaagaaagccacgcttcctccacgcccattgggtcacgaaatccttgctaatcctggccggggcactggaggatgctataaacaatcacggatctgagcaggtggatgaagggaacgtagatgacacgttgagggtgtggtgcgggcaatacacagactaagagtgggaactggcgaagtgagctataatcccaagcataaaggaaaggaggggaggtggcctccagcgcctctcctactagttaaaggagagagagggagaaaaataccactggaacctccaggcaggtcagacgggcacttggggcttatgtgcattatttgatggaacaagcagtgtctttgtttcttaggatggccatttttatctttttgataagtgtggaggaagttggcttagtataatttaatttctctctcctattaacaggtctcagtaaaacaatggggaatataccaaaaaagagagagagagagagaaagccaaaagaacataaaactagcacattagtcttttaaataaaaatgcagaggaagatagggaaggaaaagaatactacccaatattagtccagacctcgaatacgaccaggacagcctgccacagcagaaagaccaggtgtgtgggcttttgttttgtttttgttttctttcgagatggactctcactctgtcgcccaggctggagtgcagtagcgtgatctcagctcagtgcaaccactgcctcctggggtcaagtgattctcctgcctcggcctcccaagtagatgggattataggtgtgtgccaccacacccggctaatttttgtatttttagtagagacagggtttcaccatgttggccaggttggtcttgaactcctgacctcaggtgattcacctgcctgggactcccaaagtgctgggattacaggtgtggccactgtgcctgggcaggtgtttggtctttctaatggcaaaaggcttccttcgaactttacccttgctagatcttaatattgattcaatggggaggcatattttgctaacagcaaagaagaaaaacatcattgaataattgagatacaattctcagtctaaggccatcaaactgtttgtggacaggaagtggaagcagaagctgagcctggctttccaggcagaggcctctgctgtggtgcccaggaaccatgtcaggagcccacttctgaataaagatgccccaaggcagccccgtgggcaggtgccctcaggcccagggccccctgtgaacgtggatcatggtcttgggccagccagcatccagttccagcttcatggtggaagcatcaaagtgttcttggttaacccattttagaaattccttcagttaccaggtgactcttccctttctccagttcggctatagtttcctttcataacatatttgctgacggactttaattagaatccttcactttcggccgggcgtggtggcttacacctgtaatcctagcattttgggaggccaagggggaggatcacctgaggttaggagttcaagaccagcctggccaacatggcaaaaccctatctctacaaaaaatacaaaattagccgggcatgatggcaggtgcctgtaatcccagctacccaggaggttgaggcaggagaatggcttgaacccaggaggcaaaggttgcagtgagccaagatcacaccactgcattccagcctgggtgacagagtaagactctatctcaaaaaaagaattaataaataaataaaatttaaatttaaattttaaaaaaatccttcacttcccctgacacagactttaaagtacgaatcatcacacccaaattcagctctgaagacattgttttctgaagtgttcacgccctgttttgggcataccaggaaaggaggcagtgttctgttctgttttctcatatcctacctgaatcttatgattgattttacagctaacgttctacagctccccgttctcctaatcacagctctgaggtcctccccaaatgatcactgagtaagaaaacatcttgggaccttttttaagtcaaggaaatgatacagatggctcgaatgttcccacaaagtgcatatggtcctggagaagggagaccacagctctaccaaagctgccatctgaaaccccctcaggcccatatttctagacagcacagtcgcaaaccgaggggtccttatcttcactaaactagctttgcttttgctgtggagccttgtttgcttgcttctgttattgtccaaatcttaactgactctgacttggcctataaggcaggttcacccacccggtagagccatgctagtggctcctagcagcccaagagcccagcctgtaaccattcatccctggagggaaaggagctgaacctaaagtttccagtacaacctcctccccgccccgtcctctgcaccttcctctcccatcgtttattttcatttccatctccagtcttctatctcaagctccactttccacctgcctaggcatggacttctccaacctcttagttccgcttcttttcaattagagagaattctaaatcaaaagcgtgtctgcaaagtggagagattcaaaagatgagaatctcctctaaagattgcaatcagtggccaagagtgagggagggaattcacaaagttcaactcctttcagaaaacatctgtgttcgtcgggaatactggcctgtagtcttctttccctggagtgtttgtctggctttggcatcagggtaatgatggcctcgtaaaatctgtttggaagtgtttcctcctcttcagtgttttggaagagtttgagaagatgggtattagttcttctggaagtgtctggtaggattcagcaatgaaaacatccgttcgtgggcattattttggctgagacattttattactgattcaatctccttactcgttacagtctgtttttctgtttcttcatgattcagtcttggtaggttgtatgtgtctaggaagggctccatttcttccagattgtccaatgtcttggcgtataaatgtccacagtggtctcatgacccttggtgtttctgtggtatccattgtaacgcctcttctttcatttctgattctatttatttgagtcttctctcatttctcagtctagctgaagatctgtccattttgtgtcttttcaacaaaacaactcccaattttgatgatctttcctattgtttttctaggctatttgacttgtttcttctctaatcattgttatttccttccttccactaactttgggcttagtttgttcttcatttcctagtgccttggggtgtaatgttaggttgattagaaaacaaaataagctaacccaggaagctggagtgagaagattccagctagaaagcacagacgccttcacttcagcctcaacctgtgatcagagcagacacagcaggaaagcaggaaagctttcatttccatataccagactcagagctgaaaagaggcaaagaaagtcttctctcccaaaattaatcaatgcaagaggagcagaccatttcactgcttcacactggcacttctcaccttgtttctcttgcccaaccctagtaaaaatgattcccatgtgagcacaacagcctggacattgtggtttaaaagtctggtcactgtagtgagaggaaaaaaagatctgtctggtttcatgagaagaaatgctcagtggagagatggttactcgtgttttccagatggttctgtggaccccagaacgctgtcccagccaaactccaccacagataccaccttcagagttggccaggagctgcaggaagcccacaaaggttgatttggaagaagcaacatcctacaaaccagatccatccacacagagagcaggctctgctccttggcagtagtctctacttagtgctaagtactaagtacctcctaagttgtagtctctgcttagtactaggtacctcctgagtcatagtctctgctaagtactaagcactagtcactactatatatctcctaagtatcagtgtctacttagtactaactactgctaagcactaagtacctcctaaatagcagtctgtttagtacaaagtactattaatgataattacaaactacctcctaagtagcagtctttgcttagttctaagtactgctaaatactaagtacttcctaagtcacagtccctacttcgtatctaatacctcctaagcaacagtctctacttagtgctgatccctcccaccccgagtcactgacatcacttcctgtcctccctccttcctcacaatgtggcccattttccccactgaccaccaatgcagcacccagtccctgggaagagaacaagctgcctccttcccccaggacttccatggtggttcctgctcagccagaagggaaaggccaggctctgaagtccttccagctagctcctgcttcttcactcagaagtgcaggaaactgaccttcccattaatgcttcagagggggtagtagcacagaagttggaaacgcaaattaaaaggtgaaaggtcaaggcagtgtcctgaagaaaaaggctgaacaagcctcaaaaacacacctttcaggtattcatgaaaaaggaacagatacacagagtgtctgtagacagtgagctgtgtgttttgcgtgagtgtgaatgagcgtgttttgtgtgtgagctgtgcataagctatgagtgtttatgagtttttgtgtgagctgtgtgtgagggtgtgtgtgaatgagcatgttttttgtgtgtgttttgtgtgaaaatgagtgtgtgagcgtgagttttgtctgagttgtgtgtacaagctatgtatgtgttttgtgtgagctgacttgtgattgttttgtgtgtcagttgtgtgagttctgtaagctgtgtaagttgtgagtgtgtgtggttgtgagttgtgttagagtgaaagtgtgtgtgtgtgtgagttgtgtggttagcgtcagagtatgtgtgggtgtgtgtgagttgtgtgagtgtgagttgtgtgtgagagtgtgtatgagtgtgagttgtgcacatgtgagtgtatggggggcgtgtgttatataaaatattaaactttttctctgagctcagtgtctcccagtgtgacagagccccagtgccccggggtgggggccgtgggagaagcgacaggcctgagcgaggccagcagttcgaagcccctgctccctggctgtgtcatgtggacaagtgacgtcgtcttgaggatggcctcgtgaggcggcggtgggcatgaaatgagatgaggcgtccagccctgcatctgcagcgtggtcagcacagaggctgacatccatggtcatgccggaatccgtggtcatgccagaatccgtggccatgccggaatccatggccatgccggaatccgtggtcatgctggaatccacggtcatgccggaacccatggccatgccggaatccgtggtcatgctggaatccacggtcatgccggaacccatggccatgccagaatccgtggtcatgccagaatccgtggtcatgccggaatccactgatggtgcacgtgacccacgatgggaaaagtcacaagacagcttcagagctggtcaaacgggactgagaggggctgcaccaggaatgcgcggcctgttgagtttcagtgatgaggccatcagaagccatctccacgcacttctcatagagcgcatgggccgccctggcctgagtcaaaccaggggcctttcatccgagccgacctcttgacgtagagtcaggtctccttgccgagagtgggacctgcaccctgatccattactaggtggagggagttttccagactgggtttgtttgggttgatacaaaggcaactctgcacatccaaattcgcatggatgggagctgccttctaggcccctctggcagtttccccaggagtcaggcacagcgtctcatgacgtggctgtgtgaacaggtgagtggggatgtggaagcagccggctcagggccggcacacagtaggtcgcttgtgcgtggccaccatgctatccgccaaccccggtgccatggttatccctatgctgactcacaggcatggggctgctgactcacaggcatggagctggacatcagtctggctcgcaggcacactggaaagctgctcttaccctactaactttcagtcactgagacacaaatcagggcctggttggcagcagcgagaccgtcagggtgccctccccacctgcgacaataaacaccgcatgatgttaccctccagggatgacccaggattgtgtgaaaccaaaattcattaaaaatgaatattctgggccaggctgcattcactaattgattgattgattgattgataatttgatttatttaaaatacacctttctcgtaagcttctcggcacatacggcaaaatataaataccccacatgaataaaattatcacttgaaaaaactcatcacttgaaggaagagggggaaaaatccatgttatggaaatggcagcgtaatgggtgggtctcctggtgaccaaagacatcctgggaggtgagagatggagagagaaacagaggcttaaagatttggagtcgagacgcgtctctctaccaagaaggaagaagacggctctcactgcccccagctctaactccgtgtggtccacaggacaggaagtcccacacgggagaaggaggatgctggggctgctgacgataagaaaatgtgagcgtttcacaagtcaccgtgggtggtcattgtccttgtccacgggatttttcaaagtaggacaatctgtattttaaagaagttgcgttttcttcctttttgacctttttaaagacttatgcagaaagtgactgcaaccaaaagcatatggttttattgctaattcaaccttacagagctgacaggcaaggccgaccaatgtgtgggagggctctgatgacagcaacgacgacagtgaatccaggggtgacgtcccccaggcgtgtgcttcccatggccatgccggaatccgtggtcatgccggaatccactgatggtgcacgtgacccacgatgggaaaagtcacaagacagcttcagagctggtcaaacaggactgagaggggctacaccaggaatgcgcggcctgttgagtttctgtgatgaggccatcagaagccatctccacgcacttctcatagagcgcatggagcttcccagagcaagcgtgcagccatgccaggcctgggctgggagacatgtgtgaggacgcacgatggggttaggcagcctgagaaaccatccctggcacgggctgcctcaaggaatgaggaggtgtgggcttcccggctgcccatccccatatctgcacatagcccctgcatctcactacacagagcgtggcccgtgggtggcaccccccagcatggccaggagcaccgaggcgcacgctgggctctgagacgccccctggccaagaggggtggaggaagggggcaggcgccaggatctggaaggagatttccaacccacgtggggtctcacaggagaaggccgtgatgggaggtggggaagtggggaggagggcgctcttgaccgtgtctgcgtgtctaagcaaaggatacaggggcgcaaagggaaggagtggccaggggtgcccgtcccaggtgtgctcttcttcacggcgcccctgcttccccaccacgcccatgtccacggctcgtgggcagctgggcactgggccactcagacaccgtcctaaacactccacacaggtaacttgctccctctccagccacacagcaaacacagcaaaggggacttgggtgtctgcggtttttttgtttgtttgtttttaagatggagtttcattcttgtggcccaggctggagtgctatggtgcgatcttggctcactgcaatctccgcctcccgggttcaagcgattctcctgcctcagcctcctgagtaggtgggattacaggcatgcaccaccatgcctgggtaactttgtaattttagtagagatgggttttccccatgttggccaggctggtctcgaactcctcacctcaggtgatccacccaccttggcctcccaaagtgctgggattacaggcatgatccaccgcgcccagcctaccatctgtgttcttaaccatacctcgcacaagaccccagcctggagagaggagcgggagggggaggcctttatccccccattattagggagatcccaaaggcttgtctcataaaatcacagcacatcgtttctgagggtaaagaattagagactccttgaaaatgggagagaatgagtgatgctttaacaagcttctaagatgaaatcctaaagctggggctttgctcagagcccactaaggccaggcgggtcatgctgtccttccaggagcggccccaccccttccgtcttgacactcaaaccatcgggctggaggcaaatgtcagaggagaaaagcctttgcttttctcccagctctcctgtaagaagccgctgagctgccagctatgcagcaagcacctgcgtaccccaagatgcagccaggaaggagtggggtaccccgaccacgtggggacacagccctcccaaggggcagccagtgtttccctgaaggaactgaggccaggaagcttgtttctcatttacttgaattcaaatcttaaaatgtttgcaataaattcaaaattttcaaaatactgtgtaggactgaacaaaacaaaacactcccacacacaccccatgcacacatatcacatatgtgcatatatacaccacacagtgcacacatgccacacacggacccacatcacatacatgcacatacacacgcacacacaccacacatatgcacacatcacacccacacagcacatatgtgcatatatacaccacacacgtgcacacacgccacacacatgcacccacatcacatgcatgcccctacacacgcacacacatcacacatatgtgcacatcgcacacatcacatatgtgcatatagatgacacacgtgcacacatgccacacgcatgcacccacgtcacatacatgcacatacacatgcacacaccacacatatgcacgcatcacacgcagcacatatgtgcatatatacaccacacagtgcacacatgccacacacatgcacccacatcacatacatgcacatacacgtgcacaccacacatatgcacacatcacacatgcagcacatatgtgcatacataaacacacgtgcacacatgccacacacgtgcacccacatcacacacatacaccacacacaccacacatatgcacacatcacacacacacatgaacatgccacacacaccacacgtgaatcacatattcatatcaccacacacgtgcacacagcacacacacgaacacacatcacacacatgcacaccatacataaatgcatacatacacgtatctaccacacatcctgcatgcacacgcatcacacacatgcacaccatacacacatgcatacatatgcatatctaccacacctgcatgcacacaccctgcatgcacacacatcacacacatgcacaccatacatacatgcatacatacacatatctaccacacctgcacgcacacaccctgcatgcacacgcatcacacacatgcacaccatacatacatgcatacatacacatatctaccacacctgcacacacacaccctgcatgcacatgcatcacacacatgcacaccatacatgcatacatacacatatctaccacacctgcacacacacaccctgcatgcacacgcatcacacacatgcaccatacctgtgagttggattggctgatgagtctcccagttgtgacgtctatgcagccaataaaatgtggaagaggggtttcctatggtcagtgaggctttaggaccagaaaagccccatcccctggggactgcagagggctttatctcagcggtcagatgccctctgtgacatcattgccaagcatcattcactcataactttgacagacatgcactgaatgcattcccatttaaactgcttctcctgtgctccagcaagacgccacgtccctcccccagtgtgtgtgcacaacgacccgtgcagtgtcattgtgtcataaatgcatctgagtgtaatgcaagtgagagaacacgtgttggatgcacgacacacacacgagtttcccacactggacactcagtggatgcacaacacacacacgagtttcctacacttgacactcagatgcatttatggtctactcttaccaaagtaaaaagcaacagatgaattgttgaagtatggtacatcagctctaaatgcttcacatatttatggaaatattataataaagaaaatacttatactatcaaggaaagccgaacaacaggacccacaatcggatctatggggtggtccctgcctctaacctgagctcagataaagtaggacacttaagccctcatttttaggatgtatgaatgtggatattctctcattcctactgttgcataattttcagattctttctaatgcatataggttatttattgttatacatttatagcataatgcatgcctatttaagaaaattgaaatggtatcaaaacaaggcagaaattgcacagaacagcaaaagggaaccggcctccccatcctcatcccctctccatctgctcttaacccagactcaggttttgcttttctgcatacatgtacacacccatgtacacacacattccatacatatgcacacacacacgtacacacacatcccccccacatccacacagaaacagaagtgatagaaaacaacgatttttataagacaggtatattttctttgcaaaatctcaaacccccgaattgttgtggtttctctctcgtctgttttttgacgtgatgcaaaacatgtttgaatgttgcgccgtagtcctgattccttcaaatcaacatcagctgactcttagcagcactgtgctatcactatttcatatcattttcaaccagtcataaatgtgtcctcctaaccatgttgccacaaaagacaattccagatgctttgctatctggtagagaaaaaattaacaattcgcttattcttaaagtgtttgtggggaaattttccaaaagaaaaaaggtgaaattacgcacagtgagatgagcacatttttacttgattgtaacaagtacggaagttaaagccccctggaaatctcggtggaaatcacataaagtagactctaggagacaattccctatctaggctggcatgaaatcctaatgcatagaaagggtaatgggacacgcacaaagcgtactgttacttagcaggctctcaagaaccacacagcatgacggtaataatgtgctcatcttcaggagaatgggaacaagtgctcagggtcaaagaactgggctcccgtcctgcctgctgaggtccctggggtgctttggaaccctcattggtgagccgaggagaacctcgcctttctcccagcagagatcagatgtcctccttactgcacggatatgatacatgtgcatgcggtatgtgtgcatgtggggcgtgtgcaggtgtgcaatggatgtatacagtgcatgtggggcgtgtgcaggtgtgcaatggatgtatatggtgcatgtggggtgtgtgcaggtgtgcaatggatgtatatggtgcacgtgtggtgtgtgcaggtgtgcaatggatgtatatggtgcatgtggggggtgtgcaatggatgtctatggtgcctgtggggtgtgtgcaggtgtgcaatggatgtctatggtgcatgtggggcgtgtgcaggtgtgcaatggatgtctatggtgcacatgtggtgtgcacaggtgtgcaatggatgtctatggtgcacgtgtggtgtgtgcaggtgtgcaatggatgtctatggtgcacgtgtggtgtgcacaggtgtgcaatggatgtatatggtgcacgtatgcatgtgtgtgtccccctcattacctcacatgcgtatagagcacagacacacaccttaataaagcccagagtatgctcagcacagtaagtgtgcaaatcctgaaacgctgtaaaactggacctgtgacttgaagcctccattccattgttggggacacacaagcagggctccctaaggggaggtcagggaaacgagagccaccacatacctgccccaggctcagggcaggtcccagcaaagccccttcttggctctggcctcctcatcgtctgtgggacacgcccattttaccagaaacacaaagttggtccctccatccatccttcgcctaagcagcctgcctctccagttgccatggcaactctgctctggttgccgcacagcctcaagcctcagctgcttggagtgggtgggaacgcgagagcacttgagcaccagtggcctgacaactctgcctcgtccccatcacctctgcggcgagaatcagagcagtcgcagaagctcctgccacaccactcccataatctctcagtgccaattacttggaggaaaaatggaatcatccccgtgcccagggtggtgagtggtgtcaccgttcggatggctcagatgaaggcggccaactgggcagcgggaatggagcctttctaggcaggcagacccaagcatactgctcctgaattagtgtgtgggttggtgagcactccaggcggacctgatagcccggagccctatccctcactaccccccagccccagccctgcaccagttaccaaagacaaacaagagacacgtttctccaaaggatggcaggacaggacagggtaggaaggccccaccaccccatctccaggcacctggctttcagggaagccaccacgccagctgcacagacgcgtgacaggcaccccagtgctgaagcccaaggaggaggctgacagcccagttagatcgagtccaagcagcaaaatcacacagcacatcccgacaatcagccgcatcacatgcaaagccagagaacgaacctctcactccccaaatccaatcctccccaacatgagccacccccaccacccccgattgatggggagattaacatgccggaaaacgaccccatatcacaaagcagagcctggtttctcaaaggagaccttaatcttccctcacccttgggctggcggagtgagagtccctgtggcccgaggttcctcctgtcatgcccacggcactcagaactgaggctggcatgcggagggtgtggtttccccggaccagacctcgttgtccagaccaaacccaaccacagttccaatctgttttttagccaagtgctttaaatatgtgtcaagcactaatgctgggaggacttaaataaatacatgagccttttcttctaataaactggcagatccaccagatctacctgggccagtctcattttccaggcgactgagcctggatgtgcataactgaagctgcctgaggactggaggactgaccggggccagcacagcgggcgggggcctgaggactcgaggactgaccggggccagcacagcgggcggggctctgcccattaaatacactttcgcgtgtttcttttaacaacgtgctcctttcacagaagtgttttatgctgcatttcgtagaaaggaggaagcactcaacagaaccttccgtttccagtcaccgggtgattgccgcgcctgttgcttccacaaggaacccactgcaaaaccatctagggcaggggcagccccgggtctccagagcacacgccagactcccgaaacccaggccaggaccgcgccccacaggaatctgtcccctcccctcggcggtggtcaggttggccttgagtcttccatgagaatctgcagaatgcggcacacaggcgaggcaagactggggacttccttgaataacaaggtgtccagtgctttaaaaatactctaatggtgaggaaggaaattgagaaaatgattcattagaagagcggaataactctttttaagagcaggctcgcagaagtcgagctgggcaacagattctcgagccgctggcatccatatttatcgagcagaggaagcatccctgtaactgcacggcggcacagagccactgcccacggcacgacccgccctccatctctacgttcaggagcatccctgtaactggacagcagcacagagccactgcccacggcacgacccgccctccatctccacgttcaggagcatccctgtaactggacagcagcacagagccactgcccacggcacgacccgccctccatctccacgttcaggagcatccctgtaactggacagcagcacagagccactgcccacggcatgacccgccctccatctccacgttcaggagcatccctgtaactggacagtggcacagagccactgccgcccacagcacaacccgccccccatctccacgttcaggagcatccctgtaactggacagcggcacagagccactgcccacggcacgacccgccctccatctccacgttcaggagcatccctgtaactggacagtggcacagagccactgcccacggcacgacccgccctccatctccacgttcaggagcatccctgtaactggacagtggcacagagccactgcccacggcacgacccgccccccatctccacgttcaggagcatccctgtaactggacagtggcacagagccactgcccacggcacgacccgccctccatctccacgttcaggagcatccctgtaactggacagtggcacagagccactgcccacggcacgacctgccctccatctccacgttcaggagcatccctgtaactggacagtggcacagagccactgcccacggcacgacccgccctccatctccacgttcaggagcatccctgtaactggacagtggcacagagccaccgctgcacacagcagtaaaaatgtacagccctccctctctgcgttcaggagcagagggcatgagtttcacctccctacaggacaggaaactacgacagtcatctttgcacctgaagaaacaaattatttaaactttctcatcctgcagtttacttcttagacatgtctactttctatagcaaaatagatctggacacgaataataaatgcgaagcatggtgttacagggaaaatcccgaggcatggcccaggcccaggaagaagctgcagaaaaggagaaattcatgtccctcccctgctgtctttcctaggacatcccttccctgctcacccacgtccaggacctgttctttgtatagaggttcctgtcttctggtgttgagtgacacagagcaacccaaaagctccctcgcagaagcccctgcaggcttcacgacgtgtgagcaagggaggttctttggctaaagacccagacaaggcaatgatctacccaacaagatcaccaagggcaagacttcacgcgagcacagctgaggaagatgtttggggcttatctgaccgtttctacaagcatctctcaaatcacaccacagaggaaaccaaaaggcctggttcagcctccaggggccgggctctggaagaaagtaggcccagggcaggagtccacggccacagggaacagggaatgctgccttcctgtggggaacaagaggatcggccactccaccaccaaagatccgcggccgaaccaccttgctgaaatttaacctgaacttgcctcagcacgacagcttcaggattaaaagtggttcacggatttggggaactgcagaggacagtatgtgtgtacagagaattacacaatcatgtagctttttgtggagtgaggggtgttgagccctctgtccattcaggatgctttggaaatgtttttaccaaactatgagtctcacagtttcgaggactccattcccgctggggctgtgctgtccgccgcacccttgcactgggccctgacccaccctcccaccccatgcaccaagctcctggccactcttttctggctgccctgggctcgccagctgatgaggccaatgggccctcctgtccctggggcttggcactaagcctcagggcacccgtcctcactgcctgactacctttctctgcctgttccagctggacccactgagcaaaaccttctaaaccagacgatgctcagaactacccagcctcagaactacctctgtcctcagacttagatgccacaggaaaccccttgctgggagagccagtgctgactccagcttctcagcgggtttgattttggatgccgtgatcagaaccctgcaggtgctgtgtgttctgtctcatccagggatgtcccgtgtctactgcaggaccttcgggggaggcctgcctgcagaatctctgtgcaaaggtgatgtgggcagggagtgttgacgacgatgctttgatggtcctcttctgttgtctcccataggcacagctttggaccaagctctgtcccccacacaatggactgacctcttgggactcagagtctgatgccgactggctgaggaaagtggacgtggcagggaccccgcggctgcctctgctgagggggacaagagggcaccgaggcttctcctcactctgagaggagttgtcacgtgcacccttggagcaaggtcaccagccagtcacaagtgcagggccattattctggtccgcgccatgtggaattttaaaaagttttagatggtggaccattggcagttttagaaatacactaaggccccggaagacctacctattggttcaggtacctgaggaaaggtggtggaggagacagaagctggcgggggcgggggggaacctaggcagctcccgtgaggacaagtgatgacggcagagaagagggcaggactcaagcagctgggcgcccagcagaagctccatgttggacaaccatgcactaccctggtggcttgagagcaatagaatttgcccgagcttaaaattaaactcagccctaataggaagtttatggaatgattcaccatctgtaataaaatttatctttcttggagtagaaaagagtatttttcccaaaaaatatagtctctaagaaattgtggaataatcaaatctatctataacctaaacttatgcaaaaagaaacatggatgtgagtttattctgccaaaacgaggaataaggtccttcaagctaccagctttttgccgtctgggagcttgggtttcagaagatcccctgtaaattccggacccctagttccctggaacaggcatgagacaacctgctaaggcagactgagagcccagtcagatccctgctttccctgggatctgggttgaaatggagttgaatgagggacccggacaaccagaatcatgctcaaagaggtttcgagtatcctctgtctaccacccaggtcagcaggcggggtttgccctggaccagcgtgtggagagacccgggcacacggctgctcaggacgcagtcagacgcggaacccgacccctcaggtttgatcacagaaacctgtggcgtgtttctggggtaggatccttcctttaaataaaaacttacacaggaaccaaatgttcagagagtctacatcccagatttggctgattcttttctcctcagcgttacaatgagatggcgtgatttgaggacctgctgtacgtgcgctaaacgtctttttcttgttactctgacattcgaatccagtcaggcatcctgtattcaatctggaactctgctcttccttctggggggccctcaagctctgggaatcataggataagaggactgtggtgctggacgaccccgagcccccagttgggtgagcaagcgtgcagcagcgagaaatgtctgagcccccaggcttcaagcccacttcgctcagcctgggtctcacccactgtacaaaggatccaaccctgcagctccgctcctggaggactgaccaagacctgcggcggtgactgcccccgcccagccccacggcgctgacctggaactgccctgatgatgagaatcacagggatggcgtgcgtgccaggggtgagcccgcctgcagaggagctggtgagggccacagcccatgccctcccctgctgggctccttgctgtcagctgacagtaccctggcttcgcggtgacagcagctcttcctctgagcgctgcctcagctcatcacatgagctgagagtgggatgggtctcatcatagctaccttctatccattcttttttacctaaggctttcttgagaggcagttttcactttgcagcctgaatcctactctgcttcaggtaagataactgggcgggagcctgacagtttaagagacccaaatagaactaatctccaagcgggcacgtaagaacagctcacagcatggctgccccggctccttctcacctgggatttctcctggagcattcccgacgtccacacaccacatttcctccgctctgtctgctgcagagcctgctccagggtgaacacaggccgtcctgaatcagccgctgacgcctcccccggcatctccacgtgcagcccctgccctgcgcgactggcgtggaaagggctctggtgcgtctcacactctgctatcatcagcctccttcctgctccagttcttaagttcttgtcttttctgttgtctgcatttaatttaaatttctatgaatcgccgcgagacgaccctgtgagtacgcactccatgtgcatgtgcttctccacggagggagctgcctgggtggccgccctgctgatcctctgcatccagcctctggtaggatgggggcgaccacatcagataccacctctgtggaagggtctgtgtctcctcccctgccccccagtcacagctttgggggagatttcagaggtttcagggccttccctgaagcctttcctggaaggtggattctcttgctttttcagcaaccaccagccgttggctctgctggaatggcatccagggttttccttgttgcttctgtatctgtttgttttggcctatttgttgttcatattgttaagctttagggaggaacatttggggatctggtttcacaaggtcccaggaagccagaagtctcctgcagccacgcgaggtctgtccacgaggcctgcactgcgtggtcgtgctgggtagacacaccggctaggagacgaatgtggaagagttgatttcaactaaaggatccagagtggggtgagggaggtgcagcgtcggtacagggaggcaggaagcaggagcaggacgggttgaggcagcagcaccagcaacgcctgtgaaaccccttgtgcatgtccccgtgaggacccctgatgcctctgctgcctgatgctgcaaacgtctcttgagtgagagctcagtttccaaatggagtgacaaggagcagaacttctagacaccggaagtggaaggttgctcaaggcagatgcacaaataaatgacaaatggcagtttgataaccaacacaatgctaaagggccacaggcacaggccacagagaagggccatgggagcaggcaggccacgcaggacacggagaagagccagggaagcaggtggcccatgcagggcacagagccacccttccgggcagggcaagcggcctctcatcccacgtcacaacccgcagctgctgctgtgctgcagggaagagtgacatcacagacacccctcagagcccctgggaaaagcctaaaggaggctctggaggctccaccaaagaccgtcggcaccaacggctggcatgttccttgggaaattagaggagggcgtgtctgccaaaggtggatttataacaagagcccaagagtgggactcactcttcccggggatcccacctgctcccactcctcaccagggagcagcatggctgtgtccatgtgtccctgtgtgtacatgtatatatgcatgtgtttgtgtgtccttgtgtcccgggtgtacaggtatgtgtgtttgtgtgtccatgtgtccatgagtacacatatgtgcatgtgtttgtgtccatgtgtctctggtatacacgtatttgtccacgtgtccctttgtgtacacatatgtgaatgtgtttgtgtgtccatgtgtccctggtgtacatgtatgtgcgtttgtgtgtccatgtgtccatgagtacacatatgtgcatgtgtttctgtgtccatgtgtctctggtatacacatatgtatttgtccacgcgtccctttgtgtacacatatgtgaatgtgtttgtgtgtccatgtgtccctggtgtacatgtatgtgcgtttgtgtgtacatgtgtgtgcatgcacatatttgtgtgtatgtgcgtgcacgtctgtgtgcatattctgcacatgagaaccagaacgcctgcatgcctagcagacaagatgcctgctgtctctctgtggggtttggagaagcacatcagtacagtcaccaggctgcctaaaacacgacaaagcaaagccaattagcaatgctgaggactctcaggccaggatgccgccctaggctgccttcccaagtcagctagcttgacaaaagctttcatatcagtgcctgcaaaaacaccttctcagcacacagctcaaatgttattaaataattccatggggaaataagactttatacacaaaagtttgctttataaataatttgtcagtaatgtatagtaatgcatgcattcataaatcatggttaacagaagcagagacacaaccggatacgacttcttcagaaggcctagaaaaagagtctatttgaataaagcccagagggcctatagaatccaaagtatgcactcccacaataccccaaaacaaaagcaaaacaaccatgacatttatcctacggacattctaatgctgatagtaaggttaaaatccccgtccacataacacacccacacacaaacacaaactggctgttgccactagcgctccgtggggctgaagatggcaagaccccaagcctcaggctggcatttccagaaaacaccctcgctgccacgcctacacaaggggaagactggcagagacggctccttcctcctgacccagaagccaggagagaaagctgatcagtcgcacaggccgggacccagcatgccctgccactctggcaggtcctcaggcaggagtgtgagctcctaatgtctcaggagagacaggggaggagagaggaggcagacgggcaggagggggcctgtccctccagggtcagctcagccctcagagccacttgtaggaggtctgggcacaatagatacagtgactcctctgagaagctgcactgtgatgggacctggggtatccagcaaggggggcgtgaggctccgactggctgagtctgtgtcagcgtcagcaacagtgcccatcccgagctctttcccagcgcaccccaggacatggtggaaggtggaagaccctgcctacgggcagctcagagagcaggtggcagaggccagggtcggcctgcatgcagacaagcaggccgggcagcgggaagaagctcccggaaagatgggagcaccaggccacatggagcttggacagggcaaggagtcagggggagggaggtaacagcccctgggaaataataaagcacacgaacttgtgagacacaatcccttccccagattcccaactgtgtgatcctggcagggacccagcccaagcctcaggggctcacaggcagcgatgggccaaggaagggcttcagggcccagcgactccctgcaaactgagccctgtcctgcacaggtgagaagggaagggatggctcccctgccagttagagacagaggcttggtgcctgggggactccagccacccatcctgagccagaatgtggacgtccactccatagagcacacgaagaggataaaacagcagggtgcactccgggaccgcaggctccccccagcacacatgggtccctgtctgggcatgcacaccgccaggacacagcagctctgtggaagacgccatgcagaagcctcttcagggcaccgccatgagccaccctcagaacctgagctccaggcactacggacgattttaggaaacctgtgtctgttgcatttcgaatattctgacggggcttcccgttatttcaggagaagctaattccccacacagttagtgctcaggagggaggaatctaggagctcacttggccctaaagcccgtggtggctgcgccgtacttctgcccctcctcccgcggtgactgtgacaacaggaggggccacagccgccctgagcccctggttcccaggtgccagtggctgcagcacggaggccacctacggttcccagagcacgaagagctcctacgtccagcaggggatgttaagggtcacaccctcgaggccacagtgactgccccaaagtctgaggcctccccggttcactcctgcctccctcccctgctttcctgatgtaaacacagacacaagcatacacacttgcatggacacacaggcactcacactcacagatgcacactgcaacacatatacacacattcacacacaccgcacacacattcacacactgcacacacattcacacacactgcacacatattcacacacactgcaaacattcactgcacacacatacacacattcacacacactgcacacacacatacatacattcacacacatacacacattcacacacactgcacacgcagattcacacactgcaaacattcacgctgcacacacatacatgcacacacactgcacacacattcacacactgcacacatacacacattcacacactgcacacactacacacacattcacacacagcacacacattcacacacattcacacacactgcacacacacatacattcacactgcaaacattcactgcacacactgacacactgcacgcacattcacacatacacacattcacacacactgcacagattcacacacattgcgcacacatacattcacacactgcacatatacacacactgcacacacacattcacacacactacacacatacacattcacacactacacacattcacactgcacacattcacacactacacacacatacatacattcacacacattcacacactgcacacacatacattcacacacactgcaaacattcacactgcacacacattcacacactgcacacacacattcacacacatacacacattcacacactgcacacatacagattcacacacattgcacacacacattcacacacagtgcacacatacatattcacaaaatgcacatatacattcacattgcacacacacatcacacacaccacacacattcacacactgcacacacacactgcacacacatacacatatacacacattcacacactgcacacagtcacacattcacacacactgcacacacattcacacacactgcacatgcggtacctgtgtgcacccgcatgtgcctactgtatgcatgcatttacacacttgtgcatgcactgcacgtgttgcactcacagtcacatgtgcacaccgtgtgtgggtgtacacacagctgtacctactgcacatgtacatgtgtacacatatgagcacacacatgcacactgtacacacacgtgcacatccacattcatccacaatgcacaaacacatgcacacacacacaggcacacacacacagccatcttctcccgaccgcatcccacaggaggggcttcctcaccccatgctgcctgggtttggggcaggcccatcagcatctgctcagcttgctctggaggactttgccccaccgttgtttgtgtatttcccatcgctctgccacagagcctctgggtgctgggtgagggtctacttccaaattcctctcccgggcattccagctcctggcttctgtggcctgctggctaaggggaaggcacagccatgggtgggcgcccagcacctcaacggcccttttcccaccagggacccctccaaagcacccgtggcacctggggagaacctcctgccagttgtggacacctccctgcatgggacactgagtgagaggcacttgaaaatgtgaaagcaaggctgcaatgacggccgagccagagagcagcacctccctagcacaccctgcacccagcggaggtggctgaacacccgcgtcactcagcaaactccacggtgatgtgggccagctgaccaacttcatctagagccactgggctccctaaattcaagtccaactctacccctgccactctcacgcttcccaccttcatcttccagtgcaggactttggagcggcaaacggttattatttagaaggaggtcacatggtgaaagtccaagcctcctcaccttctagtcaaggcttgctgataacattgtccctaacgaacagccgcagcagcgcgtcaggcagaatgagcctctgtttagagttggtaacgaccgcctgaaaatgtcgtggtagaaataaaaccatgcaattcagtaggggaaataaaatacatatccagatggaactgcactgagacgctggcacactgacatctcaagttagacaatcatttaccactcaaagcaccgtggagtgaaggtagcttcccagggcagtttgctgagctcttcctgcgtgctggacacacacggtccaaagatcgtgctgagctcttcctacatgctggacacacacagcctgaagttcaccgcctaagccacactcctgtccatacgacagatcgccatgggccacacgtgacatgtgcatgggtacctgcagcagccggtggcagcaggtgacagtggggaccatcgagatggcccttgcaacagtctaggaagagactcactgccccagattcacctcgagactccaaatggtctcaggtcccttgcggggaccaaaggccgggagccaggagccgtgggctctctcctaatgctcttcctccatgcccaggctccaggactgcctcaagtgtgcactgaaaactgccccattccgaaaagccagcttgcaccttcttgttcctggtagggttccagaacagcgatgctgcttctcacgtggggtccctggtccttgctggcactttccttgatgcccgggaggagctgtcccatggagttttggggtcctcctcctcttccctcccttttctgcctttacacgaagagccccctgaccctcacctgctagagcagtcgaggtccgcctgttcacaacagccctcctggccatgggctctcctactccaggccccacagcccccaagcctggtgacattcccccaggtcactttctatctgctccaggtaggctacctcccagcccccaaggtagtgcatgcttcgtatgtgttccgcaggcccctggcccggtggagcagtgacttgctcagaaactagcaaggcctctcggtagtggcctcccactgacctggctccccacctgccatccactatgctcctggtgctggaaacacccccatgtggctcagagtggtccccagaggcccctgacacagacacgagcacatacctgcaggcacacacctgcaggggcacacttgtggatgcacacctgcaggcaggtacatacctatgggcacatacttgcaggcaggcacccacctgcgggcacacacctgtgggcacacacctgtgggcacacctgcaggcaggtacacaccgacgggacacacctggaggtaggcacccacctgcaggcacccacccacaggtgcatatatccccccatgtccaccctctgcacagcccccttgccaggctgccctctgcacatttctgtttggtcccagactctgggtgaagggatcacctggtgccatcatcagtctatcaccagccctcagagaagtgcctcagcaggaggcctggcagaactgtgtgaggctgcccagcagcacagccccgggtacacagcgtggcatttgatgagtacagctggaaatgaatgagcagaggcaccatgaggacatggtccaggcacacatcaaaggcggtggccagaggccgcctggctccccatcagcaggagcttcagccctgcctttgggtggaggcccacagagccccgccatggaacacagaatcagagtctgcgtgggggctgcgtccaccccatctgtttgcccagcttctctctctagcatgctcagaccccacagaggcgcagggctccttcgcctccccaggggttggggacccctggtctggaggaccagtggggacagtgtctgctgcggtgtgatgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggcgtctgctgcggggtattgtctggcagtgaggctggggacggtgtctgctgcggggtattgtctggcagtgaggctggggatggtgtctgctgcggggtgttgtctggcagtgaagctggggacggtgtccgctgcagtgtgatgtctggcagtgaggctggggacggtgtctgctgcggtgtgatgtctggcagaaagagccggggccagtgtggctgtgagcatcaggcctgaattccgtgaactgaggaacagcctgacagagggacccagcagcagcggcctcaggacaggcacaacggccacttcccggcttaacctgggcagagagacgagagccacttcccggctttaacctgggcagagagatgagagttctgtaatttttgaagattgaattcagtctgataaataattcaaagtacattgcctgaccccattaaaaaatggagttcaaatatgccaaatttttaaaacttcatccattggctgcacaaacaggaaagtgggctccagtggccctggctggtggttcagatgccgctgtggggccggccttcaggggtggtggggtggcccagctgcctccaccccagctccctcccacgtctacatccaagatgtctggcttccactttccgtgtcactaaagggcggggaagctgcaggggaggtgcctcatctgcagcgtcgtctccagtgactggcacctcagacagccccacacccgcggcaggtcccgcctggcactcgggaagctcttgcatttaagagatctagaaatgttgacactttgcgtggaattttaaaagctgcttaatcaggaaggagccagtcaggaaaagggacctgccaacctgcttgttagccgagcagcgaggcactgtgagcacacgggatgatgggtgctgggtgctggagttgaccggctggcccggcagagctggttcccgcggggaaccccgggggcgtggtgctcacagcaaccttgttagaagggacactggggagggtgtgtgctctctccatctggagccgcctggaagccagggagcatgtttttgtgtgagtgttgattgtggacaacgcccagaccctgcctgcagcacagaggaattccaggtgtcaaagcgataggaattcagggagatgatggacgtgggctccacaccccaccttccacctcaaggaggtggcagtgggaacccttacacgggggtgactgagcatctgagcgggatcaccgtggcctgggggcctgcccctcgcccctgagagctcctggttagagccgttgtgggcacagcctaagcttctgcaggccttctctctcacctctctcatatccttccatcatttaagtagattaaactcagaaacatttttagtgctgtgtacaaaccaagggcagcaaaaaacccaacctctatgccaggctgagcttctgttcttcctgactctacagcaagagctctgggcatctctccacgtgaccagctgtgaccacggacttaggaacactgtttcctacctccttcacctcacctccctgccacctccagcccgtaatttagagagaagctgatgcagttgactcttcccagcttgccatttaaacgcacactgggttatgtgcacagagatgctgccccagtgactgtatttgggtaactgtttcaccctcgtggtgtgacagcccatttgagcgctcttcaaggcacgagatcctcagcaccgtcaacaagtctgtgtctcacctgcaatcacagctcattgagccgccagctaattagagagcccctaagtgaatcagtgacacaatgccgcctgcaaaagcatcagagccgcggccgcacgcacacagagcggggtgtgagatatcccagccgcacacacacagagcggggtgtgaaatatcccagcccagacgcgtgcacacggggcgggtgtgaaatatcccagccgcacgcacacagggcgggtgtgaaatatcccagctgcacgcacacagagtggggtgtgaaatatcccagccgcacgcacacagggcgagtgtgtaatatcccagccgcatgcacacagggcaggtgtgaaatatcccagctgcacacacacagggtgggtgtgaaatatcccagcccagccacaaacagggcgggtgtgaaatatcccagccacacgcacacagggcgggtgtgtaatatcccagccgcacgcacacagggcgggtgtgaaatatcccagccgcaggcacacagggcgggtgtgaaatatcccagccgcacacacacagggcgggtgtgaaatatcccagccgtgtgcacacagagagggtgtgaaatatcccagcccagccgcacacagagagggtgtgaaatatcccagcccagccgcacacagggcgggtgtgaaatatcccagccgcacacacacagggcgggtgtgaaatatcccagccgcacgcacacagggtgggtgtgaaatatcccagccgcacacacacagggcgggtgtgaaatatcccagccgcacgcacacagagtggggtgtgaaatatcccagccgcgtgcacacagggcgggtgtgaaatatcgcagccacattgttgttgaaagccgttgccgggcctgaaaatcgcagctttttgaacgcacacactgaacctccccggctttgttttctaggaaggacgtggcggctgctgcccaactttgaacggaggagcacaggaggagctccaaggcccctcaggagtcgccactgttgcctccggtcacccccaccttctgttggagtggccttcagggaaaatgccccaaaggggcctcctaggagcccctgcccgaccccgccccagatgctccctcccatcgccaaacctcgtctcctcatctatggaaggagaacaaggagacggccctcacctagcagtgtaaccctgaatgccaaggccatgcctggtgcagaaaggcccaaacaccagcctcaggaggcgcggccatccccgtcatcacacctggtttctgctttgacctttgctgccaataaatgtgagcagctgccatcctgtgcccagtccccggggcatacctgcagcccaggctggctgtctttgcttcccagacacctgggaagtctgggctctggggaagacattctgcagctctaattttaaaactatttggcattttcaaatccagttttcaagtccctggggtgggtaaaggatgcttcaagaagaaagtgctctgagccagagtaggaacaatggtgaagggtccaggatggcacaggacgggagcctgccaggtggttctgccagggcccaggaggacagcaaagtcagctgacggctgggaccaagagacagaaacagagagacagagacagagagagacagagacagaggaacagagacagagagagagacaaagggagcaggagagggacagagacagagatagaaagagacagagggatagggagtcggagacacagagacagagagagacagaaagagacagagagagacagagagacagagacatagagacagagaaacagagagacagagatagagagacacagggagacagagagaaagaatcagagacagagatagccagagaacagcagagacagagtcccagcagttgcccgtccactctctgcctgacctgcaatctgcctcttctgaccttggatgtgccccaaccagagcttttgcaggaggggctgctcactgtggaggggagcccagagctggaccatcaggagacccaggacagacgccccacagcaaaagccaggacacctgaactggtcaggccagcagtgactcagggcctggagagccccgtgggcagaggctgcctggaaggctccaccggccaagggcaggtcagcaaggcaagtcatggccagaaggcagaagggccagcacaaaggccagctttataggtgcagagcgggagccaggcgggggcactgggagcacaggcatggttctcggggtgaggacgcctccttggccccactccatgtcactggtgactggtcaacaaggtgcaagctgctaccttcacagagggtgatcctaccggagacagatgagcctcactcactggccataacgtgcccccgaccccctggctccctctgcctatgaccaggccaggccccctgcagtgggtgctgctatcacaattgagggctgaacaccccaggggaaactgagtcctttcagggcagtaataagggaaggtttcgaccactgttagctgcagaagggccaacccctttacctggctgtccctctccctgggagcttgctgggccacccctctactgggctgcccctctccctggggtgccttctctacctgagccgtcttctccacctggaccaccccgtccacctggaccacccctccacctggaccaccccctcacctggaccgccccctccacctggatgaccccctcacctggaccgcccccccacctggaccgccccctccacctggatgaccccctccacctggaccaccccccccacctggaccaccccccccacctggaccacccccccacctggaccacccctccacctggaccaccccctccacctgggcctccccatccacctggaccacccctccacctggacggccccctccacctgggcctccccccaacctgggccaccccctccacctggacgaccccctccacctgggctgccccctccacctggaccaccccctccacctggggtgtgccagagggagtaactgtgggatggaaacaaaattcgactctagtgggtggccaggagaggtcacgtgctgcttctcttgtgttgtgaatgcagcggtcagccgcaaaacaccaaatgacacccagtcactggaattcttggattaaatgcttttgatgcacatatatcctctccacacactgcataattaactgaatatccgacaatcggcagatccatactgttgaagctggactagccacaacttatcattaaagtattcaattacataatttataatgaaaagccacaatcaacgctaagcaataccaatggtcacaattcatcagggtccttcccaaaactgtgggactctcagcagagtccacatgcacgggacgggggcaacacagccaagccccatggggcaatccagcttctctgcagacactgctggcttttagtttgtgccaaattttaataaacgttaataactcacttgataggtgtctcagcccatgcaggctgctataagaaaataccatagcttgggtaattgataaacaacagaggtttctttctcacagttctggagatacccacagattcggtgtcggtgagcgcccactttttggttgggccttcccctgtcatctcacagcagaaggggtgaagaagcgtcctgaggcctctttcagaagcgcattagcccatccgtgaggctcttcctcagggcctcagcgccttgcaaaggcccctaacaccatggccttgggtgaggatttccatgtaggaactggaggcgtggggtaggcggacacaaaccttcagtcgctatggcaattgtgactaataagtaatttgtacttatatacaaaaatgaattcgtttgacattcttttagggttaaaagctgcaccatcaaaagacggtcaggttgttccctcctcatttaagccaattttaaaacgatttttcctcctacaacgtgaaaatgatcacagggtgccatcaggtgactatgcacacttcgtgctgagctggcagaggagggtctagagtgaagcccatctcaagccaagtggaactggtccaaatggaaaaacagccccccgggacgtcttgtcttcggagagccgcgtctccggggcccgggcaggccctgtggtctccctgcctgggctgtacttgctcagccttttgcaactgcccggtaccaacggtcaaggatgagaattgcagcagagctttaaagacttgggtcccaacgtcactgtctattgactgagtttttcaagtggtttgagtcagaagtagggatataccttcaattagagtcctgaattttaggcattacttaccaaaaacactgagcaggtttgcccagaaaatacagtctgcatggaacttccacatcccctcactctctaccagaacggcagcccacctcaaagacaccgcacgcggcccacctgccttgcaccccagacaccagggttgaaagcctgagtccaggcaggagccaacctcacagagtcaaatctcggagcaccaggtgaggggaggtctcagcgccactgccgggataagccctcaggatggagacagtcgcatctgccagatccctttcaccagactgcagagtgaggtgaaaccagggcctcataggtgtgagggccatcggggaggtgccgccggcagaaggagaggtgggaaggctgagtggatggaaggatcaggaatgaccaggaggaagctacagtcaatagctgatggggcttggctgtgttgccccccagcccggtgcatgcagactctgctgacagtcccacggtttgggactctcgtttcactcattcatcatttattgagcatcagggaatatgaaagtggccatgggcctccaaacagctcagaatgtaaaggggaagagctctgtgctgtagctgcaactccagccacaaggaagacaagacccagggctgtgggacgaaggggagagaggactcaggccccagctgcaggattcgagtgcccttcgggagtgagctcgcaggggaggaaccctcctaggacagggcacgtggagctccaggcagcctctccagggccctgcgtgtgctgtttctctgtcttgaaaatgacaccgaacgtttatggccagtgagcacccaccgcaagcccacactgtgagctccttgcctgctggggaggccaggagatgcagaaccaagggcagaagcactgcctgcagccctgtcccagcgtcgtggatgcagacacgggaggagccgcagacagacgcgggaggagccgcagacagacgcgggaggagccgcagacgcagggggagccgcaggcacagggggagccgcaggcacagggggagccgcagacagacatgggaggagccgcagacacggggagccgcagacacagggggagccgcaggcacagggggagccgcagacagacatgggaggagccgcagacacggggagccgcaggcatgggggagccgcagacagacatgggaggagccgcagacacgggaggagccgcagacacagggagccgcagacacagggggagctgcagacacaggaggagacacacaaggagccgcagacacagggggagccacagacagacatgggaggagccgcagacacggggagccgcagacacagggggagccgcaggcatgggggagccgcagacacagggggagccgcagacacaggaggagacacacgaggagccgcagacgcaggaggagccgcagacagacgcgggaggagccgcagacacagggggagccgcagacacagggggagctgcagacagacatgggaggagccgcagacacagggagccgcagacacagggagccgcagacacagggggagccgcagacacaggaggagacacacgaggagccgcaggcacagggggagccgcagacacagggggagctgcagacagacatgggaggagccgcagacacggggagccgcagacacagggagccgcagacacagggggagccgcagacacaggaggagacacacgaggagccgcagacacagggggagccgcagacagacatgggaggagccacagacacgggagccgcagacacggggagccgcagacacagggggagacgcagacacaggaggagacacacaaggagccgcagccacagggggagccgcagacgcgggagagccacagacacagggggagccgcagacacagggggagccgcaggcacagggggagccacaggcacagggggagccgcagacagacatgggaggagccgcagacacggggagccgcagacacaggaggagacacacgaggagccgcaggcacagggggagccacaggcacgggggagccgcaggcacagggggagccacagacaccctcacactccgggatctagcgtgtgtggacgagcccgaggcgctcggcccagcttgtcagcagccttcctgggaacgctgtggaaatgtgtggaggggccgcgtggcttcctgctgcctgggacgacattactgcatctgcatttgaggtgtggggcccagaggggctcaggtaccctacggggggagtcaccccatgaccaggaatcacgctgtggccacacacagggagcctgactgcagctttctggaggagaacgtggttgcatttcacatagaaacacaggtcattttgtttctgaagaattcattccgaatatttatttgctacttgacaaagaagagacttcatcagggataagatctcgacaaagaccatctcctggctgccttttatattcaaatccaccacagatcaactcctggggcgtagcagagtcctgtctccccccaaaatagggagcactttctgattgtggggttcaaaaagctgccttctgagggtaaagggtgttcttaccaggaaagaggagacagaacaatgaagtccccaggggccggcagcagtgccgaggagccccggggaagagctcaagccagtggccaagcctggaccagcctccagcagggacagcaccgtggctgtggggacagtggggacagcgcctcggggccacagagacgtgctccctggacgttggcccaggtgcctgcccacttcctcggagggcctctgaacaagctgcagggctgtctccatgggaaggcgcgcacctcctcacgcctctccagggaagccacagcttcactgtgctggcagacccactctgttttttctacattgcctagagttcggctatttttctcttcccaaagagcctacccagcaaattttactggacaaagtgcctggaacaaagcagccaacaataaaactggcgtgcaccccatgaataaaggcgtcgcccagaaaatgctctaaattaggatttaattgctagaaattactttcaattacaaaaattgcaataaattacttgttgaatagacacattctttcaccaccattaataatttaaaattgctaattgcacgtaatcgcaagtaatttttgttctttggtgagaatcgaggtactacgttatgtggggtgggtttgccagggctggcccccaccctgcgcacctccacgtgtggcaggcagagccgaactcccagaagaagagttgcagtgatggggcctccaccgccaaagccacggacctggtgcagttcataaggtggcctcctccctccatcagcccctcagggacaacaggtggccaagggggtgaccttcccaaggagctggtccctccgccatcctgagaacagtgaatttgtatttgcagtaaaacccagattctccagaaaacgtcttgctgtcagcatccccgccgccttacacgtgctatggctgccctctgactctgctgcctgacttttatctgcacaaatcctacagtctcctgggagcccaccggtcagccagctgcctccaggggtgcgtctcctctcagcttcctcttccatctgaaccttccctccctccccaagtgttcgtcccttgtccacctggaaagcctctctgcccttgaagcacagctcctgccctggccccggcaggctgtaaggtagcacccccacatcccggtcctggtagcacccccacactctggccccaacaggctgtaaggcagcacccccacaccccggccccgacaggctgtaatgtatcacccccgcaccccggccccgacaggctgtaaggcagcacccccacaccccggccccaacaggctgtatcaccccccacaccccggccccgacaggctgtaaggcagcacccccacaccccggccccaacaggctgtaatgtatcacccccacaccccggccccgacaggctgtaaggcagcacccccacaccccggccccgacaggctgtaaggcagcacccccacaccctggccctgggcagtcgtggtgaccgcatggccttgttggtagcttccttctttattaacttggccccatttattaaccaccagcttcctgagggatgaaaccatgcttccagcgtttccaggcccacacagcactgtgccaggggctccagggaagctgatggatgtgggtgctatgacaccagctgctgcggggccctgatgccatggctgggaaggacgtcggcctggggacgctcagctggcaggatatgcctccccaggtgtgcgggcggcctcctcgtagtggaggcaggggcggagggtgcgaggcatgccactgtgagctggggccgagggggccatatgctcaggtgctgtctatcagctctggagggagaagccaaactctcaggcagcccacagcggggtgaggaccgggctccgtcccctctaacagggtggggtggggggcactgactggtcggaccctgcaagatccccacgggcaagagtggctgatcagagctccatgaacagccccttcgtcagaagccatcctctcacacacgtgcacacacacacacacgtgcccgcacacgcacacacgcgcacatacacgtgcacataaacatgctcttctcacgtcgcagtggatttctcttgcactgttgctttaagaactgtcagagcggtgagatgacggcagcctgtgcgaatcggcctccagcctcctcggggtcctgcccactctgttcgccattcggtcccacacctcagccacaacgggcagtcagggcttcagccactccacgggcaccaatgctgaagaccacagaggaatgtgctccagacggaggaggccgggcccaggcctgatggagacacggacgtttgtacctgaagccctcaagtctgccctataaaggagatgaaccctgaaaacactgacccctgaaatcagcaagaggaggcggctacagtgccaggacctaacccgcgctctcccaagtctcctcctcatcacacagctcccgaggcctgccagaagcaccccttgaaggcactgtcagggccttgccacactgctgcacgaggtgcacacgcaggggctgggacatatagctctggccttgcctccaagtctgtctccaaaacaatgagctggggaagagaaactctgtacggtcctccctactcccttgcccggccggggttgtggtcaggccaccctgggaaagaggagcagcccagggcagctacagaggctcctcctcccacctggggagaggaatccgccttcagggagcagcccatgccctccctggcttctcctgtctggcatcacggctgcggcagagtctaagagaaaggctctcagccgggcaggaccaccaggcacacaagggggggatgggagttagaggtgccagccctgctcctgacctccctgacctccagcacataacagggaggccaggtccttgtctgacacacccagagaatcatcagatccaaggcccggggtggccggggaccaagtatggctcctatgagaaaacaggcgtctgcaggaggcctgagcctgccccaccagcctcagcacgtaacatgtctagaacattcctagagccagaaggatgtaggaacttccttccagaatacacttcccagtggacagggaaatgggaatcgaatgcagggaccacccaccacctgccaggggacctctgaccccagggaggaggaaacaaggtcaaatcccaagaccagcctgtgcaacatgatgaaaccccgtctctactaaaatacaaaaaaaaaaaaaaattcagctggacgtgaaggtgggcacctgtaatcccagctacgcgggaggctgcgggtgaaggtgggcgcctgtaatcccagctacgtgggaggctgcagcaggagaattgctcgaaccggtagcagtgagctgagatcgcaccatttgggcaacaaactgaaattctctctcgaaaccaacaatcaatacaaaccaataagcccagaacccacaacttcctgatgtagatggacatgttgtgtccggaattggtgggttcttggtctcgctgacttcaagaatgaagccgcggaccctcgcggtgagtgttacagtttttaaagatggtgtgtccagagtttgttccttcaggtgtgtccagagtttctttcttccggtgggttcatggtctccctgacttcaggagtgaagctgcagacctttgcagtgggtgtcacagctcataaacacagcgcatccagaattgttcattcctcccagtgggttcgtggtctctatggcttcaagagtgaagctgaagaccctcacagtgagtgttacagctcataaaggtagcatatccggagttgttcattcctcgtggtggatttgtggtctcactggcctcaggagtgaagctgcagaccttcgaggtgagtgttacagctcacagacgtagtgaggacccaaagagtgagcaccagcaaaacttactgtgaacagcaaaaaaacaaaccctccacactgtggaatgggacccaaccggtttgctgctgctggctctggcagcctgcttttatccccatatctggccgcacctacatcctgctgattggtccattttacagagagttgattggtccattttacagaggctaactggtccgttttgacagagtgctggttggtgcatttacaaacctttagctagacacagagtgctgatttgtgcatttacaatcctttagctagacacagagcactgatgggtgcatttacaatcctttagctagacagaaaacttctccaagtccccaccctcccagcagcccagccagcttcacctctcactggtactcgctgcaggactttgtggcccctagcccgggcactccaggcagcccaatgggagctcgtcccagacaaccaagagaaaaagaggggaagcgagaaagagacagagacccaccatcatggccaacgacccagggaagagggaatggcagtcctctcacgggatccagcctccaatcaagcccagcaggtgccggccagtcccacggagtgccaggcccgctaagcccgtgcccacccggaacctgcgccggcccacaagccccgtgtgcagccccggctcccatccgcgcttctccctccacacctccccgcaagcagagggagccggctccggcctcagcaagccccagagaggggcccccacagtgcagcagcgggctgaggggctcttcgagcccggccagagcagacaccgaggcagagaaggcgcccagagtgagcgagggctgctagcacgttatcacctctcaatgtggacttgaccccacggtgtgccaggtaaaataaaggtctccttagttccgtgaagacagtcgaggtctgtgcacttaatccagagccccggacggcccccacgccccaccgctgcccccgaacccacagagccccgcggcggcccccacgccccaccgctgcccccaaactgcaccaagacacagcagtttgctctcaagcagtttaaactcgtctaatgctttaactggcctgtcaaatcattgtttcacagaccgcataatatgaattgtgtcccttccatatctggaacaccaaatcctaaatccacagccttcaagcacatctggttttcccgggcccaatcggaaagcaggtcctctccggcctgaagctgcgaagagaggcagcagccatgagaaggtggctaaccccgtcgggggccatggctgcctaggggaggccggcagagcctgcctgggggtcggtaaggacgctggctttggtctgacaccggcagggagggacagcgacgagggcaggagccgcggctctacctgggaacgcaggatcatctctactctgacggctcagcctctgcacacaaaccatccttctgcgtttaattggtcctctccaggggatgttttttgaaactaggtctttgaagacctttcatagcagccctgagataccgggtggagagggcagatggagagagaaccaggagatgaaaggaggagccgagagagcctgggggagccggacgggtgcggcccgacactgcgtagagacgcggccgtggagtttctccaccgtcattaaaccccttttttgctgaggaacgtgttatcaattttaaaattttcccaaatgttgaacaatggaagtgttgtttgcagagagagctcaactgtctaaagtagagaaatagaaggtctcccgagactgaaatgacaaagatggaaagcgggaggggaggcctcacggcagctgtgcccagaaccagcacgctgtgaacaggcgccaggccctgcgccggcccacggctacacggtgctctggaaacataggctagcgagagtctaaagaggtggtgcaggctcaaagccatgtgctcgtcatcacagcttccatttaaatcttgagggctgggcgcagtggctcacgcctctaatcccaccactttgggaggccgagtcgggcagatctcttgagatcaggagttcaagaccagcctgatcaacatagtgaaccccacctctactaaaaatacaaaagttagccgcgcttataatcccagctgcttgggagagtgaggcaggagaatcacttgaaccggggaggcagaggttgcaatgagctgggatcatgccactgcactccagtctgggtgacagagcaagactccgtctcaaaaaataaaaatgaaaataagcaaatacattttgtgtatggtttaaaagcatataaaacagtagtagagtcatacacatactcctaaataacaaaggcaaataggaataccaggagtgcatgctttgtgtgttttcatcaagaacatagtcaccaaaatccaagcggatgggcacagccatttgcatgtaactttacagtataagagacattgtcatatgcccacagtctgctatgaagacacagatccagactggctaagagcacagaggtgcatggaaatgctcgggtgtgtggtgtgcgtggtgccctgcgcatttgtgctggctttgcacccccctcctgccacgtcccgtgcaaacgctcaggtgtgtggcatgcctggggccctttgcattggtgctggctttgcacccacctcctgccacgccccaaaccccaaggagtccaggagccaggagagcccaaaatccccatccatgctcctagaaaggaagtttcttgacaaaggtctgagtcaaccatgggtaaagccagaataaaccctgctagttcttttgaggtgtgaacagtctcagctactctgagccccgcataactcactttggtcaccagaggagcaggatttacagggtcaaaagccatttctccttccagaggctcccagctcaaagcccagccatcgtctcccagacattttgggtcgcatggaaatctgcctcttaagagacctggcctcctgtctagggttagagaacactgtgttcccagaagggacagtcaggcctcaggatcctctcctgagaagccctgaactcaagtcaaactgagcctgtgttaacagggtcctttgccgctaagaacccaactgtctcaggagtggctctgcctttttttttttttttcctttctattttcagacaaatcgtcactcagcatagtaaacccaagatataaaaaccaacaattgagtaactggtcttttccgtctgtcttgggaaagtagcttatcaaaagtaagatgaaaaaagagtattttattgttaaactctataatgaagcaactgtctttgactacacaatgtgggaacttgccagtgaatgtagaagtactgcggggccatgcgtcagaggtgtgtgggtctaggagacgcagatcaggagtctggcctggctcagatgtccacagccaggaagccgcgggcagagcagcggggtcgaggctgcggctgagtttgtgagctgtggcagccatacttactctgcagggcatgttgagttctgaaggagacagcactgctgaagtgagcacagcagcaggacagacggctgatccctccttgtgctcccacacacagcagcgagacacaaacggctcgtccctcctggtgctccacacacagcagccggacagacggctgatccctcctcgtgctcccacatgcagcagccagacacagacggctcatccctcctcgtgctcccacacacagcagccggacagacagctgatccctcctcgtgctcccacacacacagcagccggacacagatggcttgtccctccctgtgctcccacacacagcagcgggacacagagggctcatccctcctcatgctcccacacagcagcgggatatagacggtggtccctcctcgtgctcccacgcagcagcaggacatagacggctcgtccctcctcatgctcccacacgcacagcagccggacacagatggctgatccctcctcgtgctcccacatgcaggggcctcagctctcaggaggaaaacactcttgagagaagagaactgaggaaaggtagcgctgatgtcaggggaagacgcattcgacaacacgcatgaaaaaaaacacttcttgttacgttcatgccatgcttttgtattcgccacaataagaaaaccaagcaagtacttcagtcaggcggcagccgtcacaggtaaacaaactcctatgtgggaaatgaaccgaggctgtgagcctcaggcagctccccagacccccaagaggagagggagcagtgaccgagcaggccccgtctgcagttcacaccgtctgccatccgtcccagagcccagcctcttgtagccaagacggggcaggagacagagcaaaaccactgagaccaccactgagagggtaaccaggcttctcagtagaaccaggggcttgccgcagggacgggagctctgactggccacgtcgtggagtctgcagctgcccatggtggagggaatggcatgcaggtgacaaggacatagggaccttgctgtggccacccgccggggtcacagcatgtccacggcaccctgatggaagctttaatcatcaacggtgttggccgccaatggcataatgaccggacctcaccccacccgcagccctagtggacacgcccatgcaggtgatcagcagtgccgtggcagccacagagacaggccaccaccactcctcaggccactcaaagccaccagcccctccctaatggcctcctgagcaccagaaatgcagaggggtgacagcatgtctcagaacacactgtgagcacagacctagaatcaccacgtcgttcagaatcgccacctcacagagaagcaaacccaaaggcagccagcgtaggagccttttcctcaggagggctgtgtcctgctcctaaaacatttccagggttcgggcatcaagatcagatcacacgttaatcaatcacacgtttaagaacgcctgaaagacatgttcatagctatattcgatgtcgttggattttccaacatggactgatgctcttcaattctctcaagcgcgtttacacacacacttgtttgcctgtgtgtttttgtgtccaatgtgtgtcgtgcacaggtgcaatccaagtgtgcaccggactcacaagactcagtattggcagcgtcctacatttagagagaatccagacaaacagctggtgggcactgggcactgttgtgtgccaggaactctccgagtcagccaggcactgggcactgttgtgggctgggcactctccaagtcagccgggcactgggcactgtgtgtgtgccaggcactctccgagtcagtgtacatgaatgcacttggccctcttgatgctctatgagtaagtgctgctgggacacacccatttcacaggtactaaagctgagacagagatccactctgcaaacccttgcccagtgccactctggtaataggaagagtgagaatttgagctcaggcagagccactgtcggtggttttgacagaaattatggactctttctgaacttcctaatgagaatttaggaggctctcaggtgccccttcctgtcccactccatagtttggcgtacggactccgcttattcctgaccctccctgccatcccacctctgtcccctctacccacacctcccgcaggaaggcattcccacccagctcctctgcccgcatccaatggagtgagcaggtgcaggcgatgaatgtactatcaccaataattttggaacttctactacatatgtgtatctaccacatgctgcctgagctcgttgagctggacttttaaagcagcagtgcctcaatatgcctggcctggctggcacacgccgcctgcctagattgcatagggtgagcagtctgcctgtgcccccacgagcccggctgtgcccatatgctgacgttatcctccactgggtacaaaaaggatgacaggaaccctcctcatcacgctcgtcatctcagtaattccctgggagcttttgtttgttttttgttttgtttttctccctgcatctgtcttgctgttgctctcagtggaaaacatacaatatttctgacgtgcccaggctttgggccatgctgcaaatgtatcctgccattgtgaaatgaccttcactgcgctcctgcccagaatgtgtgggaagaaaagggcactcgcggtcccatgggccaaacaaaagagtggtctgggggatcctgtgctatgtagggacaggagaaggtgccaggactcctggtgaacaagacattccaaaggccaagcattgctaactaatgcaaggctgcaggagagaccagcaaatgacaatagccactctcctcagaaggacagggatgtgcccacgccggcttcaactctcccgcccaaccccagcacaagcagagctgagcgctcaggtcctcctccatccatgctgctcctgcaggcgggccccaggaggctggacctgctcttgcctgggtacagcaggcagctgagccccctcctctgacaccagcatcctgtgtcccagccctgcctccacagcttctcctcatcaggcctgccattcccacaccacagagcatgctgctgtaagaggccaggtgtgaagagcccttatgctctcaaccttgtctgatcagggtggaatgaggagtggaacagcgtagagcgcgggctgtctatgtcagctacaccggctaactccggcaaaacctcagtccttgggttagggagacaggtgacaaccccattcgcctctgagctagggaagtagagatgctctatacctgtgtccacacccctcagaggacaccaaaggtttcacagagagagctccacacacctctgaggttggatccagccacacagaggtgtctgctatgcagcaagctaaacacaaccaattcctggtgttgggattaacaagcagcagggcagaccacgagaatgaacatttatcaacagccatcgggaaacatgccctccagctctcacatgttctccaggctccctgggcaaatggagtcctaagtattttatattttttgagctactataaatgggattattatctgatttctttttcagacagttcattctcagtgtataaaaatgctctttatttttgtctgtggattttgtatcctgcaaatttactgaatttattagctctaacagtgtttttggtggcatctttaggattctatatgtaagatcatgtcatctgcaaacagggacaattttaacttcttttgttccaatttggatgccttttgtttcttccttttgcctaattgccctggctaggttttgcaatacagtgttgaaagaagtggcgagagttagcatccttatctggttcctgatcttagaggaaaagctttcagcttttcaccattgcgtatgatgttatctgtgagtttgtcatatatggtctttattatgttgaagcacatcccttctacagtatatctaatttattgagtgtttttattatgagaggatgttgtgttttgttgtatgttttttatacatctaatgagatgatatatggtttttatccttccctcaatgtggcatatcacattaatagagttgcatatattgaaccatccttgcataccagggataaatcccagttgatcgtggtgaatgatccttttcatgagctgttgaattcagtctgctggtattctttcgagggtttttgcatctatgttcatcagggattttggcctgtaattttcttttcttatagtgcctttgtcagctttggtatcacggtagtgctgacctcgtaaaatgagtgtggaagtattcctcttcttcagttttttggaagagtttgagaaggatgagtattagtccttctttaaatgttaggtaagatcagcagtaaagccatcaggtcctgaactctttttatgggagactttttattactaatcaaatctccatatttgttattggtctgttcagattttctgtttctccataatttttcttggtaggtatcatatgcttagggattttccatttcttctgggttatccaatttttggcatataattgttcatagtctcatggtcccttacatttctgtggtatttgttgtaatgtttcctccttcatttctcattccacttgacttttctcttttttcttagtctaaaggttttcaattttgtttatcatttcaacaaacaaactcttagttccattgatcttttctattgtttttctagtttcgatgtaatctctttctgttctgatctttattatttctttcctattagatttaggcttagttagttctttttatagtaccttgaggtgtaatattaggttgtttatttggattctttcttcttttctgatgtaggcatttatcactataaacatccctcttagacctgcttctgctgcatcccataggttttggtatgctttgtttttatttttatttatctcaagagatcttttaattctctttttaatttcttctttgacatattggtggttcagaagcatgttgttcaatttccatatatttgtcaattttctgaaattcctcctgttattaatttctagtctcataccaggatgttcagaaaagatgcttaatgtgatttgaatcttcttaaatttattaatgtgttttgtggcataatgtgatctatcctggagaatgttctctgtgtttcagaagaatgtgtatttgctaccattatatggtatattctgtatatatctgttatgtccatttggtctaaaagtatagtttaagactgatgtttccttattgattttctgtctgaatgatctgtccattgccgaaagtgggtattgaagtcccctactgctacattacagtccatctctctttcttcagacatattaatatttgctttacatacttaggttctccagtttttagcccatatttataattattatatcttcttgatgaattgacccctttatcactgtataatgactttattttacagtttatgacatgaagtctattttatttaagtatagcacttctactctcttttggtcttcatttgcatgaaatatctttttcatcccttcgctttcagtctatgtccttaaaagtgaagggaatctcttgtaggtagcatatagttgggtcctatttttcagccattcagccactctgtcttttgattagaaaatgtaatccatttacattcacagtaattattgacaggcagggtcttactaatgccattttgttcattgttttctggtattttctaagtcctttttcctttcatcctctgtgtctgtcttcccttatgattgggtgattttctctagtgatatgctttgattccttactttctatctttggcatatctactaaggtttttgctttgtagttaccatgaggcttacataaaaatatcttacagttatagcaagcttttctaagttggtaacagcttaactttgatcacatttttaaaatctctacacatttactccacccaccccacgcataaactttaatgtcacaattcatatctttttgttgtagctattatttaagaaatttcatagctatcactgtgatagttttctctttttaccttcatgctaaagacttaagtgatttgtacaccaccattacagtattattctgaatttgactgtatacttatttttatcagtgagttctatacttttgtatgttttcatgttgctagttagcattcttttctttcagcttgaagaactctctttagaatttcttgtaggacagctctggtggtgattaatccctcagcttttggttggctaggaaggtcttttcctctccttcatttctgaagaacagctttgccaagtacagtattcttggttggccatttttttccttcagcaccttgaatatatcattctactctctcttgcctatagggtttctgctgagaagtctgctataaaccttcctgtaactcctttatatgtgatttgcttcttttctctcactgcttttaagatcctctttgtctttgatttttgacagtttgattataatatatctcagtatagtcttatttggattcaatctaatcggagacttttgatcttcctgtacctagatatttatatatttccccagaattggaatgttttctcatattatttaaatatgctttcagtcccttggtctctcttctccttcttgaatacctgtaactcaaatatttgatcttttggtgttatctcacaaatcccataagctttcttcattcccgtttactctttttctcctctgactgtatgttttcaaataacctgtctttaagttcacggattctgtttcatcaattctgcagttgacactctctactgcatttttcatttcatttattgtgttttccacatccagagtttctagaatttttaaaaaataatttatacctctctgtggaatttctaattgcagtcatttactgttttcctgattttattgaattgtttttctatattttcttgaagttcatgaacttccttcaaacacttactttgaattatcgggccatttgtttatctccatttctttggagtctgctgctgggagattattgtggtttttggtggtgttgtgtctccttggtttttcatgtttgttgttgttgttgttgttgttgccttacgttgatgtctgcacattttgggaagtagggacttattctattctttgtagaatggcttcgcctgggtaagcccttcatcaataagcccatgcagattctgggcgtcatctggcatgctccataggtaggcttgctattggggtcctcacgcaggctggtccaatgcctgggttagcaggtgagtgagccttggcctggatccactggagtggacctgttgattgagtctgcaagggtgaacttagagcctggcatccgttaaggcaggactggtgctagggtaggccatatacctgagtctgaaggggctgtcctggggctaaggtgggcccagagcttgaatttgtgggggtgagcctgggtcctggatccacaagggttggcctggagcctaagtctgcagaagtggtcttggagcctctgtccaaaggggctggctggcaccaggggtctattggagtgggcctggactctgagttctggagcctggagcactggggaccagcctggatcctgagtccacagggacactcctggagcccaggtcagtgagggctggttcagtgctggggcctaccaggataggcctgggtcctgtctgctaaccatggagctgcagggccagcctggtgccagagatgatgtggagcctgaggccaatggggtcaacctgtatgcggagtgggcccagagactaagtccactgggcaggtgtggggcctgggcctgcatgatcctacctggtattggggcaggcctgaagcctccgtccttgggtaccagcctggagtaggaagctatgggggcatgtctggtgctgggtttaacttggttggtgggggatcaggaggcagttttagagttagaagcaaagtctggtactcacttctctttccttcccccacatagagggcatctctcaccacaacatgctgctaggcctgggtgagaggggacccagtcatgcaaaactgttttttctgccttttcagtgcatcttatttctgtgccatgcccaggtgctatcacctctcacctggtttccttagcacttgtgaaggtatttttgcacacagatagatgttcaaattgttgtttctgtgatggatgagcaatggagagtcctctcctgctgccttgctgatgtccatctctgacgaatgttgactatgtgactctctttaaaatattcagggaaaggagcatctgattctttaagaagtcagcagataaaatgtggatgctctttgacagaggaggaggaggtctgctgagccaagagcaggatgcagagatggggcatttctgctctggggtggggagttgagaacctcatggcaggaggagtttccaaggcttgccttcattccaccccacttggtgatgatgtaacagcttccatttgtgtttcacagttttcaaaatgtactcaccaggatcaacccacttggtcttcatgactcttttgatgtggatctagctgtgttgctttgtattattcaagatgtctaatcattttcacacttgagggttctagggatttttctgatactatccactcttcccttgatatacaaagtcatatgatacagaatcacacatatttgttgatctggagaaacaatagggatatgaggatatcatttattggaatttatattttgtttgggtttttttagtctaagctctaggagcttcccctcccccaattgttataaattaactagattttggttgatttctaatgttttccaaaaagtgtttattcattggtttttgtctttaaagttaagattcactgggtaaagtaaaatagagttctgtggcaagaaacaaccctgacagatgaaactgaccctggacagtgctgctgtctttggttgtctgacttattacttctgatttgtaataatttctgaggctgaatacagtgttaaatgaaattccctgtctgcaccaatgttcctgcactttgtaactcgattcttgacttcaaataaaagtgacttcttcatatagctttgccatttactcttagagccagctaacactaccagaaccctaacaaaatcacaagaaagtttaactcaagaagagagagatgaaagagggagagaaagaagaggggagtgtaaaagccatttccaaaacaagaggcccagacatcaatttgtaattatctgcccacatgagtctaaaggcttttatttgataaggccagtaatacacaagcctgtaatgtgaattatttcaaagaataaaagcctgattgtctccatgacctgtctagcttttagtgaggcttaagacaagattacattccatacagcccgcaaatggatccctcctctccccaccttcctgcttctttcagaaatgccagggttttctgtgctgccatctggtaagcttccagttccgataggtctcaatttcctcctctgttgagacatctaattctcctgagggtgacggttcttccttgtctgaaatgaagcttctattaaacaaagactgcccctattccaggatgttcaaaagcagatggagcccgcctcctggtgaggcttttccattaacactaaagaatgccctaaatcaagcttttcagttttaaatagggatgaagtctaactgacctcatactttaaaattaaaaggtaaaaactgtgggttgcatcagaaaagaaaatgcaagcttttaaagcattcacaggtaagccatgtagttttaatcctaagagtagtacagttgcattgcttaatggtaggggtacattctgagtaattcctcattaggtgatcctgtcactgtgcaaacatcacgggtgcacttacgcacccccagatgggacagcccgccacacacctgggctggatggtaaagcccattgtgcctaggctacaaatctgtcctacaagttactgtgctgaatgctacaggcaattgtaacacaaggttaagtatctgtgtatcatctatacattaaaaggtgcagtaaaaatatggtataaaagataaaaatgggccgggcatggtggctcacgcctgtaatcccagcactttgggaggtcaaggtgggtggatcagttgaggtcaggagtttgagttcagcctggccaacatggtgaaaccctgtctctactaaaaatacaaaaattagcctggcgaggcagcaggcacctgtaatcccagctactagggaggctgagtcaggagaatcacttgaaccacggaggcagaggttgcagtgagtcaagatcacgtcactgcactccagcctgggcaacagagtgacattcagtctaaaaaagaagattaaaatggtgcagctatatagagcactgaccatgaatggagcctgcaggactgaaatttgctctgagtgcatcagtgagggtggggtgggtgagtgtgaaggccgaggacattactgtacaccactctagactatcaacactgtatacttaggctacactaaatttataaaaatgttttttcttcaataataaattacctttaaatagtaactttgggctgggcacggtgactcacgcctataatcccagcagtttgggaagctgagacaggtgatcacctgaagtcaggaattcaagaccagcctggccaacatggttaaaccccgtctctactaaaaatacaaaaattagccaggtgtggtagtgtgcacatgtaatcccaggtactcgggaggctgaggcaggagaatcgttcaaacctaggaggcagaggttgcagtgagctgagatcgcaccactgttctccagcctaggtgacagagcaagactctgtctcgaaaaaaaaaaatagtaacttgtgtactttataaatgttttaactacttttaactttttcttataacacttagcttaaaacaaacacatagtacagcagtataaaaatagtctctttatatccttattctataagctttttcctatttacacttttcttccacttttaaaacttttttgttaaaaaaaaaaaaactaagacacaaacacacaccctagcctaggcctacacagggcaggctcatcaatatcactgtcttccacctccacatcttgtcccacaggaaggtcttcaggggcaatagcacatgtggggccatcatctcctatgagaagaatgccttctgccggcatatctcctgaaggacctgcctgagtctgtgtgagtgttagttttgctttttaataagtaaaaagagtgcattctaaaataatgataaaagtacagcaaatacacatgtaccgtgcacagctagactagactttcatacaagtgggagtgcagttggctcgtctacaccagcatcaccacaaacatgtaattcactgcactgtgacatcatgagggccacaaggtcagtcggtgacaggggttttcagctccactacaaccatatgggaccaccatcatgtacgcgatctgctgctggtggaaacattgttatgttgtgcttgctgtttacagtttctcaacatcacttgaacctacaagaatatctaaggaccttctgagacacaaaagcttgattctcaaatacataaaaataagaaggatttttgttttcccccaaagtgatgaaattacatgagagtttgttgttttcatgtctggctcccatattttttgtaagtttttcatgtaaattaaaggtttactctggcgtcaactattccctcctggcctggaatcacagacgttccatttcttccatctactcatttgggaataagtcacgtaattcccggccctcagctcctcaactgatatccctgagcaacagcatcagacatgcgtgtgcctctgacacaggaggatgcgagaggcagggctgagccaggccaggcaggagcaagcggggagggaggagtgttcccgggggagagtgagaggcaggaaagacatccagccacaaggagacctgggagcacgggtcgcccagaattcagtgtgcttctatttccacgctcatggttcacccacctttctgagggtccaagcccacggcacccgctgaccctgcctgtctgcccagacactgcaccacatcgtggttcacctgcctttctgagggtctaagcccatggggcccgctgaccctgcctgtctgcccagacactgcgccactttccacgcgcgtggttcacccacctttctgagggtccaagcccacggcgcccgctgaccctgcctgtctgcccagacactgcaccaccttccacgcgcatggttcacccacctttctgagggtccaagcccatggcgcccgctgaccctgcctgtctgcccagacattgcaccacatcatggttcacccgcctttccgagggtcagagcccatggcacccgctgaccctgcctgtctgcccagacactgcaccacatcgtggttcacctgcctttctgagggtctaagcccatggggcccgctgaccctgcctgtctgcccagacactgcgccactttccacgcgcatggttcacccacctttctgagggtccaagcccacggcacccgctgaccctgcctgtctgcccagacactgaaccacattgtggttcacccgcctttctgagggtctaggcccatggggcccgctgaccctgcctgcctgcccagacactgcaccactctccatgcgcgtggttcacccacctttccgagggtctaagcccatggagcccgctgaccctgcctgtctgcccagacactgcaccactctccatgcgcgtggttcacccacctttccgagggtctaagcccatggagctcgctgaccctgcctgtctgcccagacactgcaccactctccatgtgcgtggttcacccatctttatgagggtctaagcccatggggcccgctgaccctgcctgtctgcccagacactgcaccacatcgtggttcacctgcctttctgagggtctaagcccacggtgcctgctgaccctgcctgtctgcccaaacactgcaccactctccatccgcacggttcacccgcctttctgagggtccaagcccacggcgcccgctgaccctgcctgtctgcccagatgctgccccacatctccatagcacccagttgtgcactagcagctgaggtgagctgtcgaatcctcattttctcacttttcattttcacatcatcaggcaccttgtctgagatggttgcttagttaaataaacagaaagatgagtttggattgcttctgatatgggagatgggcagggaagtgctgggtggagaagggcgggtctctggcaagggctctacccctggacctttcccatgggcctaggcgaggacaggcatttttgtttttgtgcccaaatgttgcatttcccaagaccaccctggtccaccatgcctctatcctgtgcctataaaaaccctgagaccctagcaggcagagacacaagcagctccccaagaccctagtgggcaaagacacaagggctggatgtcaagaggagcacaccggcagaagaactcactgacaggcaccagcagactaggtagttggaggagagcctggctgctgagcggcccgactccaggggaaaactgccttcccagtccatctccctctggctcctgctgagagttacttccactctataaaaccttgcgctcattctccaagcccatgtgcgatctgattcttccagtacaccaaggcaagaaactccaggacacagaaagccccctgtccttgcaataaggcagagggtctaattgagctggttaacacaagccgcccacagacggcgaaactaaaaaagcaccctgtaacacacgcccactggggctttaggagctgtaagcattcacccctagacacggccgtggggtctgagcccacagcctgcccgtctgtatgctcccctgcaggtgggagcagtggggcactgaagaagcaacccactcctccatcgcacgccctgtgaggggaataagggaacttttcctgtttcacttcatctcaaccctcctgacccactctcttctgggtggcagttggcctttctgaggcagcagatggagccaagcatgtaggctgtggtcacagaggcacatggccacctggcccacaggaagaccatgggaagaccacaggtggacacgcccggcactcagggaactctaagggaggtggagcttgggtggtggagcagttggggtggtggggcaggagagaccagcagatgtggccgggggcaacatttggaatgtccatggatagcattccatccaaacacaaacgtgcgccttactagttcctctgcttctgaagcggtaacggtgaaaatcctgggagctctcaggatccagtcccggagggaccagcacagcacatatacagcttctgccaatggctgggcataagcttttaaaaactgatcatgtttcctagctacagaatgactttctcttcatttcagattgatcatcattcagagagagctgctaactctctggctttcagccgttctgtcctggtgttaacaatctgggaacctattctgaaatgtaccagagaaactctctgttcaaagggatctgccagaaaccctttgggaagggaagacgcccctggagccacagtgatgacactgcaaagtccgttcatttgtgatacggtatctccttgtggttcagcaaccctcagcccatgacctggtgagcttgacttgaggcttcattcttcatcagacacagaagcatcttgtcttgggaagggtcttcacgtacagccctcatttctcctttgactacaaaacccagcagtaaggaggggtctttcagagtcattaaggacaggtcccaaagaaatatggacttagtaaaaaatataatcaggtttcttgtaaaacagagaatggccaatgtttagaggttaagagtgctacaggtgcacaccacacgtgcctatgtttaaaataactaacccccatcctacctaaccacataccccagttatgctgttccctcacctctccacatatattttggagaatatcacaataggatggtttgtggacagaatgaatttcctattgtgaatgtggactactcttactgaagttacaaaacaagttgactgaaaatttaaggaatgcatgttttaatgaatatagactaactcaagttttctttactttttgagtcacttttatcaacttacaggttttttttctaattgccttttcaaatttcttagaacaaagtcattagtagtgttttcctacgattcttgaattcaatttacctatggtggaattccctttttcctctcattaattgtgtacttatgcccttttttgtcattgtcggtaaaaagagctctgtaagtcttttcaaagacccagagatatttctgctgtttgtgttcttgatgcttgccctcatttcttcgtacctatttcagtattttctgctcttgtcttcattattttcttctttttaatgtcttttgcttgctttgttcgtccttttattcttattatgaaacgtttcaggcacacaaaaaggaataaaataatatgacacaggttgaatatccctcatctgaaatgtttgggactagaagtgctttggatttcagatatgtttggatttattctggaatatttgcatgtacataatgaaatatcttggggacaggacccaagtcgaaacatgaaattacttgtgtttccttataccttatatagaaggcctgaaggtaatgttatgtaatttttaataattttgtgcacataacaaagtttatgtgccgtgaatctggaagaaaagaatgaagagcttgcgggggaggccacctctgaaggaatggccgagaaacttcccaagtgaaaaagctgtgaggcttcagattggaggagggcgcaagggcccagcaggatgtgccaaagttgtgctcgggcacatcaggaggaaatcaggccccacaatgtcacctccaagcacctcctggggttgcctgtcctctctcctcttcctgctgagcccctgggtccaaggacctcccaccttcaaaaaagtaaaaacagcacagcccagacccaggggtaaaattcatgtcatcacttcttcctgggccagcacccaaatacctcctgagccacaggaacacgatgcctctgtggccctgacagccactgccgattgtcctgggaggggccttcagggaaccgcacaggaaggagggtgcagctcagcccgttttcaaatccagcaggatgttcatgacctccctgcagacactaatggacagaacgtcacagcagtctggtgagcgatgatgtcagtgcattattaaattcaaactggaggggaagttttgacactaatcaatgctttttatcccacccaagactggcatattcccgagacaaatctcagtggttactgaatagcttgcagacctgggctgccctggggaaactgccatgcaagtctgtccttcccacctttctgcagatgcacgcagggctctcaggaagcaatttttttttttttttgagatggagtctcactctgttgcccaggctggagtgcaatggcatggtcttggctcactgcaacctctgcctcccaggttcaagcaattctcctgcctcagcctcaggagtagctgggactacaggtgcatgccaccacatccggctaatttttgtatttttagtagagatggggtttcaccatgttggccaggctggtcgtaaactcctgacctcttgatccgctggcctcagcctcccagagtgctgggattacatgtgtgagccaccacgcctgaccaggaagcaattttttttagctcattaacatggcaaagacagatagccagggccttctgagagctgtaaatgagcttctcacctctctgacagttttcagcagacatggattcctcagtcctagagctgctggctgcattcatccttcactgccacagagctccctcacctccctcaggaagtggcagagcagttggcggttcccaggccccccagggaagccctggcaggtgcttgctggggttgggtctttaccccagaacccagcaaaatgagcaccttggtctgggaggagaacgtccctgaaaggcccttggacagtattagcagctcaggggcaggttctggaaaggccttttccggttaacaccactgaatggttcatggggtcagagcaggcaaaacgagcaccatttcctcccaagaaacacatttttcccactgtctgacagttgaaaatatttgtttactttgtagaaacctaggatgttttggcagcaagcaatttatgtcactttgaaccacagagaatgcctctgaaatgatgatatgggtcaatgaagaagcaaagtttcttaactgaagtccatttcatagaaacaaatgcggaaatgattgtaattatgagggatgggcccactgtggcatttcccaatggtgacagtcaggctctacccctagcccttggagtcaaggccataaagcaaacggccaaaggtcccctcgtatcgtctgatccgacggctagggttggaaggtgggcagcctcacgggagcatggacctaggtagtcgccaggggcctgtgtgcagaaaaatttctcatttgctttgacacgctgctgttgctgtcttgaaattctcaaagattttatctcccaacctatattttgtgtgagacatcccatgaggcgacgtggtgcgcgcacctgcagagaagacaccccaatctgcacgcccacagcgcctcgcccgccacccagtcccgcagcgcctcgccccccacgtgtctgtctgtgctcatgtggccctaagaggccactcctctgcttacccagagcttgctgcaaaccacaaagtgcaacagtgttctaagaaacacaaacgaccaagggtcccaccctctctcccactcacattgctttcccacataagccaccatttatgctgaacgtggccgtgtggagggaggggaggtgggcagcccacagtccttctcatgtgtgagcaaaggtggagaatctcggtggacaggggctgtttcatgaagggaaataaacacagccgagtgagtttcacacagcatttccaccgctgtaatgagaatgaaatacatatgcatgtttgagctgtgacagatgaactatgtagttgttcagattctgcatgtgaattaaatgttctttcatttgcatttgaaaccagcaacgcacgatatacagatgaatggtaaccttcatgttaataattcaaaaatcttaatgtttttagaatgatgctgaatagcaaataaaaatcccatgacaagtcaagacggagattgtgaaaggaaacatcttatactataactagttcctttaggggcacttttccttgatttctgaactaaggacctgtatttgcactttgcacgggccgtgcaaattaaacagacagcattgcagggcatgaacacagacgaaccacgaccaactcagctgtcccgaggctctgtgttaacggctcctgacacactcccctcctccctgttctgatctgtttgcattaatatgcgctcaattgtaagaagctgaacagatgtatttattcagaattcccaagcagctaactagaactcccaattctgagtcatcgtcttagctcccgaggtgcttagcagaatgctctgtatttatcagcttcccggttaacctacacaccactccccagctcttgctggtttgagttatgtgaaccttcaacatcattagggaagcttctaccacacttagtactgataagcaaagtgcattcacacttcctgaggatttaatgagtggcaccatctaaattaatcttaagaacaatcccatttgctgggcgtggtggcccattcctataatcccagaactttgggaggccaaggcaggtgcattgcttgagcccaggagtttgagaccagcctgggcaacatggcaaaaccccatctctgccaaaaaatacgaaaattagctgggcatggtggtttgcacctgtagtttcaactacttgggaggctgaggtgggaggatcacttgagtccaggaggcagaggttgcagtaagccgagattgtgccgctgtattccagcctgggcaatagagtaagagcctgtctcaaaaaaagcaatcccctgtcccatgagatggtatgacctcctccaatctaggaagctattgattgcaagacagaccattactctagtactgctaaggaaaaacaaacccgctggcagttaaactatgatgtgctatttataaaagatgcctcctaatttcagtgatgggaaaacaatacacacctgagaaatgatgacattcagggtggtgggtactgtgacagccacactgctgcttcctggggactctgcatcctctccccagacaccagctgttgagggctaggggttagccgctgaatccctccccatcaccacctgagcccaagggaacagccactccctaagttacagtctcttgctccctggaggtgaaccaccatcagtgatccctcatgtgggacacaaaggcctagcccccagccttggttgggtcaaccctgaaggggaaccccagctccggctgcagagcacctcacaggatcagctcggtcctcttaaactgcattccagctcaccttctccctctgcccaattcagcttccctcacctgtacgggggttaccccagatcacccccagtcaccgactgcatgcaaatctctgtctcagagtttggtcccagcacattcaacctagggcatgtaggaccaccctcgtttcacgataaacaaccaaaacagggcagttacgtgatgtgcgtaagatggcacgactcacacgtgccgcagctggaacttaaactccatccggactccaaggccaccctgttgtctctccacaatcaatgctcagagcacagcctgcaactgtaagaggcccctaagctctttcaagtggtccatgaggccaaaactattttcataaaatactaagacatactttgcctttctcacgtgtactcttttatgagagaacttggaacagtccagaggctatgtggcaggaaatgacacagaatgagtgggaggcagagatgagaatccaagtgttttctgttaaatgaaacaatgagatatgcaaaagcgtgaaacaagaatgtaaaaatgtaaaacaaaaatgtcacacttagcacttttttatgttttggaaaatatagctactgtgtttataatgaaataattttatgatttattttaaagtgaattaataaacagcttttctaaagtgttggcaattttaatttctaaggtaacaaatgtggatagcactaacccaccaaaaaaaaaaaaaaaaattctttggagtcttcagtaattttcaataataggatgtgatcctgagaacaacattttaaaaatcacggctctgcactctgctgctgggagtttggaattccgctctccattccacaccagccgaaggaccccaggaacaccctgtaatccctctgtgattccgtctctttaatctgctaaataaagagatgtaacttccctacagcaaaaggaaagcaccagtagaattctgtaagttaaaactactgttaaaattttactgctctatactatatccagtattcccttctccattattctatgaaaattttaacaaaatgcattatactaatttaccatacaggattaaaatgtcattaagcttgcaatgtgtaaaccttaaaacagctggataaaaatttaagacaggaataagaagaaagccattcatattgttggtatataaaacaagcttcagagagtgttagtcccattttattcatggaagaaaataaatatgaagacactgaaatcacctggagaatttttaggagatgctgatggcaggcctcatatgagacaaatcaattcagaatctttgaagggtaagccccagacaccatggtttccgaggctcccaagttattttaatataacgtcagggctgacaactactgctcctgttgatgaagagggtcaaactctgaaaactatttgaagaaatgtattctgagccacatgtgggtgaccaatggcccaggccacagccccaggagagcctaagatcatgtgcccaaggtggatgggcttcagcttggatttctacacactagggaggcataagacatccaacaatacactaagatgtgcacaggcttggatttctacatgctagggaggcataagacacccatcaatacacataagatgtacacaggcttggatttctacatgctagggaggcataagacatccatcaatacacataagatgtacacaggcttggatttctacatgctagggaggcataagacatccatcaatacacataagacgtacacaggcttggatttctacatgctagggaggcataaaacacccgtcaatacactaagatgtacacaggcttggatttctacatgctagggaggcatcagacacccgtcaatatgctaagatgtacacaggcttggatttctacattctagggaggcataagacatccgtcaatatgctaagacgtacacaggcttggatttctacatgctagggaggcataagacacccgtcaatacactaagatgtacacaggcttggatttctacattctagggaggcataagacacccgtcaataggctaagacgtacacaggcttggatttctacatgctagagaggcataagacacccatcaataccctaagatgtacacaggcttggtccagaaagatgggaaaacactaagcagggtcttccagggcataggtgaattcaaagatttctgaatggcaattggttgagtttatctaaggactgggaatcggtagaaagagtgtctgggttaagataagggactgtggagaccaaggtttttattatgcagatgaagcctccaggttgcaggcttcagagagaatagatggtcaatgtttatcagacttgaaaaggtgccagactcttaattaattccctcttggatcagggaaaagacctggaaaggaaaagggattctctacagaatgtagacatttcccaggagagacagctttgcaagccatttaaatatatcgcagaaatatattttggggtaaaatacttccatttctttcagggcctgcaatctgccatgttggtaccttatagctgcaaaaggtctgctttgtctgtcttcacgcctctgttccaatgttaacgctggtcagctgtgcctggacaccaagggaggagggtaggataaggtgtgtccaaacaccccttcccatcatggcctgaactagtgtttcaggtttactttagagtgcccttggccaagaggaagggtccattcagctggctgggggacttagaattttatttttggtttatactctaaagccaagagtggcttctttccttcagtgcagaggaatccaacggatatttttaacaaggaaaggacaacagaaaaaatagggattcatttttatattagacaaaacatagagctaaagatagagggagagagggagggagggagacagtggtggagggaggtggagagagaaagagaaaaaaagatggatgtggccatggcagcattgtttttgggtattccccaattcccacataaaacagacggagcaactagacaaggaaatcaacaaaccaagatcacacttaaatcaaactgaagtgaagctgtccccagctagtgatccccaaggcgatgtccagatgaacgttgaggagaggaccagagaaaagcagccttaggaagtagctgtagacatcagtgaaaatggcaaagaaccttaaacattccctccttcataaaagcaatgagaaaaccacccaaaaatatcagaatcaacttttacagaactctggaaattaactaaaggctagcagaaatcagagcaatttactcaaaaaaaaaaaaaaagaaagaaagaaaaagaaagaaatggctgaatctcagcaagaacagcgaacttcctggcatcttaactcaccctatttccagctccctctcctcagctctgccacaggcttgaaaatgagcagcccacaatggcagtaaaaaccaacagcctggaagccaccagaaagcacagggtggggttagagtgccttcaaagccccattcccagagaattgtcactacttgacctgtctggttgttccctggaggacccactggaaaggctgtctttatttcatccaactcaaagctcacatatgtgaaaagtctttccctgggggcatttgttgaaaacatttagagacaatgttttacttaccagccacctgaggtagaggataatggttgggacaaacaataggctaaccagaaagcttgaaggaaaagctggaaaatgagatgtgcacaggtgctttgcaaagctctgacacgatccttggaatatggatggccacaacacatggagggctgtgtgcctgcccaggctgtgcacactcagggaagacatgaggctctaagctctcaccactggctgatgtagaggctctgggccagcatgaagtgaaggctacaacagagctgtgaactgcctgtctgatggctgaaggtatgccccacactcacacagaaccctcagcagagactgaggcttgtttctaggcatttaaggcaatctgtctggtcatctgaccactaaccaaactgagcagagacttggtggccacacatgatgaaaaaacacaaactttacagaattagttcagaatagtcactaagcaagcaaacaacaataaacagcaacaacaacaacaacaacacctaaggagagggaaattctggttttcaaagttgccacactatgttatttaaaatattgagttttactaaaaatttttgaggcattcaaagaaacatgcaaatgtgcctcttccacaggaaaacaatagaagctgttcttggggaagccaaatggcttacaagacaaagactttaaatgagctgttttttgttttttttttttttttttttttttttttttagacagagtcttgctctgtcatccaggctggagtgcagtggtgtgatcccagcctactgcaacttctgcctcccaagttcaattgattcccctgcctcagcctcccaagtaactgggattacaggcatgcaccaccatgcccagctaatttttgtatttttagtagagacggggtttcaccatgttgggcagactagtcttgaactcctgacctcaagtgatccacccgcctcggcctcccaaagtgctgggattataggcatgagccactgtgcccagactaaatgagctatttttaatgtgctccaaaaactgtaagaacaatgtctaaagagctaaataaaagtaggaaaatagtgtctcatcaaatagagaatatgaataaaaagatagaaattatatttcaaaaataattgaaaaattcagtacagcagctcaacagcagatcttagcagcagaagaaagaatcagcaaacttcaggataggtcaactgaaattatccagtctgaggaacagaaaaaaaaagaataataaaaaattagaaacctgtgagagaccatccaatgtactgagatacacgtaaaggaagtcccagatgtaggagaggaagaatgaggtagaaagaatatttgaagaaataatgacccaaaattcccaaaactagatggaaaacatgaatctacatatctaagacactcaatgaactccaagtagaataaactctaagacagccacacctagatacatcaaaatcagaccttcaaaacccaaagacaaagtaaatctaatgaaagcagtaagagagaagcaacttgtcacacatgttatggactagatatttgtcccctccaaaactcatgttgaagtttaatccctaatttgggagtatcaggagggaggaggaaactgggtcatgagggctctgccctcatgaatggattaatccactcatgaattaatgaattaattcatgtgggttatcacaagaggggacctggtgactttctaagaagaggaagggagacctgagctagcacactagcatgctcagcctcctcatcatgtgataccctgtgccacctcaggactctgcagagagtccccaacagcaagaagacccttacctgattctgcccctcaaccttgaacttctcagcccagatacctgtaataaataaattccttttctttataaattacccagtttcagatattctgtgataagcaacagaaaataggcaatgatcctcaataatattaacaactaatttctcatctgagactatgaaggccaagaggcagtggaatgatatattcaaagtcctaaaagaaaaaagtctatcaaccaagaattctatattcagaaaatcgatccttcaaaactaaaggagaaatcaatacattcccaaacaaaaaacaaagagaattttttccaacaacccttccctagcaagttctaaatggagtactttaggcaaaaatgaaaggacattagacagtgagttgtatccagatgaagaaataaacagcaccagtaaaggtcattatttagtaaatatgaaagacagaacaaatatttgagtatgtaacatttattttctcctaattttctttaaaaaacctgcataaagcaataattataaatccatgttgataaacatacaatctataaagatataattttcatgacaataacagcacaaaggagggaaagagaaaaaatgacagagagtgtttgaaaattaagttggtattaattcaactagattattataaagatcttaatgttaatttgaattaataattaaattaatattaacttggtgttaataaaattaaataatattaatcttctagcaaacactaagaaagcaactcaaaaaataatcaggaatgaaaagacattattactgatcttacagacataaaaattacaaggactatacagaaatactataagtaatcatatgccaacaaactagataatctaggtgaaattgacaaattcctatgaagacatgaactactgaagctgactcaagaagaaatagaaaatttgaatatgcctataataattaaggaaattcaatgagtaatttaaaacctcataaagaaaagcccatggtcagatggcttccatttgcaatagcttcacttcaaatgtttaaggaagaattaacatcattctttcacagtcttccaaaaaaaataaagaaagaatactcttcaattaacttgatgtgatggttaatattgagtgtcaacctgatgggattgaaggatgcaaagtattgatcctgggtgtgtctgtgagggcatttccaaaggagattcacatttgagtcagtggactgggagaggcagacccaccctcagtctgggtgggcaccatctaatcagcttccagcatggccagaataaaagcaggcagaagaacacaaaagtagtttagtcttccagcctacacgctactcccctgcgggatgcttcctgccttcgaacctcggacctcaagttattcagctttaggactcagactggcttccttgctcctcagggcctattatgggacctcaccctgtgatcgtgagtcaatactccttaaaatactcccctttatatacacatctatcctattagttctgtccttctagagaaccctgactaatgcatttgacaagttatgtattactataataccaaaaccaaagatatcaaaagattaagagatatcctttataaatacggacataaaaattctcaacgaaacactaagatactaaatccagaaacatataaaaagaattatacagcatggtcaagtaagacttatcccaggaatataagattagttcaaatataaaaactaaccaatgagatacactatggtcatagaatacacatgctatgatacagactgaatgttgacatcctccccaaacgtacgtgctggaattctgatccccagtgtgacagcattaggaggtgaaggctttgggggtaattaggtcatgaagacggcgcccatgcaggtgggattagtgtccatacgaaagagatcccagagcgctcccttgccccgtctgccacatgaggacacggggggaagatgccacccatgaaccaggaagccacccaccaccagacaccaaatatgggggagcctccagagctctgagaaatcaatgtttgctgtttcagccacccacgccatgtgatttttgtgacagcaactcgaacaagagaaaaattggcaccgggaagtagcagcacggctgtgacaaattcctaaaaatgcagaagcaactttgggtctgggaaacttgttgaggctgagtcttgaggtgtgtgctggaacaagcctccttcgccatggatgaatttttaaaagtgcttgtgttgagagatcaaaaggaagacaaagcagtatctcttagagaacagctcggccatcatgaatggaatgctgggaggatgcagacagagcattctgtgaggcctgggaaaggaggaacacactatcggacggtggagaagaggctgtgctcctcgcagagtggtgaggaccatggccgaatgcgttcatgctctgggctcctgtggaaggtagagcttgtgaatgaggaattggaaacagtgcacctcagtggcagagggcctcacaaatggccggccggagatgggggctgggtggaaggagccactgggcctgctcgggaggttcctccattgccctgcgcagcctgagccagacagagcgcaaatcccacggagggcgagccctgagccggacagagcgcaagtcccacggagggcgagccctgagccggacagagcgcaagtcccacggagggcaagccctgagccggacagagcgcaagtcccacggagggcgagccctgagccggacagagcgcaagtcccacggagggcgagccctgagccggacagagcgcaaatcccacggagggcgagccctgagcctgacagagcgcgagtcacacggagggtgagcaccacgcgtgactccaacacacccacctgtgctcaccagacgtgagccagacgttctccctccccaaccccacaccacacatctgcctggaggtcgggtagggggtggatctcagctcctctcagcaagaaggaaagcctccaagctccaagggcccaggatgggaggtaaaacaagacaggcgagcacagggagggcgcaaatagagtgggcaaggaggaggcagaacccggctcccctgacctgtgccggcaagcacgtccccagcagcagctccccggatgccatcccagccaggacccgtgcggccagccttggatttctgtgttccagtccacattatttagggatttattttccttctcttttaaggaatgataacactgttttatgtacatatttggtttttttgctttttgcttctgacatgcagctcaataagtcagaagattcttaccaggaaatgaatccacagtcgttttcatgacagcaaattgcatgccaacgagtgacatttaaatgctgaattttaatggcttgtcagaaaaagtgaaatgtatttaaaaaaaaatcatacatgagagagcagtgtgtctgcccatgaaataatgctgcctgtagtagacaagaatggtaaaaacacagtgaacgtattttgttctgtgatgtacacatctacctggaggaagaaggttgtgaaattaactcccatttaccctcctcttcgtgcagaagactctgaaggccgcgcaagcagctgtctgtcaatgaatctgacaactgcacctgcaagaagtggcctggatgaagacgacaggcagaagcacaggatcaactctgtttcaagcgcagttaccaagacagaatcatttctggaatcctgaaaaacctgcatatgaacatgctcacgtgtagacacccacacacatgcacacacacctgcacacacactcacatgctcatgtgtagacacccacacacctgcacgtgtagacacccacacacgcacacacctgcacacacatgtgctcacgtgtagacacccacatacctgtacatgcactcacgtgctcacatgtagacacccacacacatgcacacacacctgcacattcacatgctcacgtgtagagacacacacatgcacacacgtgctcacatgtagacacacacacgtgcactcattcacatgctcacatgtagacgcccacacaaggcaaacacacgtgctcacgtgtagacagccacacatgcacacacacctgcacatgcactcacatgctcatgtgtagacactcacatgcacacacacgtgctcacagacacccacacacatgcacacacacctgcacacgcactcacgtgctcacatgtagacacgcacacatgcacacacatgtgctcacacagacacccacacacatctgcacatgcactcacgtgctcaggtgtagacacacacacatgcacacatgcacacatacctgtacatgcactcacatgctcacatgtagacatacacacacatgcacacacccctgcgcactcattcacatgctcacgtggatacccacacatgtacacacacgtgctcacgtgtagacacccacacacacgcacagacacctgcacacacatgtgctccagtgtagacacccacacgcaaaacctccctactcaaacactccccccatgtgaggctgacaaaactcaggaagacaccaggatttgagattctttccttcaagtgtgcatgcatgtgtgcctgcctgcacacatgcatgcacacctgcacactcattcacgtgctcacatatagatacccacacacacacacctgcacactcattcacgtgctcatgtgtagatacccacacacgcacacacacctgcacactcattcacgtgctcacgtgtagatatcccctacacgtgagcatgggtgtgtgtgcatgtgtgtggatgtctacacatgagcatgtgtgtgtgcaggtgtgcatgcatgtgtggggatgtctacatgtcagcatgtcaatgagtgtgcaggggtgtgtgcgtgtgtgcatgtctacatgtgagcatgtgtgtgtgcaggtgagtgtgcaggtgtgtgcgtgtgtgggtatctacacatgagcacgtgaatgtgtgtgcaggtttgtctgcgtgtgggtatctacatgtgagcatgtgtatgagtgtgcaagtgtgtgtgcaaatgtgtctgtgtctacacgtgagcatgtgaatgcatgtgcaggtacgtgtgccttcgcagcatgcccaccttccagaagcctgcatcctggactagacacaccaatggccctggcaaccaaagaggcctcctgccacagggtcgtcctcctgccacggggtcatccccagggtttgctggaaatgcccaccccaggacacaccccacagctgtgtcagaaccagctgggaaggtgtcagcaattctgtgtccccacaatgcagaagatgacttttcactgtctagagagtccaacagcccaggacacacagtccctggggatggagctgggcagagggctccagctgcccaggccatgggcagttctgatacacctgggcagacgctcagccagggcctgagcaagactggagatgcagggctgcctgggacctctgtctctatgcaaggatacctacgaccccccatctccacatggggctgcctgggacccccctatccccatgtggggctgcctgggactccgtctccataaagatgctcttatcctcaagaacaggtgccaggaatgtggacatagcctgacactcggcacaatattaattttctctgagatggttttccttaggagttaccttttgccattatttggttagattattgtcatgtaatttaaattcatggatatatgagacaaactagaaaaagctattgctttaaaatcataggtgagaaaactcatctctgttggggaattcggggccactagatatttttctatccctccttttgaaactcaccttaaatttcttggtttttttctagtttgtcaggctgagagtcttgtgcattctctggtttcatttcatcccaggacgcccacccaggcagggccccggagcccttgtggcactagctcccatgacaagggagctcaggtgaactccggcaccctgcccccgccacatctcagcacaggatagcacagaaacgtgatgatgttcagtgccagttgccagcacatggtgatagctacatacatacctagagccgggctgaaattacgctcaggggaagttctgaaagagtcacgcccattctcattgaaagacccctggcctccactcgcacgtccagccatcagagtggcaaaagctcatctgtttgctccttaaatgaggcttttccctcttctcaagataataaagtgaagggtgaaacacagagtaaggctcacaagacaagcaaactcagaaaatgtgacacagttgaatatttacacaaccttccttcaatatggctcgctccatgtttgtccctgcgtgggcagcattccgtctgtgtcatctacattgatacccatatctacgtgccctgccaagcctggcactggcctgcgcacagcaccccatcgccaaacgacagtggcacatatggagcaggagctgggcccaagccgccctggaggctcccgtggggaaagggctcaggagtccagtgtggcctggagtgtgcatcagggagctgcccggcgccctggcccacaccgccacacgcgtttctctcaacccgcagtttggctttgtggagggttccccatggactttgggctcaggtgacttgggctttgtttgtgggtggttctgtgtaatgcacaggcaccacccaaaagcagacacgtgtagcactacacaccacccatgctgggaccccctgaaggacagaggtgaacccggaacccctgtaggacagaggtgaacccgggacccccttaaggacagaggtgaacccgggacgccctcaaggacagaggtgaacccgggaccccctaaaggacagaggtgaacccgggaccccctgaaggacagaggtgaacccgggaccccctgaaggacagaggtgaacccgggacgccctcaaggacagaggtgaacccgggacgccctcaaggacagaggtgaacccgggaccccctaaaggacagaggtgaacccgggaccccctgaaggacagaggtgaacccgggaccccctgaaggacagaggtgaacccgggaccccctgaaggacagaggtgaacccgggacgccctcaaggacagaggtgaacccgggaccccctaaaggacagaggtgaacccgggaccccctgaaggacagaggtgaacccgggaccccctgaaggacagaggtgaacccgggaccccctgaaggacagaggtgaacccgggacgccctcaaggacagaggtgaacccgggaccccttgaaggacagaggtgaacccaggacgccctcaaggacagaggtgaacccaggaccccatgaaggacagaggtgaacccaggactccctgaaggatagaggtgaacccgggacgccctcaaggacagaggtgaacccgggacccctgaaggacagaggtgaacccgggacccctgaagaacagaggtgattggaaaccctcctgtgagcagaatctccagcagtgcacctggctggtgattccgcctggaaggagaaacggccagatgtgtgattacttatgaattaatgggctgtggccagtggtttggctggagggccagggactcggagagaatatggttggaaacattgttgacaagggcaactggggaagagacatattagatagacgtctatgaagtggtatgaagtactaagatatgaatgtcccgtgtgaatgttctccaaagagtgacctcagcagaggaggattttaataaccaagtggatagggtgacctgttctgtggacaccagtcagcctctttccccagccaccctgccgttgccccatgggcccatgaacaaggtggtcgcggtggcagagttggaggtgatgcctgggctcccactcaacaaggccagccctgctgtggccacccttgagtccccagtcagccaccacaaagaccatccctgagtccccaacatgacatcattccccgaggtgatcagccagccgccggggggcaggtggttccgcaggcagcttcccctgtggaaggggtggggaatggtccttgctggactagacgcttactccagatgtggatttcccttccctacgcacagtgctcctgccagaactaccctccgtggagtcagaacgccttatccatcaccatggtgtccacacagcactgcttctgaccaagagccctcacttcacagtcaaagaagcgcagcagtgggccggtgctgtgggaattccctggtcctaccatgttgccatatataatttttaaattatcataattttaaaaattatcttctcatcacccctgcagggaccacctgcaacaaaaatttcacaacagtgacaggcagaggctgattctctccaggccgagccacgcctgcactggacccagccaggcccagataagcagccgacgcctgcctactttgtgccaggcccagctgcgggccactgcagcctcctggcatctcctccctcagacacaggaggcagcaggcctgggctcctccaaacccaggaacggacgatcccagtaggaagcacccatgagcccagcgcccggctcccacctgccccttccaccaccacactcgtggattcagtccgtcccagctcctcaccgcccaggaggagaagccaagcccgtgcggtcgctcagtgcggcagccgccgagcctcggcccacgcccgccctacctgtgccggaaagcttctgcaacgccacgcgcaggcgctgcagggccacgggcgacacctcgtagcggtaaaagtccattgccggaaccttctggcaccttccaaacactccatctgtgagaagggaaggagataagacagaacgagacgtttcattttcagagagcaggaaggtgtcacacacgtccttgcaatgcgttctgatcatgtgccgccgtgaggttttggagcacggcgtcaccagagggctgttaggacccgggagcacccggaggatgctggtttgtgagataaaaaccgagcatcacggaaaacacaaatgccaaggtggagagaaagtccagtgtggctgcaatgttgtcactccactttcctccataccccccgagccctccttttatgtaatttcacattttttatgtaaaacttgcctctgacaactcagtgacaacaaaaaaacaaagtcaataacattccaggccagttttccagatgaaaaacagaacacccaggaaatataaatattactttgcaggagctacaaggatcggcggagacgcctctccctgggctgcgtgggaggcaagcacggcttcccgggctcctttccggcggcgcaggagaggcgcggggctggcgaacggtgtgggactaatggggactaatttatttagctcgattccatttgtctgaaatggcagactctgctcatcaacatcctttccaaccacaccttctaattaatttagtccccaattagtctttattcggcgaattgttcactttgagacaagcttcctgtggggtttcaaacattcaaattaccttctttggtgcacacaaaaggttaattcaggcgctactgcttccacacagggcggccatctgcagcttcgggcggggcggaaggggaaatggtctcttttattgttcactaggtttcgccgtgcagcttggctgaagaaagccattcaaatgcaacaagtgtaattagcagaaacacatttgcccagggccaggctgacggtaattgctggtctgatattgcatatatgctcacgacgacggggccgggtgattagcagaaaataacctcgagtattgcaagcgtcctgcgggtttctatgggactttgcaaagcccagggaatccgggaggcagcctggcagctgcgcgggcgggcggacaatggcaaggaggagacgccaggcccgcgccgtttccctccgtgcagcccggccgcgccgcctcctgtccgagagccggcccgagatgcctgcgaggccacacaaaggcggagggctctcggggacgcgtctgcagagcccggcgccccccaccgtccgtgatggacaggccgcaccacaggcgggaacacaggcagatgtgcccgctcctttgccttcctcagacacgcaccattcagtgcaagcaggagtgggaaaggggggaggagggagaaaggggcaaagagggaaaataaggagcgacttcaaacatacccagtgttcctactctgcttttcgaatgaaaatatcttgaaaatagaaaggcaacaagcaggaactgggcagcacgtcgagacggcccagctcccgtgctcacaatgcagaacaatcctaggcctcaggaccaaggcctggggccccagaggagggagtgagccacgggccaggaagaaccaaaagccaggttcctggacccccaagcggggcccaagtcagtgaccacctaatcctaggccagggccggcggcctcttccgatccctgaggccagggaggctcagaagcccagggctccactcagccgcagagcccgcgagctgcactccccaccctcagaaggaaggcgctctcggccggccccagagcagtgacggtgccggctgcctgcagctccccggcctcttgcgcacattggaaaatgcacccccggggtggacgtgcgtggccagctcagggcatggcagagcctggctggtccgggccccactcggccactccgggtgtctgcacacagggcttggtgatttggtgccaaatataagagaagcacatctgtgagtagccaacgcttcgcaacatgcagctgaggatccccttcccaggcaacctcatcaaatcattcagcttttcataaagaaaaatggcccaggacaattcctatcaattttggaacgttccaagcaaagcatttctcaagcataacagcctcattctttaaattttgtttcttgcatacaatgtcataaatatattttaaaattatattagactttcttgaaaactttcttttaaacatttatttagaatatatacaatataatgcataatatagtttgtgcttttaaaatcagttttagctaataattttagctacttgacagttgaaataaactaaccattgattctctttgccttagactatccctgtgctgaatgcagtggacacagacaccatccccagtgcattgttaatagactttatttttagagcagtttagattactgcaaacttgagtggaaagtagggatattttccatgcatcctcacacatgcacacacacacacagcctcccacacacacacacagcctcccacacacacacacacacagcctccctcacacacgcacacagcctccctcacacacaagcacagcctccctcacactcacacagcctccccccacacacacagcctccctcacacacacagcctccctcacacacacacggtctccctcacacacgcacacagcctccctcacacacgcacacagcctcccttgtacacacacagcctccctcacacacacacagcctccctcacacacacacacagcctccctcacacacacagcctctctcacacagcctccctcatacacacagcctccctcacacacactcacagtctccctcacacacacagcctccctcacacacacagcctcccttgtacacagcctccctcgtacacacacagcctccctcacacacactcagtctccctcacacacacacacagcctccctcacacacacagcctccctcgtacacagcctccctcgtacacacacagcctccctcacacacacacagcctccctcacacacacacacagcctccctcacacacacacagcctccctcacacacacacagcctccctcacacacactcacacagcctccctcatacacacacacagcctccctcacacacactcacagtctccctcacacacacacacagcctccctcacacacactcacatagtctccctcacacacacacacagcctccctcacacacacagcctcccttgtacacacacagcctccctcgtacacacacagcctccctcgtacacacacagcctccctcacacacacacacagcctccctcacagggtatttgcagatattaattttccacttttttgggtaaagaccaacacgagtgactgctggctcatatggtaagagtatgcttagttttgtaggaaaccgccaaactgtcctccatggtgacaatcagactaacagtggccgtgccatttttcactcccagcagctgcgatggcacccccatcgcccatgtcctcaccacagtgacaatcagcctaacggtggccgtgccatttttcactccgagcagctgtgatggcgcccccatcgcccgcatcctcagcagcgccaggtggcgtccgtgttcccgcgtcctcggcagcgccgggtggcgtccgtgttcccacgtcctcggcagcgctgggtgacacttggaggcgtccatgttccagcgtttggctgctgtcataggtgtgtatcggtatctcatgattttttatccaatgcatttttcaacaatgatattcatccttatctccgtatttaaaggacttcatgatgtgggtgtcctttattctagtaaatactcagcaataaggcttgttgaagatgattgtgaccagaaggaaggagcccagaagctcccacagatcatgcccaggttcgctgctacctgcttgattttaaggggatactggattcccccaaatatggatacgtgcctagcagtgaaatagaaaattaaggaaatttctaaatacatctggtagaattgatttttatgtggccagaattttgaaactattgctttgttcttccgggtcacttggctaataggcaggaccccaaaaggtctctatgaacatactagagaaaaggactggaaagtcaaatctcaatcaggaaagcatcaggtgcgatgagactccggagtcgggacgccaggggtgatctacacagcaggggtgccggagccagagaaccaaagctcccaccagtccaggctgagctccaccgtctcagacgtgcagtgcggcctctgaaacaatcccgggaagtggcacactgaagtcgcctcaccgccgaccatttaatcaccctagaaaccacccagagcccgtaaccctcaggcccctcctctgcgggactcctgccttcgtgttcttgggacacagccaggaccccacctgggatctgagcttgcttggggtttcctcatgaactctcttctacttcggactctgtttcctgtgccatggccctgcagcctgtcgacatgaccctatcgtcgaagcccggactgacccgtccagctctgcagccctgcgggccatgctgagctcccagctggaagtgcatcaccgcaccgcagtggaggcaggaggccttgggtgatggagcccatccacgagactttcagaaccagggtcctgctcttcgtccagaacgggcattccatgcgcaaccttaattccaagtctcactgctggcaactgagttcaaattgggggctgtctgaaaatcatgggagatgagaacaggtttgcctatgaaaactgtgggctccctgtccacccgtccttggctactgtcaccatcaaaacactcatgtgtgcaaatatatgtgtacgtgtcaatccttatacagaaacacgtgcacagctgctaactcatacacgcacataagcacagccgctaacgtgtttaactgccaaacttactgtgcgtgcccaaggatgccgccaatccaacatcataaacccttccggcaaacagacactgcccgtgcctctgcgcggaagcctaacccccaggtgctcctcgatgacggcttcgtgccttctccctctgtcttccctgcagcgttgggtgctctcatcaacgaggctcatcatctctgtccccagcattgcctgagccttgcaaagccccttcctgttctgggagcaggtcagtgctatgcctgctgcttggctgcctccgccccacaccctcgtcccagggaagccacagctctgccctgcatcctgcttgcatggccaggccaggacagccgggagacacgcacacagaaaaagcagacactgcaggctccatgctccagagcttccaggatcctggggcaacagatgttcaccactgatggttcggttataattgtggacaggctgcaaaaaagggcacgagagcacctgacagagggcactgacctcacccagcggtcagagaacgaacagcggccgacctgaggacatcgaggacactccaggctaagggagcagctccgtgcatggcagcatccagccccggtgggcgacggggagggagcagttccgtgcatggcaacacctggccccagtgggcggccaggagggagcagctccgtgcatggcagcacctggccccagtgggcaacggggagggagcagctccgtgcatggcagcacctggccctggtcagccccagtgggcagtggggacaaggccttgcagttctggatcaggcaggagaggacaccaagctggtcaagccactcaagcagattgtgcagagcctgcgggaatcagaggcagtggccttcatcccaggagctagaggaggccacctccacttgggtggtgttccaggcagggcaggctcttgaatgggtctgcgttttaaaacagatctccctggcaagggctggagattgccaggagcccatggcgggtaaacagagcagccccaaccaggggatggtggctaagtgaggatggtggtcatggagaccagagacctggatagactggagccatctgcaaggtgaaccttaggacaacacacatccctctgccggcagcagcaaccaggcctttccacatgctacccagcccatgcacagacaggcttgtgggggaggggaatattctgggagacgttctgtagaatgagtctttttccaaaacaggaaggaaggcaggcttcttgctgccctggctgggagaggcgagacatggaaggcgtcccccgacaagaattctgcctggcctggaactccgatatcagggactcaacgaactggggggcctcacacccccagagttctgggatgcaacccccttcactgtgcagacagaaggctggaccccacagaactccaatctcagggactcagtgaaccagggggccccacatttcagagttctaggacgcaaccccttcactgtgcagacagaaggctggaccccactgcctctgggaccggaatggacagtgctaaagacagtgagagaaggaatgcccaggatgcagagcagcggatgaacagggcccaggacaatggacacaaaagctttgaggagcaaaaggtttgcttagagacacttttattaacagtaatctagaattgggtggtcagtttctttcatttgaaagaaaatattgagcattttctgtggttggatttttggagaaataagaaaaagagctcatttatcttggtaatttgttttaaacagtggtccttagagcactgttcccacaggccaaagtaatttcattcgcaagcgtcactgtccccaaaacacaaacacaggcctcctccaggaccaagcttccagcccacttctattctcatatagtctgtggggctgcatacctccctccaaccttacaccacacgtgtgtacacggtgcatgtatgcacattcatacctgcatgaaccaacacacacattttcacacacttctcccatgcacgggacactcacacatacacacactcacacgcacccacgtgaacattccaacacatgtacacacacacaagtgtgcacacactcatttgcatgcacttgattatgcagacacacacacaggagcacgtacacacacatttgcaaacgtgcacacacacacacacacacccagacacactaactcatatacaggtgcacacaagcgcacatgcacaaactcacacgcccacacgcgtacgctcacacacagtctccgcatagacaagacggcacctcgcctctaccgccctgcaggaccaccctctccccggtgacaccgtgagttcctggaaggcagggatcacagctacagcctcttcacgcccccacagcatctggtacagtgccttgcccccggtgtggactaaaaggatgttagtgaatgactataactggtattttcccatttgtctaaaagaaaatggagatgtccgtggaagtgtttaagaccatcagctagaagcctcatttgttgaaatctcacatagatttacaagtcctcacccctggcagtgacccacttggatgaaagactcactggggaccaaaaaggctggtggtgggggcaccctaggaggggctggcatgagtctcgcaagttctcaggtggccatgcgcctccaccccatcccgtactgtctctctgcttgggctcagagggccgattgacccccagcatttctatccccagctccataagtgaagcaggtgatcctagtggacctctgttcttcagagtaagggtggggctctgctgcccagggtgcccccagagggtcctgttgcttggagatactgagcctccactctctgtgacacccatagcactgacccagaaccatccaattggagcaccggaaagctgtggaccgaacaaggtggctttgataccctgtgaggaaagtactcttgccacactttgcttaggtgatacgcccaggcctgcactaaacgacatcccgagtgacacgtccaggcctgccctagaggatatcctaggagaaatggcccagagacgctaactgtgcatctgctgagaaacgtcactcactgcgttaccccacaattctccacagagatccacagggggtcccccagtccccacaattatccacagagatccacagggggtcccccaggccccacaattctccccagagatccacagggggtcctccagtccccacaattctccacagagatccaagggggtcccccaggccccacaatctccacagagatccacagggggtcccccagccaggagcatcttccttccaccaaacgccgtgaacacgaccagctcctgggcagggacacctcctgcttacaggcgcctgtggcacagattccagtgaactaaccatctgcttttcccctttttctaatatctttacctacttttacttatatgtctttttttttttaacatttcttatttatttatggaaatataacaggacttgggaattaatgaatacaatatgatcacttaatttagtatttcaaagtgaggcaattagcttagggcattgtttgaaataaccacaatgcgcatacctattcaatcatttgtgtaaacagcatattaaggtaaatggtatgcacgtgaaaactgatttatctcagctgcctggaaactatcagaacaaagttcttgaattgtgagcaagaagggatgggcagaaaaggcaccccaattacgaagcctttgcagatgagaggcgtgggaggctgtattccgacaagaagggcaggcgagagacacccggcaaaccaccgggcaggcagaaccccggcggagcaagcactagcacgttccagggctgggcagggactgcgaccatttctagaatcgtcacaaagccatcgctgagacagacactcaggtttgcagaatactgtctacagtaaacaccaaatgcatccgctcttgcggctgccagctgaccctgcccagacaaaaggaacgggcagtcagtctcacagcagctccctgggaacacacctgggaagcccaggaggggaacgcggcctcctgggggtgtcccaggcactgaacccagagcctagaaacagcaacgttgcagggctcagggcgcactttccagagagaatgggaccacatccagggccccacaggccatacccgccgcaggtcttgagtctggcagccagggagggagcacagccgcctctcatgaaacaatggcaccctgctgtgcttcttcaagctggtctgtcactcactccctccctgcatccaaacaaggcaaggcccagaggctgcggtcacccaggtggccagtgagcaccaagcagcaccagtgacccctcgtggctgcctccctgcagtgccagttcttcatccgagacatcgctcaggagccctgctctggctcaggcctgaagatgccagtggcagactcagtcggccagtgtgaggggccaggagacgagacactgctgcccagtacagcaggagaattaatgcacacttgtacacgtgtgcacaatacacaagcaaccacatacacagacattcacagcatgcacacacaatgtatgcagacacatgcacatatgcagacacacaaccacataatgcatgcacattctcacatacacgtcctcacacatgctctcacaggcacacgttctcacacacatgcacattctcacatgcacacgttttcacacatgctcacactctcacatgcacacacatgcacagtctcacacatgcacacatcctcacacatgctctcacatgcatacattctcacacacatgcacattctcacatgcacgtttcacacatgctcacacactcacatgcacacacatgcacattctcacacatgcacacatcctcacacatgctctcacatgcattctcacacacatgctcattctcgcatgcacacgttctcacacatgcacacattctcacacatgcacatgctcacacgttctcacatgcacacatacacattttcacacatgcacacacgcacacattcacatgcacatacacattctcagatgcacacacatgcattctcacatatatacacattctcacacatgcacatgtacacattctcatctgcacatacatgcacacattctcacatgcactcattctcacccatgcacattctcacacaagcacacacatacacactcatatccacacacgtgcacacattctcacatgcacacacacatgctcacattctcacacatgcacacattctcaaacacacacgtaaacattctcatatccacatacatgcacacattctcacatgcacacacgtgctcacacatgctcacacatgtacacattctcacacatacacattctcacatgcacacacgtgctcacacatgctcacacatgtacacattgtcacacacacattatcacatgcacacacatgctcacacatgctcacacatgtacacgttctcacacacattctcacatgcacacacctgctcacacatgtacacgttctcacacatacattctcacatgcacaagttctcacacacatgaacattctcacacacatgcacatgtacacactatctgttctcacatgctcacacatgtacatgttctcatgtacacactcactactcacactcagaatagcagaaggagccctcaccagcctgggaccgccatgctccaggtgtcctgctgtaccaggctaggtcaccctttcattctttcctgcctcccctgctggggtccctcaggaccctgcctctctcccactgccccctcctggtggaggctgccttgccaaagtaccttcaatctgtaaatcccggtgccctgggacactggagctgcctctgaagtcccctccctgcagggagctggcagcgttgccagggttccctcggtcccatggggcttctcaaagcagcaccacagacggaggagcccactgctccatcagggtccccaggggtgcagcaacaagaaaaaaatctccccagctatttttggaggagggaaaagtaattacagctcagaatcactgccctgttgaaaggaattctccagagggagaaaaagccctttatctgaactgatcaagcacctgccatgcacatttctgcaaggaagctgtaaaagtgctcccattctgcaaggaagctgtaaaagtgctcccattctcagggagtagaaactgctgtcatggcatccagtcataactgctgcaaaaattccaggaggccaaaggtgaatcctgagagacagcaatggcttctgaggcccaaggaagcaggcactggctcaccacacacccaggtcagatttaaggagccgttggatccgtgggctgcgtccaaggcaggactgctgtgaagtctgagcagcttagttcgtaatgaaacctgaagataagccgagaccctatatcgctggaaattcctttattttcaaggatttcgttacagttcagagcagccactgacaggcagcagaaggcaggggacagagtgacagtgcctgggagcggccagcacagcctatgcatctgcagagcagcgtgaggctctgactggggaggagccccacgtccgggcagcacctgcacccacagcgggagcctcactgtccggagaggccagcttcccttgtgtgaggagcagggcccccattcctcccaccacccagatcccagtgaggcctgggatggtatatccaggagaggccagcttcccttgtgagtgtgagtgacgtctgcaggtgtcaggtcttatggtgagagtgtgggtgtcagtgacatctgcaagtcactaggagcggggcctccattcccccccccccgccacccagggatcccagggaggcctgggacagtaaatccaggagatcccagcttccctgagcgacaagcgggacctctgttcctctcgccacccagggatcccagtgaggcctgggacggtaaatccaggagaggccagcttcccttgtgagtgtgagtgatgtctgcaagcatcaggtcttatgatgagattgtgggtgtgagtgacatctgcaagtcactatgagtggggcctccattcctcccgccacccagggatcccagtgaggcctgggatggcaaatccagcggcgcacagcccactgcaccgagggaggcgcacgacagaagccacagcttgagggtgtgagccggcagtactgaggagcccagcagacaccggccaggcggggcagggggaagcgtggcgggtgggaggcccttctgggaggtgaggagcaggctaggaggggaggacagtgaagacagtgccaagaacacagccagtcatgcctccctcacggagcaccagcgcgcccagcacttcccagccttttacctttaaggatgccttaaacccccaccccaagcccatgaggctcctcctccatgcaacaggctgtgtgccgaaaccagccccgggtgctgctgttagcaggcggacggctgagaggcgaggaggtggggccttccttacacaggccccaaggacggctcacgctccagccacatgaggacacgtgaggaggcaccgtcgatgagccaggaggggactcgccagacaccagacgtcaaccctgccagggcggtgaccttggcttccagccttcagaactgagaaatcaatgtctgctgtttctaagccccgcaataggtggtactttgagcagccttcatggactaagacactgcgtattattatcccattgacgccatgtggaaattaaggcacagggaggttaaggaacttgctcagagttggcctgggagtcgcaacccaagatctgtccacatggtcccacttcaccgctcgaggctgtgtcctctacggagactcactttcactttagactgtagatgccagcgtctgactgagaaaatgcggtcaccatagctacatggagtgactggcagagtgtcctattctgcaaccaactcacaaaatcctcaggtcttgtatggcgactctcaccataagagctcacgcccgcagacgacactcacacccacactctcaccataagaggtgacatctgcagacgtcactcacacccacactctcaccataagagctgacacctgcagacgtcactcacacccacactctcaccataagagctgacacccgcagacgtcactcacacccacactctcaccctaagaggtgacacccgcagacgtcactcacacccacactctcaccataagagctgacacctgcagacgtcactcacacccacactctcaccataagagctgacacccgcagacgtcactcacacccacactctcaccataagagctgacacccgcagacgtcactcacacccacactctcaccctgaggtgacatctgcagacgtcactcacacccacactctcaccataagagctgacacctgcagacgtcactcacaccaacactctcaccataagagctgacacccgcagacgtcactcacacccacactctcaccctaagaggtgacatctgcagacgtcactcacacccacactctcaccataagagctgacacccgcagacgtcactcacacccacactctcaccctaagaggtgacatctgcagacgtcactcacacccacactctcaccataagaggtgacatctgcagacgtcactcacacccacactctcacaataagagctgaggcacaaagaggtcactcacatccatactctcaccataagagccgacacgtgcagacgtcactcacacccacactctcaccataagagctgacacccgcagacgtcactcacacccacactctcaccataagagctgacacccgcagacgtcactcacatccacattctcaccataagagctgatgcccgcagacgtcattcacacccaaactctcaccataagagctgacacctgcagacgtcactcacacccacactctcacgataagagctgtcacacgcagacgacactcacacccacactctcaccataagagctgacacccgcagacgtcactcacatccacactctcaccataagaggtgacacctgcagacgtcactcacacccacactctcaccataagagctgatgcccgcagacgtcactcacacccacactctcaccataagagctgacgcccgcagacgtcactcacacccacactctcaccagaagagctgtcacacgcagacgtcactcacacccacactctcaccataagagctgacgcccgcagacgtcactcacacccacactctcaccataagagctgacacccgcagacgtcactcacacccacactctcaccataagagctgaggcccacagaggtcactcacacccatactctcaccataagagctgacacccgcagaagtcactcacacccacactctcaccataagagctgaggcccacagaggtcactcacacccatactctcaccataagagctgacacccgcagacgtcactcacacccacactctcaccatacgagctgtcacccacagacatcactcacacccacactgtcaccataagagctgacacccgcagacgtcactcacacccacactctcaccataagagctgaggaccacagaggtcacttacagccatactctcaccataagaggtgacacctgcagacgtcactcacgccgacactctcaccataagaggtgacacttgcagacgtcactaacacccacattctcaccataagagctgacacctgcagacgtcactcaaactcacactctcaccataagagctgtcacgcacagacatcactcacacccacactgtcaccctaagaggtgacacccgcagacgacactaacaaccagattctcaccataagagctgacacccgcagacgtcactcacacccacactctcaccataagagctgacgcccgcagatgtcactcacactcacactcccacgataagagctgacaactgaagacgtcactcacatccacactctctccataagagctgacaaccgcaaacgtcactgacacccacactctaacgataagaggtgacatctgcagacgacactcacacccacactctcaccataagagctgaggcccacagaggtcactcacacccatactcccaccataagagccgacacctgcagatgtcactcacatccacactctcaccataagatgtgacacctgcagacatcactcacatccacactctgtccataagagctgacacccgcagacgtcactgacacccacactctcacgataagaggtgacatctgcagacgtcactcacacccacactctcaccataagagctgaggcccacagaggacactcacacccacactctcaccataagaggtgacacctgcagatgtcactcacacccatactctcaacataagagctgacacctgcagacgtcactcacacccacactctcaccataagaggtgacatctacagacggcactcacacccacactctcaccataagagctgaggcacaaagaggtcactcacatccatactctcaccataagaggtgacacctgcagacgtcactcacacccacactctcaccataagaagtgacacctgcagatgtcactcacacccacactgtcaccataagagctgatgcctgcagacatcactcacacccacactctaaccataagagttgacacctgcagatgtcacttacacccacactctcaccataagagctgaggcccacagaggacactcacacccatactctcaccataagagctgatgcctgcagacgtcactcacgtacacacttctcaccataagaggtgacacatgcaaacgtcactcacacccacactctcaccataagaagtgacacctgcaaacgtcactcacacccacactctcaccataagaagtgacacctgcagacatcactcacacccacagtctcaccataagaggtgacacctgcagacgtcactcacacccacactctcaccataagagctgaaacctgcagacgtcactcacacccacactctcaccataagaagtgacacctgcaaatgtcactcacacccacgctctcaccataagaagtgacacctgcagacatcactcacacccacagtctcaccataagaggtgacacctgcagacgtcactcaaacccacactctcaccataagagctgtcgcccgcagacgtgactcacacccacactctccccaaaagagctgtcgcccgcaggagtcactcacacccacactctcaccataagaggtgacatctgcagacgtcactcacacccacactgtcaccataagaggtgacacctgcagacgtcactcacacccacactcgcaccataagaggtgacacctgcagacgtcactcacacccacactgtcaccataagaggtgacacctgcagacgtctctcacacccacactctctccataagaggtgacacctggagacgtcactcacacccacactctcaccataagacctgacactcgcagacgtcactcacacccacactctcaccataagagctgatgccggcacacgtcacacacacccacactctcactataagaggtgacacctacagacatcactcacacccacattctcaccataagagctgacacccacagacatcactcacacccacactgtcaccataagagctgaggcccacagaggtcactcacacacatactctcaccataagagctgacacccgcagacatcactcacacacacactctcaccataagagctgaggcccacagaggtcactcacacccacactctcaccatagagctgacacccgcagacgtcactcacacccacactctcaccataagagctgacacccgcagacgtcactcacacccacactctcaccataagagctgtcgcccgcagaggtcactcacacccacaatctcaccataagagccgacacccgcagacatcactcacacacacacgcgtcactcacactcacactctagccataagagctgacgcccgcagacgtcactcacacccacactctcaccataagaggtgacacctgcagacgtcactcacacccacactctcaccataagaggtgacacatgcagacgtcacacacacccacactctcaccataattggtgacacctgcagacggaactcacacccacacatgtcactcacacccacactctcaccataagagctgacacatgcagacgtcactcacacccacactctcaccataagagctgacacctgcagacgtcactcacacccacacgtcactcacacccacactctcaccataagagctgacgcccgcagatgtcactcacacccacactctcaccataagaggtgaaacctgcagacgtcactcacacccacactctcaccataagaggtgacgcccatagacgtcactcacacccacacacgtcactcacacccacactctcaccataagaggtgacacctgcagacgtcactcacacccacactctcaccataagagctctcgcccacagaggtcactcacacccacactctcaccataagagccgacgcccgcagacgtcactcacacccacactctcaccataattggtgacacctgcagacgtcactcacacccacactctcaccataagaggtgacacctgcagacgtcacacccacactctcaccataagaggtgacgcccgcagacatcactcacacccacactctcaccatagagctgacgcccgcagacgttactcacacccacactctcaccataagaggtgacacctgcagacgtcactcacacccacactctcaccataatagctgtcgtccggaggcgtcactcacacccacactctcaccataagcgctgtcgtccggaggcgtcactcacacccacactctcaccataagcgctgacacctgctgacgtcactcacacccacactgtcaccataagagctgacacccgcagacgtcactcacatccacactctcaccataagaggtgacacctgcagacgtcactcacacccacactctcaccataagagctgaggcccacagaggacactcacacccacactctgaccataagaggtgacacatgcagatgtcactcacacccacactgtcaccataagagctgatgcctgcagacgtcactcacacccacactctcaccataagaggtgacacctgcagacgtcactcacacccacactgtcaccataagagctgaggcccacagaggacactcacacccatactctcaccataagaggtgacacctgcagatatcactcacacccatactctcaccataagagctgacacctgcagacgtcactcacacccacactctcaaccataagaggtgacacatgcagatgtcactcacacccacgctgtcaccataagagctgatgcctgcagacgtcactcacacccacactctcaccataagagttgacacctgcagatgtcactcacacccacactctcaccataagagctgaggcccacagaggacactcacacccatactctcaccataaaagctgatgcctgcagacgtcactcacgtacacacttctcaccataagaggtgacacatgcaaacgtcactcacacccacactctcaccataagaagtgacacctgcaaacgtcactcacacccacactctcaccataagaagtgaaacctgcagacatcactcacacccacagtctcaccataagaggtgacacctgcagacgtcactcacacccacactctcaccataagagctgacacctgcagacgtcactcacacccacactctcaccataagtgacacctgcaaatgtcactcacacccacactatcaccataagaagtgacacctgcagacatcactcacacccacagtctcaccataagaggtgacacctgcagacgtcactcacacccacactctcaccataagaagtgacacctgcaaatgtcactcacacccacactctcaccataagaagtgacaactgcagacatcactcacacccacagtctcaccataagaggtgacacgtgcagacgtcactcacacccacattctcaccataagagctgtcgcccgcagaggtcactcacacccacaatctcaccataagagccgacgcccgcagacatcactcacacccacacacgtcactcgcactcacactctagccataagagctgacgcccgcagacgtcactcacacccacactctcaccataagaggtgacacctgcagacgtcactcacacccacactctcaccataagagctgacacatgcagacgtcactcacacccacactctcacaataattggtgacacctgcagacgtcactcacacccacacatgtcactcacacccacactctcaccataagagctgacgcccgcagatgtcactcacacccacactctcaccataagaggtgaaacctgccgacgtcactcacacccacactcaccataagagttgacacctgcagacgtcattcacacccacactctcaccataattggtgacacatgcagacgtcactcacacccacacgtcactcacacccacactctcaccataagagctgacgcccgcagacgtcactcacacccacactctcaccaaaagagctgacgcccgcagacgtcactcacacccacagtctcaccataagaggtgacacctgcagacgtcactcacatccacactctcaccataagaagtgacacctgcagacgtcactcacccacactctcaccataagagctgtcgcccgcacaggtcactcacacccacactctcaccataagatccgacgcccgcagacgtcactcacacccacactcgtcactcacactcacactctcaccataagagctgatgcccgcagacgtcactcacacccacactctcaccataagagctgtcacccacagacatcactcacacccacactgtcaccataagagctgacacccgcagacgtcactcacacccacactctcaccataagagctgaggcccacagaggtcacttacagccatactctcaccataagaggtgacacctgcagacgtcactcacaccgacactctcaccataagaggtgacacttgcagacgtcactaacacccacattctcaccataagagctgacacctgcagacgtcactcaaactcacactctcaccataagagctgtcacgcacagacatcattcacacccacactgtcaccctaagaggtgacacctgcagacgtccctcacacccacactctcaccataagaggtaacacctgcagacgtccctcacacccacactctcaccataagaggtgacacccacagacgtcactcaaacccacactctcaccataagaggtgacacctgcagacgtcactcgcacccacactctcaccataagaggtgacacctgcagacgtcattcacacccacactctcaccataattggtgacacctgcagacgtcactcacacccacactctcaccataagaggagacacctgcagacgtcattcacacccacactctcaccataattggtgacacctgcagacgtcactcacacccacactctcaccataagagctgacgcccgcagacgtcactcacaaccacactctcaccataagaggtgacacctgcaaacgtcactcacacccacactctcaccataagaggtgacgcccatagacgtcactcacacccacacacgtcactcacactcacactctcaccataagagtgtgacacctgcagacgtcactcacacccacactctcaccataatgagtctcgcccgcagaggtcactcacacccacactctcaccataagagctgacgcccgcagacgtcactcacacccacactctcaccataattggtgacacctgcagacgtcactcacacccacactctcaccataagaggtgacacctgcagacgtcacacccacactctcaccataagaggtgatgcccgcagacatcactcacacccacactctcaccatagagctgacgcccgcagacgttactcacacccacactctcaccataagaggtgacacctgcagacgtcactcacacccacactctcaccataatagctgtcgtccggaggcgtcactcacacccacactctcaccataagcgctgacacctgctgacgtcactcacacccacactgtcaccataagagctgacacccgcagacgtcactcacatccacactctcaccataagaggtgacacctgcagacgtcactcacacccacactctcaccataagagctgaggcccacagaggacactcacacccacactctgaccataagaggtgacacatgcagatgtcactcacacccacactgtcaccataagagctgatgcctgcagacgtcactcacacccacactctcaccataagaggtgacacctgcagacgtcactcacacccacactctcaccataagagctgaggcccacagaggacactcacacccatactctcaccataaaagctgatgcctgcagacgtcactcacgtacacagttctcaccataagaggtgacacatgcaaacgtcactcacacccacattctcaccataagaagtgacacctgcaaacgtcactcacacccacactctcaccataagaagtgacacctgcagacatcactcacacccacagtctcaccataagaggtgacacctgcagacgtcactcacacccacactctcaccataagagctgacacctgcagacgtcactcacacccacactctcaccataagaagtgacacctgcaaatgtcactcacacccacactctcaccataagaactgacacctgcagacatcactcacacccacagtctcaccataagaggtgacacctgcagacgtcactcacacccacactctcaccataagagctgtcgcccgcagacgtgactcacacccacactctccccataagagctgtcgcccgcagaagtcactcacacccacactctcactataagaggtgacatatgcagacgtcactcacacccacactgtcaccataagaggtgacacctgcagacgtcactcacacccacactcgcaccataagaggtgacacctgcagatgtcactcacacccatactctcaccataagagctgacacctgcatacgtcactcacacccacactctcaaccataagaggtgacacatgcagatgtcactcacacccacgctgtcaccataagagctgatgcctgcagacgtcactcacacccacactctcaccataagagttgacacctgcagatgtcacttacacccacactctcacgataagagctgaggcccacagaggacactcacacccatactctcaccataaaagctgatgcctgcagacgtcactcacgtacacacttctcaccataagaggtgacacatgcaaacgtcactcacgcccacactctcaccataagaagtgacacctgcaaacgtcactcacacccacactctcaccataagaagtgacacctgcagacatcactcacacccacagtctcaccataagaggtgacacctgcagacgtcactcacacccacactctcaccataagagctgacacctgcagacgtcactcacacccacactctcaccataagaagtgacacctgcaaatgtcactcacacccacactctcaccataagaagtgacacctgcagacatcactcacacccacagtctcaccataagaggtgacacctgcagacgtcactcacacccacactctcaccataagagctgtcgcccgcagacgtgactcacacccacactctccccataagagctgtcgcccgcagaagtcactcacacccacactctcactataagaggtgacatatgcagacgtcactcacacccacactgtcaccataagaggtgacacctgcagacgtcactcacacccacactcgcaccataagaggtgacacctggagacgtcactcacacccacactctcaccataagacctgacactcgcagacgtcactcacacccacactctcaccataagagctgatgccggcacacgtcactcacacccacactctcactataagaggtgacacctacagacatcactcacacccacattctcaccataggagctgacacccacagacatcactcacacccacactgtcaccataagagctgaggcccacagaggtcactcacacccatactctcaccataagagctgacacccgcagacgtcactcacacacacactctcaccgtaagagctgacacccgcagacgtcactcacatccacactctcaccataataggtgacacctgcagacgtcactcacacccacattctcaccataagagctgtcgcccgcagaggtcactcacacccacaatctcaccataagagccgacgcccgcagacatcactcacacccacacacgtcactcacactcacactctagccataagagctgacgcccgcagacgtcactcacacccacactctcaccataagaggtgaaacctgcagacgtcactcacacccacactcaccataagaggtgacacatgcagacgtcacacacacccacactctcaccataattggtgacacctgcagacgtcactcacacccacacatgtcactcacacccacactctcaccataagagctgacacatgcagacgtcactcacacccacactctcaccataagagctgacacccgaagtcagtcacacccacacacgtcaatcacactcacactctcaccataagagctgacgcccgcagatgtcactcacacccacactctcaccataagaggtgaaacctgcagacgtcactcacacccacactcaccatgaggtgacacctgcagacgtcattcacacccacactctcaccataattggtgacacctgcagacgtcactcacacccacacgtcactcacacccacagtctcaccataagagctgacgcccgcagacgtcactcacacccacactctcaccataagaggtaacacctgcagacgtcattcacacccacactctcaccataattggtgacacctgcagacgtcattcacacccacactctcaccataagagccgacgcccatagacgtcactcacacccacacacgtcactcacacccacactctcaccataagaggtaacacatgcagacgtcactcacacccacactctcaccataagagctgtcgcccgcagaggtcactcacacccacactctcaccataagaggtaacaccttcagacgtcattcacacccacactctcaccataattggtgacacgtgcagacgtcactcacacccacactctcaccataagaggtgacatctgcagacgtcactcacacccacactctcaccataagaggtgacacccgcagacatcactcacacccacactctcaccataagaggtaacacatgcagacgtcactcacacccacactctcaccataagagctgtcgcccgcagaggtcactcacacccacactctcaccatagagctgacgcccgcagacgtcactcacaccgacactctcaccataagagctgacacctgcagacgtcactcacacccacactctcaccgtaagaggtgacaccagcagacgtcactcacacccacactctcaccataagagtgtgccccgcaggcgtcactcacacccacactcaccatatgagctgacacctgcagacgtcactcacacccacattctcaccataagagctgtcgcccgcagacgtcactcacacccacactctcaccataagaggtgacacctgcagacgtcactcacacccacactctcaccataagagctgacacccgcagacgttactcacatccacactctcaccagaaggggtgtcacctgcagacgtcactcacacccacactctcaccataagagctgtcgcccgcagaggtcactcacacccacactctcaccataagagccgacgcccacagacgtcactcacacccacacacgtcactcacactcacactctcaccataagagctgacgcccgcagacgtcactcacacccacactctcaccatagagctgacacccgcagacgtcactcacacccacactctcaccataagagctgacacctgcagacgtcactcacacccacactctcaccataagagctgacatctgcagacgtcactcacacccacactctcaccataagagctgacacctgcagacgtcactcacacccacactctcaccataagagctgacacctgcagacgtcactcaaacccacactctcaccataagagctgacacctgcagacgtcactcacacccacactctcaccataagagctgacacctgcagacgtcgctcacacccacactctcaccataagagctgacatctacagacatcactcacacagtcaactcagtcagtccttatgataacccttagtggcataaactgtcatggtccccattccatattcagaaactagagcccagagaggttgggtgccttgctggagcccatagaggaatgggcagcggcaggaaagtctgactgacacttagcacccatgagggaggtacggaaacaggatcaaccattccagaccaccgggagctcaggaaacctcatcatcgtgctcacttgagccaagatccaggaaatattaagtccttaggggcttcaaaagcgaaggagaacggcagggtggacaagtgctgggttcttttcagccagcacatgccgatgaccagctctgcgttgcagtgagctgagattgcgccattgcactccagcctgggcaacaagagtgaaacttcatctcaaaaagaaagaatgtaaccatcaaaattaaaacttctgtgcatcaaaggacactattagcagcaggaaaaggcagccagggagtggggaaatatttgccctcatctatctgataagggatttgtatccaaaatacataaagaaccacaactcgacaacaacaacaaaaaacctgattaaaaacgggtaaaggacctgagtagacttttctccagagaagatgtacaaacagctgaaagcacagggaaggcgcccagcatcaccagcgtcaaggcaacgcaaatcaaaaccacagtgagacctactgcccgctcagcaggacatctgctatcaaaaaacgaaacgaagcaaaaccgaaaataacgcgtgtgggtgagaacatggagaaaatagggccctgtgctccgcgggcaggaacgtaacctgatgcagtcgccgtggaaagcacacgggaaaagttcaatgtggaagtagcagatgatccgacagccccatttgattttacacccaatacctgcaagcagggctcgcgcagaggctcaggcagccatgctggtggcacatgggctgtcgcgactgctcccggtggaatcagccccatttctgattttacacccaacacctgcaagcagagctcgcgcagaggctcaggcagccatgctcgtggcacgtgggctgtcgcggctgctcccggtggaatcagccccctttctgattttacacccaacacctgcaagcagggctcgcgcagaggctcaggcagccatgctcgtggcacgtgggctgtcgcggctgctcccagtggaatcacagctacaatcgagctcaggtaaaggcttccatggagggtctagactgcatttccaggcaccaggatgagtttaaattcagctcccaaagaagaccagtgaacacaccaatgaacatacacttcacactgccacaccccaagataagacccagaaactcacattcagggaaagacagcccctcttacatgccacccagacccccatacgagagtgtcagaccccagcaccttccaaaaacacaaaatgtccccctgccgaggagccagcacctgggcccttagaagccgtgacaacgagcagcaaagcgcagggcctcacccaagagatacccaggacagcacagacgggggaagctccagcaaccccacacaggccccaagaagccaccagccagaccaggctcgggaagagctgtcttcagcaggaacaaggcagtttagtaactagaagcaatatgggatggggctgagccatcatcaggagctccgtccagtggggagcattggccccagtcgcaggcaagggaggctgtttcaagtttaggcctccagaagaggcagctcctcgaccaaactgaagacacataatttcctgttaaattaacacttgcaacgccttgcacccaggtcttgaatgctaattatactcgccggcatttaatacaagacaccctggagtctgggctgaaatgccacacaggaatctggaatcgcataaaacgtggaaaaccagacttttctagcccaagaatgagtgagatgtaaaaatcaaagaggtcccacacgtaacccaccaagaaagaacaagtgaggctgtgttgctggaggtggtcgctctccccaagctcagtcctgacagaaatgacgctctgacggtgcacgatttgcaatgtgcaggaacagaccccagcacctttcatcggtgggtttaggagaggggcccaggggaccctggcactcctctgatgagaaatcaggcaccagcttgtgcatctgtttccctggaaatcactgcttccctgttggtttgcacatgtcctgtcagccctgtgaggtgagaacccagaagctgatggacgatacccaaaacagagctttaggcagaagacagcttggacccaaggcctcagttaggccatggagggaaagtatggtgcggacacctgggaccgcagtgggcgggagaaattctggaggataaaatgttgggccccagtgctccatctctgagggtggaccctgctgcctgggagcagtcctggcaggacccccacagtccacgtgactgatggtctaggcctatgtctgctcaactatgatggcataaacacccctcccagcagagccttgaaactaaagaagtcatctgagtgactagacgttaacaaggagagaaaacctaactgcctgtctcctggccaacgggaagacaggttttttgtcttactttgggttttgtcttaatttgggttttttgtgggctactctggtaaccagagctttgtctggagacagcgtgttcttataggaggccacagagggttttatgaagagtaagcttcggaggctcaggaggacttgtatttttgagcagggtggagcaagagaaagaacaaagacaaaggccaccggttttggaagccccaggtagaaggagacagggtcttccacccccgtggaaaaacctcctgaagctacaagctggggccaaagctggtgtggcagcagtggtcacccagagctttccaatgccgtccactcatcccaggtggggaaactgaggctgaggaagcaaaatgacttggtcacacacattttataatttacaattgtatatatatatgggtgtccattttcacacagctataaagaactacccaagactaagtaatttttgaagaaaagagatttaattgactcacagttccacagggctggggaggcctcaagaaactagtcatggcaaaaggcgaaggagaagcaagcaccttcttcctgaggcggcagaaggagtgggggtggggggagtgctacacttttaaaccatcagctctcatgagaactccctcactatcacgagaacagcgtggtggaaaccacccgcatgatccagtcacctcccaccaggtccctccccaacgctggggattacaactcaaggtgagatgtgggtggggacacagagccaaaccatatcaatgggtacaaggcaatgctatgatttatgaatacaatgtggaataattaaatcaagctagttaacatatccatcacttcaaatacttaacatttttgtggcaaaaacatttggaatttgttctctcagcagttttgagatgtataaccgtctactgttatcttcatcacactgtacaatcgaactcaaaaaattgcccctgagatttgtgccctccacctgttatctccccattccctccacccctggcctctggcgacctcagttctactctctgctactgtgagttcaattgttttcagttccacatatgagtaagatcatgcggtatttgtctttctgtgcctggcttatttcactcagcgtaatgctttccaattccatccatgatgctggaaatcacagaattccttcctttttaagactgaatagtatcccactgtgtctttatccatccatctgtcgatggacatttaggttgattctatgtcatggccattgtggacagtgctgcagtaaacatgagggtgcagatctctcttcaacatgctgattttacttcctttggataaatacctcatagtgggattgctagatgatatggtagtttgttgtttgagaggcctccatacagttctccataatgactgtaccgatttagattcccaatagtgcacaagatttcccttttcaccacttcctcaccaacacttgctgtctttttaataatagccattctaacaggtgtgatatgatatcccattgtggttttgatttgcatttccctaatgattagcacagttgagcatcttttcacatacatgttggccatttttatgtcttcttttgagaaatatctactcagattctttacctgtcttttaattgggtttttcattttcatgctattgagttgtttgagcttattatatattttggatattaagcccttattggatgtacagcttgcaaatattttctccccatccttaggttgtctgtgcactctgctaactgttttgtttgctgtgtagagctttgtatttgatataatcccatttgtttatttttgattttgttgcctgtgctttggggatcaaataaaaaaaattgttgcccaggataatgttatgtcattttgccctgtgatttcttctagtagttttacagtttcaggtcttaaatttaagtctttaatcccttttgagtttttgtatgtggtgagagataagttctaatttcattcttctgcatgtggatatccagtttttctggcaccatttattgaagacactgtccttttcccattatgtgttcttgccacttttgctgaaaatgaattgagcataaatgcatggattcatttcctggctctctattctgttccattagttgatgtgtctattttgttttgttgttgccagtaccacgttgttttggttattatagtttcatagtatattttgaaatcaggtggtgtgatgcatccagctttgttcctttggctcctgattgccttggctattcagggttttatgtggttccatatgaattttaggattgcttttctatttctgtaaaaaaaatgccattggaattttgataggggttgcactgaaactatagattgctctaggtagtacggacattttaacaatattaattctttcaatcaatgaacatgggataccttctatttatttgccttgtcttccatttctttcaccatctcatagttttcagtgtacaggtctcaccgtctgggttaaattaattcctatctattgcagtcacacatttttttagtggcagcactcaccttcttgagtgaaccatggaggttgtggcatttgcttgtcaagggccttgcattcctgggggtgccccctctgctgttgtggtatcctaggatggctgtcaatccctaaacttgctcccttgcggcccaggagccacaagaacatctcattccctgcccagtcactggtcaggtgcaggccctgacccattccaaaccacggccccctcctacatgcttttctctggtggaagattctctcttttcatgcagattggttgctaagccctgtgaacaggagtgaacaggtggacaagcagccatcccaacaccacacaaagagagagaaactggagacaaaagcagcggggagatgctgcagatcccggccactgtgccagagccaccctgggttcgccattcacagccccagagccaccctgggttccccattcacagccccagagccaccctggggtccccattcacagccccagagccaccctggggtccccattcacagccccagagccaccctggggtccccattcacagccccagagccaccctggggtccccattcacagccccagagccaccctggggtccccattcacagccccagagccaccctggggtccccattcacagccccagagccaccctggggtccccattcacagtccagtatgccccacgtgagtctgtgttggcttctgtcacttgcagtcctgagtgctgagctgggccaggcccccaacacctgaggtccttccctccctcacagagttttcatgctcagttgtgaggtatggtgatggccacaggcccgaatcctaaccaccacagcacaggacttctcaaagagaccgtcactgtgtctcctgccccaacaaggtgaacagttctgggatgctaatccccactcactcattccatccccatcctggagcctcctggacagattccatcattaccctccctcaggaggaggcagtgctgagggtggcccacgtcactgcacccctgggtggtccctgagggcactgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggcccctgagggcagtgctgaggatggcccacgtcactgtgctccctgggtggtccctgagggcagtgctgagggtggcccacgtcactgcacccctgggtggtccctgagggcagtgctgagggtggcccacatcactgcacccctgggtggtccctgagggcactgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggtccctgagggcagtgctgagggtggcccacgtcactgcacccctgggtggcccctgagggcagtgctgaggatggcccacgtcactgtgctccctgggtggtccctgagggcagtgctgagggtggcccacgtcactgcacccctgggtggtccctgagggcagtgctgagggtggcccacatcactgcacccctgggtggcccctgagggcagtgctgaggatggcccacgtcactgtgctccctgggtggtccctgagggccccccgggccacatgaggcccacccccttcctgatgtccaagaacaagggcgttactagcgctcacgtgttcccctttgcagactaggtcacaggatacagcacggattccttccggcaaaaggtgctcagtaaagtggattgcagcatcctgtgtctcccctaaaacatcctcaaacagaatggctgcaccaagatgtatgggatctgtaccaagacatgggtaaaaagaaggccctggcatgttcacctgattgttactcaaaagccccacagatggaggctccattgagcattgaccctgaggccctaagagttgctgcccgaggagagatgctcaacatcagccggcacttccatctccgctccctctggcaggaacaaactccactgaaacaggcggctctttcccaagcaggggcaggactggctggttgccgtgttcccaggaaacatgtacagggtacctgcttcacccaggaagtgcagggaggttggaatgaaacctcagaaggatggagaggctgctcagaagatgctgactgcgggcctgcttctggtgtctgactgccgtctgcacccagaatctgcctgtcaattttgtcttcaatgattttgaaactcctgggggtgagggagctggagacaaatagtgacttagagtcccataacacatttgtccccatcaccccattggatctcagggctgcctgtgagccaggctgtgcaggaaggaaggtgccagagctgctgcctaaggtgccctagggacaggagagcccctgcctcctgccggccactggatccacgcccagtggatcagtcgctcatcaccggccaggccagtgcctcgcctcacctcacccagcctcacagttcagatgaggaaacagacccagaaggagcaagtagctggattctaggctatcaacaaaatgccaaaggcagaaaaaaccctgattttccaaaagggaaaaaaatgttggaatacaaatcaatttgtctgctgtttaccaaagctcattctctcccccagcgtttccaaatcccacccggcacacctgtggcccattcaggtgccagttccgtcaactgcctggaaatccctgcagagaacaacggcacacctgagcctcttccagagcccacagttatcccattacgaaatgaaaagctgctttggggaatgctgtgttgatgtgtcagcatcaaactgttatgcgggaggcagaaggacctcaccgacggcatctctcgccacctcgagggcacgggtgaggtgcaggaggaactcgtgctaccacctccacccacccccaggggttctgccccttcagaaggagggtccaggagggggactcacccgctggcaccattggccactgcacactattccccagctccctcctactgcaccccatgagccaccctcagttgggccccatccctgagtcccttttgggttcctaattgttgggcacagtctaagcccagggctccctgcaggcctgcagctgtctggggcgactcgtacactgtacctgctttccttcgttgctcacacagcagccgacacagtcactcaaaactcccatttgtgaaagtaagtggccttttaaagaatgctaaaacattacgggcactttagccccgcgtttcttactacacgaaacatggttacctacgagtgaaatggcagaaggaatgaccttattaacgcctcatccttctcaagggcaagagagtgcaactcaacaactccatgtgaacacctgccctggcatgcaggcagccgggccagtccacagccagtcacggccccacgggaggagccttctgagtgacagatatcattttcattcaggggggcttgaactctggccatcagaagagctggttactacaaaggtagcagaacaggaagtactgagaagaaagtgcacctttctgaccacccactcccagcccagctcccctcctgtctgctcgcctcctgtccgctcccctcctgtccgctcccctcctgtccgctcccctcctgaccgctcccctcctgtccgctcccctcctgaccgctcccctcctgtccgctcccctcctgtccgctcccctcctgaccgctcccctcctgtccgctcccctcctgaccgctcccctcctgtccgctcccctcctgtccgctcccctcctgtccgctcccctcctgaccgctcccctcctgtccgctcccctcctgtccgctcccctcctgactgctcccctcctgaccgctcccctcctgtccgctcccctcctgactgctcccctcctgactgctcccctcctgtccgctcccctcctgtccgctcccctcctgactgctcccctcctgtccactcccctcctgtctgctcccctcttgactgctcccctccctgccagctaccctcctgaccgctcccctcctgtccgctcccctcctgaccactcccctccctggccagctactctggagcaaacttacacaagcacacagcaggacccaaggatcagcttcgataggcattttccagaagtgcattagaatggctgcttcaccctcctgtgatgatgcctggaccctgaggtgggtcaggcccctcccgtgctgcagccgattcgtggctggattaaacttcttattgccccctgaaggtgaggtcaggcagcagaagcatcgtgcagctaggaatagaaggctctgggccccacacatttcagagaggcgtaattggggtaggctggtattggtaatcctgagtacaatattgattgacaaaaacgaatcacacctgagcctcaaagctcttagcccttccctgcaaagaaaactctctcttagaattaccaaatatagctttcaatcccttcaatctaaatgtttcaggtgagagcagagatagatttttcgaatggagacattaacctttctgagctgcagctgcctggctctctctgcctgttactctgtttctggaacatggcagctgctttcgccgcaccagggcctgcaccaggccacccagttacattcaggccaccctgggccaataggccagacactcgctcctattccgggtctcctaacagcaggccaacagatcacaccctgttagtatttagaataatcaagatttttatcagaagttgaagagaacagcagcatgtatttcactcaggacccttcattttacaaataagaaaactgaggtcctccacagccgtgctgcccactgggagcaccccctgcctcacaccacatcatccaataccacgatgcagatgtggtcctcactcttggccctgatggggcactctagcatcccactgttttccttaatagaaaacaacacaatagaagttaaggtcagagtcaaaagatgacacatcactcggggctttataaaatccaggactcatgtaaacaagtcctaaaactatgagtggacattcacttgctaagcacaatgttgaagttatggctgaaagcttactttacatttgcctaagaccacacttgtcatacacacctaaaaccatctgctgtcttctgagttctattaaaggacaatgagaaaacagcaattgaaatggggtttctggttccaaacggcaggacaggagcaagctgtctcaccaccccagcagaaacctgaaagcaaacatgcagtgctgagatgctgagatggtcaccagcaacatctgagaacccagaggtgaggatgagtcaggtcctggggccaccaggaacagaaaaaccccgaacagacagacagcaggagaaccagacccccacatctgcaaggcccctccccataacctgcctggcatccagtacacaaaagattttcccttgacacagtttctacacttagaaaggtgagataacaacagcttgccctgctcttgggtgccctggcaggagacctctccctgcctcaacccatggggagcatcctgagtgcctgaagggagaaacagccctgaggatggccagagacaaaggtgggggtggggctactgtccccagccctggaaactctgctctgcaactcggccaaaggaggcactcaatcagagtggccactcgcagccccacgctgcaggacctgtgctcccaggtcccctcccagccttcccacgttatcaggacatcccctttgggacatctgctttgggacaggcagcactttcatcagtgaccagagctgagttgaacctgggcttaaggcgccatctagtgccaaaaaggaggctgcaacctagcaagaaaacactccacaggtaaatcacaaagaatctttaagcaaacataccccagaaaaaccaaaacacccagacagagaagagataaataaataaccgttcagtgccaagacacagacacacatcaacaaaccagaaagcagcagacgggaccatggcctccccaaacggacaaagccaagaaccagtgactggcccaacaaagtggcgatttgtgagctctcatcaagaaatcaaaatggcagccctaaggaaactcggtgatccccaagataacaccaggaaatcaattcagaaagttaacaacagattgaaataatttttaaaaatcagacagaagtcttgaaacaaaaatacatttagcgaaatgaggaaattcatgacaagctcccaacagcagagtggcttaagcagaggaaagaatcagtgagctcaaatacacaatcagaggaggaaaaagaacaaagaatgaaagacaacctacaagatagagaaaattacctcaaaacaccaaatccaagaattactggtgttcaagagggagctgagtgagaacaagaggtaccaagcttactcaaagaaacagtaacagaaaactttctgaaacttgagaaaggtatagataaccagattcgggaaagtcagagaacaccagattcaacccaaatatgaccacctcaggcttttaataattaaactgtcaaagctcaagggcaaagagaagaccccaaaggaagcaaataacatctaaaggagctccaatttgtttgtcaacagacatctcaatggaaaacatacagaccaggagaaaatgggatgatactttcggagtcttgaaaggaaaaaaaaaaaaaatctgtcacccaagaatactgtatccagcaaagctacccttcaaatacaaagaagagataaattctttcccagacgaacaaaagctgagagaattcatcaccaccaaacccaccttacaataaatgctgaagagatctcttcattcagaaagaacaaaaatacatcgaatggggcactaagagggcagattctcattccaccttgccaccagcctgctgtgcaaacttgggcaaatcacttcacttctctgtgcttccatttcctaaattgagaccaatgaattcggtattttctaggatcctttccaatcaaatgttctgtgtttgcatgatgatagctagggtgctgcagcataagtgtctgtaatttagcttttgtgagctgtgaacattgcctgcctctctctcactctcctgccagctgctcacactgtgtcatctgtccgtttgtgtcaacagagaactgaggaaatgcaactgcagtgcagccctgcaatgggctggccaccagcaacaacggcaggagaggcaggagcagtcaggcaggctgggccccagaagcacgcagtggagaagcccgcagcagtgcagagggatgtccttatgagccaggacagagtcccctcatttgctggactctgcagaactacactggctgcatccaaaacccagtactcaccaccagatggcaacagggagaatctgcgtgcacaggagccagcctgaaggaagcatccagggaacgcaggggaagagcgtgagcgtgaaccccaagatgatggggtgagacctcgctcacaggcagatgcgaatcctccacgtggggatgcgggaaggctgttcttgccaaaggctgatgatgaccctgctgcctctctgcttatctgccctcgaaacagaatgtggttccaggcgccaccacccagcctagcagccgtcatgggcccacagtgattgagccctcaatcaaagcttttttattattatggaaaattacaagttttttcacaatgagttttcacacacatataaatcaatggaaaatgtcttcttggctgtctttatggtatttaagtaaatgattaaagttttcacagttgggataaaggacatccaatgtaaaagactgccatttctgaaaataaagacaatacaagctggtcatcactgttgacaaaaatttcctcgggaatctaaaataaccaacaagtcactcatttccctttgtctaacctactacatgcattttttatttataaagccccactcaacttatctttttcccctttcatcctgaattctgggagctcaaaggcaaccttaaggcttagttgcaggaactctgttgaccttgtgggaacatttgcttctttttccttccctatcacattcccacttcaaattcatcaactcatagagtatctttttgttgcttccttgggtttttttggacaaggaaagttgaacataatcaaaaacaacagtggtgaagtcctcacccaacactgccagcaatctgtggagcacagggcttcccacccggcagataagaaccccatgcacacctcttaaataaacaggctgatgctgagcaggcaccaccatccaggcaccatgctgagcgctgtgcgtaaagaaaatacaaagatcagccagacagagcctgtgctgcaaggagcccacattttatttgaggggccagataggtcacaattcataacataacaaagcaaaaggtgaaaagagctaaaaaaaaaaaagtagaaataatttctgataaattttctcttagcttttctatggggaaatcaggagaaatggactgactgggagaaagcttctggggaccaagtaaaacccatcacgatcatcatcgaaactgtggctgggaagatcctgggccccagcacagggtcaggtgggctctgtgctggccgggagagcggcctccgtctggctaccaggcctctctggactgcagagttagtttttctgcaagtaacagagtggaacccaatggcaggaacatctccaattccgaaattccatggtcctgtgcaaacaaccagaaaatagaaaccaagatttgaggacggaagaggaaccggacgaatgatgtgaacacggggcttgtttgcaggtagagtttactgggggaaagcatccacattacataaaagagaaaggagacaaaacgacgcccggcagtgggtgcccggcttgcaggcctctgcggcaggtctgtgggttccctggcccagcggcaccacccaaaggcgagggccaggctgtcgttgacgccctgtggcagcacctcagtgatttcaggggtggttttgactctttctgtggaggtgacaggaggtgcctccatcacagacacaaatggtggcttcctggcttgctcggtagacgccaggctatgctcaccccaaggccagaccccggacaaggccaggggctggcccaacactggccttcagggtgctgggcaacctgcatttgctgcgcagcccaggcccacccaaatcactgagggcgtcacacaggcaccgtcagctgcgggtgctaagaaaagcggcaggagaggaggaaggcagcttatctgtgcagccgtcagccatcagcaagcctgtagcagccactgccaagcaaccgggacccagctcttatgtcccgtaaggttccagggaccattccggggagaaagaagggcctggtcccagggcaggaagctcacaaggcaggaggcgcattgcgtccagcaggggtgtcccattgggacagtggcggctctcagaacccagccgccagccctcaactctggctcaccgtcccaccaccaactagagggccccggccaagccaagggcaaagtaggggacacacttacaatcaggggtgcatggggctcctcccctccccttgtgtgtgcatgtctctgtttctctctttctgtctctgtctctctctttttctctctctggccctcccacaaggcttaaggtggctccttagaatggaaggcccaactttgtgagttactcgaatacatgaactcagcccaggacagtgggaacagcagcccggctcacccctgcaggcggggactgggtgcccagcaagcctcgggaggctgccccaaaccaaccacagggagacctgagacgccctacgcccacctttcttccggcctggtcttaaactggtgggaggggcgtgggctgaggtagccatggggggccctctttcctgccctcagcttcacctttttcaggagcatggcctggaagctcagccattctcagaaggatgggctggaggagggctgcaggcggctctgcccttcctggcctccagagacacactgaaagcccagttatcacaatattcggccgacggaaatggtttcatgaaaatttaccagacttgaaagcaatgactcaaagaaatacgtgtatgtacccccacgcacacagcatgttattcacagaagccagacacagaaacaacccaggcgcccagcagctgaggggtggagaaacagaacgtggtctatttacacgacagaatgggactcagcctcagaaaggaaggagacgctgacacagtccacacctgcaccagccctgagcacgcggtgctgcctttagcgttcggctgcagccgggcacatgctccgattgcactgatacgtggcccccagatggtcaggttcacagaaggtacactgagtgcagccagggccttggggagggggagtcagcattaatgcgcacagaggttctgtttggaatagaaagttggcaggtggatggtggtgatggctacacagcagtgtgaatatcctttataccactgaactatatccctaaatggttaaaatggtcattcttatgtataagttactgaaagtctttaagaagtgataaaaggtttactgaataaatgagaaactggatgggagggacgccatccccactctaaggagtctggactatgaggttgatgatgagcatgacctcaaggccccagcatagctaatccaaccacaggaaggcaggcagcatctgggaggccccatcagcaaggccatggccggcgagtccctgctcagaccccagaaatccaaagtgattcacgcacaggtgggaagacgctatcaatactcacaactttaaccagacacaagtctacagaggcgaccatcactaacgttgaaaatgtcttggcttctgatttgaacaggatcagacctcaagcacgaaatgaatgctttaaataatggatgttttttcaagaaacttaatttggtatcacattggccaagaggtcatttggcgaggccaacacacagtcacaaaggaaaggtggtcctcagtgccacccaggcactccgctcggccagccggggggacccagctggagccataaaaggactgctcccaggtcaacacgaaggcctgcccaaggactcctgcggccttcaaagatttgcagcctgaggacaactttcagcaacaccgcgacactctaggttgttttttcaaagattaaacataataataattctgtaaaaccaacatgggtcatcattaattactgcaccgtgaccatggctatttaaaaacccagcctcagcacagtagctgacaaacattaatgagcagtaatgtacacgtggtgttgtcgatgaacggataatgaaagcaatttatttgaaaattaaaacatgattaagaatggcagcccaagcgagagcccagatgcctgaagaaggcattcctgatggaatggccttcttcctctgacagtttttaatatacagcaccttagcttggcccctccttggtgcccaagacctaacactggagatgtcagctgtggagagtgagaagacaagcccctcagtgggacatctcacagcgctccttaagagcagcgtgtgaaggggacacggacgctgcatccttcctcacccagacaacccacagatcccaagtccacccacacccaggacgacgcacagaccccacatccaccctcacccaggatgacgcacagaccccacatccaccctcacccaggacgacgcacagaccccacatccaccctcacccaggacgacgcacagaccccacatccaccctcacccaggacgacgcacagaccccacatccaccctcacccaggacgacgcacagaccccacatccaccctcacccaggacgacgcacagaccccacatccaccctcacccaggatgacgcacagaccccacatccaccctcacccaggatgacgcacagaccccacatccaccctcacccaggacgacgcacagaccccacatccacccacacccaggatgacgcacagaccccacatccaccctcacccaggatgacgcacagaccccacatccaccctcacccaggacgatgcacagaccccacatccaccctcacccaggatgacgcacagaccccacatccacccacacccaggatgacgcacagaccccacatccaccctcacccaggacgacgcacagaccccacatccacccacacccaggatgacgcacagaccccacatccaccctcacccaggatgacgcacagaccccacatccacccacacccaggatgacccacagaccccacatccaccctcacccaggacgacgcacagaccccacatccaccctcacccaggatgacgcacagaccccacatccaccctcacccaggacgacgcacagaccccacatccaccctcacccaggatgacgcacagaccccacatccaccctcacccaggacgacgcacagaccccgcgtccaccctcacccggggtgacccacagaccctgcatccaccctcacccaggacgacgcacagaccccacatccaccctcacccaggacgacgcacagaccccacatccaccctcacccaggacgatgcacagaccccacatccaccctcacccaggacgacgcacagaccccacatccacccacacccaggacgacgcacagaccccacatccaccctcacccaggatgacgcacagaccccgcgtccaccctcacccggggtgacccacagaccctgcatccaccctcacccaggatgatgcgcagaccccacaccctggcaacccacagaccccgcgtccaccctcacctggggtgacccacagaccctgcatccaccctcaccaaggatgatgcgcagaccccacaccctggcaacccacagaccccgtgtccaccctcacctgggacgactcacaaaccctacgtccaccctcccccaggatgacccacagacgccatgtccacccctccccaggacaacccacagactcttcatccatccttgcccagaccccatcacagctggctggagaaggacgctgtgaaaacctcttttgctctttcttgctgctcaggccatccacacctggcagaaatccccactgcccagttccactgaagccctgggctccaatattcagacctgagacccaaacagccctccagagagagctgagccacagacgatctggagccccggagccagccctgccctcaggacaggctgttagcagatgcccaccatggaccttgggggcactcccggaccctcctgggggatcctaggcaggcatggatctgtgttcccccaacacagataccaacaagggccccaggaaggtcagtgcctggagccaggtgtgggctcaccttcaccacagatggtctggctggggcaggccctcctgagaacctgagctggcactgcccagtcctcactgtgtctctgcctgagccctgcctctccctcatccccctcttcccagctcttcccgctgagcctggaccctgcctatggagctcatccccgcttctctcctcccttcgtttcttggccctgaatcccagccccttccccatcgtgggttccatctttcctccgtctgtctgtcactcatcccgtccctgcacctgtgctaccatcaacctcccagcctgggcctcttttccattaacaaacagcccagcccagactagaaatgcagagaagccacagctgcaccagcaggcaccacctttcctggacctccatcgccccagctctcctaactcagctctgggctgtccagaggaggaggcagaagaggccgcccctgcccgcccggcctcagcctggtgtctcccaaggccagcactgtcctgtgtggcaagaggatgaagggacagagcccctgtgcccggcactttcctcaggccaccctggccccaaagcacaggaagaaaaaaatgtccacaactcatttactcacagagaagaaaaatttgactttatttgtaattaaagatggcctaattaaggcaatgtgacaattctgcccatcagacctcagaaaggcaaaggactttgtgggataactcaggttgctggtgaatgacatggactcatctacattttgttgggcacaaattaggtgtcccctctgcaagggacaaatttgcaacttgactgaagttttaaaatggccaagccccaggagccccagtttctctgctaaagatatattctaaggagataactggatgtgcgtataaaaccgtaagtcaggtttgtccatcacaaccacgctcatcctggtgaaaatgcagagaatcagggaactcgagtccagatgagaggtagtggagaaggaaggcaggggtctgaaagccctgcagatttccaagggttagtgttcacttctggggcccaaacatcccaggggcagtagccccaaagccccagatgggactggctcagtcaccgtccctctggggaccttgagtcagaattaagagtcagaattaaagagaagtctcaaaacgacgccactggagacacaatcgcaattcaggccaccatgttgtaggtggccctggtccccatgatccatggaacagaggcggccccagctgtctccgcaggattatgcaccgcgcgtcatgagccgagggggacaggacccgtggagcaccactctcgaaagccctttccctggggccagatggccagcaccatggacagcagctcgccagccttcgctgagcctccaccagagaggcaaggggaggacactagggaggccaggagaggctacgggaggacgctcgggaggccacgagaggctacaggaggatgcttgggaggccatgagaggctatgggaggacgctcaggtgctcgcagaggccctgagaagctatgggaggatgctcggttgcttggggaggccgcctcctccagagcctctggaactaagtcacacccacgctggaaccactgcgagcccaatttcggaaaaaacaaaacatacaagtgaaactcagcccacagctctgaattcattctctgaccagagaggtcctgcagccccgtcgaagcctgcacacaattcctggtgagcgctttcctgaccacctgacctggaagggcctcacccagtcttgatcgtcacatttcccagacaaacataaaatcgtgcctgcctaggagagaaccgcgcatgctgatacagtgagacaggcagggtgccagaactccgaggtgagacacttagggtgtcccagggcgctcggcccccagagctctgaggtgagagagccaggagaggtcgggagggggcggggcacgggcctgggaagcggctggcctgcagctcaggaaccccagtgtctgggtctccacggatgcctctggcaggtcagggagaggaggtggccgatggagagagtggatggaggagtctctggtgttgatcacagtggactagaatatgacagaaaaggggacttcaggctggcagacaaccacacacacacatgcacagacacacatgcacatggggagacacacacacgcttccccagacatcgcctcctgccggacgctgtttcattcttctctttgaaaggcgaacgatgaggcagtcagtgaccttctagccaatggggctttgggaaccaaatcaattccttaagaccaaaaaccctgcctctcaccatgcttcccccagcagggtctgcagagcccccatcctcacttcatctgcctctcgccatgcttcccacagcagggtctgcagaacccccatcctcacttcacctgcctctcgccatgcttcccccagcaaggtctgcagagcccccatcctcacttcacctgcctctcgccatgcttcccacagcagggtctgcagagcccccatcctcacttcacctgcctctcgccatgcttcccccagcagggtatgcagagcccccatcctcacttcacctgcctctcgccatgcttcccacagcagggtatgcagagcccccatcctcacttcgtattcaggtaagtgtgaccaagaatgtctctttttctggtttataaatcaattttttaaagatctcctaagatctgagaatacaagcaaagagacagtcacatgtaagcttaataatgaggttcatattaaaggcagacagatgttcaattaaacatcagacttcacgctgacacgctgagagtgaggatctccatgcataattctccgtcccagccccagatcccgggagttttgatcacacagctgggaagtcgtcatccaagcctcggatgtgtttgtggggcatcgtctatagccggggctcctcccctctctctgtccacacacacaggtctccaggcatgtttacctctaaatacacaccctgccaaggactgtggcctggaaagtcataggcacttgacttctaccaaaaaagaaataacggaacggcatgagaatggtcacacctgagcaggcagctaacagcaacaggttcactacacacaaccacccttgcacatatgcgtgtgcacccacaacacacacattcacacacacacacgcatgtgcacacacaacacatacatacattcatacagacacacacgttctcaccctaaagtcatggtcaaattgggtggtttactccacactattttaataaatagccttcactcttcagacacaatctgaaaaaaccccagactcgaaagcgtttcccataactcaggacaaggaatcacgcaagtgggaaaccgtccttgcgagcgcctcacgtgagccacagtcaccgcacaaagtctccatcgcgttggacggtccgtgggaatttctcagggctccggaggccagcggggctggaggcagacctcatcggcacttctgacaacggcaatttttgtgctcctcacaaccaacgagggtgtgatttttcccatctgtcttcccttcctcacccctcccttccccttctcttccctttgtctctcctccctctcttcctacaaaagaaatcacatgacatcgattccctgatattcagatcaatcagctggagtgacaggaaacacgttcgctcccattggaaacagcacgtgctccagcagagctcaggtgttgttgaagcccgttagaactggcatgcgtggagtctgctcccatgcatgcatgcacacgcacacacacccacagcatccctgggagaagccgcagcccaatgcacacgcacacacacagcatccctgggagaagccgcagcccaatgcacacatgcacacgcacacacacccacacacacacagcatccctgggagaagccgaagcccagtgcacacgtgcatacacacacacacacccacacacacacagcatccctgggagaagccgcagaccagtgcatgcgtgcacacacacacacccacacacacacagcatccctgggagaagccgcagcccaatgcacgcgtgcacacacacacacacactgcatccctgggagaagccacagcccaatgcacacatgcacatgcacacatgcacacacacccacagcatccctgggagaagctgcagcccaatgcacgtgtgcaaatacacacacacacagcatccctagaagctgcagcccaatgcacgcgtgcacacacacacgcacacacacacagcatccctagaagctgcagcccaatgcacgcgtgcacatgcacacacacccacacacccacagcatccctgggagaagctgcagcccaatgcacgtgtgcaaatgcacacacacacacagcatccctagaagctgcagcccaatgcacgcgtgcacatgcacacacacccacacacccacagcatccctgggagaagctgcagcccaatgcacgtgtgcaaatgcacacacacacccacagcatccccgggagaagccacagcccaatgcacgcgtgcaaacgcacacacacccacacacccacagcatccctgggagaagccacagcccaatgcacgcgtgcacacgcacacacacccacacacccacagcatccctgggagaagctgcagcacatgtgtaagctgccaataccctgcacacggctctgtgactggagataatgaggaatcgccatggcaacccgggaacaagcccacagcgccttgtttccccgaacgcagagccccggcagcccctccatccaccgagacatacacggctggaaggacgtggtgctgcggaccatgggtggttcttctgccacatttgctgggacttgtcctaaggacattttcaatttctgaaatcagtcgccattgacggccagggttctcattcctgaatttttgtctttgcttctggttaccagagatccaaagctgcagtcgtttagctggtttctgtttccaggggtattgtgaatggaaataaaccatgaaaatgaccgaagacgtcacaaggaaagcaaataggatttaaaacagcaaagcggtgcctttgccaattccagggagtgtttctgctacataaccctgtctgtgctgggcagtgccgctcccgtgcacccaggactggaaaagcatagcttaggggttcaggggagaaacagtgacctctgcatcagaaaagtcctagataagttgccaggaaaggcaacagcacctggaatgagagacaagctcaggactcgtgccccaggctgcagggacacccacagagctgacttctcctcggtcaaccagcccccagtgctcggaagcatctggcccaggcacaagcatgctcctgctgctacggcagctgaattgggaagtatggcgggggcacagatgccccaggtggacggccaggcctctggtccacacacaggcattcactccccatgtggccatgagcccccgattctccaagtcctgtgttctcacctgtaaaatacggaagctatgctagacaactgctgacttccctcacctgagctctgtggtactcagatatcctcactggtgggaaagggaaaggccacggccatcatgggcaggaggacgcagtggttcacaggatggaggcaccaactgggaggctgggcggtggcactcacactgtgctggagtcaggctggctcctggggagcacgtcagtcacctgcttaattcaccatgggttagctctccgcgggcgaaggatgacgaaattacgttgtaagtgagcctcagcattctgtcctttggaaatagccccaagaagtctgggataagctctattaatgttagtttttttccagagagtaaaaaataagctcttgaacccatccatggctatcagaatgaaggaaaagtcgtttgacctccttggcccagagcccatcagatgctcagtcattcccctctaaaatgcaactctctccataatgagttcattttcaaaagattcaattatatggaccgtttctccagacggtttacaaatttcaaccatggcagcagcatttgggaatggctcatctgctcccaccataacttagggccatgttcctgtttcaagacaccaaattcctgagtttgactttcccttctgcaagtttcccagaggaggaaaacctttaaattgagctgaggaaagaacaatatttgaccagcaccagaagtcaccgagcattttaatacaaaccttattgatgaggctttactgtccacaccactgcatatctaagtcagagaatttgtcctgtaattccataacttcaacagggcaaacgtttacagtacaggttgattctagagcctcctgcaccggcctcccaggatattcggcagcaggctgaacccaactggaacatccctaccaggagagaagcgggaccctgtaacagctgccacagcttccctgggaggcccccgcttgtgttgacttcagagaagcaaatcttgacttttcttagcgactacctaaagctttcattacaaactttcttgaaaaagaaaaaatggtattcctaccagcatcactggctgggctagcactgatcacagtgatgaccaggtagatgaagtagggtttccatacatgatggaagccgacagccacactttgaaaagctcagtgtggacttttaggtgaagttcatatgaaactgttagttcctggcccggcccgcccgcacagtaaatgagaaatgacaggtgtggaagccaggaggccactgctttgctgcacagggacgtccaaggaccaaggcacagagcagctggggggctccccagggaggaaggacagcactcagccccctcccctgcaggtccctcagagacccaaggcccagctgggccccaccatcctcgaccccccaagtcttcctccttgctgtggccacacagaaactgtaattttaggacgagagctctgccagacagaggtgaagaggcaggaattgtgtggggtccagaggaaccagagtgtgatggttaacactgagtgtcaacttgattggattgaaggatggaaagtattgatcctgggtgtgtctgtgagggcgttgccgaaggagattcacatttgggtcagtggactgggaggggcagacccaccctcagtctgggtgggcaccatctaatcagtcgctggcatggccagaatataaagcaggcagaatatcgtgacaagactagactggcctagcctcccagcctacatctttctcccatgctggatgcttcttgcccttgaacattggactccaagttcttcagccttgggacctggactggctctccttgcagacagcctattgtgggaccttgtgatcatgtgagttaatacttagtaaactcccctttatatatatatacacacatacacacacacacacacacacacatatatatacctataaagttatatacatacacgtatatgtaactaatatgatatatatatatctgcccctctagagaaccctgactaatacacagagtgtccaaaagtgaatcactcaacacatggtgagggtgccgggggtcagaacaggacccccccaacctggggccactgggcagatgctatcagcaccaggctgacttgaggccacacatggcatctgcctgaaccgagaggaaacgcctcccactgtccagtagagaaagtaaaagggccaaggggaatctgctcattcaccaatctgtttattggtaaatatcagccctgattacacatttcccgttataaggataaaaacgtgaaaacatagttacaaacatacacagagaaactggaacactgaaacagaaaaaccatgtgagagccacaaaatgattctgtagcacggaaaaggcaaacctacattgaaggtacaggaaaataaataggttttaaaaattacagttggaaacccatgtaaattctaaaaagcatctgatttgtgttctcaaatttaagaaaatgacaaccataaaaagcaagataacagcactccagaagtccccgacctgactgggcggcagacagactgagaaggaagtctgtgaagaggacagtgtggtctcagcgggcaggaggcccagtcagaaacaccgagggcagaactgtcccgggaagtcacctcagtcacacgaaagccaccgtgaacaggagcttagctacagacgatgggaacgaggtgatcaacactgcaggagaaactggtgcacggcggtgactgactggggatttggcataaggacaactgccttttaaaggctgggagaggccagcgcagtggctcatgcctgtaatctcaacacttagggaggccgaggcacaccgatcacctgaggtcaggagtttgagagcagcctggccgacacggcaaaaccccatctctattaaaaatacaaaaattagctaggtatggtgacacacctgtagtcccagttactcgagaggctgaggcaggagaattgcttgaacctgggaggcagaggttgcagtgagccgagattgtaccactgcactccagcctgggtgacagagcgagactccatctcaaaaataaaaagaaaaaataaataaaggctgggagggctgggcgcagtggctcacgcctgtaatcccagcactttgggaggccgaggcgggtggatcacgaggtcaggagactgagaccatcctggccaacacggtgaaaccccgtctctactaaaaatacaataaattagctgggcgtggtggtgggcacctgtagtcccagctactcaggaggctgaagcaggagaatgccataaacccaggaggcggagcttgcagtgaaccaagattgcaccactgcactccagcctgggtgacagagcgagactcctgtctcaaaaaaatttttaaaaatcaatcaatcaataaaggctgggagaaccagaataaatgaaagaaagcaacatgcaaaagtggaatacaaaaaaacttccacttccaaagatgctcatctgaagattcagagtttactaaataccacacaaaattaacaatttttaaaacacccttacacacaactgtttttgaattctaaagaatcaaacgaactatcacaatgaaagagttttggtagagcagcccattataagaaaaaaagtaaaaaatgtagcagcaattgtcatttgggaaatatgagaaaaaataatctcactcggtcataacgaaaaattttcagatacctaggaacaaacttgaccaggtatgtgactgcgcagggaagaaacacgggcccacagtgtggacaaggataacacggccaagtgaccctgacagcaacatggatctccaatggcttagatggattcaagtaaaacctttttttggtaggaaaaatttaggtgaaaaaaaggaaggaaaaaattaggtgaatagttatcagatcctataataagagagacttcctaaacaagcaaaggaaagcaaaaaaaaaaaagattaatttcacttcatgaagatttaaccttctatttttaaatacatgagaataaaatatatccttatgttttatttgattaacatttgtaacaattttaccaataaaattcataaaagaaaacataaacttagcataagaaatgaaaaccaaaacgaggaggcatattttcctacacaattaaaattcttcactaataaacatccacattgatgaccttgtgacgcaacaagcacctcacgcttgagagaggaactttatgcaagttctcggaaggaaaattcagcaactctcaaaaatgcacacaccaagtgacctaggaatttcacttctaggggaatgttctaaggaaatgattcatatgcggaaaaccgttcgttttcaaagatgtgcttactaagaatcagacattgagaaacaaaggaatttccaaccgtaggtgaataattaaattacaccacattaaagatcatatttataaaacagataacgtgacatgctcaagatatagtacttattgagaaaaggaatataaacccatggatgtaattttctaaaagggagagatgaacctcacacagctggacgtagcgcactcagcgtccgtcgtggccccggggatgaggttctgtgagtcacgccacagacaccctctgccatcagccctcctgggcgctggctgtgtgcggaagaccccctcgcagggccacaccttccggggatgagcacctctggctgagcactgcaggcacagagggaggcttgccccgagccccagcagctctaagaggtccccgtggagtctcacctgcccaccccgtgctggtccccagagctggacccccaacgctggtccccggagctggacacccccaggctggaccccggagctggcctccccagtgctggtccccagagctgatccccccaacgctggtccccggagctggtccccccaacgctggtccccggagctggtccccccaacgctggtccctggagctggacacccccaggctggaccccagagctggcctccccaatgctggtccccagagctggtccccccaacactggtccccgaagctggtccccccaatgctggtccctggagctgatccccccaatgctggtccccagagctggtctcccatgagctggtacccggagctggtccccccatgctggtccccagagctggtctcccctgtgctggtccctggagctggtccccccaacactggtccctagagctggtccccaccacgctggtccccggagctggtccccaccacgctggttcccggagctgatctccaccacgctgatccccagagtgccccaagacagccccagcatctagtcaccctctgattcagcttcatgggcatctcccttttggtttttatttctgttttttatacagcttgcattatctttaagtgcaggaaaaaatatatatattaagcaaacaaatcaaaaggcatgcatagtcctgacaggcagagttctccaggctgtgattcagcacccagggtccaagcagccacatagggctgctaagactccccgacctgacagcttccgggcatccctcctgcaatctggggccacctggccactctagaacaccgaaggtaacactgagcagggccactacagggaggctgccagaggatgcgctgcacagggcagcacggccgaaggttccacccagcggcctcttaaatcaaggacttccaggcagaggaaactcctgtggccacacccccaagatggctttgtctgtaaaggagcgttaacatcggcatttataagactaatatgacagcagatgtgctttcctctgacgcccgtacgctgcggaatcgcattatggaaatagagtgccaaatggatgccttgacctcggggcccggcctattctgcacaaagatgacttctgaaatgagttttttgctataatttgctcttgcctttgctaaaaggttgaaggcacttctattccaactgagtgtgagtaacgctaatttcatagcgttagctgcatgttcttaagcacgtttatcttcagcaagtacagttctgttgattgaaagaaagaaatatttctttttagtaaactagtattcccaaaggctgacagaccatctttgtatcacacacagttactaagggttcctttgcttaatctcttcagaggaaaaacagaccagctgccactgaagcaaacgaagtctctcctggcacccacatttggttgttttaggtttggagatggttttctgtgcaattaatgtgattcatccatctttgaaatgaagaattacactgcagtgcggccagttcccaccggatgaaagttgaagaaggagcaggattggaaatattcaaataaatagcaactgtttcagcccatgcacctgcagagtagcagccagcctgcaggccaggaaagggagacgctctcatccggcagcatctgggcgccctctctggatgggagtgtggggagggccctcccgtctctctgcgtctcagcctttgccaagcccagcattctgtctctgcctacctggtgcatggataactctcaaatgcacagatgagaagatgagacgctgtgggtgctgggctgggccctgagggaaacgggcagagtgtgatgactgttcccacggtggcaacacgacgcccacgcgcccggcactggagtcagggctcaggcagcgggcccttctgaccctcgcagtggcccttctgacccttggggcaagtgcacttaccatccccaccgcaaacagaggaaacagaatctagagctgaggggtttgctctgggtccaagcagcagtgaaggggaagagctgggtctcaaacaccaaaaatccaatcacaaagctcccttgtcaggaggagggagccacctccaggacagaccactggaaatggaactctccacaaacaccaactcaaaaggccaatgctgcaggccaagaacacactggcaaaaggctgcagagccacccacacactcactcgctcctgtgaaaccagaccctgcagctcctcatagacacacacctcaatatcaacagcgcagaaactccactcctggacactagcccgagagaaacaaaacacgatctgtaaaaaggattgtacaagaatgtttagagagactttattcataggcgccaaaaactgaagaaagaaaaaaagaaagaacaaagcccgtcaacaggaaagtgggtttgaaacatggcgcatccactcaatggaactcccctcaaaacagagacaaaccgtccacacacagcaagtggacagatggaggctggaggcagaaattaaagaatgccctgcggaaatccagaacagcaagctttagacctggagaaaccaagcatatcgtgcaaaggaatgggagaagtcatttccggggcggggatgtggtttcatgggaactttctgggtgatgtaaatgttctaagtcacagcacaggcaggggctgcatgctgggtgcatttgccaaaactcacagaattgaatacttcaagtctacagatttctactatatgtaacatttaactgggaaaatgtaacagaaaataataaagggtggggctaaaatcccttcctgcttaaaaacacagagcatggtggcctgaggcgcagaggaaaagatagatgagaaactccacatccccgaggctcagcagcagacgtatttcatgggggaaaccagctctcagctgcttcacgtggcagtgagaccctaaatatgagaggcagtggccggccagagcatgaagtcagaaaggtgcctaaacctggcagcactgggcctccccacagctcccaactcaccagaattataccaggcaagtgcccacagggcatcagcagagggcttgtcatgtgattcactgctcatttagtccctcattcagcaaatgtttacagagtacccaggacacaggcatagtccaggcacaatgagggcagcagacaaggcagctgtgtcttggggcagacattttaggagagcatgcaaggcagccaggctcaagctcctggtgtggccaaacccagccatctcggggatgtggtgggacagcacagctgaacattaaatccattgcaactacagttttccctgagaaaagcatcactgatatgggcaggtggcagaaaaattctgggtagaagagggtagttccccggcaaaggccccgccctcaagcctggaaacctgtggccctcaatgggaacaggcattcctgtttttgtgcccaaatgttgccttttggcctcccatgcctgcctatcctgtacccatgtaaatgccaagccccaggctccactagtggaagagcggaggaacagaagagtggcgtgtcagggaaggagagaagagaaggagcgtgtgaatgtcaagaggagttcggctggggacagtcagaaaggagattggctgcgggacggccaaactccaggggaagatcccttcccactccatcccctctccagctccccatccatcccactgagagccacctccatccagcagtaaaatcccccacatttgccatccttcaatttgtccctgtgacctgattcttcctggacgccagataagaacctgggtatcaacagggcactgagctggttaatacttaagccatctgtgggtggcaactgctaaaagagcactgtagcacacccaccgcggctttgggagtcacagacaccccacccctggatgctactgcagggccagagcccaaaagcactcaccccggctcctgcacctgcctatctgtgtgctctcccttccctaaggctctttgagcacgcagcagccaaacagatgagccacacccgtcacacgtcctgcatgcagggtcaggggactcccccacagccctgtcacacgtcctgagaggggggtcaggggactcccccacggccctgtcacacgtcctgcacgtggggttaggggactctcccacagtcctgtcacacgtcctgcgagggggggtcaggggactcccccatggccctgtcatacgtcctgagggaggggttcaggggactctcccacatccctgtcacacgtcctgagaggggggtcagtggactcccctacagccctgtcacacgtcctgagaggggggtcaggggactctcccacatccctgtcacacatcctgcacgcggggtcaggggactctcccacagccctgtcacacgtcctgagaggggggtcaggggactcccccacagccctgtcacacgtcctgcatgcggggtcaggggactcccccacagccctgtcacacgtcctgcacgcggggtcaggggactctcccacagccctgtcacacgtcctgagaggggggtcaggggactcccctacagccctgtcacacgtcctgagaggggggtcaggggactctcccacatccctgtcacacatcctgcacgcggggtcaggggactctcccacagccctgtcacacgtcctgagaggggggtcaggggactcccccacagccctgtcacacgtcctgcacgcggggtcaggggactcccccacagccctgtcacacgtcctgcacgcggggtcaggggactctcccacagccctgtcacatgtcctgagacgggggtcaggggactcccccacagccctgtcacacgtcctgagaggggggtcaggggactcccccacagccctgtcacacgtcctgagaggggggtcaggggactcccccacagccctgtcacacgtcctgagaggggggtcaggggactcccccacagccctgtcacacgtcctgagaggggggtcaggggactcccccacagccctgtcacacgtcctgagaggggggtcaggggactcccccacagccctgtcacacatcaagcacgcggggtcaggggatgctcctgtttcatcatgaatctggtagcaattaggtgcgtgtgtgttaataaaatctccatgtgttatggaaaaatagttaaatgtaaaatgtatcggtcttcaccaaagaagagcaagggatggccagtaagtgcaggaagagacagccagcatcatcacgcataagaaaaggggaccccacttggacaccaccacgaacccacaggctggggaggaaaccccagcaatgcagagtgctagggaggaggcaggcaactggctggctcggcttgggggtggaaatgcacacacaattttcccgggactcagcaatcacaggctttgtcatggacccaagaggaatgaaaatggagttcacaggaaaccggcatcggtggtttatcacagctttacgcacgacagctgaaaagtggaacaatccaaatgtccgcagctggagagctgactttcttacacccattccagggacactacctggtaataccaagggacgggctgctggtacggccctgcacggagggtgctcaagggcagggtgcaggcagaagcctcccccacagtccacacagcacagggcccgtggctacaacacagacacagcaagcacagcacagaaccagatccatgagggcaaggaagagctctgtgtggtccagatgtgacacagccagtcctggcgctagctccgggttttctgggtgtaacacagccagtcctgatgccagctgtgggttttccaggtgtgacacggcaggtcctggacctggctccgggactatacacctcctcctgactcctccagctgtgcacttagaaaccgcattttactgcatacaaatcatatgattatacaaacctgaacaaacctgacacaaaagcaaataaaagctattggcctcaggacaacccttgaccttgacaatggcttttttacataatggttggaggctgtcccctcagctcttgacattcgctccccagggcatgagttttcctaaaggggcctgcaagccccgcctgctgcccagaggcttccccaggcacctccttcttggtgcaggagggccctggacccactagggacttaagctccttttccacagaaacacagcaatggttctgaagggggaaccgcaggtcccagtgactcatggtgaccacacgcctgcatccgaggatgacttcagccccctgtcctctccccacagtgagctgctccccacaggccccctctattgcgaatgccctgagtcaagctgcccagtcttcatccagttatgctgaaaaccccactcttggttctctgccttgatatcaccacgtttccaaagaaagtgtgcaaaactcctgggctttggagtccagcacactccagggtccagggtccagggtccagggtcaacatccaactcagttgctttctggttataggctcaggcaggcacatttgtcaaagaggtgttttaatcaatacattgaagataatgataattccttccatgcagcactggtattagtaatagctgagatattatatataaaatacttgacaaaattcttaccagaaaaggctggttggctgttacgatcaaggggactttaatgggatggggagaagaccccgctcccagtcctgtcatctgtgaatttgttattaataagtatttattgacagtgcatctgcacgcactcctgtctctcagagctgtggaggggaagagctccctgcagggtgaggcagggtgcggggtgagaagtgctgggttaggacaggggctgcacctgccaggcctggccctgtgtgcatggaaggggtgggagagcccccagagtggggaaggctcataggctgccccctagagcagagaacagcaaggtcaggtgtccacacgtaggatgctccctccagcagcctgcagaaggggctgcggaccccagggtgggggtgactggggttggcaggaggaccggggtagggaatacggttctgctgtgcaacacgcctctgcagcagtggcagccaagacccaccttcatagatggtgtctgttcagtaaatgtttgatgaaagcaaagacaggaacagaggaggggagggaaggaagggtgggacaaagagccacactaattacacaggaaggaaaagctgcatcctcagaaactgcagccaaactcacactcacagcccacaggtggggggctcccaagaaatggtacagacgaaagacaaaaacaactccgaactcaaactcacacctcacgggtggagcagggttcctaagaaatagcacagacaaagatggagaagactccacattcaaactcacagcacagcccacaggtggggcggggttcctaagaaacagcacagatgaaacagaaagactccaagaaggccaaagtcagtagacccacaagaggttcatgggggttcaggtggatggggaccccctagctgtattagtcctttttcatgctgctaataaagacatacctgagactgggtaatttatgcaggaaagaggtttaatggactcacaattccacatggctgggggggcctcacaatcatggtggaaggcaaagaggagcaaagtcacatctcacatggatgacagcaggcaaagagagcttgtatggggaaactcccccttataaaaccatcagatcttgtgaggtttagtcactatcaggagaacagcaagggaaagacccacccctatgattcgattaccttccaacgggtccctcccacaacatatgggaattatgggagctgcaattcaagatcagatttcagtggggacacagccaaaccatatcattatgcccctggcctctcccaaatctcacgtcctcacattttaaaaccaatcatatcttcccaacagccccccaaagtcttaactcatttcagcattaactcaaaagcccacagtccaatgtctcatctgagacaaggcaagtcccttccacctatgagcctgtaaaatcaaaaacaagttacttgtttcctagacataatggaggcataggtatttgttaaatacagccattccaaatgggagaacttggccaaaacaaagaggctacaggccccacgcaagtctgaaatctagcagggcagtcaaatcttaaagctccaaaatgatctcctttgactccatgtcaaacatctgggtcatggtgatgcaagaggtgggttctcatggtcttgggcaactctgcccctgtggctttgcagagtaaagcctccctcccagctgccttcacgggctggcattgagtgtctgagacttttccaggcacacagtgccagttgttggtagatctaccattttggggtctggaggaccgtggccctcttctcacagctccactagacagtgccccagtagggactctgtgtgcaggttccaactccacatttcccttctgcactgccctagcagaggttctccatgagggccccacccctggagccaacttctgcctgggcatccaggcatttccatacatcttctgaaatctatgcagaggttcccaaaccccagtacttgacttctgtgcacctgcaggctcaacactatgtggaagctgccaaggcttggggcttgcccccctctgaagccacagcctgagctccacattgactcatttcagccacaactggagcagctgggacgcagggcatcaagtccctaggctgcacacagcatggggaccctgggcccaacccacaaaaccactttttcctcctgggcctcagggcctgtgatgggaggggctgctgtgaagacctctgacatgccctggagacattttccctattgtctcagggattcacatttggctccttgttacttaggcaaatttccacagctggcttgaatttctagtcagaaattgggattttattttctatcacactgtcaggctgcaaattttctgaacttttatgctctgcttcccctacaaaaccaagcacccaagtcaccttttgaatgctttgctgcttagaaatttcttccgccacataccctaaatcatcttgctcaagttcaaagttccacaaatgtctaggacaggggcaaaatgctgccagtctatttgctaaaacataacaagagtcacttttgctctggttcccaacaagttcctcatttccatctgagaccacctcagcctggactttattgtccatattgctgtcagcattttaggcaaagccattcaacaagcctctaggaagtgccaaactttcccacattttcctgtcttctgctgagccctccaaactgttccaacccctgcctgttacccaggtccaaagttgcttccacatttttggttatctacagcagtgccccactctaccggtaccaatttactgtattagtctgttttcatgctgttgataaagacatacccgagactgggtaatttatacaggaaagtgatttaattgactcacagttccacatggctggggaggcctcacaatcatggtgaaagaccaagggatgtcttacatggcagcaggtaagagagagtttgtgcagagaaactcccccttatagaaccatcagatcttgtaagacttattcactaccatgagaacagcacgagaaagacccactcccatgattcaagtgcctcccactgggtctctcccacaatacatgggaattgtgggagctacaatttaagatgggatttgggtacagacacagccaaaccatatcactagccctaaggcaggtgccagttacattgtctcaccagagcaccctgagagccacagccaggagagaaatggtgggcaggacccactacaggtccaccctggtgggcatacatgtgcaggcacctgggcaacgcagctcagcacagcctcatgactccaactcccctccgtgaacagccccgggggtcaggatgtggaggaggccaggaccagggaggatggggccactgcatcaccaccctgggctgaagacccctccaccatgtcctgggtaagccacacaacctcacccactttttggtgtaaaacaggtaaaacagcatggaatttgcaaagtatcccatgaatgcgactgttctcctccccactcccctcttctctcctcagaaagtcgccatgaaggaaagaaatgcataaatctgtcttctgcaaaaacaatttttccagccccattctattcttacagcaggagtccccaacccccgggccatgaaccagtacaagaaccaggccacacagcaggaggtgagcagcaggtgtgcgagcattcccgcctgagttctgctgcctgtcagatcagcggtggtgttagattttacaggagtgcaaaccccattgtgaactgcgcacaggagggacagaagctgcacactctgtacgagaatctaatgcctcatgatccaaggtggagctgaggcagtgatgggagtgctggggagcagctgcaaacacagattaacatgaacagagaggtctgactgcacagagatcacaatcaatcaattgcttgcagacacatatgaaaaccctatcagtgggctttagagtggcaaatgagttggaaaaaagtgcacaataaacatattgcacttggatctttccaaaaccacacccccaaccatggtccatggaaaaactgtcttccaggaagctggtccctggtgccaaaaaggttggggaccactgtcttacagcctattgataaatggcacactccgtcagtatcccacagtacattaatgttcatcatgacatgatgcctggagaacattaaggctcctattaacacatgaggggccctgaagacccacctcctgagctaacgtccaacaagagttcaaaagacacacctcatgcagaactcttattcaacagaatttgaagaactattttgaagaattatttttgtaactcattcaaaaaaagtgatcagaggcaaaagcagcatgcagggtcaggcacttctattagtgaatgtatctatttgatataatccacagggccagtatttgcttcagaacagagcaatcatgcacataatatcatccctataaacaaaatgggaaatagcatggacttaacattccaaagtataatatactcttccaaaggagagattgccctcaccctttgtggctgccagtttaaagtgcagagttttgccatggaatgccctttcaattttttattaattacatggaaccaaagactttaaatagcctccgggatcccaaaaaatgatattttaaaattatccagctttactgtcagaaatttaatttgaagttcaaaagtcaagataaaactaaagtcatcaaaacagaaggacaaaagaactttaagtggtcaggaaagaaaggtgtgggtttgtgttcaattgcagaagagtctcagggtgagagtttatggaaaccccaactagagcccacctgctcaggtgtcttcacgcacacatatgtctcagagaggcacacagtagcagcaaacaactacggccagtttgtgatgttaatgacttttttacagaattacgtaataacgtcattagtattttaaaccctttggcatatgagagccactatgctccggaaagcgtgatcacactgaaggaatccttttcacttgagtccttggcttgaaaatgccactgtttggatggttacttcctgttgagaaccttgaccattttcagggacagaactttaaactctgcttgaagcatcccgcgcatcctctgtctcatcgctggtcatccatgtccctcacacactcatgatttgcgtgcaccaactgtatcacaacctgctgggctcgctcaaggtacttggcacacatgtctatttgtctgctgtcacccaggtggccacatttggaggtcaccacacaggaggaggagctggtaagggcctgcattgcccattaattttgaggatttatggtaccctggaaaccaaaaggacctttcggccagacaccaacacatctctcaggagcacaacacagggcagaagcagccgggatgtggggaccgcgggctgtaaactattaatgcaagatgccaggggcagcacccaacctccagaggtttttcccgctgatctcagtgaaaggtaggcactgacagtatccacagtgtgagagggcaggggctccttaacagttacagatctctgtatgcaaatgaaagtacacaaagccagacacttaggaagaaggcgcttcaacaggcacaggtgttactgcttaagccaagacagatgagtataatgtagagaaaccctgtattacaggagggattaagccagaagggtgtttgtgggagggaatgaaccttcccttcatcaaaaatcactgcaaactgtgtgcataacacccatctgtgtgtttaaaataaaaaatttcatttactaataagtgattacatttgacccttaaacatgcactctttgtaaaagttaccaaaggtaccaaaactgaaatactaattgccagaagacattttcacgagtcagagggccgaccaaacacagatgtcagggtgcacctctgcagcatgtgggctatgcgcatcagtaaaatcacctgcccgccctcacagcagtatttgctgcgcatcagtaaaatcacctgcccgcccccacagcaggatttgctggtgtgacttccgccctcaccgcagaagaatttgctggtgtgacttccattcagtgcatcaacgtcccctaatggagtttctgatgtttaaattttccgttccacactcccaccaatgcccctgaagcatggaataataaatacgaaaccatttgtcctcttctgataacatcgacaagaacctaaatgtcttctttgtaaaccaatcataccacactatgtgagtcccactgtaacaaaagctactttaatataaaattctgggaacaattccagagacaagagtcccaaccaattaaggcaagaaagacaccactggaaaaaaaaaggtttcaattgaaccgatgaagatgtactctgatgacatttcagattttgaaaggatttgaagaaacattaagggtgaaagtgcaacaaccaagtagaattggcctctactttaaaatctcactgtatagcaagcaaagagagctgttttgagataaaatggaaaatcagaagtttgggcatccatgaaacattcttgttaattaaaatccagcataaaattccacaccttgtttcatttcagtgatttaaacaattacattaatgataataatgccttaagtcaacaaaggaggtccatacaatttttcccttttaatggggtttagatattactcaaagtttacaaatgctggcatacagaaaagcacaagttcaggcctgctactgatgagctacgtgataccagaaaacggtttcaagtccgtttctaaatttccacagtctccaggaagaagatgggttggtgaccttgtgcgtctctcctgtggtgaacaccatggatttcatctccaggaagagggctctgctgtgtttccctccatgagcagatgtgcccctcctcccatgccccgagtccctccttccgtgctcctcctccctcctcccattccccgagtccctcctcctgtgctctgagtccctatttctgtgcccctcctccctcctcccatgccctgagtccctcctcccgtgccccaagtccctcctcccgtgccccgagtccctcctcccgtgccgagtccctccttctgtacccttcctccctcctcccgtgccccaagtccctcctcccatgcccagagtccctcctcccatgccccaagtccctcctcccatgccctgagtccctcctcctgtgccccaagtccctcctcccgtgccccgagtccctcctcctgtgctctgagtccctatttctgtgcccctcctccctcctcccatgccctgagtccctcctcccgtgccccaagtccctcctcccgtgccccgagtccctcctcccgtgccgagtccctccttctgtacccctcctccctcctcccgtgccccaagtccctcctcccgtgccccaagtccctcctcccatgcccagagtccctcctcccatgccccgagtccctcctcccatggtgcaggagctgcctccgttcatccaggctcattcatccaattcccctcgggaccagggtatgcacttttccaggtagcttgatggggtcaggggagcttatagctatggatgggtgcaggagatggggccagtggggacatgaacctggagaaagcataactgaacacactgtcgatcatccaaatgcccaaacatttaacctggaaaaaaatggatccttcaatccccaatcttatccaccatcaccaaatgtagatgtacaacctaccagcgatcaagttcaggcaacaaaaaacagaaagcccagcccttcacaggctcctactgcatcgactcccagctcttgctgtggtggtttcaagtgttaatgcagctctccagagttttagcaaatctgctaccctaggagatgaatgggaaggtgttagcaatctgccaccctgggagatgaatgggaaggtgcttccacatcctccatgatgaacacgactccacacggcccgatcacccacctaagcactcgccacaggggtgggctgaggatggggggactgtggcttctcaccctctgggatcgcgtctgcccaggctcttttgatgacgcgtctctgtggcagcatgtgttctagaacacgggaggctctgcccaaatgcctctgaggccaaaccgggacccagatccccaggaggctgggaaagtcctgccctaagtggcctcagcttcaaccagcggctgccctggcttcagggcccacacggacagatctcctggtaccacatgggagaccagaaacctttccatgaaactttcagaactgtaaacacagatgcccaattcacatagacactgaaatcacatctgcaagccaaataggtcagggagggctcatcctgcaccacaggagggctgaggtggggccaggaccacgctcactgccttcgctggggtctccgcaggctccagagagctggaaggcagatggtgaccacaaagacaactcttgttttgtaagacggtagccaagggcgcatttacaagtggagtgcgatcgggttacgatgttggaaagcactctctgggtcctggggggactggactccagggggctgcggcatccctgtcagctcagcttggcccggccaggcccggggatgcagctgaaggcggagagctgctgtgaggccctgggaagacgcggtggccaccaccatctgctgaatctgctgacttaaaggcaatggtgctggatggtctcatccaggcggaggctgcagagccagggcgaagtttcctgaaggagatggaatcctgctgtagatggcggcaacatgaagagctgtcaaagtctccaagccgctgccctgtgggattcggacaagaggctgcagcaggaacccgcctctgaattcccagcccaccagctgccctgcagatgtcagacccgccaggcccccaatcggtgagctaatgccttgaaatactgtctctgtctgtacacacacatatatctctatttacacacacatatatctatttatacacacacatctctatttatacacacatacaaaccccctgctgagtctgtttctctggagaaccccagctccacagcagccttctccccacagaaaatactttcggaggattcccccgaccccaggatgtagccacctctcccctgtgtcggcttcactctgcaggtctcggcaaggagcacccctgtccacactgaacaagaagcccctggacccttccgagtggccatcacctgatccacggccacatcctccacgggaagccacggttcacgtcaatcccggcaccaaggtcccagaattcacagcttctgggctcggtcccgcaagaccacccccccatgagggccagtgcagatggacagccaggccacctgcatttcttcccagccagcgacaaactcggctgcccacaacctcctcgggtgcaatttttctttggatgacacagaacttgggaaagcacttcactcaccatcactagctcttataaaggacacagctcaaggagagccaaactgagggacgcacggggcagggtgcagggcacacgtcacacctgccctgggtgcaccaggctccctgcacctccacgtgtctgccaacctgcgagctccatgaacctctcacttagttctctatgcaggtttcacgtacataggcatgatggattaaatcactggccattggtgattaaccccccaagagttgggggggcctgaaaggcccaaccatctaatggtgccttggcctttctggccaccagccccaccctgaagccagccagggctcccagccacctctcagcacacaaaagacactcatcgccccagagactccaagggtctcaggagccaggaaccagacacaaactccaaatacatacgttattattaacccacacacagatgatacaaaacttctttttcaccctccaatgctcagtgctgagctcagctgtgatcgatctgaaggaataggtcaaccctaagggctaagctcggactggcgattagaacctacaaccatggaggcttgatttcacccaacgtgaggcgggcccctggaaggagaagggctccagatgcaggcagggcagtgcctgggcctcaaagtctgcgaagagaagctgaagggaaacaggcgtccgaagggccacacctgggccctgaagccctcggcaggaggcaggtgcggccactgaggccacaccacacttcagtgagtgattcctcacagaatgaaacacgacacacctgctgtacataaagttgtttttaagatcagcccaggctgcgacgcatgtggaggacacgcagccgtgtccatagaccacacgaagtgaaagcgcactttgactgtgaaatccaattactttggatttaagctctgaaatgcaagttcattagaaaagagatgtattgtgccttctttctgtggtggcccctcaattaatcctctggtcattgaagaatgaaaaacatcaacccacaggcttcccttgcacagacaccagagtctgagtgaataattatggttttgattctgagttatgaaacaaacactcctccttattaaataaattaaaaataatgggatctgcgaaagatcaatacacaagaaaggtacatttgcaataacggctgccgccgtcacaaatgcaattctagactcagccaccagcctggctgctggaaccaggccctgcgagaacacggatgacaacacagatgcacggataaatcatcacgcgtcgcattcccagaatagaaaatgggctaaacgcaagttctgtccttcctgctctcctttgttcctggccacatcttagttttcacaaacgggctcttggagaaaagaggtgagagcctcagcaaaggttgtgggatgttaatggacacatccagaaagcagggccctggcccaagacgcgtggtgaggcagccccaggtgctgtcctccggtgcagccaggcctcctgcatccacctcggatgactctgtaatgacgctgttcacatccacagaagacaggaggatcctacggagggatgaagcctctcaaacgtctacacgatactcagctgcgtttattcaaaccgatcttctttgtgccccagctccatccccgccccaccaccctgtcctctcatcccccggctgctgagtgtgcacagaggcatgtccccttgaactcagaggcgccgtcgccctgggccgtgtcctcccacggctctcatggtcacacagctcagtggctgctatgtggaaatggcctctccttgcagccaggggcagccggcacctggaacagcaatgaactcgactaagaagttattcccatgcagcgagtggcactaagtcgcagccgaaccaatttgcttcatgggaaacacatttgccttcaaagaacacgtaaagtggaatcagcagccagacggagttatgaggtgagacctgcggagtctctgagctggaggcccttctgccccaggacagtcacagcaggcaccccgaccccatcccttctccagcctcgcagtaggaccatcgtgctggagggcctcggccaaggtaggagggaacacaggcatctggacaccgagtggccgcaatgctgctcactgtggctctgggagctgagcctgtcccatgccaactgctgtccactgcccggccaggcttgccccgtcccagagggtgcagaaccaccagcccctcagctctcagcgcactttgcgggagagctggccgatgtctcccaagccttctcttctcgcgcatcgtccccttaactgtcagctccactctacaaatgtcctctcaaaatgcgaagctcaaggtgggtatgtcatgccccaaagaggctacgaaaaatggaggggcaggaagggcagatgaaaacccatcccccacgggtgccgcgtcacatgcactgtgtccacgtggcaggctctgtccgctgtcagggccctacaggaacaagccctcctgaaatggtgtgaaacccacccccacctccactaattcaccacttccaaattcgaggggtggaaatcatcctaactacagactagattttcttccctcttgcgacggttgtaacgcaacagccatgtttcacgttcagatgtacagctgcaggaacaaatacttcttattccaaacaccctaacccagcagctgctgctcccttaaagataaaaagaacctgcacgagagacattgacttccattccctggagggaccctctggggccaatggccgaggagaaaggggctgtgagcccacgccatccctccaagcctggaagcccaggcgccaccctcccttgtctgaaaccgcgctccctctcctggccaagctgcaccaggcccgaaatccaggtccgggccctgacacccagctatactcacaggcccatctctccttcggacgctgactgcagaggcccgtcgggaaagagaccatgtcctgggaaggtctctcagccacagcagcctcccctagcttcttcctgaggcttaaggtcaccatgaggaggatacaaatgtctcattttatgatgagaaatgcccacctaccccgcaggaggagaggccttcccacattttcccaccagcacccatgctgcacatgccccttgagatgcaggcccaacccctgccaggacatagagcagctggagtcccaccccagcccctcacagccctgaccagctgcccaggctggatgcagccctgcagccctggggatgggaggaggcaggaggtttccccagtgccaggccctggtcagtaccgggggcgggggaggaaaggagctgcacccccagccagacaaggccacaaacagggcacaacagtgagcagcactgctctcaccagaatttaaaagcaaacagatttgccacctgggatgacgccctcaggaatgagcacctttgagacagggagcccgcctgtgagtcgagagtcctccaccaggcccccagggtggcttcaggagggaccgtttgcagggcagggatgatgcagtactgggctggtgcggggggagtagccatacccaggggagggaattgtgaggactgggctgcctttgggggtgacctttggccaagggacaatggccaggctggggcttccgtggggagggaatgagggtggacctcccctctccctcccttcatctcctgtccatcctcagggtgaggactctgatgtggccatgcaggtcaaactccccgaggaggagaggggctgggtcagggaccaccccagcactggacacagggtgtggacacaaaggcaagcctcctgggcactgtggatgttccacaagatgggtccactcatgagaccgtggctgagcggcaggcacagggcaaccccaagtgttctgtccatgcgtcagctcacacgaggagagggcggcggggatctgctgcacacccagcgttgtctggggaaccatcctggcatggagcagggcctcacaggacagctgcttctcttggccagcaagagctccacgtgggggcacggccccagcagccagtgaggatggcagaacatgtgggtgcagccctgtccttgtgtccgtgggggaggagtcaactcaccggggtctgaccacatcaaggtgctacagaaacacattgtagatcaatgtgtttcaccaactgcgaagacacaaagccgggccctgggtccagtcagcagccaaggggcagggtccttggaagccaagccggagcctcgccaggaccccacaggcttcccggtatcccctgcggacaggaccatcctgctctggttatctgtccacatcccaaagcctcatcggacctgcaggtatgtctcaccccaggcagcccctctcggtagaattttagaaataacttccttccattaaggaagaacagggtgatgagaactcctcgagcacgcctgtcaacctcagtgtctagaaccaccagcccctccagggaggctgaaaacagcaagtccacagagagaaagggctgcacaggcccagctgcccaggcccctgtgcctgctgcagagaaggaaggggagtcctttccaggggcctctgcaccccaggtggccctggtcttactcgatgttggctggaaaggagactgggcaggaagaaaacgggagctggaaaccatcccatcctggtcacagcgcctccaacgcaccctcctcaccccacggcgtctttaaaaaggccgaaacctgggtttgaaaatcctgcaaacatccaagagactcaaatgctgcgtgataaatttagaaaggtcaagtgtacttaacacgctctgccacgaacactgaaggaaaattaaagttcagcctggtttccttaaacatcatcaccagggggcacgtcggagggacttcgctctgggagacgccttgcaggacgaccccgggcaacttcagcctccacacaaatgacacagaaatggttcccagaacaaaaaaggacactctgagcctgacaggggatggaggtgtttccctcagacaacataaaggtctcaggcccggcacctgctgcagaccggcctcagctctgggtttctccctttggtgaatctgcaccttttggaagtggaagtcatctttcagcgtcattttcatcagagtttctagcttttcacagcttagtgggggatgcttcccaatagtgtgatggctctaatgcttttcattataatctcatcgcctaacactggtgaagaaggaatcatgacgtgattgcaacacacttcaaggaagcccacaccgtcttcatgatggaacatcactcaggggcttctcaaacgtggtgagcagcctgggttcaatgtatatcaccttccatcacctccctccccagccaaggccacgtcccctaacacacaatcaaacccaaaccccaaggacaccactgctctgggacccccacccttcatctctcaccccttaaactgtgccatcagcccatccactggcatcctgggtaacaatgtcccacccccatggacacctcgctccccctctgtccctcacagatgcgtggcccccctctgtaccccacagatgcctggacccttctctcccacagacacctggaccccctctgtcccccacggacacctcaacccctctgtccccgacggacacctggaccccctctgtcccccacggatgcgtggttcccctatgtcccccacagatgcctggacctctctgttccctgtggaccactggccccactctgtcccccatagacgcctggctcccctctggctcccccaccaaggagcaggtataatttttcttggcacaaaaatccatggctgctttcagggccacagggagggcattggaggccacggaagtgtgagaggcacaggtgtgtgcagggaacacctgtggaactgctgtcccagcctgcgacggggatgctgctgcctcaccaggagtgacccaggttggcaggtcggggatgagcccccgtggctgtccaagcccacctggtgagaatggagcagccctggttccctgagcacccccttcagagctccgggtggtctctaagtactggctgctcgtccatccccccaggcgcagaaagtgtcaaggcacaaaactcactcattgatgaggggagcagatttttgctgctgggggcctaagaaaggaagacgagctagcgtcaaagcttccagcattcaggacggggcgacaaggactgtaggcaactcacaaaaacacagagggtgtgcggcaggggctgcccctccacctgactcagtgttggagacccgacaccctcacctcctaaacagccctgaccagaggcatttaccgtgtgcccaaaagagaccgaatcgtcacagggacagtgggacagcggccaggctgtgcaggccgcatctctgcaacgcgtcagccagagaaagccgggggcaccccagccagcactcaggaggccctgcccgtccacacgacacctgggccaaccagccctttctgctgtaaaacttcggctcctctacctgcctgagtctttgccaagcacgagggacagtgactgacccctcgttcccgccagcctgagtaagtagccgcgttttcgcctgggtggtctgcaaggttcacccaccttccaggagcctccggagtctggggtggaggggctgcagtacccgagcacggccgctagatggcacgcaggcgcggtctcgacctgaatcccccgtgcgggcacctgcgcccagggctgtccctgcacaagtgaggggtgaggggtgaggggcgaggggtgaggggcgaggggcgaggggcgaggcgcgaggggccaggggccaggggcgaggggcgagggggaggcgcgaggggcgaggggccaggggcgaggcgcgaggggtgaggggtgaggggcgaggggtgaggcgcgaggggccaggggcgaggggcgaggggcgaggggccaggggcgaggggtgcggggcgaggggcgaggcgcgaggggccaggggtgaggggtgaggggtgaggcgcgaggggccaggggcgaggggcgaggcgcgaggggccaggggtgaggggtgaggggtgaggcgcgaggggccaggggcgaggggccaggggcgaggcgcgaggggagaggggcgaggggcgaggcgcgaggggcgaggcgcgaggggcgaggggcgaggggcgaggggcgaggcgcgaggggagaggggagaggggcgaggggtgaggcgcgaggggcgaggggtgaggcgcgaggggcgaggggtgaggcgcgaggggcgaggggcgagggctcccggcctgcgccgccttggatcccaccagccccgaattcgggcagagcgccatggagggcccagcctggagggggagctcggagcctgcagcaggtgaggtcgggctacagacttccctctgccccctggtcacagaggtgagagtggggcctcatcccagtcccgccgcgacccatggggcagagctgctgccctggcccaggcacgcacagcttctcaacagccacatcgcaggctggccctggcctccccaaccagagaccaagctcccaggctgcagaggcagcgaaggccgggacacgcacagggcagcgggcagccagtgccacgtgggctgaggaggcactccctaacgggagacagcgcccagccagggctggttttctcaccgtcattgtcaaaggccttttgagcattttcacacacacacacaaagaagccgtttaaaacaataaaagtgtagtgctggggaaatgattaatgcatatatctctatttcaaacccgcaaaaggaatcaaaacaaaaagacctttaaagagacacacaaaaaggtgacagcatcgtgaggtgaagtctgtgtgtgtgtgtacatgtgcacgtgtgtgtgcatgaatgtgtcacgtgtgtgcacgcgtgtacatgcatgtgattttgttcacatgcatgcacatgtggagggagcgagctgctcccctcctcgccgagtgagttttgtgccttgcccgcttcctgtgctcagggggatggacaagcagccaggatgttagaggccacccagagctctgaagggggcactcagggaactggggcagctccgttctcacagggtaggcttgtgtgtgctttgtgtgcacgtgtgtgtgcatgtttgtgtgtgcacatgtgtgcatgtgtgtgtgtgcgcataccatctccccaagccgcctccacctgcacacaccagcggtgacccgcctcggggtctgtcctgttttgccacaacagctgtagagaatgccaagcagctcagcagtggttcccaaaataagactgttgagagcccagaaatagcccccagagaacactgtaaaagccccaagacaaggaaaaagtacacgagcttgtgacatgatggtacaatggcctcaaggaaattgcagctttggaaagaaactttattttctgtcttttgaaacaaaccgacatcctgtcctctgtggagacccaggccccgctgaagtgctctttcaatttgctcttttaatttgctcttttaattattctgaaaggccatctgctgtaagagtgcctccctgatttaaactatgcctcacaccctcaaaacttacacttcagcattttttccttccttgcgtaatctcaaagcaaacaagattcagagaggctcacttcctgggtaatgcaggagatgccctccgaggtagggacaggggcttgtgcccaatgtggggccactctgcagagaaccacatgagctgcgcccatccaggatgctgccaggagcctgcatccagacaccctcagcggttgtgaaccagccctcccagcggcaggacccccgagcagttgtgaaccagcctcagggttgccctccaagtggccaggggacagggctgacatgaagcaggtcctcagatcgagaccagctctggaggcccaaacaaacactcctcctgtgccctgcaccctcaccttcccttccagagaaatagtgtgtcctgccccagctcaaaatagggacagcacagggctccacccaggaaagctgggggccgaaatgtcataccatttgggcaggtctgggcctgtcctgccactccctccccaccccccagtcactctgtgcctccacttccacatgacaacaacatccctctcagggctgagtctcctcccctgcagagaagatgccttgtgaggcctcttgaccaaaagaaacaggaaacaaatacagaataaaagtataacagtgaataaaaacagctacatgcacacacaactgtgcaaagcaaaacaaaacaaattgaaaagcacaagcagggtgccacggcctgacagtaacaatcaaacaggagggttttccaatgccatgaacgtaaatcgaggtgtgcatgataacaaggagtaggaaccggagggacggccactgagggtggaaccaaagcagggaaatgagaggatgatgagtccccactgatcctgaggctgggaaaatttgcagactcgaagattctgtagtgctgatacatccacacattccatggtcctgagggacactgtctagcttacaaatccatctgtaactgttcaaccagactagcaacccgtcattcatcattcataggagaatgcaaaattacatcatgcacaaagtgctcccccatgtatcaactgcatttgaacagatttgtgttttcaaaaccagggtggtagcaagattgagtatgcccagtaaatgctagatattattatcccactagacactgaaaacggtcccctttcctgggttgtgttgctggccttgccacaggcaatgccgagggcagctgcctcatcctcccccacactgttgcctcacctggtcacaggtgggaagccaggtggggctcggtgagtgtcttctaactgtttctgcattgctagaatggggtaaacaaagaacaaagaaaacatacataaagtacattctttgttctgttattgccgttgtcaaagttaactctctcttcttattttagggtttatttttaaacatcatgcttgcacatagtttgaaaaatctaagtctggttggggaaatgagcaaacctctaacccaccttttccccacccgcatttctactccccagaggtaagcaccctcaactcatttagctgactcttggttttcatctccatatctccacatgacacattcacgttgccatttctcagctttcagatttaggatgtatctattttctgactgctacagaagatgggcctacctctccataacacatcactgtttccaagcttactttctctttcccagtttagttacattacaattttcatcagatcagtattatgtgcttacaatattgtgactttgtaaatgctatccccaactaggctatgtagtacgctgtgactagtattaattttttttctttttgttttccctggagttataaatgtcttatgtatttgcttagtgtccacagtgtctcttcctttcacagtgtcttcttgtttttcctggagttatacatgtcttatgtatttgcttagtgtccatagtctctcttcatttcatgctgtcttcttccatgtggctgtcagggctctttcattagaggctttccataagtgtccagtgatcctgggatgcctgctcatatttaataaggggcacaaagagctgatttagaattgtgtcacctggtgaattgttgaaagtgggtgtcagtataggagaccctgctgagcagtttcactgggaaaaattttctctatttctattcccacagaagcagacctggaataagaaacaattgtagttggccaggtgtggtagtgcacacctgtgatctcagtgttttgggaggccaaggcaggagaatcacttgagtccaagagtttgagaacagcctgggccacaaagtgagatctctgtctctataaaatcatttttaaaaattagccaggcatggtagctcctgcctgtggtctcagctacttaggaggctgaggcaggaggattacttcagcccaggaggtcaaggctgcagtgagctatgatcaagccactgcactgcagcctgggtgataaagcaagatcctgtctcaagaaaagaaagaaaagaaaagaaggaaaagaaacaagggaatggaaggggaggggagaggaggaaatttttaaaagaaaaaaagtgtgacaaggaaggttgggtttccagtgaaaggtgcatcaccagccagctcctactgcaccggaaccatcccattcaaggggtggtgtagctgaggtatttaaacgctcactccttggccgtcagttggagctctcccagcaaggggagtgggaagcgggactcattagtccccaggcacttgcagtcccacagggagcgaagctgggaggggcggcgagtctgcagaccagcaccagtctgggtttgccaaactccctgcatgcaagagatctgctgtgaccacacctgcagggtactcaggccacctttcatactggggtgaggagaggaagtaaacgcttttctcatgtaacagatgcctttatgtcatcgttaaagctgtgctttctgacagtctttagaggttttaatgaggatgcctaaacttacgaggcccccacaaacatcaagaattttgccaaaagaaatgacgtaactgatggatattttttgaagaccaatgtcttagtcacttttgaaccaagcagatgcgctaccctatgtggacagggcagtcgtcatgcacagaacccatgctgtcccatctcccccacactcaggctggagcagcattctggctttgtttttgttttgctttattgctctgtgtctaccagacacacagctcctcagaaactggacagaaagcctcctgacatcaccacaacaaaatcacagccattaagtccaacgggattgctttatggtggctcaagcccatttctctgagctccaaagccatcctgacatcattatgctgcatcattatgaagccaacacacatctaacaagaacacaagatgcgctttgtcatctcagctacgattctccttggggtgaaagtgaggggcgctgggagttgccctcttgcaggtcccaaggcagcatctccccagcaactgagaccagcctcagcacaggacaccgtggtcccagccacaaatgcagacagagcctctcaggccaacctcagagcctctctggagtgcaggcatcctctacacaaacggaggcagccctgctccatgcctgccatgcagctgagacggatcctcaggacacgtcctgcctgcaggtgagctcctcaaacaccaaccagcagcccccgtcccaccccccgcattcccccagatcctgtaaagaacatcctgtaaagaacctcacgaggaaagccgagcagacagcaaacccagagcttccccgactgcggtgggccctgctccgcctcctgtggccaaggccgctcatcacccaggaaccgacacgcacgagatgcagaatctaaaagagaaagcggcaccgccaccagcaagcacaagagggacgtggggcctgatgacggaggcagcagtgatgcctgcggtgccaggggctctccgggttcctgaccctctgacagttcacctggaaggcgggctccaagcccctcagacccaggctcatcccgtgagcaaggaaggctgtgtgtatggaggctccatcccctcgtttgttatttttactgggcttcttcctctttttccagcagtgaaaaatcttcagagacctccaccagggagaaaatagaccggaagctccttctctgtgttgctgccacccaggagccgctggaccccaagggagcagcatggaggcagagagacctggcccagcacagaagcgaagctgccacgggacggccccacgggtgccaagacacgatggaccccaagggagcagcgtggaggcagagagaccctggcctagtgcaggagtggggctgccatgggacagccccatggttgccatgacacactgggtcccaggcattctagtgaagagctgttaccataagaggaactcaaaaagggaaatgctagtttaataactaaattcttaggaagaaatgtctttagtaaaatatcttgatgatctgataatgcacaaaattattcccgagacaaaatttgaaggggctgaaaggaaaacaaaaggacgaatggctggtaattcctaagggagaagctgggaagacagaggggctcaggggactgacggcagcctggaaaccagcaggtgcccagtggagggaagacaaaacgagagcaggggtgcctgaatccatagagatgtccacactgccgcccagacctcccaggcctctctccatccagaccgccagtcaagttcccatctgggaaagggggtctggccggtgcccagagccagggagaggtgggaaacggggtgtgaaagagagatgaggaaagggggtctgaccggtgcccagcagggtcagggagaggcgggacacggggtgtgaaagagaggagatgaggagtcagcacatccagccaccccctccaaacacacctgggaaaagggagaaccccggaggacagcccggtgggagagtggctcacaacaagtccacatacatcttgtgggactcagggaccagccagacacaggaccagggtatacaggtgctgacttttgagctgtccacggcactaggaggcacatgccccagcacctccccaaattggaaatctgggggtacaacctctgtacacacatgcattccagctcgcaaatgagcacctgcctcagagcttcaccttgactctcggaggtggggctggctcatgctgttggccagtgcaccccacgccctcttctctgctaattttgcatctgcactgaatttacgttggtgggagtcagcgccctccaactccatggagacaagactctgctgtgcacactgctgagactccaatatcccacgtgccaggggcttactccatatttggcagataaattaaagccccaaaatgcagagtcatcgatgagtctccttccaatgcagctgtccatgcggccttgggcaagccctgcgatgttcctgcagggaagggaaggtctgggtgtctgcagctgtcgtgcctgctctccggaccctgcgcccgccctagagggatccaagggccatggccaggcagggtggtgtcatggacagctctggtcccacggtggagggacagggtggtgggggctcaacccaggccagggactgtctgtcccttcctggctttgcccagcagaaagcaaaactctgatgagggagaatcatggggtgcaggggcagcaggtcagaaaagaaaagcctcctctgtgattctccacagcaaagggacccttcccagagctggcactgaaaacccatgagcagccccatcccttacaaccaaacacagctccgtttgcctcccacggcttcttcatatgcttcccagggggttcattctcgctctgtttggagacaccacagggttttggtgaaaatccccccacattaaggtctggaccaccttcaagctgtgcacttgggaggttgagcagacagaatgcacgtgggcacgtggccagagagaaacctgccccatcaggccaggggagcacatgtgagcacctctgccagcagacccctcaccagcaggaagccaagtgaaagacacaaacgcacccatgcaggccctgccgtactgatgtgaaaacgtaaataaccagagctgacctgaagagcatgtctccaccaggctgcaggcaggagtggcaaggattccaccctgacatgcaggccccaccccagcaaccctggacaggcccgggcacaggcccagctgccctcgttctgcaacagctcccaggtaatcctcatgggctccaggtttgagaatcgtgcccggagcaagcacatttaggcccaaacccctgggtgtggcctttgttactccaagggccactctggtggcacgtcaatcaccacagagaggtcacttctgttcacgctgcctgtcggactggaagtgggctaaggtgggcagcaggcaggcagtgcggcagccgggactgcgagtgcctggggtctgaggatcgcacaccaagacccactcggggaggggtcctgcacccccactctgaaaactcccaaaaccccacgaggctgaatcttgattcccccagagttctgaaattctgatgctgggatgatgcactttggaaaaaaccatgatggctggaaagggggaaatgaatatttgctttatgcctttagctagcacaaaaagtcacctaattaaggtaatgaggtttaaaatgtagggtaaaagtcacaagaaacactacaattccatttttataattactcatgtccttaccaaagaaaaggaagtccattaggacagacacaaaaatgacacgaagacgttgtggtgggggaatcccagcatgcgcagtcttttcctggtgatttgcagcctctggactttctataataaaaggtatcgccgtgacaataggagagatcaactttacaaacatcgcttaatcaggacacactgtggccccaaggcttataagtgaccctttcactggacgtcaccagaacacctgtgtgcagggtggggacacgtgctggaggtttgtgctgctgtgtcacacgtgggaagacgtcagacctttcctgagccactagccaggaacacatgcggacagactttgatgggaggatgctgaggagacagagattctgtgtgtgcctttgaaggttctccagttcaggcattaaaacctcctgctgcaggggctgtggaccccttaacctgctgaccccggggcaggcgctgaggccaggctgagccagtccacaggatgaagacaccaggacccgtgaggacgggggctccccaggggacgtggctttgggcaattgctggctgcattccttaaatccctgtttggttatatccaccccaacaacaccagtcactcgggagtcctgtgccagaaacacaagccagggcctgcagtcctcggcctccagctccccagcctcagctccccggcccccagctccttggcctcagctcccgggcctccagctccccggcccccagctctccggcccccagctctccggcttccagctccccggcctcagctccccggcccccagctctccggcctccagctccctggcccccagctccccggcccccagctccccggccccagctccccggcctccagctccccagcccccagctccctggcctccagctcctcggcctcagctccccggccccagctccctggctcccagctccccggccccagctccccagctcccagctccctggcctccagctcctcagcctcagctccccagcctccagctcctcggcctcagctccccggccccagctccccggcccccagctccccggcccccagctccctggcctccagctcctcggcctcagctccccggccccagctccctggccccagcaggagctaagttgttacagggtttccccatccacaaagacagcatcacgaacatccacaccccctaggatgcctggagtccacatcctcccggggtgcctgggagatctctagaattcctgggtgtcacatcccctaggattttggggtcctagcaatgccaacacctagacgaaggtcaggcatggccacagaggccaccctagctataggaaaactctctgaaagcttcgatgttagctccaagcagaggcttggtccaggagggctgaaatcctcccatttaaaacctctgaaaatcttgcctttcacaaacagccccctggaggaaatgtttttttagcatgatgcctgataaggacacaacacagagctgcagcgtccgaccgtctctcctccacactggaagggaacaacaaacaaagcctccgcaagcttgctaagaaacggggcatgcacaacactttactgcagcaagagacgatttatccagttatgtggtatcagatatttttaataactacttttctgaatccaaccaagatccggccctctatactcttaatacagtgaaacttatctgtgtgtggagcctgcacttggaaaactcggaaaaccttcccagaagcaaagtgaaatgctgcataccacgaccacaagtggcttatccatgcatgtggccgcacactgagatcccggtggctcatccgtgagacatgtggccacacactgagatcccgcagtggctcatccgtgagacacgtgtccgcacactgagatcccgcagtggctcatccgtgagacacgtggccgcacactgagatcccgcagtggctcatccgtgagacacgtgtccgcacactgagatcccgcagtggctcatccgtgagacacgtggctgcacactgagatcccggtggctcatccgtgagacacgtggccgcacactgagatcccgcagtggctcatccatgagacacgtggccgcacactgagatcccggtggctcatccgtgagacacgtggccgcacactgagatcccgcagtggctcatccatgagacacgtggccgcacactgagatcccggtggctcatccgtgagacatttggctgcacactgagatcccggtggctcatccgtgagacatttggctgcacactgagatcccggtggctcatccgtgagacatttggctgcacactgagatcccggtggctcatccgtgagacatttggctgcacactgagatcccgcagtggctcatccgtgagacatgtggctgcacactgagatcctgcagtggctcatccgtgagacatgtggctgcacactgagatcccggtggctcatccatgagacatgtggctgcacactgagatcccgcagtggtgcttatctcaggaaggaagagctggtcatgcctggagccccctgcatcatcatcggctccttccccagggcaggtgccgctctggaagcctccccagtctctcccgcggacctgagtcctgctgcagccactcgctggcatgtgacactgaccatgccctgagacctgccctgttcacacacctctagaagactacctctcatccccatgccactggataagtggctgactgcctcctggatacctggctaaacttcaaaaatgctcctgattttgtttttttgtattagatttgtgtttcggctcatttcgttcctctgctgttataaacagaccctggatgacagagctccaggatcacagcaggcactccaggcaaattgctttatctctcaacatggaatcaggaaaatgctgtaaatactggacaaagtctgtcctgcacaggcctcgcccacagcaaacatggagctgccagccctgaacaatgagcaaggctgagcgtgctcaggctgtcagcaaggaaccctccagggagacccagcaagagaaccaacatccgcctgtgaggaggtcgggctgcagacaagcccagccctgggtcctgcgtcctgggtcctgggtcctgcgtcctgcgtcctgggtcctgggtcctgggtcctgcgtcctgcgtcctgggtcctgggtcctgggtcctgggtcctgcgtcctgcgtcctgggtcctgggtcctgggtcctgcgtcctgggtcctgggtcctgggtcctgggtcctgggtcctgggtcctgcgtcctgggtcctgggtcctgggtcctgcgtcctgggtcctgcgtcctgggtcctgggtcctgcgtcctgggtcctgggtcctgggtcctgcgtcctgggtcctgcgtcctgggtcctgggtcctgggtcctgggtcctgggtcctgcgtcctgggtcctgggtcctgcgtcctgcgtcctgggtcctgggtcctgggtcctgcgtcctgggtcctgcgtcctgcgtcctgcgtcctgggtcctgcgtcctgcgtcctgggtcctgtgtcctgggtcctgcgtcctgggtcctgggtcctgcgtcctgcgtcctgggtcctgggtcctgggtcctgcgtcctgggtcctgggtcctgcatcctgcgtcctgcgtcctgggtcctgggtcctgggtcctgcgtcctgcatcctgcgtcctgggtcctggattgagacagaagaccctgggccgctcaagcagagcccggctgcagccccaacctggaatccgtccttgccacgaagccgatgtggaaccatcgccgtgctcagtggagggaccatgagttcatggcgtgattagctgggaggtttggaaacagcaaaagcaaaaaggcatctcccacaatgtccagtgactcaagtctacagagcttgtgtgcaaattcccttaaagtccctcctcatcttcagaagatatccaatgactcaagtctatggagcttgtgtgcaaattcccttaaagtccctcttcatcttcagaagttgaaataggaaaggaaaaggcaacacttagaccaaatgctgaagtcaacgtgacatgtaggatgtgatttgttaagttacactgacatctggtggccttcagtgttagaagagaaacacacgagatcctgtgatctgaaacacacatgatcaaatgtgcctttgcattttctttggtattgaaagcagacaacaccagaggcagcattaaacattaataaaatcatgaataaattaataagaacaccactatgcatatttttcaatttaataagccaaaagtataaaggatgattttcttcttcctaggccaaatcttcttaaggagcagattacagtagctttctctacagtggaatttttcaaatagacttttaagagaagaagaggaagaagaagaaaaccgtcaccactgtgtatcagcccggaggtgggtccctgcctgtgagaactgcacgtggtggactcatactgcatcttcagaggaagcagatgttcattacttatttccagaaaatgacatttattactgtgttgcaaaatcaaaatcataaaacaagcaatttgatgggctcagaaaaagtccaaatgataagaaaaggtaaattgcataatataaataaggtgtttcctccgtgtttgcagaaatacaccaaacgtgtgaccacccttcgtgaccggactacagcaataactaagccagtggggtaggaaggagaatcggatcaaaagttcacattttgatcaacgtcacatatgcttgagataaaacgctgctaacgtcaacactggactcaccccagtcatattaacattgacacgactcaccccagtcatattaacattgacaccaaacacagcctaaaactctgttaccacaaacatgacttaaacgatacaaagttaacctccatatttgctatacattctagtaatgactttgctctccttaattaaaaaaaaaaaaaaatcaaaagatcatcctcccagaccagattccaagctcagtgctttatgtacacaatcatatcattttcgtaacaccctgaaagttctgttttcattcatgagaagcccccgcaggtaatgcttggtttacgttaatgagtagatgcagactgcagtgcatctactcatttggggctcacctggggcctcacctccaaaggggctcctggagatggcagatcctgtggggcccacgctgacctctgcagccagaagccagccattgcctgtgttcagggctggccctggcagcatatggggagatgtgtgcaggagcaggcagtgagcaggctggggaggtgggcagtcctcagcttaggagaggacctacccaggcataagcgtggacctacccaggacctacccaggcatgagcgtggagagggcacagaagacctggtcagtctgaggaaggaaagagtggctgctgctaacagatagagtcaggtcaatttccccagggctgccttctgaagctggtttccatgttatgaacatgcctgaaaaggaccgtggttaaagcagctcaaactccggcaggagaatttacgaagcatccaagcccctcctctatgtgaaccaaagggtggctgtgagggttccgggggtctctaacaacagaaaacctccactggctttcaacctcacctgccagggaaggggccaggtagggatcgcgcaggccccctcagaccctcgctctgaagaacaggtgccctcacagagcatgccgacattcagaactgtcctgcagaatctggcaagtgttttaagaattgacataaagagctgagaagatgtgttgacgtcgcctctcaaaaaatctggctttaaaaaataataataaagctagtgtttttttgagcagcttccatgaacttgccttccaaagttttctgaaaacttgagaagatggggtgtgcccccacagccccagctgcctgaggttcgctgaacagcctgggtggctccgaggcgtccccgcagattcagcctgatcactccttcggtttcctcctacggctgcaggcagacctggagttcatccgggtgacctccacagtctctggccaccttccctccatttaagaaaaagaaaaacagcccatgtctgagccacctccccaaaccctctctgccttcaagcatctgacaagctaccctcaccacacaaggcccgctccctctctagagagcctctcccgacaccaaaatgtcaacctaacacgacactcaggacacagctgtcatcccgaaggcaggagatgtgggggaaaggacacagaatgaggtcacgatgccagagtcaccctcgtctcatccccgagtacccaggtgactacagacaggagaattaatctccttctcgtgggatgaagtgacagagtagacacctgtgagcccacttccagctccagttaaggtttcctctggccctgaagttctgcgactctgaggcatgtggggtgaccaagggcagaggctcccagtctgtctcaaactacaggctttgagcaaggtgagcctccctaagcttcggtttccccaacttcggtaaagtgaaataacaaaaccacgagtggctcttaacttctctgggaatgtccagccagagcctcggaatgtaactacgtggaaacagggtcctcgcagacctcattattgaaggaccttgaggtgagatcatctggatccagggtgggccctaaatgtagtgattgacgtccctgtagggagaggagaagacacggagacacagggaaggggtgttggtggagtcacgggtgggaggccccggagggacagtgcagacaagtgcccaggtgaccccagacacggagacacagggaaggggtgacgggacagtgtgctcatggggtgggaggccccggagggacagggtacacaagcacccaggtgaccccagacatggagcgtgagtaggaaattcacttggtggtgtcaggccacagagatccggacaggctgggctgcccctgcgaacccggggccctctcctccctggcacagccttattttcactcctgcagctcccgagaggaggcctcgctcttccacctgtttctgtgtcatgggacccttcacagagcaggcactcaaaacccatgagcaccccatcccttacaaccaaacgcagctccgtttctgcctcccacggcttcttcacacgcttcccagtgggttcattctcccttccccacgtaaagatgtgtgcagccacagctttccggccaccttgaaatgaggtgacatctccagtcgcttcccgtgatgaagtgcggggcctggcactgcgcactgctgcccctgctgggtcctcacagctccttcagcagcctctggggtctcacctcctggtcccctgggcccttgcacatgcccggccaccactctctggtccccccagcactcacggctcacctcctgggagccaaggcacctgcaagtcctgctgtcgtcccgggaacaggggtccccttcccgtgggagatgggatcccccaggtaacacagccagtcagagggcagcatcagaactcactcgctgtccttgtctacactaagcactcaacttcaagttgggaaacctgggtaccaagcagccaaccaacgccaatggaggtggaaggcgccgccccgcggcactcacacccgcctcagatgggagcatggtctcaggggccagggcccaggtcttatccagactcagctgctctgtgacccaggtcagtcactggccttcctcccgggctgcttctctgtggctcaggggacaataggcccatctcgttaggctgccgtgagggtgaaatgaggctgcgcacatgagactggggctgagaacatgcgtgggccaagaacacacctgccagggcccatcgcagcaccctcatcagctccagggcccatcacagcaccctcctcagctgcagggcccatcacagcaccctcctcagctccagggcccatccagtgccctcctcagcaccagggcccatccagcaccctccttagcaccagggcccatctcagcaccctcctcaacaccagggcccatctcagcaccctcctcagcaccagggcccatccagcaccctcctcaacaccagggcccatctcagcaccctcctcagcaccagggcccatctcagcaccctcctcagcaccagggcccatctcagcaccctcctcagcaccagggcccatctcagcaccctcctcaacaccagggcccatccagcgccctcctcagcaccagggcccatctcagcaccctccttagcaccagggcccatctcagcaccctcctcaacaccagggcccatccagcgccctcctcagcaccagggcccatctcagcaccctcctcagcaccagggcccatccagcgccctcctcagcaccagggcccatctcagcaccctcctcagcaccagggcccatccagcaccctcctcagcaccagggcccatctcagcaccctcctcagcaccagggcctatctcagcaccctcctcagctccagggcccatccagtgccctcctcagcaccagggcccacctcagcaccctcctcaacaccagggcccatctcagcaccctcctcagcaccagggcccatccagcaccctcctcagctccagggcccatccagcgccctcctcagcaccagggcccagctcagcaccctcctcagcaccagggcccatccagcaccctcctcagctccagggcccatctcagcaccctcctcagctccagggcccatccagtgccctcctcagcaccagggcccatctcagcaccctcctcagcaccagggcccatccagtgccctcctcaacaccagggcccatccagcgccctcctcagcaccagggcccatctcagcaccctcctcagctccagggcccatccagcaccctcctcagcaccagggcccatccagtggcctcctcagctccagggcccatccagtgcccttctcagctccagggcccgtctcagcgccctcctcagctccaggacccatccagcaccctcctcagctccaggacccatccagcgccctcctcaacatggctcccttccctctcgccactgagcagacttgataacagatgcaagctcgttccagacccacaagaaaatccacagcaagacaaattttgtgccaaagttgggttcaagatcaaaaacaatcctttgtatctcatttgtaataagtcgtaggggctcacgagaaaaggaaagataattcaattttgaatgtatgtttacatttcctaaacagctcacttagcatctgaacccgaatgcacacaaaaaaataaaacattgtctttaaggaaataaaatgcagtgggcctaacatggcccccaattggccaagtcctcttctcaactaggaaactggccactgtccactctgggcctgtgactaacacagatgaggatctcttgtccttaaccttttccgactcccctcccagaagatggcagggctcaagaggcctgaacgggaaagccccgtgtgggctccatggcgacctcagcaggcgagcccacccctctcccgggaggactaacagtgggaagacttctgtgggtgggagatgaggaccccagtctctcagcctggtgtctgtaaaactaggagaacgggcccatcctgcgggtgctggggagcctgtgggacacacaggaagcacttgtgtgtccaggcccagcggtcctgacccagccttttcagctcaacctgggccacccttaaacatggaggcaagggccaggtgtgatggctcacgcctgtaatcccagcactttgggaggccgaggcaggtgaattacctgaggtcaggagttcgagacaagcctggtcaacatggagaaaccgtgtctctactaaatcacttgaacctgggaggcggaggttgcagtgagccgtgatcgtgccactgcacttcagcctgggtgacagagacagcctctatctcaaaaaaaaaaaaaaaaaaaaaaaggaagcaaggggattcctagtgttccagcagggggagaactgtggttctagcaaatcctctaccaagtgagtaccgtgcacttccagagcgtagggaatcaggtgctcaaccccgaacggcccatagcagagctctcccgatgatgcagggcacaccaggagtgaggacagcagcactaaaccatgaggttaagacaaaggggctgacagggagcagtcacctgtgagaatttaaagagcagaattaacgggctggagcattaagccccaaaggacggatccaggagggtgcccgggcggttaacaatggctattcaggcctaagaaggaaagaaataaccttaaaatagaatcccatcccatcctcctggaccagatttcactacagtaattgcatctgtgaggaagagagctgcaaaggaaattagatgttctccgggctcagctgtaagtcatacatcagagccacccactgagaattcccattaggaagaagctggcacgagctcacatgcgggctggaggccgcccccgcttccacggcccaaaaagctgtccccaccgaggtcctcgatctggcataattgccggcattgtgccgtgcctcccgccctggccacatcaatgtggctcattcttcgaggctccactgaacgctgggagctgtgttgaaagtgggggaggggcatccactgatgaagcttccggagcatctccatccagccagctccctcacaccaactgaatgagccagcgtgctgtaaggaaaacactaccagtcatccacatgaggaggggcgggggaaggtacctctgcctgggacaaaagcctgcaaggaaaacaggagctgagcactccagccataatacaaccagctactttcctgatgatacaaccagctactttcctgatgatacaaccagctactttcctgatgatacaaccagctacttctctgatgatacaaccagctacttctctgatgatacaaccagctacttctctgatgatacaaccagctacttctctgatgatacaaacagctaatttcctgacctaccaagaggccagaaaccacacctcaactccctgcttcccaattaatctttactctgcagtccccactctgggccccagcgacagtattggtgaagagacgcaaagctgatgaatgacgtcaaacaaacaaaaacaacctgtagcaggtggcttcaagaaaccctcctgctttccttcctcaggggagagagccagcagccttgctgcctgggtttggaagggtcaccccaggccctacccaccatcctctctaagcccccaccagctgcttcagccctggatgacactggacaccacctgggaccctgaaaatgcaggtgcctgggccccacctccaccagattcagatgtcactgctccggagtgcggcctgcttaccagacttatctgagcactcccagctactgtggatgtacagaaagggtttagaaccatgggcccattctaccaacaagaactgcatataccacgggccccgcctcagagttattgttgaggacttgtccccccaccccaccctacaatggctcattaatatcccatacacgcaaatcctcgtcaaagaccctcaatgaagtatgcaggccacccatgcctcttcctcattcaattgataaatgagaaagtttcttaaggaaaaattaaacaaatcaggtgatttagcctagttttagtcactaagaagggacttcagagtagttcataaattgtctctaaggattttcaataccagagcattcctcagagggctgggtggtcccctagaagcccctgccacccctgtgtctgctgtggctggggctccacatccccatgacgtgtctggtggcagccaccacagtcctgtctcttctaggaatctaagtgttaggttctggtttcttctcttccacatccacctttggtgttggtttcagaaacagcaaatcctacaatccacggttcccaagcctgactgcacacctgaaccatccctaaatactttccacacaggtgccttccctgggccccatgcactggaggaagccttctgtgaaggtccactttggggcccaggaatgggaatccagcttcactccatagtcagccaggcttgggacaactgtggtggatgatctgattgcatccgactgtcctcccttgcaggcccaacccacagggatacatggccaaagtttagatatgcacccccagcccccaaccacacagtccagatttcaattacatggcatgttaaccgagtaactacataaagtacaaagtgtgctgccaggtgtaggcaacaaaccaccacatgttaacagccatgtgggattggtggctgcatggggattggccagggtgcctgtcactcagctcagcacagacagcaaagcatggagctgtgtggccacatcatctcccagggagaaaccaaacaacatttcgcagaagtgaattatcagaagaaagaacagacaaacaaagatataagtgcaccagagaatgaaaagggatggtgctggaagtgaaattccaaagaaaggccagggggcaggaaacagacagcctgctgggaaacatagactggctaccatgtgggacactcacggtgctgcaggaacctaaggaaggcaactcatccgcacacagcagggaagtggctgtgagggaaacgatgatatccaggggaaatggggcaataagaccttcacagtaaagggacactcagaggcacttcaccaccacaaaatggcaaagcacaaaatgttggagggcaatccagactcagaaagggattgacactcagcaagccatggggagaatgctcacaactatcacagcctagacaaggattcaagtgccacacacactacatcgagatgctctacctctcactgtccccctgtgctaagtcacagtgcactacatcaagatgctgcagctctcagtgtcccactgtgttaagttgtggtgtactacatcaagatgccgtagctctcagtgtcctggtgtaagtcacagtgtactacattgagatgctgtagctctcagtttccctgctgtgttaagtcacagtgcactacaacaagatgctctagctctcagtgtcctgctgtgttaagtcatggtgtactacatcgagatgctgaagctttcagtgtcccactgtgttaagtcatggtgtactacatcgagatgctgaagctttcagtgtcccgctgtgctgtcatggtgtactacatcgagatgctgtagctttcagtgtcccgctgtgttaagtcatggtgaactacatcgagatgctgtagctttcagtgtcccgctgtgttgtcatggtgtactacatcgagatgctctagctctcagtgtcccactgtgttaagtcatggtgtactacatcgagatgctgctgtagctctcactgtcccactctattaagtcatgatgtcctacatcgagatgctctagctctcagtgtcccactgtgttaagtcacggtgtcctacatcgagatgctctagctctcagtgtcccactgtgttaagtcacggtgtactacatcgagatgctctagctctcagtgtcccactgtgttaagtcacggtgtactacatcgagatgctctctcagtgtcccgctgtgttaagtcacggtgtactacatcgagatgctctagctttcagtgtcccgctgtgttaagtcacagtgtactacatcgagatgctctagctctccgtgtccccctgtgttaagtcatggtgtactacatcgagatgctctagctctccgtgtcccactgtgttaagtcatggtgtactacatcgagatgctctagctctcagtgtcccactgtgttaagtcacggtgtactacatcgagatgctctagctctcagtgtcccgctgtgttaagtcatggtgtactacatcgagatgctctagctttcagtgtcccactgtgttaagtcacggtgtactacatcgagatgctccagctctccatgtcccgctgtgttaagtcatggtgtactacatcaagatgctctagctctccgtgtcctgctgtgttaagtcacggtgtactacatcgagatgctctagctctcagtgtcccactgtgttgtcatggtgtactacatcgagatgctgtagctctccgtgtcctgctgtggtaagtcatggtgtactacatcgagatgctctagctctccgtgtcccgctgtgttaagtcatggtgaactacatcaagatgctctagctctcagtgtcccactgtgttgtcatggtgtactacatcgagatgctgtagctctcagtgtcccgctgtgttaagtcatggtgtactacatcgacatgctctagctctccgtgtcccactgtgttaagtcacagtgtactacatcgagatgctgtagctctccatgtcccgctgtgttaagtcacggtgtactacatcgagatgctgtagctctccgtgtcccgctgtgttaagtcacggtgtactacatcaagatgctgtagctctcagtgtccccctgtgttaagtcacggtgtactacatcgagatgctgtagctctcagtgtcccactgtgttaagtcacggtgtactacatcaagatgctgtagctctcagtgtcccactgtgttaagtcatggtgtactacatcgagatgctccagctctcagtgtcccactgtgttaagtcatgttgtactacatcaagatgctgtagctctcactgtcccactgtgttgtcacagtgtactacatcattgtcagactcactgttttcatttccatacacacttagattataagagtttgtaacgttttcacaacattacaggtcatgaaacaatcctcattttcctataagttattccagtggctcacatagtccttgccacttctccttcaccatgcaatgaggtacaacctggtattggttttgtgcttgactctgaccctcttgccatcttttgtaaggttctgtgtttaaatattgcatttcaggcagctgtggtgttgccagccttgaggcagggttctggagcctgaagacatgtgtccttggcagtaacctgtgtgtagacccacctttctgaaattagacccagatgctatctcaaagctaaaagtcattttcttgacatcaagcatttttggcctggaaagctccattttagaaaacggctgttttgcaaacattatataagctgtcaccagcaagaattccgtcactgcaagaattccttcactgcaagaattccatcattgcaagaattctgtcactgccgtaatcactcatcagagactgaggaagtctcagtcaagtgcacggggcctcgggactctcggaggtgcccagctccacagacccttccacatgggaaggcagcagagtggctgctctctttcccattccctgctctgggagtgtcagccctgactcacacagccctccttccatgtcacgccaggagcctcaccacgcagcactgcagctggaatgagtgaaatacctgatggaggacttggagaagagagtcgaattcacaagcctccagcactcggtgtggccagcattcaccactcagggatttctaagatcacacgtgatgtctgaccggactcagaagctcacacgtgatgtctgaccggacttggaagctcagcacttcgttattttattatctccaaatccaaaagaagtggcagtcattacttcaaagcccactcctgaaggaaaaggcccactgacaccagtgctggtgatgcaatccacctatgttagcattggaccccgagctgtgcctgaacctcggtgcctgcattctttactcaacaggcatctgttgaaactctgtcatgttggccactgttacaatcttgtgcacaggacctgacccctaaggtctccagagctttggggcattttatcagaggttcctgccacatttgtgtccagcacaacagtgagtaaagaactgggaacatgttctccctcccaattcctcccgttttccttcccaaggcaggcaggacacattgtctcacggcgagctggccttaccctgaactcagagcatcagcaccccaaagctgcagtgaggaggaagagactgcccacccgcgaaaaggcccctcagtcttcagccaacaccacaggcacagcttcagccctctgactcttgctgaccacgggttaccttggatcttctctcctttgagggcaactgagccacatttggctcctttcagaacatagaatcttggctttgtcttttcctgggcttggggtacctgggactccagcttcaggcacagggtccagcacacattccttcttcttcaccaaaagccaatgagatcagcatagttgcaaagctgccttatgtttttaatgagaagagttatttacaaaaagagatggcttgacaaatatcgtgcataagcaatcccaccagtgcgcattgcccctgagttcccttccctctgagacccaagctgtcatggctgtgagccatgcagatgaggtcctccttgtcatcctagtgggcttcccagaagatactccccatcatccgagtgggcttcccagaagataatcccagtgactgagtggttcctgcctcccttctccggccacatttgtgaaatatgtaagcagcatgtcttccatggaagcggggatgaagtgacggctcggagtcagtttcctccgcgtccctgttgatgagacgtggcagttgcatgaggggcaggtcacaggcggttgtggcttacagacgccctgggttccaacagggcctgacagagatgtccaattccagggatcaccttcccattcttgatcggacccataacatcttagaaagcacaatatactcagttctgcccatgtcatcctctgctcaagtatctgagttcaaggtcatttctggactgaggattcccgtaccccattagacgtgtgtggctcagatcttcagtccaggctttggaatcgagggccagccgcaccccttgttgctcccattctggctggtggtcccctggtgcacctgtcatgtcctgcacagctctcaggcctttggttgaaaagctgactggaatcacacttgaaaaaagagctcagcctgtggatattagtgacacccaccctggtaggaaatgaacatgtaaggctgagtttgtttcttggagttttcctatttattttaaagttggggtgacaagcactgggtttttgaacactgagcggagggcaacgtttcattatttatgcaaagtgcatcgacaaagcgacattgaaagtttttgccatattttcctctttgtagtttctccaagtgagatatgtcaagaagcagctttcctgtgatgtgcctcagaaataaatggaaagaaagaaacgcagcagatggcttggattaaatctgaacagtgataagttctgcttttaggacagctgggtaatgtactctttgctcaaaaacatgtttgatttgaaacacaaaaacaatcttatggtttccatgaaaatgaaagaaaaatgaagctgaatcgtggagtaaattgctagttttctccgcagcatgttctgggctgctttgggagccatatgctctgtttgatgtaaatgagatggaactgaaattaaaaagttttacatttaaaagtagtgaccaaacctattcatcaatgcctttgggcattctaataaagaatttttattagccctaaggtttggggttaaaaaaataaagtttgtcttaaccctgaacaacttgggcccaccttcattttcaggtctgtgaaatattcaagcaacagatgctgaagctagagaccaagttactgatgagggaggtagtttggttcttggcaatcaagttctgcattaataatcgagcctcatcacagaaatacttcaaatccacttttcacagaatatctactgaaaagtatcactaaaacgcaattttgctagaatccattaattttacgagctgactgaatcttcctcagagatcaaaaactgcaaaggagctagactacaaggaactgaatttcagtcaaccttttaagaaatgcagatcagaatgcaaatcctaggtaggttcttaaacagcaaaagacagcatccacgtctctgcaaaaggcttgaactctttggccagcttggttggggagagctggaatggcaggttgagaagtaccaacaaaccccatcaatggcagcttccaacaccatctgattttctgaatttcaaatctggacacggaattgagccggaaaactctgaatgctgccagattctcatttcagatgcacacacatactcttacatgtctcaaagaaagtaaaataaaaggaagatagaaagaaggaaaaagaagaaaaagaaaccctgtagtccacatgaaagagcaaatgccatctgaaggcctcagcagctacacgggatgtcatacctgggctgacgctgccggcttctggggccacccttcggacgtggtctcagtcacacccaggctgacgctgccggcttctggggccaccattcggatgtggtctcagtcacacccaggctgacactgccggcttctggggccaccattgggatgtggtctccgtcacacctgggctgacactgccggcttctggggccaccattcggacatggtctcaataatcttcccgagctcggccagctcacaggagctcaagcttacaagtagttggtgtgtaatttgcatggtcagtagagacaaagaaaggcttcaaagccactgcacactcctgctgctctccagagataaagcgaggagagggtgacgatagccaatcagggcccacgccagtttcccagataggaaccatggccgataaacccgagaccacaggtgttccatccctgctactcagcccaaagcaacaaggaagcctgaggtgacaccacaaaatgcaaatttatctccaacgctgtcacttgttaagatagcaaagaaatgagccttgatccgtgaataaactgtatacatcaactcatctgggaaacaagcaagaaacccaagagaaaccacgggggagaaaccgggatccatgttctatcccctgctgctgggccagacctgagcagcacggcagtgaaggaagtggatttggggggcttccctccacccacagtaaccttcctttgctgagtgatgcaagcctgacctttccggggagcacccatgacctcgtggggacacggtgaaccctagggacatgaaatggtcccgccctagcttcctctccagtgccctgcctgtcctgcccagggcactcccaaaatgtctcaacgaaaatgttcttagaggggaagaggtctcagagattagcccctctggttcctcattttttttttttgagacaaagtctcactctgtcacccaggctggagtgcaatggcaccatctcagctcactgcaacctccacctcctaggttcaagcgattctcctgcctcagcctcctgagtagctgagattactagtttttgtatttttagtagagacggggtttcaccacgttaaccaggctggtctcaaactcctgacctcaagtgttccgcccacctccgcctcccaaagtgctgggattacaggcatgagccaccacatccagcccctcattttctagatgaggaaagagaaactgggacattacagtccctttacggccaacactggaatggaatcctgaaaactgctttgcacggagttctgctgtggtctgtagtttgcatgtatcatttcctttaatcctcacaactcccctctaaggtggtaattaccttattttcacttttttagacgagaaagattaattcggaagaggctaaacagctccaaggtctccgagcagagaggcagccgtcggattccggaacctgctggaccaccctccaggcgcccagtgatttctccagggtggacacaggcttacgtgtggcgcaggagtgctctgtgacgtacacaaggcgcatcccacaggtggatgcagagaggccagagaggggaggcacctggcaccatcccgttctgttttcggtgcggcccgttcttcgggctttattaagcaactgcccacgtggaagaaaagcaataatgaagcaaggcgtcgtatcgattcccccagctgtaatggaattccgtcaaggagcaaagcgaggcgttttcagaaactctgcctgttaacgtttattgctcccaaagtctgattataacacactagctccgggggccgagtgaacatcacttcacacaaaaacagggacaacgtctgtgaccaccggagatgaatattagtgaaagaactgactctcccgattcctctattaacctgtctctggctacattcaaacaaatcatatgtgtgtacggaacaggctcatacacacatgccagcacgcgtaatgcccagtggtcagaaaatgctcttcaaaccggggactgagacgcccgcagagcgcggccctgagagccctgagagcagagtcaagcacgatgctgctgcctggccccagtggccatgcatgtgccgcaccctcgagaacatctggggacctcggggcccacaggcattaaccatcagcttaatctcccacgccaggtgtgctcagcaccctcgagaaggtccggggacctcggggcccaggggcattaaccatcagcttaatctcccacgccaggtgtgctcagcaccctcaagaaggtccggggatctcggggcccacaggcattaaccatcagcctaatctcccataccagctcaccaggtctggggcccgggtgtttcggagaaggcattctgtagttataactaccatccaccatcaggtgactgtcggtaaaggaggggaccctccttcatgtggccatcacttgaggccttaagacaaaaacaatcatgttcattgctgctaagaacccaaaacaataggctgaaagtcctgctgatgcactgccaggaaagacgcagagtacgagaccagtctagctgaggcctgcgcaccgccgggaaagacgcggtgtccgagtccagcctagctgaggcctgcgcaccgccgggaaagacgcggggtccgagaccagcctagctgaggcctgcgcaccgccgggaaagacccagagtccgagaccagcctagctgaggcctgcgcaccgccgggaaagacgcggtgtccgagtccagcctagctgaggcctgcgcaccgccgggaaagacgcggggtccgagaccagcctagctgaggcctgcgcaccaccgggaaagacgcggggtccgagaccagcctagctgaggcctgcgcaccgccgggaaagacgcggggtccgagaccagcctagctgaggcctgcgcaccgccgggaaagacgcggggtccgagaccagcctagctgaggcctgcgcaccgccgggaaagacccagagtccgagtccagcctagctgaggcctgcgcaccgccgggaaagacgcggggtccaagtgcagcctagctgaggcctgcgcaccgccgggaaagacgcggtgtccgagtccagcctagctgaggcctgcgcaccgccgggaaagacgcggggtccaagtgcagcctagctgaggcctgcgcaccgccgggaaagacgcggggtccgagaccagcctagctgaggcctgcgcaccgccgggaaagacgcggggtccgagtccagcctagctgaggcctgcacagcgccgggaaagacgcagagtcagtccagcctagctggggcctgcgcaccgccgggaaagacgcagagtccgagaccagcctagctggggcctgcgcaccgccgggaaagacgcagagtccgagaccagcctagctggggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccaagtgcagcctagctgaggcctgcgcaccgccgggaaagacccagagtccgagaccagcctagctgaggcctgcgcaccgccgggaaagacgcggggtccaagtgcagcctagctgaggcctgcgcaccgccgggaaagacgcagagtccgagaccagcctagctggggcctgcgcaccgccgggaaagacgcagagtccgagaccagcctagctgaggcctgcgcaccgccgggaaagacgcggggtccgagtccagcctagctgaggcctgcgcaccgccgggaaagacggagagtccgagtccagcctagctgaggcctgcgcaccgccgggaaagacgcggggtccgagtccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcagagtccgagaccagcctagctgaggcctgcgcaccgccgggaaagacgcggggtccgagtccagcctagctgaggcctgcgcaccgccgggaaagacgcggtgtccgagaccagcctagctgaggcctgcgcaccaccgggaaagacgcgggtccgagaccagcctagctgaggcctgcgcaccgccgggaaagacgcggtgtccgagaccagcctagctgaggcctgcgcaccgccgggaaagacccagagtccgagtccagcctagctgaggcctgcgcaccgccgggaaagacccagagtccaagtccagcctagctggggcctgcgcaccgccgggaaagacgcggggtccgagtccagcctagctgaggcctgcgcaccgccgggaaagacgcggtgtccgagaccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagtccagcctagctgaggcctgcgcaccgccgggaaagacgcggtgtccgagaccagcctagctgaggcctgcgcaccgccgggaaagacgcggggtccgagtccagcctagctgaggcctgcgcaccgccgggaaagacccagagtccgagtccagcctagctgaggcctgcgcaccgccgggaaagacgcggggtccgagaccagcctagctgaggcctgcgcaccgccgggaaagacgcggggtccgagaccagcctagctgaggcctgcacagcgccgggaaagacgcagagtccgagaccagcctagctgagtcctgcatacctaactccgccgaggacttacattctgatttcaggggttctcttagcctgtcaccaagtgtttaaagaaggttatgatgaaaccaacaagccaatccgagtgtctttaaactggggccacgaatgaaattcactcctgtaagagggcaggggagctggggcactctctcatcccaaaatggaaaaacattcatttttaacagtaataaaacatgaggtggtgaaggcacagcggcgtcggacgtgactcgcagcgcatccaagacaaggggcctgctcttggtggctcagaagacgagggcggcagcaagaccctcgggggaacccttagggaagtcaccgggttgtccttttaaacgatgtgtgccaccgcacagaaactgcaaaggagaaaactaaaattatttgtaacccaccgatctgaggaaacggctgctggcattggctgtttctctccatggttgagatcgcagtattgggacacttttacagctgcctttgtcatttaacactattccaccggaattttcttatgttcttaagaaactcctaagaagtataattttagtacctgcaaggtatctgtcacagagtcaccattactcgaccaggcctctgtttcacacagtcgggtcgtttttagtcagtgatccaagggggccgggcggtgaaccaagtctaacggaggcagtcacagttcagtgacagagttccttcctggttctgatggggaagttcagtcaccgtgtctgtatgttacttactcgcttctttcagggtcttttccaataaagacagctatttttcatggcaatggaaattataaaagcagctaccgtcatgcagatcgtcctgggggcatcccagctgcaccctggtgccgggacagccttactgcaagaaaaacagggtgtgggaggatttacgagttccagctgagccagctacatcaacctgtgggcacgtggcgggttggtggccaagcctgaactgagaccaaggctttggactcctagcactggctgtctcgcttgctaaaccgtaatagtctcatctaactgctctgtactaagaacatgcttccggatccaaccgatgtgtttcggaggtgccctacccattcaggggcagggtggggctgtcacccagtcgagaggctttcctgaagccgagagcactgggaggcagcatctgagacctctctccacagcaggagctcccccacatctccagggaagaacacgttccagcagatccacagccggcacaaaggaaaccttaggaaggtggtgctaggctctccacgctggtccttagcagctgttcctcctgcagctcagagctcagcatcccttctccaggaccttcccgccatcaggcactctctgcaccacccagctccaccaccatctctgcctcgttcccacggaccgtcagcccaatgctgggtccccactgcagcttccacaaacccttagacccgctggtgatgtgctagctccctcattcccggcctgggagagcctggcctggtcccacctccctcctgccaccctccgctcaagcacatggccatcccaacagcagagccctgtctgagaggaaagaactcagctccagaccgccagcaggcaaacatatggaaagatgggctcaactcagtttctggtttttcactaattcatggcttttttattaaatgcaatcttaatacagatggatgcaggagtgggtttccataacaggccatggatggtgagctaatggcctgaaatgtcaagtccaaatctccaaacaaaagtgatcatttaaaaggaagatgtgtgtagccgtactcgtgggacataaactgttctttttcttttcttttcttttttcttttgagatggagtctcgctctgtcgtccaggctggagtgcaatggtacaatcttggctcactgcaacctctgcctcctgggtttaagcaattctccttcctcagcctcctgagtagctgggattacaggtgcacgctaccacgcccagctaatttttgtatttttagtagagatggggtttcactatgttggccaggctggtctcaaactcctgaccttgtgatccacctgcctcggcctcccaaagtgctgagattacaggtatgagccaccacgcccagctgggacatgaagttttcttaaacaacaatgctttgtaaggatcccaagcagcagaagaatccaactgaattgaaagtgggctaaagagtgcacaaactcagcatgggatgaggtgagggagagcagcctgctggcgctcacaggctgaggggcctgtagacccggaagtcggtaccacttgtgggaagtctctggtgaagatgaaaaccaccccaggcacattcacagaaatgctctggggtttgtggaccctgggcatgttcccagaagcgctctgtggtttgcggggcctcgcacggctcagcgcggcaccccctccctgtggattcccgctctgagagtcaagatcactgcatgggagtgcattgcttcttgtcctaattgacagggaacatttggtggtgtctccaccacaagagacgcagcatggctgcgggaccagtgaagccataaagcccactcggtgccttgtggggccgacaccgtgtcactgcaggaagccgcagcccggcctggatttccaggaagcaaggccagctcagcacagacacaactcccatgacagcttgaacccagctcacccccgctatgagagaaacaccgggtgactgacctggagtgaaaacagcagtgaggaagggggaagagccccccacactctcagaatggtctctggacggagacccccaggcagtggccatctgaccctggctgtgtctgaccgtggaaccaaagcagacatgtttgagcagaaccagagcagacatgtttgactccagtcagcccttgagggagctggctaacgaggaccacccaagaccccagaacatgacaaatgcaaagagcttggactgaggaaagcaagttcaaattcttcactgtgtgattccaagcaaatcagaaccaaattcttatctgaatgttttcagtgacagatcaaagaaaagatcccagccagcgtgagccccaggcacacactgcctcacagcgggctcacactgggcccacactggcttacactgggtatacactgggctcacactggctcacactgggctcactccgggctcaacactggctcaaactgggcacacaccaggcttacactgggcacatactggccacacacttgctcacactggcttgcactgggcttagaccaggcacacaccaggcacactggctcacctcgagcacacaatggctcacactgggcacactggctcacaccaggcacacactgcctcacacgacacacactgggcacatactgggcacacactggcttgcactgggctcacaccagacacacagcaggcacactggctcacatcgagcacacactggctcacactgggcacatactggccacatactggctcacactggctcacactggccacacactggctcgcactgggcacacaccaggacacactggctcacatcgagcacacactggctcacactgggcacatactggccacacactggctcacactgggcacatactggctcacactggctcacactggccacacactggctcacaatggctcacactgggcacacaccaggacacactggctcacaccgggcacacactgggcacacactggcttacagccacccacccgagggacaggctggtgccaggggaagctgtgtctgagtgctccatcatgttatccgggacctgctcgtccctctctctgacctgcctgctggacaccaacaccagccctcaagtgccagcagtgacaagcccacctgagcagaaatgcagattctcgtccagcatcctcagagtccaatccactctaacaggatcccctttggtcacatgacccctcctgagccaatcactgcagccaggaccacggaacattctggctgactcacgggatgccttgtccagggcggggaggactcagagttctcgctggacctttaatgacgtgtgagggagaagagaaacacgacacggtcagggagacgtcacaggttttccccagatcctcaggggaaccacacacagtgactcatgaggagcggcggggccttgagccagggcgaaagcaccgggcgctccaggatcccaggctccttccctgaacaagcatccaaacctctcaagctagggctgactacaaacgacaaagtcctgtaacacagagctcagatagcggatttcaaacgttttgttcatgaaaatgtaacctctgtgtcgtcttggaacagtgttcaggagggggagggtgcaagctctggcccaggccccacctctaccagggaaggcaaacatcacttaaacgcctgcagcctcctgcgaaggttttctgagactatcagtaaagataatatgttttcaagctcctggaatatgtttaaagtattatgcaaacaaacaacagctattagaaatatcactttacaaactttttgttgagatactatgcattccaaagcgttcaccagtgagaagtacacagcttggtgctgcctgaagacgcagcctggcccgggatttccaggagcaaggccagctcagaacagatgcaacccccataaaacagagcttaagacaacctcaccctcactagaatggcttacactcctgctacaaaagaaacacctggtgactgacctggagtgaaaacaggaacgaggaagggggaagaggccccgcgccctgacaaatgtttacagaacaaacactcccacccagacatagattcataacccacaagccccgcccccatcctctcagtcaccatcattctaaattccaggctgaacgtcagctttgcctgtttgaactgtaggtccgtggaatcacactctctgctctcctgaatccggcttctttgcgcaatatcccatttgtgagagtcacctgtgtggctctgtacaacagtagctggtggttttttattgctctgtagtatttaattgcatggaacatcccacagttatttctacattcccctgtgcatagacgtgtaagttatttcagttgtaagctgttataaatcaagctgctgggaacattcttaggcctttttgtatatttaaggatgcatttctattgggtatgtactcataggagtgggattactagaccataaaagacagatatattcagcttccacagatacgaaccaagctgctaggcacattcttgtacatgtcctttgcatacctcagtctgcatttctgttgggaatacatgtatctaggagtgctattatttgatcacagggtaaaaaaaatacatagctacatttgtcactttattctgaagtttacaggcaaaagctgctgatgatacggattgatagcgatgtccacttttcattcctggcactggtaagttggtccttccttctgtttttcttgatcagccttgccagaagtgtatattcacatcttttaaagaagcaatgattggttttgttcattctctctaccgtacatttgttttctattacattatttttctttttattatattcttatatttctttaacttcaattttctgttctttttctacactctttagacatatgtcattttcaccttttcttcttttctaataaaagcatctaaggttataatttatttctaaccatagctttaacttgatcccaaaattcccaaaattgtttaatattgtatttttattatagttcagttcacaatattttcagatttctattgacatttcttctttgacaaatggggtatttagaagagtactgcttaatttccaaacatttagattttctagggatttttttttccatttgtttttagcttaatttctttggccaaagaaatactccgaatgatttcaatctttagcaatatgttaagatttgtttatctgatcaaaacatttccgtctaatagatggtcattttcaatatgtatgctgtgtgcactggaaaagaacacaggttctattttgatagttgcagtgtgtccattagatcaaggccattaatcccgttcttcagacctgcttcagcatgtctctctaaatacatgacaggacacacacaccaataataaaaacaaacatgcataaaaatgtgcattattctctccggtaattatctcaatatttgctttatacatttgaaaattatatcaggtgcatcaaatttataattactgtgtgttcctgatagaccaacccttatatttattatggccctttttatctcggaaaatgcttcctgccttaacatctactttgtatattagtttagatataccagctttctttagggtagtgttttcattgtattctcttccagcgtttcaaacttttatatctcaacattgaaggtggtcccttgcaagcagtgtggttttgttttttagtgacaatctttaatttttgagtggagtatttatctcatttatttacaatgaaattactaatatattgggatttatatcgactatcttaccttgtttttttatttgtctcatctgttttatttttccttttatcctttattgctttcttctggatggagtatttttattattattttgattccctttcttagcttgttagctattctttttgtggctattctagaaataataacacgggaccttgatttatcatggtgcaacacacatcacatcccacatggtgtcagaaaaactggatacacacatgcacataacaaaattggaccgttaccttataccatacacacacacaaatcaactaaaaatggattcatgccttaaacataacacctgaacctgtaaaccgcctagaaggaaatataggaaaaaaccttcatgacattggtcttagcaattattttttggatatgacaccaaaagctcaggcaacaaaagcagaaacagacaagggagactacatcaaactaaagtttctgcaaaagaaacaatcaacagtgaaaaggcaatctacagaacaggataaaatacttgcaaatcgtataactttttaaaaggttaatgtccaaaatgtataaggaactgctgcaacccaataaccaaaaacaaaataacctgattttttaaacgggcaaaaggacctaaatagacatttctcacaagaagaaatacaaatggactgcaggtatacaacaaaaatgctcgacatcactaatcgccagcaaaatctaaatcagcactacaatgagctatcatatcaaacttgttaggatacctattatcagaaaaaaaaaagatgagtattggtgaagactgtatactgttgtgggaatgcaaaaggtccttatggaaaacagtatacaggttcctcaaaaaattaaaaatagaactactatttgatccagcaaccccactctgggtttttacccaaaagagtcaaaatcaagatctccaaagagatacttgcattcccacactaactgtggcattatttgcaatatccaagatgtggccacaacccaaatgtccatcaacagatggatggatgttttacatgtggtatatctagacaatgaaacattactcagccttaaaaaagaagaaaatcctgctgtaagtgacagcatagatgaacctggaagacatgagctgagcgaagtaatccaggcacagaaaagataacactgatgatttcacttagacgaggcatctaaaatagtccaatgcgtagacccagagagaagaatggtggtttccaggggctgggtcggggcagggtgaggtattgctaatcaatgggtatcaagttttagttctgcaggatgaacgagtgctagagatctgcggtacagatcatggctgtcatcaacaatactgtgccatgcacttaaaatgttaagagggtggatctcatgttatatgttctttccacaaaaaaggacatggatccctgacttattagtgtaacacgcattatcgcatcctggataatgccaaaacctgagaacactaactcctttaccttctgtgccaccaatattcgtgttgatttaccaacccattgatagttcccactgctatccctgcctgccttgtttcctggtttccatgtgggtttactttcctcctgccagaagcccctgcagtcttttcccaagagtcatctgttgatggagtctctcgagttctgtctgtcttttcgtaggagtcatctgttgatggagtctctcgagttctgtctgtcttttcctaagagtcatctgttgatggagtctctcgagttctgtctgtcttttcctaagagtcatctgttgatggagtctctcgagttctgtctgtcttttcctaagagtcatctgttgatggagtctctcgagttctgtctgtcttttcctaagagtcatctgttgatggagtctctcgagttctgtctgtcttttcctaagagtcatctgttgatggagtctctcaagttctgtctgtctggtcacgtcttgatttcatctttatacctgagaaacatttccagggagtagagaacttgaattgatggggtgttttcttccatcacatgcgaggttcatcacacttctggtctccatggtttctggtgaaacaattcatcaatagagattaatttcctatgatttttctctgcttgctttccagattttctcttaaactttggtttttactaattttagagtgatgttcagaggtagggttttctttgtgttcattctgtgaggttgaactaaccacacaaaactgccaatattcaactgttgtttacctttaaaatagctatataatagattttttaaaatccaagctttggtgtctttcttcaggtttgaaaaaaatcatagctctcatcgcctcaaacattgcttctaagctgttttccttctcctcttctgggactccacctacacatatagacctttccaacagatctcctctgcctcatacactccgtcctgtactttctctcagttttgatctgttactctgcctcattatttcccagggaccttcttccagctcactcatctgctcttccttcatactcaatgttttgtgatgcccatctattgagttattagattcagctctagaatttccatttgattactttgtttatagaatcaatttttctggtgaaattttccacttaccctttattttcttgaacatatcaaccacagttattttaaaatttgactgcaacaagtataataactatctgtgggtgtactgttgtcatctgtttttgtgtcttggtcttgcttcttgacaactgaaattcagacattacatatgaaactgcagagactctgggtgagtctatcttcttaccttcctcctcactagacagccagatcgagggtagatccccttaactcaagggaggcctgagacaagaagacagacccatcattcttggaaggctcagtcacctggggtttatcctcacacctatggcatgacccatccggggctgggacctgggatgtgtgcgatggcccctctttcttagaagttcctgaattccagtttcatctcttcagcattatgagactgccagaaatcctgctctgcttttccatagctttctgatcagcctctgattcaactcaagaatttggcaaatgtgtcagaggtgaaagccacaggtgctgattgcctctgtacctactttctctttgggatccagtctcctcagggcctggtaacctttgcaatgcaaacatctatttgtgtgttgatgaccctatgaggttgccaagtgctctgtgggtttcactgcctcttctccacagcccttgcctggtttctcagcctctttcgacaggaatcacaaatgcccccaggagacaggcagcccgcagggagtgggctccctaacagtgcccctccgatgggtcttttttaagtttttttggccaggggctgtggctcacacctgtcatcccagcactttgggaggctgaggtgggcggatcacctgaggtcaggaatttgagaccagcctggccaacatggtgaaaccccgtctctactaaaaatacaaaaattagccaggcgtggtggtgcatgcctgtaatcccagctactgggaggctgaggcaggagaattgcttgaacctgggaggcagaagttgcagtgccactgcactccaacctgggcaacagagtgggactccatctcaaaaaaaaaaaagaaaaagttttattttatttttaattgacaaataattgtacatatttatgggctacggtgtgatgtttcaacacatatatacattgtggaatcatcaaaacaggctaattaacaggatcttggcctctcaaatcccggttgcctccgcagctccccaaagcaggcattctgtggattttacccagcacttctagttgttccccacaggaaatctgatccgatgcaaacagatcattatagccaagagaaggtcagttctgatcgttgttgattttcctggaatttgctaatgatgaatcgtgctgtgtgaaaatacactttaggctgatgcccagctgattagcatatagggtttagtgacatttccactgatagtgacttcctcaaagacactctgaccaggggtcagcaaaccagagccccgggacctaccccacctgtcttttcatgtagggcctgggaaaggaaaacaaaccttgggactccaaaatctccaggctaaagggaaaagtcaagctgggaactgctcagggcaaacctgcctcccattctgttcaaagtcacccctctgaggctgccctgagacaaatgcatctcattgctccctctcccctattgcttatgtaaaaatgcagattcactgagccaggctcaattgtgtattcactggaaggctggtcaaggactcaaaagaatgcaaacttttgtctcttatctatttctaacctggaagccgccatttccagtcatcccgccttactggactgaaccaaagtatgtcttacacatattgattgacgtctcatgtctccctaaaatgtataaaagcaaactgtgcccccgaccacctcgggcacatgcctcaggcccccgtccacctcctgcgcatgcctcagcccccgaccacctcaggcacaagtctcaggacttcctgaggctgtatcatggatgcatccttcaccttgccaaaatactttctaaattgactgagacctttctcagatattttgtgctcacaagcctttgagctaagaatggtttttatatttttttaagggttgtaggaaaaatgagatggagacagggacagagaagaagtggggaagagagaagaaaggaggagaaggaagagaagaagaagaggagaaggagtaagatgaggaggaggaaacagtaatctttgtggctttcaaagccaagatatttatcatttggtcctttacagataaagcttgccaactcaagttcatgaccatctctaattcttttaaatatcaagtcatgatgtgtattaatataaagattgcatattaaatgcatcttccatagacatagaaagtaaagatatgaaaatcagtttgtactgattgtaagacaagtctctgaacgaccaacaagatggcccagtctgtggagctccaggcttatttacggggtgcacctcgtagtgcccacaaggaagctagatcttttggaaataattctgcaatgtggaaataattttgcaacgtggaaatactgaggcctggggctgactgatttattgatgagaaacccagggaggcattggtttggggttctgtgacatcatgttgaggcatctgcatttcctatcacactgtactaaatcagttagaaaatatcttaatttccctatcctcacatgagtcttactgggtcctgacaacctcctggcctctcaccctaatgagtcctcatttctgagtggacatttctcccaaattcagttgcaacaacagatggtgtgtggccacagcccataaaggtagagactcatgctcaaagctgccttctggtaggcaaagtcgccacctcgaacacaccctccaaagacttgacattcagataccaaatgctccaggtccagctcccaaaagctagatggattgtccgttccattcgggcttcaaatcagaggctgtggtggctgtggtatctcaggactggtgcagtagggttctagcacagcttcaggcagacttcctcaacaacagtgatggtgatggtagtggtggtggtgatagtgaaagcagtggtggtggtgatgatggtggtaatggtagtagctatgggtgtggtggtgatgatggtggtgatggtagtgatggtaataggggtgatagtggtgatgtggtaatgatggtggtggtggcagtggcggcggtggtggtgataatgatagtggtaacaatggtggtggtgatggtggtaatactggtgatggaggtggtcgtggtgatgatggtggcagtagtgatggtggtagtgatagtgacagggtggtggtggtggtgatggtgataggggtggatagtagtggtgaaggtggtggtgatgatgacagtggtggtgacagtggtggtggtgatgttagtgatagtggtgatggtgatgggggtggtagtggtgatggtggtagtagtagtggtggtggtggtgatggcagtgacgggggtggtggtgggggcagtggtattggtggtggtggtgaaggtggtggtggtgacggtgatgatgatggtagtgatagtggtgatggtggtggtgatgatggtgatggggtagtagtggtgttggtggtagtggtggtggtgatggcagtgatgggggtggtggtagtcgtggtggtggtgacagtggtagtagtgatggtggtagtgatgggggtggtagtgatggtggtgctggtggtagtgataggggtggtagtgatggtgatggtgatagtggtgatggcagtggtagtgatggtggtgatagtgatggtgatagcagtggtggcagtggtggtgatagtgatggtgatggtggtggtggtgatggtgatagtaatggtgatggcaatgaaggtgatggtgatggtgatggtgatagtgatggtgatggtggtggtggtgatggtgatagtaatggtgatggcaatgaaggtgatggtgatggtgatcagtgatggtggtgatggtgatggcagtggtggcagtggtggtggtggtgataatgatggtcatggtagtggtggtgatggtgatagtgatggtgatggcagtggtggcagtggtggtgatagtgatggtcatggcagtggtggtgatggtgatagtgatggtgatggcagtggtggcagtggtggtgatggtaatagtgatggtgatggcagtgatagtgatagtgatggtgatggcagtggtggtggtggtgatagtgatggtgatggcagtggtggtggtggtgatagtgatggtgatggcaatggtggtgatggtgatggtgatggtgatcagtgatggtggtggtgatggcaatggtggcagtggtggtgatggtgatagcgatggtgatggcagtggtggtgatagtgatagtgatggtcatggcagtggtggtgatggtgatagtgatggtcatggcagtggtggtgatggtgatagtgatggtcatggcagtggtggtgatggtgatagtgatggtcatggcagtggtggtgatagtgatagtgatggtcatggcagtggtggtgatggtgatagtgatggtcatggcagtggtggtggtgatagtgatagtgatggtcatggcagtggtggtggtggtgatagtgatggtcatggcagtggtggtgatagtgatggtgatagtgatggtggtgacagtggtggtgatggtgatggcagtggtggcagtggtggtgatggtgatagtgatggtcacggcagtggtggtggtggtgatagtgatggtggtggcagtggtggtgatggtgatggcaatggtggcagtggtggtgatggtgatagtaatggtcatggcagtggtgatggtggcagcaaggaaatcattctctgattacctgacatggttaaaaatctgagagcaaagatgagctgagaatgtcatcatacaatgtgtaaagaagctgagcctgagaaccctgaaatgcatggtattctctatgtgcaaacgtacgagagctgaaagtgaccagttacctattcatggttatcatctgcatgatgaagaaacactgcaacctaccttttctccactagagggttggttcactagataatggcacctgcatgccatggatgctacgtatcagtattcaacagtggaagcccactcagcattcaggagtaagagatttggtaagtgataagaaaaatttgcagaactacaggattccatttttgttatgtgtgtgcccagaagagcatctaaacagacatttacccgaatgttcttcaccatgattattttggggctttaggatcgtaaggaggtgattctgattttgtggcttgtacccttctgcaccacccagccatgcagcgttccgcctgcttccttttctcctgtgtgctttaattctagttacaggaaacatgcatatgaaaaaggcacggaagggaatgtatgtttccttttttgtcagaaaataaaatgacacgtttccatttttggagaagttaaaacagattttatctcctgccaccattcttgccttacggacaagaggaggacagggcctccaagcaaatgagcacattagtgagttaaaagaaatatttataaatctagagcatagtctttggcctagaaagacggtactaaagcagacagaagccttttcaggaacacaaataagtattaaaaaaaaaaaaaaaagcaaaaaaacaccttttttgttccctttaaaccagaatgactcttaacctggtcaacaagcacattgcaaatgtcttgttcccactaggtggccacaggtcactgggcgagcgggtctttgtgggcagaggcaggagcggaggctgcggaggacgctccaagcccatcttccgtggctcagcccagcggctcccgcggctccagggcagcgccaggcatggcttctccccgaaggcacagaaggctccgaagttgccacctcttgcctgagttgccggaaatccaagggtaggtttatatcaaatcagcagacaaacttgacttctgggtaaaggctaaaatgaatcaacggagaactgacgagactgtttccccactgacgggtctgtaagagttgggggctgcccgccgcctggtcagtcacgctatgcagctcttaggttgaatcctgggctgccctggctaccaggatgcctcagggaggggaggaagcaggaggagcggcgtggggcgactcctcccaacagggggagcagcgtggagcaaatcttcctgatgggggagcggcgtggggcaaatcttcctgccaagcgtgcgagctgcttgtccccacctgggcgagccacctcttcctaccaggggtgcccatgaggtccttcctaaaagtaagactcagcagggagggttccaaggcctgtggccagcaggtgaatcacacaggagcttcctctaccatgtgaggctctgggggtccttgtctgggtgacggtgtcagagtggactgttggccaccagcaacggggctgcctgggacggccaggggcagagctgctcccatgtggcaccctaccccgagtcctgggtgtctgggctcacacccatctctggcctaccccaagtcctgggtgtctgggctcatacccgtctctgggtgtcattccagcagcaccttctcctcctttcaggatggccctgttcagtcagggtcctgccctctcccactgcacggggaggtgctagagaagggagggggcctgtgggcactgccactcacccctccaacaggcagggagacaggcacctgccccagggatgctgcagcccagcacccctccggcagcctcgcctggctccagcaagagcggaatgttcacaggcctgtccaccgtcacctcctaacaggtcctggagaggccaggccacgccagtgccatcacagactgtgctcgggaagctgaggtgagccccagccggccgtgagccccagcgcccaggcgcctcctcccctgttgcagccccactgggtccccaagtccccacccacggccagtgtttgtttctccctgaaaacctgatttgacttcactcaaaatctccacacctgctgcaaacgtcagtttgataaacctgacgctgccctcccggctgggggcaggaatctctctaccacctgtgtgagaagaggccgagcctcagagtcccaggccaaaaccctgttagagcagcttagacacagcaccaagacccccctagacccagagtgagcctaaaatgaaaagcaagtgaaagcctcggaccgtgcagctgctcgccagaacgtctcaggaaaactggctgcggcctttcctgtggaatccaaccgagatggcctcagcctgtctccctttcctcgtcctcagtgctcctcacagaccccaagacccacagggcctgcgtcacatgcacagaagccaggtcctctcctacggccatttttgggatcccaagaaagcccccagtgtcccctcactgctgtgcagcttacaccccaagttcattgctcagggcccgctctctttcatcaacaattctccccctgcatcctcttgaaaacgcggccgcacccggcggggcaccatgccagaccacggccctctgcacagcagcaagcccaccacagcgtgtggaccgtgagacctgccaccgtgacttctccccaaaagggcctgagctgggcttaaccaggagggctggggagagctggatgcccttcaccctcgctgggcaagagcctcctcccaggcatgtcccagcctcagggctttgtctccagagggggcaggccctgggtgacacagcccctcagccccactgccctgtccccgaggctggccagcccttccttatctgcacagcctgaagccttgtgtggctgactcggccctgagcttgttctcaccaccaaaggaagagccaagcgcccccacctgctcacctctgccctgactgtcctcaccctggatcccttccctaattaaatccccccgtctgcaacccaggcagggagtttccaccacactctacactgcacagcagcctccatcgcaggtggtgccgtccctgagtgcaggcgccagaaaccccaaggaggctccttggcagagcctgagccggaccagtgaccccgcggcctctcgggaacaggtcagaggctctggagggccttcaggttcgtctggccctaatctccacccacccctcgcctctgccccagcccataacggggccgtcctccaacaatgagtgggcaaaggtgcagggctgaacgcagacagccgcctgctgctcatcaagggaacagcttcctgccgcatcttggggtctatgctgcctggtggggccaggagaccctgagagggcgctctgccccaagtcagcctgtccctcctttgccccagatggctcctgctcccacctcctcctgtccccgtgagccacagagcagcagacgcatcatcagtggacactggcaagaccatgtcagtgctcagaagcctccgggtcagccctcagaccaccccatgtgagaaggtaaaccccggcgcccaggtgagccctcggaccaccgcatgtgagaagccaggacactcagcatgagcaggtaaacccgggcgcccaggtgagccttcggaccaccccacgtgagaactcaggacacgtgagaacccaggacactcagcgtgggcaggtaaaccctggtgccccagcaccccaggctcctgccccacccagcccaccaacacacagttgcccaaagtccggattcccagctcgccccaggtcttcctgggcacattctgtccttgcaaaccacttagaggttgagggactgtttatggggtgggtgtgtgcctgaatgtgtgagagacagagaaaaattacccccaatctataagctataggtaagaaaaagtacattttaattttacattaaattgaatactttcaactatattttaatgtggaaattcccaggccagtatgaggtgttgctgtggtcggaccacgctgggcccactcacgatggagtctgtcgtgagagctggagccccacccaagccacagctgcccccggcaggcaggccccacccaggctctgcaatggacacacggagacccacccgagccacagccacccccagcgggcagaccccacccggactctgcctgggccacagccgcccccggcgggcagaccccacctggaccctgcctgggctgccatggacacacggagcagcttgaaaatccaatggtccctggtgtaatttcctcagagattacttggttgatgagaaaagcagtaagttttgttgtttggtttcatctatctggatttttggtgagaattctccactgctccctgtctggggagaagcccagccccatggcagccccagcctctgtccaccatcaggcacgctgggctgtcacacagccacctgtccagggcacccatgacatccggaacccacctcaaatctggcttctgtggactgaaggcggccggcctgcagcctcctagctcctgttcccacggcctcacggcatccgtcactttcgagggtcatcacaatatgaccagaagcccacgggtggctttgaaagagatgaaggcggtgacatacgtgcccagtaaggacgcagctaggatgccaggtggggcaggccaacagcagctccaggcaggaccaggatggcctctgattgtcaaacagatttaaaatttttgctctgaaacactgaaacattccttcccaagcaaggacagagccatgaatccacagccaatctggagttcctctctgggcctgggcagcctctcctagctccccagacaacactcggtgcctccctgcagcctccaccgttaagcaaaagcgtggatgtatgaattccaatttaggttttagctaatgcttgcattccagccattaattgccttgagctaaatacctaattggctgtataaattccccaaatggaattctttggcaccaaaaaaaaagaggaaggcagctaataaccactacagagcacaagacccgtctccataattaggccctgacggactcaggccagggcggcaccacctgcccagctgggcagcccagaagcagcagggccccagggagcccggtggctcagccacacatgctgcccacgcggcccgataaggccgacccgcccagcttgctcccgctgccagagcctcttccccacctctccaggaaacaaagccacctgcacgggtacccggcctgccttgcgtcctgccaggcccctggaaagcaaacatccctccaaggcctgggccagtggtgggctgcgtcaagctgttagccaagcgggcagtgaagacgaaggctgccccgtagccagggagctgacctctctgcgcaggtgccggggtacgagcaccagcagagccgagagcgggggcagtgctgaagcccctgctgccatccacaaaggggcctcagagggttggaaatgacaagccacggtcttgccccaccccggctcctggccatgctacccagccacacggcacagggcaaatgccagcaggacacaggccctcagcccggcatcatcgtcagcccgaggatgctgggccaggccaggtgccgactcagcagggcagcaagagggcctcactgctgagggtgaagccaagcccagcatggcgtgccccactccagccactccaccgccagggctgctttctgggaccactcccaggatgaatctcacagggaaggccacaggccaggtcggcaacaacatgcccccagcagagtggcccagacacaggagcaggctgggtgtctgagaatcatccttagaacacagagagaagtggacttggaaggatataaatcagaacggtaacattattttagtatttattatacattttctaaatgtttcataatagccatgtattgcttcttaattagagaaaatagtaagttagcatgaaaaccccccaaaaagagaagagatctggggaggaggagggaggttggtttccacactgctttcatcaggccagaggcaaacagaagtctccgcagacccaggtctgggcagcgctgcagtgcaggagggtggggtggggagggggtcccctccagaggagctgagtcttcactggcgcctgatgctgaatttgaggcccccaggggagcccctcagcgggagggccgtagcatgaggggctcctcctgcagctcccactcctgggccaagggcatggggcagtcccaccttaaggtcagagctgaactgacaagtgttccccggggctcccagggcaggccccagtgagagttcccctggcactgctgctgggggcatttccagcctaagacgggttcaaggcaaccccactccagtccagccactagaacgagactggactgtccaggtgctccagccccaccagcgtttccaatggtcaggagcaacggcgttgggtggttaggagaccagtgggatgccacatatctgtggggatgaggggcacggcactttgcactttgtgtcactgtggtgtccaagatggaattaaggtgacacccccgcctcctctcaacagatgttcaggacatgaagggccgtgacaggcagcacgtgcccactcagctggattccaggttcctttgtgggactcggcaccacctgtggacaacagggtgtgtttagggtccagggactttcacaccagaggaaaagtaatcctgacttctcttccctcccagtgaacactgaaaacaatcaaacgtcaaagtccgttttctcccaggtcatgcgtggggtagggatggtgtctccaatgacagataccaaaaccaacaattccaggtacatgtcaatcccacaactcaagctcaagaagcttccagaggaagcaagggctggcccaagggcaggtgagggtggtcggcccacagggccctcccggagcagcagcagatacaatcatgctatagttcagtttgctcgaagagtggagtgtcagccttggctcaggagtcaccaagagaggacgatgcacagattcccacaacagcaagacacacagcgcagtctgagtccaaacaaacaccaataggcagaagcaagacacacagcgcgggccgagtccaaacaaacaccaacaggcagaagcaagacacatagcgcgggccgagaccaaacaccaacaggcagaagtgaacccgtgaggcttaattcatagtcaggaacatttggaggagttcagcccttacttctttgccttagtgatttccaaactcatggatgccacttcagtgtggtaatggagccaggatgagtggagagcatgtcacacatcagtttcccgcagcccctgcactggtgacccttagttcattcacaatcgcataatcccttgtgattttcctggcaaacaggaacactaaacctctttttcttcctaaaatatttggtttacaaagttaagcaaaggcaaagctacaacacaaaacgttgctgtagtacagacgaatccaaggtggccacagcacagatgaacctggtgaggatgccgtggtgccacagactgggtgactcacacagaaacgtcctcatggtctggaggctggaagtctgggatgggggtgccagcacagtctgctctggtgatggcctccgcctggcttctcaccgcgtccttacatggaggagagaggactcttcctcttcttacgagagcactggtcccttcacggaagccctgccctcaagaccccatctaacccaatcaccgcccaaaggccacctatcccatcgtgggagccccaccctcacgggtgatctaactcaatcacggcccaaaggcctctcctcccagcaccatcccctgggggtttggccttctacacactgagttcaatgagacacattcagtccataaccgctgcctcagagaatgtcttcccacacacaaggacacatacacacacactggtgaaacacaactgagattcattcttgctttttttaacctcatagatataatagagaaatgcgcacaaaaacgcatcgtatagcaaacaatattaagtgaatattcatccaaacagcactcaagaaatagtcccgccagcagctggaacccccacccctgctgcaccttcatggggagccaccgccgacttgatggaagctgtgctcacggccgcgcctgcctctgcaccagattcacagggcctgtcgtctttcacaccttccttctttcactcagcttcatgtctgtgagatgatccgagtcgccccgtcatggctaaattccactgttccattgtatgaaaataaaataatcttcctctcctccaccaccaaagtgcatgtgggtcacgtccagcctggggagactgtaaacgatgccacctacgcgcttccttgcgcatctccctgaccaggcgtacgtgtgcttctgctgcgtggagggcaaggagcgaaacctcagccgcagcaaacacacctctccacattccagcacacctgcccacctgctgtccaagcccccgaggagctcagaggttgtgtatcacagccaggtgcttccaggaactccccgccccacgtcgcagctgcacctggagctggtgcttccggtttttgcccgtctagtaggggagctgctgaatttcatacggcttccgtcttcatcactccaatttaataattaggttgaagaccattttacgtatttctcagtcatttgaattttctccttagaacttctgaaatgttttgcaaatgtttccttcgttgccttgttctcagtgatttgtcagggtcctctctgttttgaacgtgagatctttgtcggttacatgtcatttacatgtgttgaaaatattgtctcccattctgtggcttgtcttttaattaattctctttacggtgtcttttttactaagagttattcttgattttaatatagttgaaattatcagtaatttcctttgcaattagcactctttgtgtcctgtctcaaaaccttcctctccgccctaaagtcatgaaacattatattctcagttgaaaacctttatagtcttgcctttcacacccatgagcacaggagttggtgtctccgaaagaaattcggtccaggttcatcttcttctaatatggattccagctgttctcatcttccttttttatttcaaaatgtcttgaggtccttctgtgtcagcccatctacctaactccgtcttgaagatgaaccacaacttgaagggtgtttagaacgctcgcggttttttcctatgataatgtttcacagaatcattgcgcatttggttctttacacccaggcctgaacatccatcacataacttcccaggagtcaggctggtgagttaaagttatgtgaattttaatttccttagatattgggctgtcttccttaaaaaaattaattccatcgcaaaattattaaaaattcccccacgttttcttccagtacttgtaaaattccattatatttttaagtctctgtgccatctggattttattttggggtaaggagtttgggagggacccagctatgtattttccaaatgtctggccagttgtccccaaatcattactgaataatacatcttttccccaccgatttaaaatgtcatcattatcatataccaaatacccatacgcatttgggtctatttctagactttctattctttcccttcaatctgcccgtctgttccccactctggcttaagtgtcccatcactgcaaagcactgagtgtgcaagactcaacgccccacacacaactttctttttcataacttttctgtttagtctcatgtttgtgtctgaacctggactttaaagctagttcgtttaatttcaaaaaaaattgttaatatgctgttgtgataacttacatgtataggtttattcagagagaattcatatccttacagaattaaaccttctcacccagaagcactgtctcccctgcccagcgggtcctccccatctcccagtggagaccatggacctgccgggttcaccgtcgccaggctcctcaaggccttccccattctccctggttcacccaggagctctgagcacgccacgcacctgcccctgcaaccttgtcccgggcggcctcctgccaccccaccgatttcccctcccactcacagactgtggcatctcaaggtgaccttgggctggagagccaggattccagcggacacctctgggcttggggggctcgataagacaggtggagtgagtgaggtcaggaggggatgaggagggagacacaaaggaaaggaagtgaccagaacctttgggaaacacaaagaaaaactatgcaagaagagaaagtcccaacaccacagttagaagtggcacatttggggcggctgttgcaggatgaagcaggagcatctcttggaactgcacaaagagtcttctcctccagagtaacacggggtcttactctgttgccccgtggctcaggggcacagagggccccactcggcttgtctgcaatcaacgctggtacagctgcaacacagggagcaccccgaggatccacccatcactgcagctgcagggctgggcatgatgcttttaacttgacagtgtgaaaactaaatgttggctaacacagcctggacgtaggggaattgaaagaggacagtcctcaccgtacggtgcagggggcaccacagggttggctaacacagcctggacataggggaattgaaagaggacagtcctcaccgtacggtgcagggggcaccacagggttggctaacacagcctggacgtaggggaattgaaagaggacagtcctcaccgtacggtgcagggggcaccacagggttggctaacacagcctggacgtaggggaattgaaagaggacagtcctcaccgtatggtgcagggggcaccacagggttggctaacacagcctggatgtaggggaattgaaagaggacagtcctcaccgtacggtgcagggggcaccacagggttggctaacacagcctggacataggggaattgaaagagaacagtcctcaccctacagtgcagggggcaccacaggggctacacagaggaggactgagtcaactcctgatgagatggtgtggaaccatatggaaaagtggcagctgccgcaggacctcaacgtgggagaggctactgttgcccctgggtgagctcaggaaagaggggcaggatctgttgcttcttattttaagccctatattactcggcttttaagtgaaccatatatatgcattactgtcacacaaattaactgaggaaaattgaaagcctcatgtctcctaagtactaagcattcaactgacatttgttgtgcactgaccatgtgcagggaaccgacggagacacttagaaactcagcaaagcagacaagtctcctcctatgaaactcacattctaggtggggacagacaagacacaatgcacacaatcaccgatgtcaggattggggacggttgctatggaggacagacaagacacacacaatcaccgatgtcaggactggggacggttgctatggaggacagacaagacacaacgcacacaatcaccgatgtcaggattggggatggttgctatggaggacagacaagacacaacgcacacaatcaccgatgtcaggattggggatggttgctatggaggacagacaagacacaacgcacacaatcaccgatgtcaggattggggatggttgctatggaggacagacaagacacaacgcacacaatcactgatgtgaggattggggatggttgctacagaggacagacaagacacaacgcacacaatcactgatgtgaggattggggacagttgttatggaggacagacaagacacaacacacacaatcactgatgtgaggattggggacggttgctacagaggacagacaagacacaacacacacaatcactgatgtgaggattggggacagttgttatggaggacagacaagacacaacacacacaatcactgatgtgaggattggggacggttgctacagaggacagacaagatacaacacacacaatcactgatgtgaggattggggacagttgttatggaggacagacaagacacaacacacacaatcactgatgtgaggattggggacggttgctacagaggacagacaagacacaacgcacacaatcaccaatgtcaggattggggatggttgctatggaggacagacaagacacaacacacacaatcactgatgtcaggattggggatggttgctatagacaaagaagagatgaagagggtgcaggcttgggggcaggttcagtgacagcagagtggagtgtggatcattgcaatgacgagagagcctcttttggccactctgttgacctcgaacatccccccaagcagactacacactgtcaatgtgttcaaaaacagagatgacggctgttgcatggaacagacatacacagcctcagcgaccccccgggggcccctcgaaatgtgtttgtcaggctgcctccacgcagcccacaggcatggagcaaacacacgctccacttgcttcatgatgccaagcacagaacccacttcaggaaaacccaagaaatggcccccatggacccccaatcccactacttcccaccctaaaaacaaaatgaacagaaacaccacacctccaggcagccagcacagtaagcttttcacttaagtttttattatagaaatgttcaaacatacacgaaagcagagaagataacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcatggacgccatcggccatggccacccatcgctctgcagagaagacaacggcatggacgccatcggccatggccacccattactctgcagagaacataacggcacagatgccatcggccacggccacccattgctctgcagagaacataacagcacggatgccatcggccatggccacccattgctctgcagagaacataacagcatggacgccattggccatggccacccatcgctctacaaagaagataacggcatggacgccatcggccacggccacccattgctctgcagagaacataacagcatggacgccatcagccacagccccccatcgctctgcagagaagacaacgacatggacgccatcggccacggccccccatcaatctgcggagaagacaacagccacccatcactcttcagagaagataacggcatggacgccatcagccacagccccccatcactctgcagagaacataatggcacggacgccattggcaatggccccccatcgctctgcagagaacgtaacggcacggatgccatcggccacggccccccattgctccacagagaagataatggcacggatgccatcagccacagccacccatcgctctgcagagaagataacagcatggacgccattggccacagccacccattgctctgcagagaacataacagcacggacgccatcggccacggccccccatcgctctgcagagaacataatggcacggacgccatcggcaatggccccccattgctctgcagagaacataacggcacggatgccatcggccatggccccccatcgctctgcggagaacataacggcacggatgccatcggccacggccccccattgctccgcagagaagataacggcacggacgccatcggccatggccacccatcactctgcagtggctcatgtttcactccatccgtctcccctgccacccctccctgttttccagggttgagggtggagtcagttagagaaaatctactacaccatattctgtgtatctctagcaaatgaggacttatctcattttattttatttaggggagacggggtcttactctgttgcccaggctggacggcggtgacacaatcacgactcactgcagcctccacctcctgggctcaatgattcccccgcctccatctcccacagcaccaggatcaccacaactcacccacatgagggctttaaaaaatgtcatcacaaacccagtatcacaccagcaacattagttaacagcaactggtctttaataatgttctagtatccggtcagtgctaaattccattaattaaaaaaaaagtcatcttgtagttaatttgtttgaattaatatccaaggagggtccatcatacgtctacacagcaatggcgcacgcagggtggattcagtgtttgtggtttgctatgaatctgatgagccaccaagaatccaggctgagtcttctgacccctttcctgatgcttatttcctgaaagcgtccttatctgtttgcacagtatccacgctctgcattcctcctaactccaatgaacatccccagaatccccaatgagaagaaaccgtgtccctcccagggctcctcagcatctcgggtgcaatgtctctggacacttccagcgggcaggtgtctaccctggccttgataagcagacaccactagccctgaaagcaaaggtgctacctcggcctgcgggaccacagcggatgcgcggccccagtcagcacacggtgaggggcgttaccaccaaacctccctctccagggcgagcctggcctggggggagtcacagtaaagccaccgtcaaaactccttccaagttcattagcaaaggtgctacctcggcctgcgggaccacagcggatgcgcggccccagtcagcacacggtgaggggcgttaacaccaaaactcccgctccagggcgagcctggcctggggggagtcacagtaaagccaccgtcaaaactccttccaagttcattagcaaaggtgctacctcggcctgcgggaacacagcggatgcgcggccccagtcagcgcacggtgaggggcgttaacaccagacctccccctccagggcgagcctggcctggggagagtcgcagtaaagccaccgtcaaaactccttccaagttcattatttacaccctgagtgttctcagcagggccaaaacttcacacctctgactgaattttcatccatttggaagggttccgggtctcctgggagttttagaaattgggagtgagaagacgtggttgaaaactgaggtgaaagctctaagagaaagttaatttggtgtctcctgggcacttcacagctctgcagtgcccagggttccattatgcgtccctcagtgtgaaacacagcaaaccttattaaatacccttctagcaaaatcccccatcctccgagcttggcctgtgctccgcttcctcctttcctgccccagacgccacagcaaacgttatttccccgacatctggtggttttcaaaggacaatgctcagaccagtgcaccaggaagtgggccgggcgagtgatctgcagtccatcgggatgtccaggagatgctgacacaggctgagaagctcggcccccagctcccaaagcttaccacggccacctgggggaaaagctgccatgtcttagaaatattgacactggcctcattccctgaattctgatttgtcaagaggtgtggcctgaccacccggatcttttaaagctcccccggtttttaaaagctctaatagtcagcaaaatgcaaaaccacgcccccacccaacagccccatgatgtcccacgaagtcgaccgccggagccctgacaccagcatcaccctctcgtgcggtctcccaacagccctgcagagccagaaccatgatcgtccccactgcacacctcggagagctgaaagttgcacagttatttactgagtagatttgggattcaaatccaaatcctactgtgaagccggtacccccataacaccaggctgggcgggctccacgctgcctaagagcagagactctgcctcatttccccttctagtcccagcaacaagcacagagtgagacctcagcacactaaccgtggacacacctttgatcccagggccccctgaggactgcgtgatcttcagaggtgcaccctccacgcagcacaggccagacaagggaaactgcagggagcactggcaaaggacacatgtggggaagacacgagaggcaggagacggcaacatctgtgggggcacaggagagagaggacagggtgccgcggccatcacagggtgacaccggagccttggtgtggctgccctgggctggacttgctgcacacacagggccacgaggactttgggaccacacgtgctgatgtctccactgtccagaggaagacaccaaggcttgaggctgtggctccaagtgcacacagttgcacaagcacacatgcatgctgcaccacaacacccagatgagaatccagagcccccactgcctgggatgaatgggctccagaatccagagcccccactgcctgggatgaatgggctccagaatccagagcacccgcctgggacgaacaggctccagaatccagaggccccgcttgggacgaacgggctccagaatccagagccctcgcctgggacgaacgggatccagaatccagagcccctgcctgggacgaacgggctccaggggcccgcaaaaggacgtcggctctgcaccacccctacctattactctatactgagccgcaaacccatgcacgcctcagtccaaatgtcatagcttctctttctcccactaccctgagggccacacacacatgactcggagaaaggccacagcctgtgtgtcacaggatctccctaaatgtccagtggcccctgtccagccgctgtggctgcccacatcatggtgctgggccctgccgtttctccatcatagaaccaccaagaggcaaccgagaaacccaggagcatggcaacatccacagtctccaggatggggccctatctacatgctcctcctagaggggctgtgtaccgtgagcacaggagggtcatccagctacaggatgggactctatctacaagttcctgctagagggtctgtgtgccgagagcacaggagggtcatccagctacaggatgggactctatctacaagttcctgctacagtgcctgtgtgccgtcagcacaggagggtcatccagctgcaggatgggactctatctacatgctcctcctagaggggctgtgtgccgtgagcacaggagggtcatccagctgcaggatgggactctatctacaagttcctgctacagtgcctgtgtgccgtcagcacaggagggtcatccagctgcaggatgggactctatctacatgctcctcctagaggggctgtgtgccgtgagcacaggagggtcatccagctgcaggatgggactctatctacaagttcctgctacagtgcctgtgtgccgtcagcacaggagggtcatccagctgcagaatgggactctatctacaagttcctgctacagggtctgtgtgccaagagcacaggagggtcattcaactgtaggatcggactctatctacatgttcctgctacaggggctgtgtgccatgagcacaggagggtcatccagctacaggatgggactctatctacaagttcctgctagagggtctgtgtgccaagaccacaggagggtcatccagctgcagaatgggactctatctacatgctcctcctacgggggctgtgtgccgagaccacaggagggtcatccagctccaggatgggactctatctacatgttcctgctacgggggctgtgtgccgtcagcacaggagggtcatccagctgtccggaaatgaaaactcacagtcaccaagcatacgcagtgccatctgatgagaattcatctgctctgtcctgcacggtcccatgggaaagtcaagccatggccccagctcccttcctcaaccatcgttcatgatcgagcttattctgatgttgatgcaagaaatgttccacccacctttggctggcaaagcctgcctagaaatatacaagaacagatagtagttccagtaaagcacagagtacctcaaaatagaagacattacagagagaaacgtgtgcacgctggcagctagctgaaaagtcagctgatccacataaagttggttaggaaaaatcttctagagatgcagaccatcattgcacaaactacaacatcctcaaacccaagacacactgcagagaaataacagctcttcctttctactatggaggattctgcccgacagtcatgtggcttcacttaagatcagaagtgacctggtcaagaagcatagaagaaacctcaaatttccaaattcccagtctttcatttttttcttggttctatgaacaataaaatcttacagcataaaggccgggcgcggtggctcatgcctgtaatcccagcactttgggaggccgaagggggtggatcacgaggtcaagagatcaagaccatcctggctaacacagtgaaaccccgtctctactaaaaatacaaaaaaattaaccgggcgtggtggcaggcgcctgtagtcccagctactcgggaggctgaggcaggagaatggcataaacccgggaggcagagcttgcagtgagctgagatggtgccactgcactccagcctgggcaacagagcgagactccgtctcaaaaaaaaaaaaaaatcttacagcataaaaactgaagcatacagaaaatggtgaaaaaaaatatcattctaggtgcattttcttccagtgttttccaaagcataattacgtactttttccaaagcactcaaattcattctgtagcctcggggctgtctcctgccactcccactgggtactacacgcgagcatttcccggaaccatggaaagagcctcttggccacctgctgtagaggctgactgcactgttccctgctatgcttggtcatatgggttgttttaaagtttttcaacattataaataaagctgtaacaaacgtgctttcaattatttttcacccacattttaaaaacacgtctttagtgtgggttcctacagtctgagttactgagcctaaagacactggcatatttgtgacttccaaggaaacaacccatactcaccccatggcagagaatccctgccttgctgcaggagccggcgcttgggtgaacgcctcccgtccttggatagaaccgcctgggtgcttcggttcgtacttctccttccatgctttcagaccccctgtgcttccgcccacgccctgtgctgctctgctttctaggtccacacaccagggcccctctctgggaccatcttgccccaggctttgatcccaacactcgccctatatctccaaataaaaataaattgttgggttctttctggaggagtttgggtgagcttgtttatcccaggatgtcacttctcaaaggcagtgcagatcctcatacagcgggctgatgctcctgaccacctccctcccagcaggcccataaagaccctcagacgccatgcaccggaggcccctgtggcttctactatctggcatttgtctggtgtgctggcatcatctataccacacccggcctctgtcacaccttctgctctcacatgatgcgataccgtacttgcatttgacagaaaacacacagagtcctagagatgatatgtgaaaattaaggggtgcctggtcctgtctcggccatgaaaatggtggtagagaaagagggaacacctgcctgttagctttcctgaggatgacaagtcatttactgccttaaaactaagacaaaaaggagtggttcctcaatgaattcctctcccctccttccaccctgagacgtgtcatatagctgcctcaggccctgtgtttctcacgtaaaacctgtgctgatgacaggttcattttcaaacacaggaaggatgtccagctcacagtccgcaaaactacaagctaagctgcctacgattgtgtggggatccaggaaaacagaggatgagttgaaggttgggacacagaccccttcaggcaaatccacacacagctcagttttattgaagaaaatcaataacataaattatttcaaatagcagtgcaacaacttgggggttacatttattttattcagcacgaataactggttctattcccttgtgctcattttagcagtgatgatttgaactcagatcattagtttcatgtttccccagcctggctgcacattacagtcaactgtactaaaaccataaaccccaaagccccagatgggagatgccgacttggtcagtctggtataggatctggatctgtgtacttttataagcttcctacatggttctagtcatttgggcaacaccaggtagaccaagcccctcaatatgcaagtacagaactggagggccaaaagggcaggtgagcccatcatcccctaactccatcttttctcatttctgtcccccaccccaaatcatcaccattgtcaccatcatcatcattactatcatcaccatcaccatcagcatcattactatcatcaccatcaccatcagcatctcatcatcattatcattaccatcacgaccatcattgttgtcatcatcaccatcaccatcattgtcatcaccatcatgttgtcattatcattaccaccatcatcaccatcatcattaccattaccatcaccaccatcatcaccatcattgtcatcaccatatcatcatcattgttatcaccatcctcattgtcatcatcattgttgtcaatatcaccgtcaccatcatcattgttatcaccatcattgttatcatcaacaccatcatcatcatcaccatcatcgtcatcaccatatcatcactatcttcaccatcatcatcaccatcatcatccttaccatcgccatcattgccatgccatttagtaaacaatcacttcatcatcaccgtcatcatccttaccatcgccatcattgccatgccatttaataaataatccttcatcatcaccatcatcatccttaccatcaccatcattgccatgccatttagtaagtaatcacttcatcatcaccgtcatcatccttaccatcgccatcattgccatgccatttagtaagtaatcacttcatcatcaccgtcatcatccttaccatcgccatcattgccatgccatttagtaaataatccttcatcatcaccatcatcatccttaccatcgccatcattgccatgccatttagtaaataatccttcatcaccaccgtcatcatccttaccatcgccatcattgccatgccatttagtaaataatccttcatcaccaccgtcatcatccttaccatcaccatcattgccatgccatttagtaaataatccttcatcatcaccatcatcatccttaccatcgccatcattgccatgccatttagtaaataatccttcatcatcaccatcatcatccttaccatcgccatcattgccatgccatttagtaaataatccttcatcaccaccgtcatcatccttaccatcgccatcattgccatgccatttagtaaataatccttcatcatcaccatcatcatccttaccatcgccatcattgccatgccatttagtaaataatccttcatcaccaccgtcatcatccttaccatcgccatcattgccatgccatttaataaataatccttcatcatcaccatcatcatccttaccatcgccatcattgccatgccatttagtaagtaatcacttcatcatcaccgtcatcatccataccgtcaccatcattgccatgccatttagtaaacaatcacttcatcgtcaccatcatcatccttaccatcaccatcattgccatgccatttagtaaataatccttcatcaccaccgtcatcatccttaccatcgccatcattgccatgccatttagtaaataatccttcatcatcaccatcatcatccttaccatcgccatcattggcatgccatttagtaaacaatcacttcatcatcaccatcatcatccttaccatcgctatcattgccatgccaatgagtaaatatcaccagtgccagattctgtgctacacccttatgctcattatcattgaccttcagatcaatgtattatccccattttagagataagggagttgaagttcagaaaggctaagtaattttcttaggataacacagctagttacagaggctatggtgttcttatcgcagactggagctaagctgctgagatacaagtccagattccagcaccaatcagctgtgtggctgtggacatttcctaaagcatgctgggcctcctctcctgggccttgtatgtggagatactaagagtgcccatcttgcagagtttgtgcgaagtgacactctggtggctctccagccttcaaatccagtcctatcaagatccatcatgattactcccccagagactgtcttgattctcccactggatgtctcttctttcccaccccgtgacccctttgaattcttaaaatgctttcttggttcttcattcataccacaccccttactcccttactgtatctcctgtacacatcatttatttaccactttatccctgcagtagacagaagctcatgagggcattttttcattatgataactgttttcactaacattcctgagcatctaatctatgccatctaatctttagtagatactgtactaaatattttatttgcagtatcacattaaatcttactacaaagaaggcattattgctatgcttactttagagacaagcaaactgaggcttagaaagagtcagtacttggaagcactgaaaggctcagctctcacagtccaagtaccagctgtttaaccactgcacagtttatatccttcccaagacactgccctgaatgcattgatccaggggcctccagtggatgcttgggaaaagccagctacctgccacatgtgtgctggacttgggctgggcaaaaacaaacctggtctctgatcacgtaagcctagaacccagaaagccagcagttatgggtgcagtcatgtgggctaagctactttgcctggggacccgcagtcacacgtgctgagcagctttacatactttcaggccttgaacccagatccctgcctcacgcctcacacaccccacttcctgttgcatgatgcatccatgcagtaataaaatggacatccttaaagcagataacaaaatccaactcatcattttgtaaaatttttggatgtacatttgaggcgtgcaacatgatgttggatacatacatgcatactgaggtggccactgtggtcaagagttaacacctctgcctccaccctctcctagaggcaccctctgggcaaattaccagtaaacaatccaatgttgttactacatacagtcctcacgctgtgcattaggcccctgggctcactcctcccacaaaactgcagcttcctaccctctcatccacatcttctcattcctcgccactcccaccccccaaaccataaccagctttccactctctgtttctatgtagtcaacttttttttttaagattctacatatgtgtgagatcatgcagtatctgcctttctgtgcctggcttatttcacttacttcacactatttacaacatcatgtcctccaggttcatccatgttttgaaaatgacaggatctccttttttaaggctgaatagtatccattgtgtatgtataccacaattgctctatccattcatccatcagaaacacctgtactgtctccatgccctggtgaatagtgctgcaatgagcatcagggtgcagacacctcttctgcccatttaatttcttctggatctataaccaaaagaggcgttgatggtagcactgtttttaatttcttgaggaacctacacactgtttccataaacagtgtgcaagttggccaggtgcagtggctcacgcctgtaatcccagaattttgggaggctgaggcgggtggatcacttgaggtcaggagctcaagaccagcctggccaacacggtgaaaccccatctctactaaaaatataaaaattagctaggcatggtggcacatgtctgtaatcccagctactcgggaggctgaggcaggagaatcacttgaacccaggaggcagaggttgcagtgagctgagatcgtgccactgtaggacagagcgagactgtctcaaacaaagcatccaagtgtcccttttctctacacacttgccaacacttgttatcttctgtctttttgataaaagccattctcacaggtgtgagagggtaagtcactggggctctgatgtgcgtttccaatgattagtgatgctcagcacctttcccatacctgtcagccatctgtatgtcctctttggaaaaatgttctattcaggttctttgccctttttaaaattggagggtttgggggttttttggcttttgggttttttttgtgtgttgtttgtttgtttgttttgctattgagttgagtgagttccttatatattttagatattaacaccttatagatctatggtttttcaacattttctcccgccctgtaggctgccttttcattttgatggtttcctttaccgcacggcagcttttcagtttgatatagtcccactcatttattttgcttttgttgcctgtgtttttgggtcttgtccaaaacttcttgccgagaccaatgtcaaggagctcttcctgtatgttttcagagttttacagtttcagatcttgtgtttgggtctttaaccaattttgggcagatttttgagaacggtgtaaggtaaggtcccatttcattcttttgagtgtggatgtccagtttccccgaaaccatttaaagagacggctcttaccccagagtctgcttcacacctagttgaccatatatggtcaggtttatttctgggctctttgttctgttcccatctcatccttttacatggcgtgtgtttaagtcactggccaaaacttgggtaattctgctgccaaagacctgggagcccccggggaaggccctgttgatgtttctgttgctgttgcgtttgttacactgtggcaagctgttcaaattcttgctttcaccgccacccatttaccctgtgctactttacagtagctagtctaggatgcaactggaattgtggggctcaagtgaaacaatgtgcataaaatctcccgtaaattataactcacactgcatgtataagcaaaaattgtggcatttttacagtcttcctacatcttcagctaatagccttaataacaaaacacagaatattgtcactcaattagactagggttatttacctaagacaattttgcattgcaatttgcaaattcttaaatggcaaattagtcatttgcattgatttgcatgtccacagagaaatatctttcatgctaattatgtttttgctaacaaaccatagaagtaataatgaggaaactgaattccctcaccgcacctttggctttgttacacaaagcacagctggcgtttcagggtgggagggtttcatcaggatcgtcttgcccagagatcctcaactctgatagcacattacagtcacctcgggaagcttcagagaaaaagaaaggacggcaaagcctgggtcccgcccccaccccgcccctcgccgccctcagctgacattctgattcactggcgccagtttatgtctgggcatcactatttttcaaagcttccaggtgtttccaggtgttaccaccggcatggctgacccccttgttttgcacgtaagaaatccaacgtgcacagagctgtggcttgaatagagaggggtgcgcagggtggtggcagggcaagacaagcccaagcttcctgactgatgcccagtcccctatgcttgtcccacaaagatcgagactctattgtgcatacaggcatgcacaccccccacccacacacactcccggtggagcaacagcgtgcacacccacgcacactcccgatcaacaatgtgcacacccacacactcccaatcgatcaagagtatgcacacccacacacactcctggtcaatcaacagtgtgcacacccaggcacactcctggtggatcaacagtaggcacacccacacacactccgggtggatcaacactatgcacacccatgcacactcccggtggatcaacactatgcacacccacacacactccgggtggatcaacactatgcacacccacacacactcctggtggatcaacactatgcacacccatgcacactcctggtggatcaacagtgtcaggctttcagactgaggaaaggaaaacactgtttttggctgtgcacagtggctcacacctgtaaccccagcacttagggaggccaaggcaggtggatcatttgaggtcaggagtttgagaccagcctggccaacatggtgaaatcctgtctctactaaaatacaaaaatgagccagtggtggtggcaggcacttgtaatcccagctactcaggaagctgagggagcagaatcgtttgaaccccaggagggggaggttgcagtgagccaagatagcaccactgcactccagcctgggcaacagagggagaccatctcccctgtctcaacaacaacaacaacaacactagtccacaatgaacacaccaaaaaaatgtgtaaagtgtgggtctagttcttttgcatctttttaaagaaagaagaagcaaaatcccaattgttgagtcatcttcccctgtggtcagcagcttgcccagctccaccgagcactcgctcgagagcgtttctgttccttgaaaacaaatgagaacgacaacagcaagatgctcctcaatcattaaaaacaccaaagagcatctgttcgtgccccagcaagtgagagagaaaacctggccaaaaaaaaaaaaaaaaaaatgcaaagaattgggagctgggatttgttctagtgccatcataaaagaattgggagctgggatctgtcctattgcatcacaatgggctgtcgccataacaggagctgggatttgtcctagtgcatcataaaagaattgggagctgggatttgtcctattgcatcataacgggctgttgccataacaggagctgggatttgtcctagtgcatcataaaagaattgggagctggaatttgtcctagtgcctcataaaagaattgggagctgggatttgtcctagtgcctcataaaagaattgggagctgggatctgtcctagtgcatcacaacgggctgccatcataacagggcctgacatggtggaaaatcgtcaagtagaaataaaagaatctcatttggacatagtttataagcaaatatggttatagcattttatttcaacaactggggaaaaaaacataaaatttattctgttttgcagaaaaactaaggccgaccaataggatttgactgttagagagacaacaatacattttcctagtgacttgtgggataaaccgcttgttgcttgtttttattttttacatttctgcatctttccagaatctcaagtaccctggatttgacggaacttctcccggtgggtgctcaacacagcgctgccttctcctctaagagctcagctcctgaaaaggttcacgcgaggatgctcacagcagccaaatgctgggaacaacctgtgtgggtacaagcaagacgtggtgtgtccctcgacggagcacgactcagcgacaacaggagcaaagggtgggggtaggaaggtagcgttgcgtcaccccgaccggctgctcagtcagttcccaatctagctccttgttgtaccctttccgccttctctctactgcacttgaccagtcttcaaaaaattaaaaaggaacaaatgtatacagtgggaggtgaggcaagagggggtcggagcattcaccgaggtggagaacaggctcagtacatcttcccgctcatgttacagtgaaatgcgtgaccttaggtgtgtgtttccgtgagattttatagatcacatggattttttttttttttagatgaggtcttgctctgtcacccaggctggagtgcggtggtgagatctcagctcactgcaaactctgcctccaaggttcaagcgattctcctgcctcaacctcccaagtagctgggattacgtgcgtgcaccaccatgcccgactaattctgtatttttatatttttagtggagacagggtttcaccatatttttagtggagacggggtttcaccatgtcaaaggttttttttgttttgttttcataaattgcactcctgtccaacctcacagtgctcttttaattggtgagaagctgagcaaagcttcctcctctctgaaggacaataggaaaaggccagcacgagaggccagcacaagagggtggggctcttctttggaggcaaagccagcctctcctgagccagctcccctcccgcctccccctcctatggaccacgcccactggacttaccaagggatcttcaacagggtctcacccacacacagcactgctggtctccagtctctgggatttcttctaattctgaggacaagtttaaaaccttactaatggctgggcgcagtggctcacacctgtaatcccagcactttgggaggccgacgcgggtggatcacaaggtcaggagatcgagaccaacctggccaacatggtgaaaccctgtctctactaaaaatacaaaaattagctgggtgtggtggcaggtgcctgtagtcccagctactagggaggctgaggcaggagaatcgcttgaacccgggagtcagaagttgtggcgagctgagattgcgccactgcactccagcctgggggacagagcgagactccgtctcaaaaaaacaaaaacaaacaaacaaaaaaaaaaccttactaacaaaattgatttcaagctaaatgaataaagaaaaggaaaactctctacaaatcatttctctgatttctgaattgaaaagcaaccaagaagactctgacaattggcgggcgccccggccccagggcccctctcaggctgggtgcgtgtctgttgcccgttctgtcggctgagaccactgtcagggcaaagagaagacatgggacagccaggaaatgtggcccacctgactccaatcatgcttccggccccgccacggttccggccccgccacggttccggcctcgccacggttcctgccccaccacggttccattcccaccacggttcctgcaggcatttcatgtaatgcaattattcttccctgcaacattcatctgaccaatacgtgaccatttcctctcttttgccagcatcatagagagttcacaagagacaaatcaaagtcaccgtgggtcccagtagcaaatctagaacctgcatcttaaggcaaagaacgatgaaccaccataaattccgtgggcctttgagaagccgaagggtgagctgattggaggaaggatgggaagacgcccgatcagtgtggttccagatcagattctgcctgtgtgtcacccacatttaacactaagggaccaagtttgtcatctgttaaatgagaacaaaaatacatgccctgttattgtcagtgacggtgcagaaatctaacacgataacatataaaacactcagaaaggcattaacccccatgcagtgcactattattactttacgccatttcagtcacaagagcaggtgctgggtgttattccagctcaagaatatctcaaagcacccaggcctggaatagagagagcaggttccaaagcagccccaggctaagctttgcacacagactcagaccatgaacatcacccatcagttagagggaaatcactcacccttcaatgcactcttaacacagaccccacctctatggaaactgcctcaaaagacagagcagaccaacgtcccaagaatgattagacggcgcctctaaaataacaaggccgttgcatgcaagggcccgagagctggccgtccacatttcctcccaactccaccttcagtgacactgcgtcagtaactgggaggcagcagtggcggcggggcgggggccttacactagagaacccggctgcaaatcaggtcccaaatgctgcaaatgctggtggttaagcatttgcccacactgcactgctgagccactgagattaggcctgaaattagttatgggttttacccacgcaccgaaagacatgtgtttgttgtatgcataatctttagaatccacgtttggttcgatatttctgctttaatgataaaaggttttgtgcttttcaaaatggtatggccacgcacagacattatccctccaaactcctggtcgtggctgaacctcagcagcttcacggtccccaagatcaatttcctatctcctccaatcctgttagcaaatgaaccaaaattaaatcaggatttggcagatttctctaaacactgcagccactcagagtcctgctaaggagaaagagcagctgtaaacatatgtgagaacccttgaagctcttcctgccataagcacacttccgttctctgaataaacccctctgacgagctgtttcgggaggctacatccacgcccaggacagccgggagggcaagctgcagcctctgcacggcctctgctgtgtctgtgcaccctgattgagaagcctgcgtatcagagacctccaagtgccggctcgcctctccctcgtccataatttagtgacaatctccatggcaactagactccaagaaaagagaaggaaaggtttcccggctctctgagcagcgggtgcttcgtaaactgcaaaaacacattccccaaacatggtgtcccaaggacactgtcagcctcagaaaatctagagtgatctgaaatgagctcattcaaacttgacctcagctttgaaaaccacacagccatccaactgtctaacagtcaaccatgatagattggggggaaaaaaacattttaaacattaatttttaaaaaaaggttggctataaatagcttaaaaaccaaatgttttaagtatttaaaagaaaataaattgggaagcgaaaactactccagtataaatctcagatattaacattccttggggctgatatctaatttacttaatgtctttcacacaggcccatgacaacccttcatggtaaaagcaaaaaaaaaatccctttctcctacgtcagtgacatttctaggtagacatcaagatctcgcgcttaggagaccaaaagcaaaagcaggctataagcaaatgaggtcagccctggcgctgggcgggtgcagcactggcccagcccccgtgcggccccactgtgtcccctcacagctggtcatcagccacagctaagccaggccaacccaagaggcacagcgaactctacaggactccacattcaaaacttgctccttcatcaaaaagcggagtaaaccgggagattcagccatgggaaggccttggaccccaggacctctggaaaacactgcgtgtaactggcaccccgagtcaacttttccctgagaaatgctcaaccccatttagtttttggacatgcctctggaaatatgaaaatgagtttcatctactaaacaattccttatcctctcaaatctctgaaatttaagggtttagaaagttaatttgataaatgggaaagtcaacccagcagataaaagggaaaacggtctttcaagagcatcttagtaaatgctgcaggttgcacagagcatgcccatgtgcccgcccaaactacgggccacctccaccagagtcaaccgcccagcagaatgtgggcacccctcctccgagagggaccctcttcccaaggtcagctaagaggcgggtgcccgtctgagagggacccttttcccaaggtcagctaagaggcgggtgcccatctgagagggaccctcttcccaaggtcggctaagaggcgggtgaccgtctgaccactgagggagtcgggagtggggctgcccatggctttggggaagcactcgctgttcagcgggagagaagtcaaagagagaggccgggtgatgccacggggtgccctgtgggactgtgcacactgcgttctgcagacatgggcatcctggacagctgaaaacagggcaatgatgcaaactggcatttgcgcctcctggtgccccacggagacaggccctgaggagcctggtggtcctcgttcagctccagggcagatgctggcgagggaggaaggtgatcataagaaccccggctgcagcacagtctccaaccttctcatgcagaagagctgggggtgcttgggaggcaccagtttccctgacgccacggtggcaggcgggagggctcaggacccgaaaagcaacaagctcccagaggagcagcctgtggatgccaccaacgagcacagttctggggaggccccgaagggccccgaggactccccggcttcccctgtctagggaggccccgaagggccctgaggactccccagctccccctgtctggggccagatgctgctcttcctcctgcgagtgggaacagcttcagcacctgttctagttcccttgattcaggcacccccggccactctcccagcgagaccatgaagatgaggatgctggagaaaggtgaccttgtgcacgcttcgcccctgcttaacaagccagccgtgcaccagggacaatcaccaaggacgggcccactcagcagaggaacccccagcaaaacaccctcgggagggcacgcccgcctccacccccagctgacacccacaccccagccgggcactccaataccttctcggggtttttaggacatgcccctgctgggctcactctccagcttccttgaatcctacctcccctctcaggcctgtggggtcaagcagctattctaactactgtgaaattgaacttccaagccaaggcacacacacacctggagaccgtcttggttaacgggtaatttattctcttagtggggattccagtccagtctacataagcatcattaaggcagtctcacggggaagaagtttgggagtcagatattagaacttcattgtgcagaaacacaaaacccagagttctttccttaaagtcctgacttgagggaagacttgaaaatccagggctgcacatctgggctcggaaacctgcatatcatacttactacgatttgtgttcctcccgccatttgtttgttggtttgtttttgagacagagtctggctctgttgcccaggctggagtgcaaaggcttaatcactgcaacctcctcttcctgggctcaagtgatcctcccacctcagcctcccgagtagctgagaccacaggcacatgccaccacacctggctgatttttgtactttttgtagagaaggggtttcaccatgttgccaggctggtcttgaactcctgagctcaagcaattcgcctgccttggcctcccacagtgctgggattacaggcgtgagccactgcacccagtcccactgttaatttagaaccagacacatcgtttctccactatttatgactttagttacaaagccacaccagatagcaccaaattcaaatcatatcaatgacgccgatgcgcacagctgtcccaacacaagacagcagggccatccgttgccagcacatgaatgactgtaagtcaccaacaactgccagccaaggacgcacgaaggatcagcctgtgtctccgtgaaaattcacagcacagacgccgctcgggagggagaggagagagaggggccccagcaggcaccctcaccctgtctgtgccgccaaggggcctgagagtgtgaccctgacaccgagtcaatctgcttctccgcctgaggctgccaggcagcctggaggctggaaaaaaaatgtaaaacatgttcctctaaaacgagggcgtccttagcggggatgctataaatacgcccaagtaagaagagacgcgagaacgtcaatctggttctgttcctcccgcttctccttcctcccagcaaacttctgaggagagaaaagtctggaaagtttgaggagcgaaccgcatcttcagagccattgggtggggtcacatgcatacatctgagctcacatgtgtgtgagacccaaactgagctgaactgattttaactcacctcaagtcactaatctgaagtctcaatatcacgtcactttttctgttaatacaccaaataaggctgagcttcacatagttcaattcagtcattcgtttccatctccttttaggttttattcattggaatttgggagtgcaatgagactgccagtcacacggagtgatgcggtctcgtgtctcacagctgtgggtcttcccgttgcctcagcccctctgagaggatgaaggggcggggccctgcccacaaggtggctgggacatcttagatggtccggttcattactaaccaataatgcaaagatggttagaccatttcagggccctggctgctagattttcttcattaagcacatatcatgcagtcctgtctgacattttaacacgcacagaaaacagggcacacagcaaacaggaaatgtctgttacctccgagtgggagtgagatttggtgaagggacacaaaaggaatttttactttttattctagatagttccaaactgttcattttgaatatatccatatacgtataattcattttttaattgattttaattgacacacctgaaagagaaaagtgggtaatactgtaatggccaacatcttcccttttcataaaatcagactttgctgccatcatccactattaaaataataccgaagtgggtcaagagaggcaaccgagaatttgattttaaagaatgtgctgaattttctattaaagcaaaaaactctttgacaccccaatagtgtatgcttcctgtaagttcaagaaatccatgtctatttccaaggcagcatcacccacccctcaccccaggttttcagcctggcctgggatgtggataggccccctgctgcctttctggaaaaagcaactgaaagctcagccaagccacggccaggttgctcttttcagcccccatggggaccaagctgccccaacaggcaggaagcacaggcggtgtccacaactctgcctccacacatccacccttggccaggaaagagggaggcacctgaagacagagaaggggagagagcgctggtcagcggagcagggacaggaccgagagcctgtggggcaggaaaccgagtgggaagagccaaggggtggtaggcaggccatgctgcagagtcaccacggagcgtgggacaggcacggcggcaaagagagtgggctgagtgggtcatcacacagcacgggagccgcggccccaggtgctgcttgaatgaagaaggctcagcccatgactgctacgtctggtccccaggacccaaactgtccagaaatcagccagcactcctgcaggtgcactgcagtggacggctagaggagggaaagcagcgccgtacagacactcggaaaactgcagactggaaggggcgtgaaagcacaaggtcttgatcattctcctggcattcggtgctgtgcgtagggtgagcaatggacgccactggggaagagtgggaaaggaaggctcagcacgtcggtaacgaatgaggaggcagaggcccgctctgcgtctcaaagaacgggtgggatgcggagccgtgacaagggcatgggaaagaaagtggagtgggaataacgccaaaattaacctgataaggaagctgctttcaacgcatccctgagctggacccacatggagaaggaccacacaccccaaggctgcccttcagttttgacttgattctgtgggaaagagggagccactgaaggtttcatatcaggatgactgtggggggcagacgagaaacacaacttataaaagtgggctctgacttgtgtacacgccgtacagagatgtaattcagtggctgtttaattagcaacttgtgtggcagacacgttcatattctcaatgacaaggagctcctacacagtccaagaaaaagacaaaactcagtgggaatggggcaaagatgggagcagtaacttacagaagcagaggtgaaagtggccccacaggacatgaaaacacgtgtcaccgcgacagtcactggggaaacacacatctaacaatacccacattgttgggggcagtggctcccgtgtttctcagctgtggacatgccacaggacaggacccacgagtgagtgtttcgggggcagaagaggtaaagaacagaggccggagatgcagacagaccgaggtgcaaagtggctgcctgagagctgcggcctagaacaagtcaccgaactcttctgaattccaatttcctcaccctaaggctgtgaatggggctcatgttactcaatgtgagtggggcggcgtggcacaggaggtactcagcctggactttctgtgagcgctcaatacaaaacagcctggacgttgctgcaagcggcctggagctcccgaatggtgacccactcgccgacagcctccctccctctctcctccgctcttctttcctgactaaagccttcttgaagtctggaggaagcagagtgaacgcttccgttggatgagctcagaactttttttcctctccattttcatgattagcaatcacaggctgcgtctgccagctcctgctgtgatctgggggacacccagagtgcagcagcaactctgagacgcagagctgttctgttttatggaactggcaaaaaatagaataataacttttgacacctgggaggctgcggaaaagcacaatgggtttgaaaaacagatgaggtagcaactgagagatctacgctctgtgaatcacaaaccactcagagagcctggaaatgctgaggccacatggcggagagaccaggtcctggctgctgcctgtgggggtgggcagaatgagccttgcattcccggaccctccagtgcccgaaggctgattctcggagagctcacagggtactacggggtggcgggcgcaagccagctctgcggcgcagtgggcgtcatcctcgctgctgtgggagcgggggctcctgctctggagatcgactgctgtttgggtaatgacagcagcaccatgcaacaactgagccactggttctctacttggcaggaatttcccaattgggattctagattccaagaaggtagggtctggcaactgtttctgcagcacaaattgaattcactgcttgatcaaacctaaataaagagtctgaggagcacgaccttcctaggagcacgttccagctttgttccacgtcgcgggggttgcgtctcaccctgaagccttgtggcaaccctatggaggagtccatcggcaccattttcccagcagcacgtgctcatcgcctgtctctgtgctaccttttggtaatttccacagtgttggatccctgagctgtgatccgtgatctttggtgttactgtcattgttttggggcaccatgaaccgtgcccatagaagacagtgagcataactgatcaatgctgtgtgtgttctgactgcgtaactgaccagccattctcccatctcgctccctctcctccagcctccctattccctgagacacaacaatattgaaattaggctaattagcaaccctacagtggcctctaagtgttcatgtgaaagaaagagccgcacctctctcactttaaatcagaagctagaaatgattaaacttagtgaggaagccatgccgaaagccaagaataggccaaaaatgaggcctctcgtgtaaaacagttagccaagttgtgaatgtaaaggaaaagttcttggagaaaattaaaagtgctactccagaaaacgagaaagtgaaacagccttactgctcatattgagaaagtctgagtggtctggatagaccaagccagccacaatattcccttaagccagagcctaatccagagcaaggccctcactcttcaattccatgaaggctgagagaagtgaggaagctgcagaagaaaactctgaagctcgcagaggttggttcatgaggttgaaggaaaggagtcatctccataacataacagtgtaaggtgcagcagcaagtgctgatggagaagctgcagcaagctctccagaagatctggctgagatcagtgacgaaggtggctgctctaacaacagattttcaatgtagatgaaacagccttacattgaagaagatgccatctaggacttccatagctagagagaagacagcgcctgacttcaaagcttcaaagcacaggctggctctcttgtgaggagctgatgcagctgaggactttaagtcaaagccaatgcttgttcatccgagggcccttaagaatcatgctaaatctatggctgcctgtgctctgtcactggaacaaagctggatgacagcacatctgtttacagcatggtttactgaatattttaagcccactattgagacctactgctcaaaaaagattcctttcaaaatatggctgctcatcagcagtgcaccagtcacccaagagctgtgatgcagctgtacaaggaggtgggtgttgtttccatgcctgctgacacctcgtccattctgcagcccagggatcaaaaaataatttccatttcaagacatatatacaaatattttgaggtagagtcttgctctgtcgcccaagctggagtgcagtggtgcgatctcggctcactacaacctccgcctcccaggttcaagcaattccttgcctcagcctcccgcatagctgggattacaggcacatgccaccatgcccggctaatttttgtatttttagtagagacagggtttcaccatcttggccaggctggtcttgaactcctgaccttgtgatccacctgcgtcggcctcccaaagtgctgggattacagacatgagccactgcacccagccaagacttatattttagaaacacactttgtaagatgacagctgccatagatagtgattcctctgactgatctgggtaaagtaaattgaaaacctcctggaaaaaattcaccgttctagatgccattgagaacacttgcgattcatggagggaggtcaaaatagcaacattcacaggagtttggaagaggctgagtccaaccctcatgcatgactttcagggattcaggacttcagtagaggaaggaactgcagatgtggtgggaacagcaagggaaccagcattagcagagctgcctgaagatgtgaccaaattgccacaatctcatgataaaactttaacaggtgaggagttgcttcctagggacgagcaaagaaagtggtttctggagatggaatctactcctggtgaagatgctgtgagcattgtgaaaatcagaacaaaggattcagaatatcacatcaacttatttgataaggcagtggcaggggttgaaaggattgactcttaattttgaaaaatgttctactgcgggtaaaatgctaccaaacagcattgcgttctgcaaagaaatctttcatgaaggaagagtcaactgatgcagtcaattttatttgtcttattttaagaaattaacacagttgccccaagcttcaagcaaccacggccctgatcaatcagcagccattaacactgcggcaagaccctccacccgcaggaagattacaacttgctgaaagctcaggtgatcattagcatttttagcaaaaacatttttaatgaaggcctgtacattgttttttagacatagtgctattacacacttaatagaccacagcctagtaaaatgtaacttttatatgcactggaaaactagaaaatctgtgtgactcactttatcgtcatatttgctttattgcagtgccctggaattgaacccacaatatctccgaggtctgcctgtagatgctaaatcagtggttttttttatattcacaaatgagcccattcactagtttttcttgggcaatttctgaagcacacttttgggaattgatatgcaatgtttatatagactggattcagaacacgctacctcaaaatatggcagggtggccctcgagaaaacggcagaagcagaccacagaaaccagaattcccccagccccttctcctcggaggcaggtcataagaccctcattccagaggggcctccctatgcccagaggggaatgtccttatctccgaagacacagaagcagctagaagactccagacaggccttgctgagcccttcagcctatgacatcagagcacgccctttgccctccgatcacacttctgcacaactgtccataaaaacaggcttccctgtttcctgggtcttcatttctgaaggctcccatgtgacatagaaaaccggtattaaataagtgggtagggttttctcttattaatctgtcttttgttacaagtctcagccatgaacctggagaggggtgagaaattactttttccccactatggtatataaatcttttatttgagggctatgggggtgtctcttgtgccatgaaagcatgattcatttattcttgtatccactcactcaataaataatttcccactgatagcctttgctgcttgctgtggccgaaaatccaaatagggttaatcacatagcttcaaagaattagggagacactctggatttgaatattctaaagtcttccactttggggacaacgctagtgcttttagtacctaagttgcaatgggaggtgattgtttgctggaaaaactcccaaatctgagagggacaagcttattgttctgctttgtgcccagatggtggagccagcattttcaaccatcttgttttgtgttgggttgaatgtcctgggagggagcccatctgtctggggtcagggaagtaaccccttattaaagaaatgcaattctctggctatatccttcactatgcttacctccttgcctaactgtatcctcagttcttttttctttcttttaaaaaacagctttattgaaacataattcatataccacataactcagccttttaaagtataggagttggccgggcgcaatggctcatgcctgtaatcccagcacttcgggaggtcaaggtgggaggaccacttgaggtcacgagttcaagactagcctgggaaacatagtgagactccatcactgcaaaaaaaaaattttttttaaatagccaggcatgatggtgtgtgcttgtagtcccagctactagggaggctgaggtgagaggattacttgagactaggagttcaaggctgcgttaggctaggattgcaccactgcacgccaaccttggcgacagaacaagtgcttgtcttaaaaaaaacaaaaaactgtaagagtcaacggttttctgaatgttcagagttccgtgaccacctcaccgtccacctcagagcctctcagtaccaccaaagggaacctgcccctctgccatcacttcccatgcccccaacactttccccagccctacacggccacaacctactttctgtctctaccgacttacctctcctggacttatttacttatttatttacttatttatttatttagagacagagtctcactctgttgctcagactggagtgcaatggtgtgaactcggctcaccgtaacctccacctcccaggttcaagcgattctcctgcctcagcctccagagtagctgggatcacaggcacgcgccaccacgcccagctaatttttgtatttttagtggagacggggtttcaccatgttggccaggctggccgtgaactcctgatctcaagtgatctgcccgcctcggcctcctgaagtgctgggattacagggtgagcctccgccctggcctcctggacattttgtataaatgaaatcatgtcccccgtgacttttgtgactcggtttcttcctctgagcacggcgattcccaggttcctccgcgtcagtgtgccggtgcttcctgcctccctttccacggccggacagcactccaccatcacagacgtcctcggttcctggtggttttctgccctcttcagtggagaaagggcttggaatagaagaagctgcagttggagacgtgaaggctgtggctgtgacgccgccacggggagtcggctgcaggaggagcctccccaccatcagcgtggccggcggagtgagccacgagcgcaagggcacccctcccagccgctgttgctgtggccccggccgccagcgtcccgggagggcacctgcggagggaaggcagacaccctgcaacggcccgcaggcccgtgtcacctgggccaccgagcgcagggcttgtgggtcgtcacagcataattcagccttgagccacgagacacggagccgacaggtgtgtagctgagccatcctcccccacctgtcagtcaccattcttccacctccctccaaacggagagcgcgacttgctcctcttgccctcctggacgtccgggatttccgcccctgggctccagcgctatggtgtggtcgtcctgacgcactcttagaagctcggccacccctctgcgcccctcctgctcggccacccctctctgcgcccctcctgctcggccacccctctctgcgcccctcctgctcggccacccctctgcgcctctcctgctcggccacccctctctgcgcccctcctgctcggccacccctctctgcgcccctcctgctcggccacccctctctgcgcccctcctgctcggccacccctctctgcgcccctcctgctcggccacccctctctgcgcccctcctgctcggccacccctctctgcgccccgcctgctcggccacccctctctgcacccctcctgcacaggcctctcctcctttctgagctcaaagggaatggtggttccttcatgtgcctccttcccacctctcttgtccttttagcaggaacatgctcacgtgaaaaactggaaaaccagagaaatatgaagaaaataaaagtcactacccagagagagccactattcacagtgtggtgtatttctttgagctttttctgctatccacattttcgcacggctgtcatcgtattagatgctcagttttggatcctgagtttttcatttactttctcccacctgcattttccgacgttattaacaactttttgaacacttctcttttaatgtctgcttaacatttgaatcatgtgaccataacatagctttaaagaagcattctcctttgtttaatattaatgatttgtctactgttttaaaattaatacaaacaccactgcagagagcagctttgtgcttcaagttttctttagtattttgggtaatggattattttattggggcatattctcacacatcagattgccgggtcacgggccacctcccttatgtggcgtgaacgtgctggccagtcagcgtccatcacgatcacgtcaggccatgctcccaccagcagggcgtgaaagcgaccagctcacttcccgacataagcgtgatctattttaatcttcatagatttgttttccttttttctattgtggagtagttgattattatgcctttagaatgtttaggacataccacctgtgtttggatgtgtcccatttaaagttatcaaccatgaaatcaaatccgctttaaaaattctttgaaacctgttttcctcatatttaggatgcccatgtaacagcatctaaactctcttttctacaagctgttccaggattatgtgattgctttatcttaagctttctcttccagaacccttacagttttttctataataaccaaagttactccagagttatgaattaccaaggaattgacccccagggtcactttaaagtttccaatcacgacttcctcctgagggagctggcctaaaacccttacagctgaagcattcgattacgttaaatgagcatgtgcagaggctgcagtttcatagttccaattgcatattgtggtaaaatatacgtcacattaaaatttaccatcttagccattcttaagtgtacagttcggtggtgttaattacattcacactgttgatcagtcatcaccaccgtctattcccagaactcttccatcgtcccaaactgaaactccaccaattaaacactgacaccccaactgtcccccagcccctggccccatcactctaccttctgtctctatgaacttgactatctttagtacgtcacatgcgtggaatcattcagtatttgtccttttgtgactggcttatttcactcagcataacagcctcaagctccccccatgtttcagcgagtgtcagcactcacttcctcttcaaggctgcgtactattccatcatgtggatggaccacgtttcacttgtccattcgcccatcagtggacactgggctgctttcgcctttggctgttgtgcattaactgctatgaatatgggtgtgcaaacagctcttcaagtctctgcttcctgtgttatggggtacgtacccagaagtggggttgctgaggcaaattaaaaactctatttttaattttttaggaaaccaccatactgtttccctcagcaacgacgccattttacattcccatcagcagcgcacaagtgttcaatttctccacattctcaccaacaccgattttcaggggttttttaatactagccatcctaatgggtgtgaggtggtatgtttatcttttgactttctttttattaataacctctgttgggcttttaaaaaacatatccaagcttgataagattatatattcctacacgtaccttaagaaaagagagggggaaagagagagagtgagccagagggagagaaagagaccctgcggctggtgacagaatgttctagactcgcagccgccccccaccgcaccctgggctgccgcacccctggcccgccagcctcgggctaaaccagtcaccatggcaaccataaatctgagccagcacaggaaccacttctcctatcgctccccgtcagcctcgcaaagcgcagttttctaagactgggcaccactggcttcgctgtttcctagaccttcagtgcatcataaaaaaaaaaaatcaaatatcatctgtttctacaaatcaaggcctgaatatgtgtatttacatttaaattgcttttcctttccaaggaatccacagtcattatctggatatgatgttgagacgactctatgtctgggaggcaagtcaaggttgaggagaaaaatgtctgagaatgatcacagtcggacacccaggccggcctttgtcaaggagccggggagacagcctcggcttttattctgctggggctacttacggctccaattaaattaaacacacacacctgcttccattatcatcaaaagctgttgagtccaggcagacgacgtaggattttcaatatcgctatttttcttaaggctgcctccaaattaaagctgcacggagtagatgccagggagccccagggggtcctaggctgggccagaacctcacccaccacccacactgcaccccacgagctgccggttcccacttgtcacactcggcacaggaatctcccgaaagaagagaaaacagcagaagctgccgccgctgaggacctgctctcctcttggcgcctccaccgtggcttcccttcccgaccccagaagctgcctaggcacagacacagaggtgcccccagccccaaaattccatccggaacccagggctggtcccacctcagggcgcacgagctcctcggtttcgcttctcagaccctcagaggcattcacctcggctccccctggatgcaccagtgcaggggaggcctgtcctgaaaggccccaggagggcggcaccccaggccagcgccctgccctgcacctcagtcccccgccggcacccacgtctgtgcagagattagtgggtgcgaggggcctctgggcaggccccgccatcctcgctaggattaaatccgctcctgcccacagtctgaggacagatgcgcagggagctggggaaagagaaggcctcgctcagtgcgccccgggcccacacgcagcccctgacttggagaaaggcggctccgcccagcgcttttctgaggatactggagtttaaccctcccctgcgcgttcagagcgcacagcgcccagttcaccagcatgacaggcccgggtggcgtctgccctgggagatgccctctgcctgaccgcgctggagggaaggggctctgcaggacccgctgctcgccgtatttcataataactgccgtcctcatgggctttcagcccaacctgaaaacacagcgtttgcactgttttcttatccgcctgataagagaggaaaatcagtggcttaaaggacgaaaaacctggccgggcgcggtgactcacgcctgtaatcccagcagtttgggaggccgaggcgggtggatcacctgaagtcaggagttcgagaccagcctggccaacatggtgaaaccctgtctctactaaaaatacaaaaaattagccgggtgcagtggcgcacgcctgtaatcccagctactcaggaggctgaggcaggagaatcgcttgagcccaggaggcgaaggttgcagtgagaggagatagccccgctgccctccagcctgggcgacagagcgagactctgtctcaaaaaaattttttaaaaaaggatgaaaaacttgccgaaggacagagcaaaacaaaatcagaaagcaagggttggtgcgagcgatgggcgcccagaacccgggcaacctcttctccccacccaccgaggccgcagcccatggctccggggttccatccgcctcctctcggcagcgcgccccgggcggccccagctccaggccagcggcggggctcaccaggctgggcgctgcgcacggcgggcaggagaggggcagaccagggcgcagcagccaggaccccacactcaccgttcacacaggcctcggacgctccgcagaggccctcctcgagcaggcagcctgcggggaaacagagaagagacgcggtcagctggaggggaggaggggggtgcccccgaggctgccttcctggccccctggtgaatttcagagaaaccgccggtcaagcaggctcctccgacccggcttttccgagatggggccgattattctgaagccagaacgctgcgcccctgacccggccacgtgcgaggcctcctggcctagtcccggagcccagctctcacctggaccaggcccacagctctgggctgagggtcaagccggcgtcatcacaggagactctctggccgcgggagcagcagcggggccggggcctccccttgaggcctcccctgggcccggcgcctcccctggaccgggtgctcaccgcacgcaccgcgtccctggaagcaaggctgccgggcgccggggagcggaggcttccagggaggtaacgagctccgcggggagcccggctgcgtgggaagcaaaccgtggcgtccgtggccacagacaagagacgcaggagagggtcgggagaggaaaggaggcagcggaggcagcagagacgaagacgggcaggaaaggccagcgcggctgggccaggccctggaggagacgcggggcagaggcagcgcctcagtccccacccaggaaggggctccagaagctccgcggtgcctgggtggccaggcgaccccaagccacgcatcccccgcggccgagcaggctggcaaaggttggcgttcggctccacgtccacgcctgtcttaaacacagagagatgggtccagaaagcaccaccccgctagggagcggctcccgcgagggcgtgagcaccctggacaccagaaccgggagggccccagggccactaggcgggagtcgcaccgccagcaaaggccaggtgtggtgtgaacgcgcagtgtctttcactcattcctgcaaagcacagtgccttcaatgctgcttcaccagccgacaaacgcctgttcatccgctaagatccctgtggaagccccagactctcccggggctgcccaggcgtccttttcgggactcgccacactgtgcagtgactgtggattgagtgtgtatttccctctcctggagttcaggagccgggcacacgcctgtttccaccctctactgtttcctcccatgccctctgtgtgtctggcacagggcaggtgcccaggagcaaatgggtgaacaaagaaactgaggaatctggagaaagttatgaattactgagggattcacccccagggtcacgttaaagtttccagtcactacttcctcatgagggagctggcctaaaacccttacagaggaagcccttggttgccttaaaccagcacgtgcggaggctttaaaactaaacgtcattccagacctaaggcagcacagagcctagcaggacccaacgctgggagttcacaggaggaggcagcctcgctcgtctcacaacagcttcacgagccttccacagttgcagggcggcccctggctgggatctgcttcctcccaggaggtggcctaggtgcagccctggcctgcccagccagtgcctgcccagcccagtgcccaccaccatcgcctgccagcagtcacaggcgggtggacaccccacccattgacgggagcctccaatccaagcagagattgtttttggtttgggggagtttttgtttgttttgttttgaaataacaatctcatgaaaaacagatttttttttttgatggagtcttgctcttatcacccaggctggagtgcaatggagtgatcttggctcactgcgacctctgcctcccaggttcaagcaatccccctgcctcagcctcccaagtggctgggactacaggcgtgcgccagcatacccaactaatttttgtatttttagtagagacgggatttcaccatgttggccaggctggtctcgaactcctgacctcaagtgatccacctgcctcggcctcccaaagtgctgggattacaggcgtgagccaccgcgcctggccagcatttcatttcttaatcccatttacccatcagctaaccccacattcagtctgcattctctgcattatttcttcattcaacaagtgtctgagccaggcagaggaggtgaacggcctacaggagcgtggcagggaacgttctgagagacacacacctggcacttgaacagcaggaggagaggcagacaccactccccacaaaagcagtgaccttgaaaaggtcagcatggaggttagaggtcctctcagatcctcacgcagtgacctccaaggctcccctcactgcctcccagagggagagcctcagctgtgagggcccctcccgccccaggcacacagaggcgcacagagaaggagctgggagcagtaaggatgtgaccacaccggagatgtgctggaggttagtccgatgtcgtggaacgtccctggtcccggctctggcaggagctgcaggactctgctcaggattctagggtgcatctccagcgtggaggaacagagaccttgggggaaggcagatgcagggatgctgcagacacagctcacgttctaactccatgtttgtcacgtggaaatggcagatgacggagctctgctaggagaggcaccgggaagaaagcccctgttttcttcccatctctgccttaatcgtggctgacagttagatgtgatctgaatgagatgtgcatcaaatgatctcttggatcctgaccttggaaaaccacctgttactggcatgtgcccaacctgattcgttactccagaggactgatgagaagtgacagtggaaaacctgcagcactccttggtgagaggcaaacacagcagcagcatttcacatgattaccagagctgcaaatgttatgcatatttcacccagccagtggatatgctaatttgactgctaagttatttgttctaaaattacgaaagagcaaatttcattttaagtatcagccacctactaatagtaattatgaccataaatcatccagagaaaagacattttctctggcagacactggttcaacccagcccaggcgcctcgggcacacgccttcctcgagtgggctccacacccgccatgtggcggcaagtggcatcctggacttgtgtaccctgtcggctcacagactgcatacactaaggtccagatgtcattctgaggccaagaagctaaatccacaaggaaagccaacagcggcctgtggggcccttaaccttgtgtgcccagcacttaaaactggaattccttcacttcaatgtattatccacccttttgcatgaaaacatgtgacattccccaaattctcaaattgctcctctgctgaaccctatagcagggctgtggtgctcaggggttcctcctcactctgtattcacagggtatccctcctgcttcagcacagagacaagcacatccagtcatgaatgcatgtgcacacatatacacacatgcacccacaagcatgtgcacacatatacatacacacatgcacactcatacatgcatgcagtcatgcccattcacaggcacactcatgcctgcacacatacacacacgcacacctgcatgcatacacacatgcacacactcatacatgtgagcatacacctgcagacacgtacacgtatgcacacacgtacatgggtacactcatgcatgcatgcagtcatgcccattcacaggcacactcatgcctgcacacatacacacacgcacacctgcatgcatacacacatgcacacactcatacatgtgagcatacacctgcagacacgtacacgtatgcacacacgtacatgggtacactcatgcatgcatgcagtcatgcccattcacaggcacactcatgcctgcacacatacacacacgcacacctgcatgcatacacacatgcacacactcatacatgtgagcatacacctgcagacacgtacacgtatgcacacacgtacatgggtacactcatgcatgcatgcagtcatgcccattcacaggcacactcatgcctgcacacatacacgcacacctgcatgcatacacacatgcacacactcatacatgtgagcatacacctgcagacacgtacacatatgcatgcacgtacatgggtgcacgtatgcacacgtacatgggtacactcatgcatgctgatcttgttctgattctgcttccctactgtgtcctcagaactctaagcagtatcttgtcaccattgtggtgccccttttttcttacccttctcaagatgaaaatggatccagttttgcaaggagtcaggctggatctgcctctcttaccccaatcactcctaagagatgtttatggagagtttgttgttcattgtggaaatacagtaaatgtgaacagagcccaccacctctctcactggctgggaggaagctcggcacatcctgtaccacatgcacctgctctgcttcctcccatctctgggcgtcgctgtggccaaggcagacatggcctaaaaatccatggcccctgcccaaccctgtctctaccaccaccgtggaaggcccttcctgggttcaggcttctcgcctgactgccatgagggcagagaaaggctgtcatcagcagcaggatgcacacgccttctgaaatgtgtgctacactttccactgaggcccataaaatccagctgatgtgagctggcatcccacagcaggaaccaaagagggaggaggggaggttcctggacagcaggctcagcaccggcacctgttgcctccaagctgcagacaggactcctcagaagcctgtgagctgctggccactcactaatcacccttcctgagaggggctcactgaagaccctgctttgaggctggaatgaccaaggccctgggatccaactgcaaacaggaaagcatcttcccagacagcaccaacacacacagcaacgggaacgccaggaccccgtggctgtgcaaacatggagatgcaggtctgttggggaagttgctgaacctgaactgggacagcccctgagaaggggatgcgggggcttcacctgtgtcagcaccactcacttggtacaaggaacacacacagatttcctcatctaaaaaatataacgaagcagagtgaagtaatctatacccagccttttcctccctggccccgccagcctcccccgctcttcagagctcacagactccacgcccaatccgaccctgttactgtcagtcactctgtgtctttgtcctgtccccctctacagccttaaaaaaaaccatgccagcaccccaggaaccccagtccctactgcctggagcaggtcctttgatgacagatgtcacctgcagcagtggcagtctcaccaccgtgggtttcaatgccagagcccatcccagatgtgattcctgtcaaagccatgtttcccacctctccctgcagaaaacgctagggcttacgacagcctgaggctctggggttatgttaaatcacattttttcctaggaacgaacgcatcatcatagaaaaggaaggtgcagtgtttgaagagatgctctttttaaacatcatcctcatttttaacattctggagagagagcagggtgcccaggctccaaccccacctcctctgcagcaaacacaaagccatgcacctggcaaagcctcccttctcccttgcattctcagatgtaaatgaggatgcgccctgcccactgcagggggggtaagagtgaagcgcctgcctgctggcaggtgggcattgcctgggccatagctaccccccaatctcagcatcccctcctggcagcacagacccttgggaccaaggagtccccacaccccactgaggttttctaaatgtttccatcggatcgaaaacaacgtgttaaaccagggcggcatccaggcaggaatagaaagccatttccacattaagaacccctattctaggaatcagcctgaaaagtgagagattaaagcgcctcagcccggaggcggggctgcctctgccaggctgggcgtgggaggacagagacccccagaccctcatctcaggcagccctgcggtcagggcatctggcttctgtggcccaaggctcaaatgaaagctgtgattgcaatttcaaagacaaaaggaagagggagagagggaggaggaaggctcctcccagatctgtctctgacaagagggaggcagccctggcagctcctgccaggcctgattgcccatccctgactgtggcttgcggacagggcttggggggcagcagggggcagcaggagacagcgctcagcccctctgctgagagcctatgaccaagggacctggcagcggcctggacggaagccagcccacctccacatgagagggactgactgcttccctgaaagcccagtcccagtctggggacaacccctgcagtgtcccccttccctgcagcctcccccttcccttcagccttccctccccttccctgcaccccttcatcttccctgcaccccctccccttccctgtgccccctctcccttccctgcagcgtccccctttcctgtggcccctccccttccctgtgcccccttccctgcgccccttccccacgccccttcccccttccctgcgccccccttctgagccccctccccttccctgcagcctcccccttccctgcgccccctccaccttccctgagccgccctccccttccctgctccccttcccccttccctgcgccccaccttccctgcagcctcccctccccttccctgcaccccttcctcttccctgcgccccctccccttccctgcaggcctcccccttccctgcagcatcccccttccctgcgcccctccccttccctgcgccccctccaccttccctgagccgccctccccttccctgctccccttcccccttcccccttccctgcacccctcccccttccctgcagcctcccctccccttccttgcaccccctccaccttccctgtgcccccctccccttccctgctccccttccccacgccccctcccccttccctgcagcctcccctccccttccctgcaccccttgctcttccctgcaccccctccccttccctgtgccccctccccctttcctgcaggcctcccccttccctgaagcatcccccttccctgcaccccctccccttctctgcagcctctcccttccctgcgccccctcccccttccctgcgccccctcccccttccctgcgccctctcccccttccctgcgccctctcccccttccttgtgccccctccccttccctgcaccccctctcccttccctgcgccccctccccttccctgcgccccctcccccttccctgctccctctcctccttccctgcgccccctccccttccctgagccccctcccccttccctgtaccccttcccccttccctgtgccccttccttgttccctgcgcccctcccccttccctgggctgccaagcaaggggctccgttgggtgacatgcagccccaccttggccaggtgacccagccccaccctgcccactgcacgtaggggtgggtgttgctcagtccccttcacctgccgatccagagtatggagccccccagtaagtcctccccaattctgaggctttcaatcacagccccagcccagcgttttggggacccgtcccttccttgccttggccacactctcagcgcagggcatttctggaggttgacacacatggctgcattcctcgcagaggagggtccacagccaaattggtagcaggaggagggataatcacccagaagattctggaaacttcagcctcaatgcctcagagagcaggaagatgggtgccccatcctgaggactgcacggtggcctggatcttagacctacaaggcaggaccccaaaacagttattaagtggcatgttctctgcgccgctgcacactcaattgccatgaacgatgggagctgaccgctggcaagttcaggccaaggtttctcctgcaggcatgagggcctgccccctgcacagcctctgggccctgttcctgcggggacacctgtccgtcccctgtgctgggaggaggggcctgaggctcacactccttccatgctgggcctgttctgccgggcacagatgtcacacatgagcaggagctgggagggcacacacaaacatggatgagtgaccgtgccttactgcaaaggtggatccttggggctcaggcccctccaattcacctccaccccatacgcctggtcagtccgctccatcacaacggtgatgtgtgtgctcagcagaggctgaaatggccaaggtcctcctcacgtctttggcttctgtaaagtcagttcttgtttgaagctggggccacaattctaaggcagttcctgatttcagatcctcctgttcacaaaatcagcttcccacagaaaaagaaccagctcactccaccctggaagaagggcagcgagctgggtaccaggacaaccatcaagtcctgtcatttatttttaggaaaaacaaaacctcttactttgattaatttccttatttcaggttcctaattgcacagatttatttaaactctcttaagagtaagaaattgtaccaaattcaggatacctaccagaattgtttgttttatttttaaagtccaggagttactttttgggaaccgcgctctccatgctacacattcctccttcattcgtttgaagacattaagagcagcaacctcaactatatttattctaaatggcacgtggttttaatcagctcttggtttttaatcggctctggttttttgtcctcgatttcctgaaatgggataataccttcaaaagaaggatgtttgctgagtcattcttcgggactaagaaaacatttctaaccttgctttcacagataaaaagttaaagacaagctttgaaaaagtatctgatgaaaatccttgaacattaaatactgcaggtgcaggtagccaggctatgccggggatgaaatggttaagctaatctcagagaacttcaaccggtaactctcatgtgctggattaaaatatagtatgacccatgaaagaacagtaccaaaagtgagaataaagtgaagaaaggtagatgtattgctcaggattgctgagacatggcacacgtgaaccacacagcctaccctgctgtaaacgtgaactttagacatgtggtacttcagacacataatttaaaaggtaaacaagctttttagcagtactgggctgacttagttgtagtctctgatgaaagaggaaaaatccagttcatagtttctcagtcattgttaaagcaccaaagccctctaacaaaaagaccttatcatctcaagacccccttaggaaatgtgagttatatcatcattatcatcatcatcatcatcatggaaacagcctctcccacactttgatgtgcatgtgaaccagctgggccctgttaaatgagtatttctattccctgggcctgggacggagccaaagattcagcatttccaaagcactccctggtgactcgtccgctgggctgcccaccacactgagaagcaagggcatcacatgtagaaatcatccgtaaattgaaaacttgggtcagcacattataaaaattgttaaaagtaaatttaacaaactctttacaatttgttttctggatccaaattcttcatcacccggataacaaatgattggccttatacaaattattttaggccaggcccagtggctcacgtctataatcccaacacactgggaggcctagaggtcaggagttcaagaccagcttggccaacatggtgtttagtctctactaaaaaatacaaaattagctgggcatggtggtgcatgcctataatcccagctacttgggaggctgaagcaggagaatcacttgaacctgggaggtggaggtttcagtgagccaagaatgtgccactgcactccagcctgggtgacggagcaagactccatctcaaatatatgtgtgtatgtgtgtgtgtgtgtgtgtgtgtatatatatatatacacacaccctccagtgtgtgtatgtgtgtgtgtgtgtgtataattttaaattaattatgtggggaaaatcatacatcaactaatttttacaaatgtattaggttcagttttaagactggatgtatatttaaatatacattgtaatttaattaagatttaaaagacaaaaactgcttcctggccctgatgattagaactcttacacttgagctaaaaaaaaaaaaaaaaaaggtttattttgaaaactttatttttaagtgatgagataggaaagaatattgccttctgctcctttagacacctgtccacaaacaccactcgcattgtgggtgagaggaatctgcacttacaataatgaaaagacaaattagatccaattgttactacagtttccccttttaaccctgatatttgctacaggcaactggatatgccacgtgagaccttatcagaggatgggactgacactttaggaggatagtctgaggtgaatttgaaaaataatttctttttatcttcctcttgagctcgctacatttccagtgtgctgggaattactaccgtccactgtagatacaggttaattgacacagaacaaagaagaaaaactacttaaaactctgtaaaagtcccccagggaattagcaagtctcagctggtggcagctctggagggcacaggtgctgtgggtcgttaacaaaaccaggcttgggctcaaaaacatttgaaaaatgtgagttgaagtttcacacactcttctctgtggaactccgaaccttcactattccaaagggccacgctggcttcccaggaaggatcctgcagacgctgccaaacgccccagccacaaaaacgtccacccgctgcctctcactggggcgcagcaaaccagacaacagaactgaagttgaaagacgtgaccagggctgttaaacgccatccagcccaacggttttcgctcttaagcccctgcagggcctgttagaacaaagctgcggggcccagtccccgagtttctgacctaatgcgtccggagcaggccagagaacctgcatatctaaccagttcccaggcaaggccggtgctgctgggccgcgctcctcacgcggcgggtcaggcaagcggcttgcacacgcgagggtgtgacaggctccgggccacgtccgctgggagctgggctctgcggcttcccgcctcccgctcggagtccaaatgtgtgaggctcggagcactcagggcgcccttccggtaatgggaatgttatcagctttatgaagtctggtgcttttctattttcattatgttaaagcttttttaactatgacattttcgtgccttcccaggcaaagcagcaacaacccacttgcggagccgcagaggggaaatcatcactccttcctggaaggaaagatgagttttatcatctcttgtgttttaagttatcctcagaccctctccccgcccggggctacagccaagcaaacagagcactgcccagggactccaagggtctcagagcctctgtaccccccgatttcagcagatggagcgccccagttcaggaggccccagtgctcgcattcctgcacccaggacgtgatcaatgggccaatcctgaacgggagaacagcctgccttctgctgggaagccctgttcccatccccgacacaacgccaggctgaggctgaggctgccttcttgtgaatcttccaaccctgtccccagtctgggaggcagatccaagaagacagctctgtcagcagtcgcagggggggacctcctgcctccagacagcacagcagagggaggggcagtgccagagccccggccaccctgtgttggagtcagagaccaccaaaggcgctgtcacagcggccttttctgtgtagccaggcagaaaagtcaccaaggaggccaacgcgtgtttcggcagccctggattttttgaagttttatttattgaggatatgttgacccgcctggagctttcattatcgatctacttagtgtcatagagtcaagttctacccctgaaagtgagacagcctgagccaccagcaccgcgcccagctcacatcgtggcttctaaccgcgtcaccatcctcctagctctgcggatgcctgcgatgtccgaactgccttaaggtgaggcgagtgtcagcactgaacacaaagcctcaggagtgataaagccgtcacggagtaaaacgcaccatcctctcctcgttccgactctctgctcctctccctagagcttgattccatcccagggccgggagaaaagtgagagaaattgatctcagcagcttcaagcacaagaagaactggcttgctctggggtaggcaaaccatggtctgccactgccatatgtttctgtattaataaagttttatggaaacacagccacgcccacttgcttacagattgcctatggccacttttgtcctataataattcaatagttgtgacagagactggcctgaaaggaaacaatttttacaaaaaaacttagccaactcttgatttattagaaggagatcaggttcttcacaagatcaaaagaaggttagaaaactgacttggagaaatgggcaggaaacaagacaggtgcccaccagaacactgtcacaaccacacagcaccatcacatctggaccagccctggacacagccacccctcaggggtccatggccaccagccccacccctgctcctcgggacgccttcctcccggctgcacttgccgagtcccctggagcacggaaaaggctgtgtcaagtggtctcacatcccccagttcacacagcgaggctaggtggacacacccaaacctggacgtcaccacacaccacgctgttgattccacagcctgattttacaatagaaaatagattcttttcttgtcaaattcacgctgagccacttttccctcacccccagccactgtgtccatcaactactgtgtccatcagccactgtgtccatcaactactgtgtccatcaactactgtgtccatcagccactgtgtccatcagccactgtgtccatcaactactgtgtccatcagccactgtgtccatcagccactgtgtccatcaactactgtgtccatcagccactgtgtccatcaactactgtgtccatcagccactgtgtccatcagccactgtgtccatcagccactgtgtccatcaactactgtgtccatcaactactgtgtccatcagccactgtgtccatcaactactgtgtccatcagccactgtgtccatcaactactgtgtccatcagccactgtgtccataagccactgtgtccatcaactactgtgtccatcagccactgtgtccatcaactactgtgtccatcagccactgtgtccatatgactttcaccactggccccttgactccaggatgggactctcttctcatccatgtgtaattccaaactcacatttgactcagatacccagtctaaacctttctggactctaatgtcacaataccagcttctctctaccctcacagctgtgtaccatgtgcaggtttaatcaacaggtccttgatgtcttcatctgactcactgaaacaagtaggaaaaaagaaagcagaagaggtggatggaaggatggcaccccttcctcccccggcctgtctccccaccaggtttcccaaactggaagcatccgttcattgcacatctctgaagaggcagagccggcaccacaagaatggaggacttggaagtaacagtaccgaacactgatgattctactgagagaatggaaagagctcctggttacgaacaaaaagttacagatattagtcatgttaccatggacaaatcactcactctgtctgcacctgttcacttgaaacattattgggaactggccagccacggtggctcacgcctgtaatcccagcactttgggaggccgaggcaggcagatcatttgagggcaggagttgtagaccagcctggccaacgtggagaaaccctgtctctactaaaaatacaaaaattagccaggcgtggtggtgtgtgcctataatcccagctacttggggggccaaggcaggagaatcgcttgaacccgggagtcggaggttgcagtgagccacactccagcctgggggacaagagtgagactgtctcaaaaaaaaaaaaatggaaaaaaaattattgggaattgttttatatcataaaagcctagaaaattaagaaaatgcagaaaatctcaaagaataatacaataccagttaactcattacctagagataaattccttgttaatattttggttttcagctacttttctttgcatatatgaaagacctggggtcatactgtacacacacctttaatttttgtccaacttatacatcctggggtccatgtccaggatgtgcaggtttgtcacataggtaagtgtgtgccatggtggtttcctgcacagagcatcccctcacctgggtatttaggccagcgtccattagcaattattcctgtgctctccctgcccacccccacaacaggtgcccagtctgtgtcgttccccccccatgtgtccatgtgctcccgtcattcagctcccacttataagtgagaacatgcagtgtttggttttctgttcctgtgttagtttgccgaggataacagcttcccgctccatccatgtccctgcaaaggacatgatctcactcttttctacggctgcatagtagtccatggtgtgtacgtatgtaccacactttctttatccagtccctcactgatgggcatttaggttggttccatgtctctgctgttgtgtacacacaactttataacctgcactttttacttataacacattgtgaacaattccctgtccttagtatttctcatcatgaattttaatcactgcttaataactatttctacacatgcacatcatctagctaaccaattccctcttgaagaaactttacattgtttccaatatttcccattaaaaataatactgcaatacgcaatcttgattgtaagtccttggagagatctctgattttttcctcttaggatacattcccataaaaagaattctagatattttaaaggtatatatgtaagactttcaaaatatcttgccaaattgccctgtcaccaacagaatatgagtgaaccttgaaacctcagcttcttaatttgttaaaatgcaaactatgttcccctcctcaccctatagggttgccgggaaaatccaaggctctaacaaaagttaaaacatgaactctgatgcaggtaggattatcatcgcatcataaatcactcagggacctgcctcttttttcccactatatcactgaggcataagtctgaaccactgttagtcaaaaaaatgcataaatgaaataaaataatataaacccatgggacacttctggcaaaatgaagcctccaggcaaggccatgctttgggacctgctgatgcgatttgctgccacctccagaaccaccaagacggagtaaaagcttttcgttccatgtgcagctgtgtgtgctccatgagcgtgcagaattctctctgttggctggttcccaggccattccttctctacaaaggtgacatctaatcatgcacaatggaacacctgtgtggtgtccaagtcccccgttcactaccagagaaaaattaatgcagggctgtcaacaggctcctaaggttaaataacaatagttttaaaatcctgagctgtaacacaaaggcacatttaatttgaaagcatgtatttctgcctctgccttttggtttagaggacttcattctgccctggacagtgagaagagggaatggggagaggaagaggaagaaaaggagtgtgaagtaggagggaacggaggagccggggtgggaggggggtggggtgacctgagcacgcgcctcactcctggaaccctgattcttccaccgtacacgtgtatgccatcaccatgccctgcgtccttaaggggttcaatgtggtgctaaataacatgagcccaaatagtgcctgccataagcaggcatccagtaatcccaagtggtggctgttaacaacacactgagtaccacctggcagctacagtgggtcagacgctgcaccgggtacagcaggaagcacagagcccaccgcgcgtcctcacatgtgatggccgaggggccacctcagggctgcagagggtgaggagggcaaagagctggaatttccagagggcttgggacgtgctctggtacagggcacacaaggccggtgctgagacactgtgcagctgggagagggcgagttctgtggggaagcacagagaaagcagaggctccatgggaggcttcggcgtcggacaaccccagtggaacaggcgggccattaggagaacacaggaaagtgagacacacacaaggaagtcccctctccccggaggtgccagactcaggtggggctgccactggcagcaatcatgaagaacatggccaaggctgcgggctccacagtgaggctgaggattgaacctgagtttgagcccagctttgtcctccttcagtagaatgactaagtgacaccggccacacaggtgtggtggcaattgtgcagagcaaagcacttcagaggcttcctgagccaagcacacgggagaggaacccacccaggccacctcccgcctagcacctactgcatctaatacccacacttcatttattttgcttaacatccgtcttctccttgaatgggagccctacaggcccggggtctacaggagccccatgaacagtggacttttggccaccaaggcagtggtgtgatgatggtgacagccacggaggagtgtggctactggcaggaagggccccgatcctcccccaaccccacctccacccaggcttggccactggctagctgtgacatgacaaggcggatgccgggggcctccgaaggcctgggtgtctcctcactcccccgcccctccgccatcgccataggaaggacacacctgggccagcccgatggttgcaagagcaggatggcaggtgcatgggcagagacactagggccagcccagcccggagcagccacaaccaatcatgaaggacaccgctctggttcggggtggtttgatggctggccaataccagggattccaacctgactagagaggccccagcatggtcagctgaggaacatcaggaggttactggggggaatgggctctgagctaggtttgaagggtggagaggcagggagaggggtgggtaagctatgggtcagaacaggcatccatgaggatctctcaggacccagggcttggatgtggggcaaggactgcacacatggatgtcagtgaggaccgtccaggggacagccctgcactaggcaggaaattgcacacagagaggtcagtgaggactgtccaggggatagcgctgcagtgtgcaggagactgcacacaagaaggtcagtgaggaccatccaggggatagccctgcgctgggcaggaaatcacacacatggaggtcagtgaggaccatccaggggacagccccgcactaggcaggaaattgcacaaacagaggtcagtgaggaccatccaggggacagccctgtgctgggcaggaaatcacacacatgaaggtcagtgaggaacatccaggggacagccctgcgctgggcgggaaatcacacacatgaaggtgagtgaggaatatccaggggacagccccgtgctaggcaggaaattgcacacacgaaggtcagtgaggaacatccaggggacagccctgctctgggcaggaaatcacacacatgaaggtcagtgaggaacatccaggggacagccctgcgctgggcgggaaatcacacacatgaaggtgagtgaggaatatccaggggacagccccatgctaggcaggaaattgcacacacagaggtcagtgaggaccatccagggaacagcctctgcaacaggcagtggacaggagaccgcatgcacggaggtcagtgaggactgcccaggggatagcgctgcagtgtgcaggagactgcacacatgaagatcagtgaggaccatccaggggacagccctgcgctgggcaggaaatcacacacatggaggtcagtgaggaccatccggggaacagccccgtgctaggcaggaaattgcatacacagaggtcagtgaggaccgtccaggggacagcgctacagtgttacgaaggtcagtgaggaacatccaggggacagccctgctctgggcaggaaatcacatacacggaggtcagtgaggaccatccaagggacagccccacggtgggcagaaggcaggtgggcaggcggcaggagaccacaggcatggaggtcagtgaggaccgtccaggggacagccccacgctgggcagggggcaggagatgacactgtggtcatccgaaagctttcgatggtcggcaggactatgaattgaaccagtcagcgggggcttccacaggctgctgagcagtgaggggacatctgagaaggtgtatgtggcacctgtccaagctgattagaacaaggagagtcaggagtgaggaggatgcatggatcatcagggccaggatgacagaggaggaacaggggaagtcagggtcaggacgagggtgtggccgtgactcagcaactgaaagaacacaggagctacccagctccaggggtgtggtgaaggcagcctgtggggagctggagaggagcaggtgcggaagtggctccgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcagggcaacgtgggatgctcaggagggggcctcagcacgcaggaagctgagctcacaaggggtcggattgcaagatctcttcagaggtggaagctgatgcgggtggaggtgggtggtttctaaagataagaaggggaggaagaagatggggactgggaggggagagggagagagagagcagaaggatgagcttctgttgaagagagaggcgccacacacagcctccacgcagcctccacccagcaggcgggaccagtggacaggctgcagctcacagggtccttgctcaaaggcggcagcaaatgcaccatccacttcctttccttgccggcccgtcagtcacagcatcggaagaatgaatagtgctccctgatccctaacgtgcaatcggggctggagccggagacccctccaccctgcagtcagggccagcggggctgtctcaggcagcacatctaaaggcctctccaagccatgcacccaccctgcaggaaagagctcagcatcctggcatcaagtctgccattcaggccacactgggacttggtgtccagtcctcatctcttctttctagaaacccaagttaaagatcaaggtgacacagaaccagagcttagcagccaaaatcagaatagcacagatgcgtagtcaccccaaagcccatctgctttgttccgggatcccccagcctcatttccatctctgtcatgggctctactgacaacacactagcagaagagaccacacgtctgtcagcgcccacaggcaggtggcccaggggagcagggcctgtcctttgcccaggcctgaggccacacgggcagagtggcagtggagggctggcatgcacacagaggatggtgacttgcagtgctctgttccatggccgagagggctgtaagtgatttggtgcatcttagatagtcattccacccggcaagcaccaactcaaggatgttcatggccctcaaatgtacacttgaggccaggctatgaggggagcacgaagatagaggacgagacacaagtcaagccttaaaaagccattctctcggcagagaagaacaggcacacacaaccaagctgcccattccccagagctgctaaggagacagtgttcgcagatcttggatcagtggagacaccctgagagagacacctcagagcctgtactttccagatttcaaggccacacccctaaacctgtttcctggtgtgcggggacacatttagctgggcccggttctatcagggaatatttaacatagtttcaatgttacaacttggcatcctcggcttctccctcttgggttctgggggagccccaatgacagaacaacttagaagcccagggtgctccgaggaaacatttcaccaactcagcccacggcacccacaccaggtgctcatagacagctgctaaagaaatgagtgaattaatgacgctttctcaaattcgcaccccacaaaaacctcattcacactaagtgtgtgtgtttactctctctctctctctctctctctctctctctctcacccagagtccaggctaagaccatctcactctcttcagtttttatcttttccaagatttcatttcttaaaaagattctacccttctttgcatccttttgaactccctcttctattcctaaccctgttctcttttattttcatattgtaatcacaaaataattcacagatatcagaaattctcctatttgataaaaaatactgtaattccatgtaagagaaacagccatgttctttaaaaactgaggaaaagaagagaaagagaaaactatgagtaggtcggatgtgaatgtaaagaataagccgacaggtcggatgtgaatgtaaagaataagccgacaggacactgagggcgttttgcaggatcacattcttctcagggccgcttgctgggaaacgacatgtgtcgagttcccagcagtgggagggctgtcgtcgaggaggcccaaggaatgtaccttcccagcctcccacaggggattcctgccacccatgtgaggtcacatggggttggcaaagaaccttccttgagtaatagaactatcatcaataggtgatttgaatttgtttttctcaagttaaaatattgaaaacagttggtcaggagttgacggcaagaaatgccagatgaaattttctggcacctttgaccctgcacctctgagataagatggcagtgaaacctcctccgtgtctacccttcatgctcttaccttttcctttccctcctcacctcaaaatgtcgagaggcagctggatgcgctggtgtggtcaggatggctacgcaatgctatttgcacttcaagttttaccccctatcctgggtcctgggccaagacctaaagagcagtgtggtttgtgatgttattaagtggatcggacagagactatggaaatgcgaacgtgcacatcacatcaacctgtgcagaacttggaagggagaacccacggctcacagaggggctttttcctcctagttctcctaaaccatccacatcttgtagaacaaagaacaagggtcccaacacgaaaaaggaggccatccacacaggctggtgccatccctcccatacctgtctctgtagacatgctctgtgccttgcttggaaaatggaaacttctccaggcaaccctggccgcacagctttgcctctcacacaatcgcacacatcagcttcacccatgtttccggctaagcgtcatgtccccgcacacccctgggcaccagtgcaagacacggtgggaggcagcatgctcacagctccttgggtacaaacgggttgttctcacagaggccggaaagagccagggttcccacatgcacattgctaagtgaaagcagccagtctgaaaatcctggaaaaggcaaaactatagagacatttaaaagatcagtggttgtcaaggattccgggagaggaagggagatgtgagtatgtgaaatagatgatttttttagggcagtgaggctatttctatgttactgtaactgtggataaatgacatgcatttatcaaagcccactgaacttcacagcacaaagaggagccttaatttatgcaagtttaacaaaaaaaatcaaggatgcttcagatcccgggacagaatgccatgcagacggtgatgacagaatcctgcagcatcacagatgtgtgaagccactgacaccaacggggcaggagaaaaagtgctgacctacatagctctggaaacgagcagagcctgtaaaactgaaaggaaaagatcctgtctataagcactgtgctctagctgataaacttgtttcccaagaggtaccagctagcaattctgactctaccacacatgcatgcaaagtgaacaatgaggttaacagctggcaggtggcaggaggaagttctccctattggagtggaggttacaggtaagcaggaggcagcgtctggaataatccacatggtaagagcctggagttggagacgtgaataagagctcatggttagcttggtatagatacagatggtaacagaaatatttataaatatgtgtatattcctagatctcacagtcacacccacatgcacacactcacacacatgcatagtcacacacacacacacacatcttctcgctccgtcagctgacatgtcctacaggcaaggacatccccgcagtaatgagcacacaccacgcccagcacttgatttccaaaaccattctcagatagaagggactgggactgcttggagaaatggctaattctaagactgagacaggaaatacacaagatgagcctaaagcctcttgtagtgtcagaaaggaaggaagtgttttcaaaaagccataaagatggacgtattcaaagggacagtttgtgtgaggccacggaacgggctgccggcagccgaagctggaacaatgtgagcaaacaaaatgaaaagtgttatgttatagcccaaaatataacataaagtgttgaataaataaatgggaagaaagagacaaatctcctgtgcagaattccaaacaatttctgtctatcctctgccttcaaggaagcagagcatgacgcgtcactcacgagtgtgggtttacactgtgccttccctcagagagtgcagcagggaaagagggaagcggggtgagggggagaagccgcaaccctccccaccaagccactgagcacagttggtatccaccatgatggcgcacactgagtgtgtggctttgatctgatgtgatgagaaggcacttcaccccaatcttcctccccagaactcaaacacatcagacaaatccaggccaggggacattctacagactgaccaggcctcctcaaaactgtcagggtcctcaaagccaaggaaagtctgagaaaatgtgatagccaagaggaccccaggagacacgaccacgaaatgtatggtagaatcctggatgagatcctgggacagagaaacttcattaggtgaaaactaaggaaatctaaataaagtagggaatttagttaacagtcacataacagtcattggttccttaattatgacaaactgtgtactaatgtaggaagttaattgggaaactggatgtgaagatatgagaactctctgttctaccttcagttattttagtaaatctaaaactgtcctgaaaaatagtttattatagacagagagagaaatagccacatggtagaatatatgaagccatcaaaatgctataggttaatacttcttaacacagaaataggtttatgctacattaagttttaaaaaacaagatgtaaatgtggaagatagaaaaggcagccccgaaacttaccagtggtcatttgtgccgggcagcgggaatgttttggcctttgatcttccttttctgcttatctgtgtttcacattttcttcaaggaacatgttaacatctttttaacccattatgaaaaattatacaagttatgggttattcaaagctcagtaaaagccactgatacactaagttgatatttcaaagggtgtgattttgaagccctctcactacaggctttatcaacgcacgatgactgcacaggtctgtcttagctctaaagcacccagcactctgcatcaacaccacgggcatcaaatgaggcggatggaagcctacaaccctcaatcagtaacagcttgctgtttcgtccaggactgacatagaaggattattcagggggccctaatctttctcttctgtctgctgaggatggtcttacctcatcacaggtatacctggtatacctctggctgtttgtggagagcccctgaaaacacagcagtacattctcctcgtttatcaatgaggagggatggccacgaaggggagcggctggagagagggagtgacggagaatgcacagctgcatggagatgaccccaggatggcagcaaagggcattcctcagaatgacgtgggctgcccagtccctgaacaagcatgggcctggcaggggtgttcctcagatgtttgtgatgcaattaaacctctgtggtccatgaaagagaaggatctcagctgtgtccacttagggtgtccctgtgagacacgacacatccctgcaccccaggtgatggcgatgcctcccactggcaaaaaggatccatgtgtgcagcaaccccacctcttcctcagtgctcacgggtgcgtcaaagagaaacaaaagaaggatacctactttccaaacacatcatccatcaacatgcatgcagctgtttactggaatttgctttttcgttacttaagctaatgaggtcatttggaagatatttatgaaaataaaacataagaggatgaacctgccccatccatttggttaacaggaaaacatctcgcagatgtaacagccatggctgacttccagaactgtcaccatccgcctgcctcaaagtcactggcacgtgtgtggtttgctgctcctggacccgctctctcaggggcatcatcatgaggcctctgcagagccagaggaaagaaaatcatctgaagaagaggattccgtgaccactcttattttatctccacagtactgtttcttgcctaatttgtgccgaacatttacgatgacaaagacgatgatccgaaaacagcaggcagaacaaggttgcactatggcgaggagaactgggatgcggagagaaaggggcagccccgggcacacaaagcggccgcgtgcaccagctggtgtttccctctcagtgagtgtattttttttttttttttgaggcagtgtttccctcttgttgcccaggctggagtgcaatggcatgttctctgctcaccgcaacctctgcctcctgggttcaagtgattctcctgcctcagtctcccgagtagctgggattacaggcacgtgccaccatgcctggctaatttttttattttcagtagagatggggtttctccatgttggtcaggctagtctcaaactcccaacctcaggtgatcagcccgcctcagcctcccaaagtgctgggattacaagcgtgagccaccatgcccagccgtgcgaatgtaatttttaaaatccagcatctcaacatcaggaagaactttacagaccagtttcccttctcactcaatttggctgcatcacccactgctcccaatgggaggcgagtcccaggggctttttccacctcattccatgctcgcctttctacatcatctgttacatgctcaaggcttccccatcggcctctgcaatccctcttcccagttccttcctgtttccctactctccatcctcctctcctgattcctttccttggcttgttttcacccacgtgccactgaaataccagcgtctaccaaattttcactatcgacacctcccacgcttcatcctctgtctggtcgtctctccacagccatggctgtagtcaggaatgattcctaaatacgtttccacactttttccaagagttccaccttcatagtccagtctttctggacgttgtaacctctatcacacaaacatttcatacttgatactctaaggctgagccccttttcactgtccccctccccacctaccatgatatccacagacacgctggtgattgcacctcacagaagcctctctgggcttctccccacgccccggccgcctggccatctcttgcctcaaaggcctcctaaggagtctccatagcattaagtaatttaccttccaattcattctcctctctcctacaattaaaagtgaatcattccagccagcgcagtggctcacacacctgtaatcccagggctttggaaggctgaggtggaaggatcacttgagcccaggagttagagaccagcctgggcaacaaagtgagaccctgtttctaaaaaacacataatttaaattttaaaaaataaatgaaaatcctccaataacatgcagcctcttctgtatgaagccaaaacttccttacaaggcacaaaggtgctttccccttgttccttcccatgccctcaactccccagccccctcccagcctgccttgcacccagccctaggcagccacattcttggtgctttctgcctattgttcttggtgctgttcttggtgcttctgcctatagttcttggtgctgttcttggtgctcctgcctattgttcttcgtgctgttcttggtgctcctgcctattgttcctggtgctgttcttggtgctcctgcctattgttcttggtgctgttcttggtgctcctgcctattgttcctggtgctgttcttggtgcttctgccttttgttcctggtgctgttcttggtgcttctgccttttgttcctggtactgttcttggtgctcctgcctattgctcttggtgcttttcttggtgctcttgcctattgttcttggtgccgttcttggtgcttctgcctattgttcttggtgctgttcttggtgcttctgcctattgttcctggtgctgttcttggtgtttctgctattcctgtaacctgcaaggcttttctccacactacaccatggaaagtcctctctagtaaaccgtagcccagcagaaccactcgtgagtcctgtgattccttccaaaccactagacctggggcaccttgggccccagcatggtgcctcactgattttggactgggcacaacacgattcatccaaacaccacttgacaaaggccagcaggacagaacagtacaacgctggttccacagtgtggtcctcactgaagacagggcgggtggcattgacccccattcctgtcccacagttgagggctgccccacaggcttcctcctcacttcgggggtgcaagcctgcaagaccaaacagcccacagccttggaggaggcagagtgcgggcagcgccccctcacagaaccgcagcaacgacacctatcaccgcccaccacaggcgcactgtgggctgatggggtgggccacatatggggaattccagaacgtgaccctgtacctaaatccctgcagttcccaagtctccctcagtccttcccagacatctcttaaggggcctgactctgcctcagccccaccgccccccagcctgagccccgttccacctcctcactggcctcgctgcccctctgcaatctcctccaacagccgccaggatcatctttacaaaatgcaaaggtcatattgctcctgagctgcaatgccctcaggcagtcccctgcctttagggtggagtccaagccagcctcatggacagcgtctccagactcttccccaccatagccaggcaggcctccaggcgcttccagactcatccccaccatagccaggcaggcctccagatgcctccagactcatccccaccacagccaggcaggcctccccaggcacctccatccccttcgtcacacatcccacacaccccggtttgttcccaccaggccttcactaacatgccactgcagaaaaaccttccctcccccccagtctgactagagtccactcatttttcaggtaccaagttgcaccttgcttcctccaagagggctccctaattcctgaccgggcggggcacccctgcaacattctcccagctccctggactctccctggcccagctctcgccaactgcattgtgattacttaagaacttgctcctcccttaaaagaaaatagactccaggagggcaagagtgggtttatctcagttactgccatggtgtctataaaatagttagagcccaatagttcttactgaatcaatctatcaattaattaatagagacgatacggatttcatggggtgggaggatatgaacattaatagagacgatatggatttcacagggtgggagaaggatatgaacattaatagagacgatacggatttcacggggtgggagaaggatatgaacattaatagagatgatacggatttcacggggtgggagaaggatatgaacacacagggacatcagcgcttgtcctttctggacttagcaaaggccatactcagtagctcaggtgccaagtaagccagaagtgaagaaaatgcacagccaagccgggccagaacgtccacagaggctaaaggatacggctcaagctccacctttaaaagagggtaggactgagatcaacagaggatataaacagattaccaggacggcatgaccatagaggaaggacccacttgaggaggccacagcaggacaagagggaaggacgaaccttccccaaggctaagggtcaaacattcgagctgattaaaaatgttacttgaggccaggcgcggtggttcatgcctgtaatcccagcactttgggaggctgaaacaggtgaattgcttgagctcaggagttcaagaccagcctgggcaacatggcgaaaccccgtctctataaaaagtacaaaaattagctgggcatgttgctgggtgcctgtaatcccaggtactcgggaggctgaggcaggagaatcacttgaatctgggaggtggaggttgcagtgagctgagattacgccactgcactccagcctgggtgacaaagcaaaacaactctgtctctaaacaaacaaacaaaaaaacaatacttgggctccaggatgcccatcatcctgcagcagtttgcactgagctccctttatgccaacaggctcaggatccccaaagcactgcagcagagaacagccgtgcagcatctcaggccacacagtacacaggcgtcgtcactgtttccaagaacttccttggctgaaaagtcatttcaaactttggggctattttggcatctaagtgggaagagggagaaaacattaaaagaagtcccttagtgctgacactgtcctgccagccagcacatctcctcattttatgaagtcggactcatcccagctatctgtgtgagacactcagttggccatgacagttaaattactttttcataccgagaacagaattagtctataaataagtaaagaggtgctagggctgagtcagaagtgccgattccacctcaagctccttccctgcccgatctgcaggtggctctcagggcatgggggaccaagctgtgtttgagcctttgctttgcatgggtggctctgaaggtgatggaatgggctggcattctccagcactctctggcattttctgacattctccagcactctcctgcactctccatgttgatctgggtgactctggaccttcattctaaagatactcaagaatctagtggccatacaacatccccaagggagaaaggggccctttttctccaatgctgctgatgctgtttcccatcatataaggactttctcccatcccaagcagccaagggaaagaagtgactcacctcagaaagaagaaaaagggaagaagggttacccaatgcctcccccatggcatggaaattctccattttccccacaacgccagcacggtcacactctgcaagcaacacccatctgttctccttacattttccaactttactatcattagcctgaaaccaagctttcctgttcagtgcaatgactactctgccaaacacacaagttctgaacaggacatgtgccatgggaaacatttcgatttaatgagcttttccagtgcaacacagaatgattttttaaatcccagggatgtcccccactcaaacttgtcatttcttttaacaaaacaacggcaatgccaagaaaggaaagcattttctggccacagagtgggcccttcagctccccttccaagagggagccctgacacggaggcagaaggacttccatcccctaagaaaaacagagtttgggatcttgaacaaggtgcattggcagcctgggtctcacaccgtcccttctagagcaggaaggtgtggaaaggagagtaaaattccactattgtgaaattcccccttcagcaatgaaacggactctgagaacttatttttcctgaaaattattatttatgtccatctagatggtgtttctatgtttactgccactacaatttaaaacagttcatgcccttcggtagacagtttctagacgagtctttcctggatgtttgaagcaggttctccaccttcagctcagctcgaggcccctggagaaacactccccagagcaggatctccagagaaggctcccttccgtcaggagcaacagtggctccaaccccgacttccaagctctgggcggccttccactgttttgtgggtggtgataattccatttaaagtagcacttacatggttttttagaaaagactataactcctggatttttttcaaccatattaccaatagaaacaaacatacgaagaacgatcgggtggctgcttatcagaaaatcctaatccctgcctcagccatgcccagccaggtcacagtgagcacgtcctggtttccatgtctgagcaccagatcggtaaccccagcctcttcactctcatgagggtgcagcaaagattcagcaggaggatacacatggatacgctgggcaaaccacaggcaccctgcaggccatgagggcctggccgagatctcagccagccaaggaacaggagatttcagccacgtccctcttatctctcccacagcaggattccaagtgctgcagccaggaccttattccatgacttccctctgtgcgaggcgctcagtcctgcagacgcagtgacttcctgccccagctggaatgctgtctgcgtagtcatactataattttatttgtattatttttattgttgtattgttattttatatttttttccccagtactttcaatcctctgttggtcgactcaggcagaacctgagggtatgcagggctggctgtattcttgcccaaagggacctgagaaaacatctagaccaacgcacaggactgtgtgattcacccgaaaccacacagttagttgctgagttagagacagtactaggtgtctggcttcccaacagggtgaattatttctggaaattgttttttctccctgcatctaaatttaacaatgaggaaatctattagtaatcagcaagatgctgaagcagtaactccaaaatcagttgacgaatgatttctcaggagcagcacgctgggtgctggctcaggaggaaggtccgcatcggaatggtggactgtccaggtactggctcaggggggaggtccacgtcacaatggtggactgtccaggtagtggctcaggagggaggtccacgtcacaatggtggactgtccaggtgctggctcgggagggaggtccacgtcacaatggtggactgtccaggtagtggctcaggagggaggtccacgtcacaatggtggactgtccgggtagtggctcgggagggaggtccacgtcacaatggtggactgtccaggtgctggctcgggagggaggtccacgtcacaatggtggactgtccgggtagtggctcgggagggaggtccacgtcacaatggtggactgtccaggtactggctcaggagggaggtccacgtcacaatggtggactgtccgggtactggctcgggagggaggtccacgtcacaatggtggactgtccgggtgctggctcgggagggaggtccacgtcacaatggtggactgtccgggtagtggctcaggggggaggtccacgtcacaatggtggactgtccaggtgctggctcaggagggaggtccacgtcacaatggtggactgtccaggtgctggctcaggagggaggtccacgtcacaatggtggactgtccgggtactggctcgggagggaggtccacgtcacaatggtggactgtccaggtagtggctcaggagggaggtccacgtcacaatggtggactgtccaggtgctggctcgggagggaggtccacgtcacaatggtggactgtccgggtagtggctcgggagggaggtccacgtcacaatggtggactgtccaggtgctggctcgggagggaggtccacgtcacaatggtggactgtccaggtgctggctcagggggaaggtccacatcggaatggtagactgtttaggagaaaggtccacgtcagaatggtggactgttttaagaggaaggtccacgtcagaatggactgtccaggatggtgcatgtgcagggtgtgttctggcaccactgtgtgtgtacagcgaatcgctctctgtaacctggcccctggtgaccagatgcacttacaacatgcaccttgctgcggctagatgcagtctgtggacacagattaaggtgaagtgagggcatcagcatggtctggagtccgtgaggcactcggaccaccggagccagcccaggggttggcacagtctgcagggctcagcgtctcccctggttctcacgtggacattggctttccttgtcttgagagcagctcaccatcacgagttcttccaacagcccaagtcttcatttccacacacttgcttctgtgtgtggcagatgtggagctggagagaacagacctgccgtgagaagggagagggcagcaaagatcacccagaacttgctgggactgagatgaacaaaagttacccaaaaatgggaatttcaagaatagccaagggcttcaacagaggatgagctgacacttagatttagggattgtcagcatcaccgtggctgctgacatcttgaaaactggaaaatggggtctcagaagaacaagataagagcgcaggaggccagggtgtgactcttggggtccaggaggggacatcacaggaagcacaagttggaggggccagacgggttgcagccaggttggggtctggggagccccagtgtgaccaggggcgggggtggtgggtgagcctcagcagccagagtggtgcagacacgtcccacggtgagggctggtgcggacaagagattagccaaaggagcagccaccatgctgccgacagcgagtctgccctgaagtggagtctgccctggagtggagtcgtctgccctggagcggagtcatctgccctggagcggagtctgccctgaagcggagtctgccctggagcggagtcgtctgccctggagtggagtcctctgccctggagtggagtcgtctgccctggagtggagtcgtctgccctggagcagagtctgccctggaatggagtcctctgccctggagtggagtcgtctgccctggagtggagtcatctgccctggagcagagtctgccctggagtggagtcatctgccctggagcggagtctgccctggagtggagtcgtctgccctggagcggagtcgtctgccctggagtggagtcgtctgccctggagtggagtctgccctggagtggagtcgtctgccctggagtggagtcgtctaccctggagtggagtctgccctggagtggagtcgtctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcgtctgccctggagtggagtctgccctggagtggagtcgtctgccctggagtggagtcatctaccctggagtggagtcgtctaccctggagtggagtctgccctggagtggagtcatctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcatctgccctggagtggagtctgccctggagtggagtcgtctgccctggagcggagtctgccctggagtggagtcgtctaccctggagcggagtctgccctggagcggagtctgccctggagcggagtctgccctggagtggagtcgtctgccctggagtggagtctgccctggagtggagtctgccctggagtggagggaagtgaagccagatcgctgaggagtgcgaggaaagctgttggttgttatggtcaagccccagaactcgtagatggatgtccccagcccagtgcctcagaaggtgactgcgtttggaaatcaggtttttgcaggaaaaattggcgttaaccctcagcatggagtggggattggtcccaggacccccacttacgccaaaatcttcacacactgaagtcctgcagctgccccacggaatctgcatacacaaaaagtcagcttctgtacacttggctttcacagccctcaaatactgcatttttgatccatatttggttggaaagatccatgaataaatgagttcagacccatgttgtcccagggcccactgtagttccgatgaggccactgggggctcctccagcacagccaacaccacctgtgccagcatcactgcccttcgaagtgtggccccagcagcggtctcctgcaccctccgaaaagacagcccttggaagactgtggctcaggatgcaaggctctgactgaaccctcaagctggccctccatgcgaagaaatgctgcgtcccaggccctgcacagtgctggacttcccagctccaggctctggagccggctgcagagcacagcgtgaggcaggccctgaccgctctggaaggaaaagcacctctggcaagtagtccagaggtgaaagtttctctattttggaaactgggcatctgccaaggagaacacacggccccctaatgtgcaacaaaaccgtgagacccgagcagaagctgcagcagaaggtagcacgggcaggatgctaggccccaggggccatgggctacgcacgggccaggtttccagcctgccagccccatccagacttaaggacggaaagtgggaccaaggctgagccgctccgcacccctcgctctacagctggacacaggctctgcagaaatcctgagctggggccaccccagcctccctggcccagaacaggcgctcactgtatctcctcccttcctcctgagaggtcctacgggatggagtattaatagtgccgtgtttaattattattcagcataatcacacatattacggggatttttaaagatcctttcatgcacaatgagtatttatctaatgtgccctcctcattcccaagcagccctcgggggcagatgcccccatctcccaggacatctctgctggtctctctccacggcacctgctccacagccacctctctctgctgtgctcacacagtgtggaagctcccgcttcagcaagaggaaagccccgatgatacagggtgaagacgcctcccctcacagacctcagacctgtcccagagccctgacaggaagacccaagctctcctgaagccttagggtctcaacatcccaagccgacaatgcccccccattgactcggctctctgcagacctgcagacctgcagcccagcccctactctcccctctggctggcattgtgcagtccttccttcctcagcagcgctgtgtgggaagggggactatctgcccagtccctgaggagatgatgacttcctacagcttctgaaagggcccgctctggggggagccacatcaggcagacacacggctcctggtgttggcagggtgccggcggaatccagggcaggattcacttgtgtggcgaaggggtcacccctcgtgcaggctcaggccctccctgcccacctgtggcggcgaagggaactgacaccactccttcccggtgagctcggcagggctgcatctctcccgtgggacgctgcagagataaccaggtagagccacgctcacgagaaccaccagccactctgagctaggacggggcacaggcaaccacgttcccacaaacacagggtctggaggtctctccgctggtcacggcctcggaattccgacatgctggactgtggcttgggaaactgactcggttgttctccattcctgatcccatttcctgtttgtgggtgtgatggctgagttgtgcaccccaaagttcatacactgaagtcctgacccccaggacctcagaatgggactgtatttggagatgggtcttgaaagaggtgatttcagtaaaacgaggtcgccggatgggcccggatccaggctgactgggtccttatggaggaggaggtgaggacacagacacgcacagatggacaaccctgtggggcacagggaggagacggcatctgccagccaaggggagaggcctctgggggaacctgccctgccgtgctctcatcttggactttcggcctccaggactcagaaatgtctgttgtttgctaagccgcctggtttgtgggggtttgttagggagactgagccaattcatacagtggattccgccactttctttctaacacaatgaagatagagttggtgacctcctcaaaccttcataaaggcataacttgtaacaacacaagttatggtttgtgacaaatatcaccagaagccccaagcagagtcgagacgtgcgcagaaactgcacaagccaacctggctcaggcctgggagagcatccctccgaggagcatccctccgaggatcccccacagccttcccgtcctcggagcaaatgcagctgtgtccttcccgcaccgtgggcctggccctcacctccccccaccccacacccagcttctccaccagctccccaggcctcctccccacaaggcgcgtcctgggcctccctgaccccggccatgccccccgccaccggagccacttcactgccttccctggccacagctccctgaagacagggccagcctgcgtctccgtgtccagtccttggacgtgctaaatcctcagcgagtgtctgccaagacacatgtgatgagcaggtgaaggaacatgtctgacctcctgcttcagtgccatggaggcctcaccagccccaggccatgggctggcctctccatttcctccttctgagaataccgtggagttgggattgtgtttgcctgtttacagggactacggtcagtgtccctcccaggccgctggtccttcctaacacctggcggcccactgctcagccatgtgggggttgtgcacagggcagggctccgaggtgtgggctccactctgtgggggggtctcacagcagccacacagagctggccattccctcaccgtgacctctgcagagagtagaattgtctgtgtacatggggctggggccaggctgtcctccgccagctctcaccccaggctcccctggtcttcctgccccgtatcccagattcatcagcaccagccacatctcacctgccccacaagctgcgcctcggtgctgctgtctcaaccaccttcctgtgtagcagggaccacctacctgtgttgcttgtgctatgtctgttggtttaaagcccatctctgatcccgcccgacacacagcagggactcagcaggacactcagtctaaacgacagggtagggggcaggcagggacagccgaggagctgctcctgggtgttcctgtgttgtgtgagcacatggaggaagttggtgtgtactaagcagtgaagctgctagcaactggctgtgtaacagctgccaagtaacacatcatgtttccacagagctccagaggcatcagcctaaacaagaggctcccgagaaggtgcactcatacagtgtggtgggggtacccgtgcttgggtgcaggacaggcgggggcacccgcctgggcagcctccagatgctgctgaggtttgccatggggtatgaacgccaggtgacgtcccaaaacaggccactcaatcactccccagagccggtcagccgtctcttgccctgtgaaatgcacatttacaaagcgtcacctggtgtatcaggaacaggttcacttgctgtctcagacctgtgaatgcctacatttcagctgatttagaaccacgcatgctgggccaggctcggtggctcacacctgtaatcccagcactttgggaggctgagggggacggatcaagaggtcaggagattgagaccatcctggctaacacggtgaaaccccgtctctactaaaaatacaaaaaaaaaaaaaattagccaggtgtggtggcgggtgcctgtacttccagctactcgggaggctgaggcaggagagtggcatgaacatgggaggcggagcttccagtaagccgagatcacaccactgcactgcactccagcctgggcaacagagcaaaactccgtctcaaaaacggaaaaaaaaaaaaaaagaactgtgcacgatggacactggcctcggtgagtccacaacaggaagcaaacaaggattaaagtgcccggaattggaagacacaacatttcctacacagcctgagtctaaggtgatgaggggtggaaacaccagctcctcagggggccagccctgtgagggaaacgtgtgctcacgaaagtcagcctggccttcgagcccaccaaggggctttgggatcacacagccaggggcaaatctcagctctgcagcctgagaaaagtcacccaaatgcctcaatccccttctcagacaggcagacagacaataataacaatgatgcctgggacacaggacattagaatgcccgcagcactcacacagcacctggtgggcactaagcacccgtcgctgttggtcctggggctaacgctgatgggaggagcagctgcgtgcatatttacttctgaatattttcacattttaaaatcatctccattttgctttggaatgcgtggcatctctgctgtgcaggtgctgacacgccccagagcaagcattggctgtgtcggcagaggaaggtgggaaggcccaggggaggccagcaggaggacggactcaccaggacacccccaaggacagggaaggtgctgctgaccacggccagcaacgacgagccatggtgacagctcacacacagctgcaaactcacatcgctgcctctggaaccacagagtgctctgtattagatattttgtgcatttttgaccaaaatgagtcaaatgtggggagagtggcaactgtgtgagtctgggctccaatcagcagcgaagatgcagtgtgggaatgacagcagcttccctctgcggacacagcacacactcaccacacctgggctgtgtccaccagccccaggggctgtggggaggggcggtcaccagaaggggccaggcgggagcaggaccagctcacagtctccccaggcctccccagccagcatgagttctcagcatctcctctacacacatggacaaacaccacacacacgtgtacatcacacatgccacacaccacacatatgcacaccacacacgtgccacacacagcacacatatgcacgctaccacacacatgcacacatgtatctcacataccacacacaagcatgcacgccacacatgccatacacaccacacgcatgccacatgcacacccctaacttaaggcctagctccaagtttctgtcacaaccaagagggaaaacagagagaatgcaaaagaagtgagatccattcctaggacaggctgaccccaaaaataagtagaattacgtcagatatttagaacatggaattagtgatttggttccctggctagtccatcaaagcctgtcgatccaaaatacaatttaaatgccacatgcttgcaataaaaagcaatggaaagcaaggtctttacagtaataattaagtgaagcaatgaaattgaatccaaaattattttttgtttctcttcaatactgatgctggtacatgaggaaaacagaacaagcataattggactgaatgagggaaggtggcaatttgcggaggctctgcaggagctcctgggaatgctggggacctggacatcccacgccggcctccccgtgtgccacagactcagctctgctccctggagcaggtttcatgcactgggacagggagctctggtaccccacgacttaaacacatagagcaaggcggggggggttccatgtgggcaaggtgaagagaaagcccacgatggaaccagctacagcacacgtgtgagagcgtgtgcctgtgagcacccatgtgtgcatatatgtgtgcccatgtgaggtgtatgtgtgcaggtttacactaacatatgaaacagagtgagtgctggggttgcaaagacccagaccacaaagagctggtggcaaaggaaaagaaacatgcacactcccaagatctgtttcacagcagaacccactccttcctgctcctgaggggcgaggcaagaggtgtcgggccatgtgggtcccatgcaggttccaggaaggacgttcactcagcagagcaggggaatggcaggctggggggagctagtgatcaagtgccctcaaaacatacacgtgtgtgtgtgtaagcatgtgtacggatgtatctgtatgcggatgtgtgtggccacatgtatgtatatgagcatgtgcatgggggtgtgtgtgtgaacatgtgcatgggcgtgggtgagcatgtgcacacaaacaaaaacaaaccacaacagactgtgttcaaagcgagaggatccctaagctgcgatgagggaactgaatttaatgtcctaggttacagcccggccaacagctgccccaaaccatgcctgacacagcaaatttacagacacatcaccctacagcgctcaggtaacggcttcccagccacgccccattacccacgtcccatgctgccatccaagaaacgctccagggaagggaagccaaggctgtcagttcacatctccctctccagagtcgagctcaagcccgcggctgccaccctccatgaactgatggggaagggggccacaggaaggccccaaccccatccagatccaggcctgcgagcccaggggtggcacagaaacagcaggtgttccctgagagaacgacccagggctgtggcaaagccccctccaggctcagctcatcccacctgtggggaaggcaccatgaggcctcctcacgaggcagacgggtgtttgctgtggtggacagatgcccacatctcacgcgcagcctcctggaaggcagcagatgcaaacaccccagctgagaggaggaggctgaagcaagtgcaggaaagaacaaaaccaatgcaccactggaccatcacctttagagaaaaaggttaagaaatctgtatcacataaaacaacctccaaacaccaggctcgacgccctcacccaccacctgccctctgctcatagaaagaacgtggtgaacaggagcatattttacacaaacacatgcctcctcccagccacgctggctccaacctactaggcacctggaagctgaacgcatcactgcactcacacgtgcctaaacacttaggtgcgccgagaagcccaggcatttggggtttccactgacaaggacacggaaggcaaaaaacccaaagcaacgtgggtccttccctctgaagggtcagataaaccggcttattttattcttagaataggtttttgccacagtgaaaactgaataaacaacaaagtcagaaaggggcgtgtccatccacagactttaatcctgcattaacagaggctccctaaagaagggggtgccggagggaggtgcagaccgcttcagggttggcccagcacctgggtggtgcccatgcccccagtgtaaaaagatcctcagctcgtcgggcacgaccttgctttgttatctgctcttggcctctgtccattctcaagccacgtcacgtctctatgaccaggctcttagatgcccaaaagcgacattgggagaggaaactgtcagcccccagcgtggctcctgtggcttctgagaagccccagatgtcaaacaggcatcagagcattccagtcacgtgccccacagagtcatcacggagacagcagagacagccatgagatttgctcagactttcagcaaacccccaccgatgcctccacactggaagttggagcgtggtggaccgtgcgttataataaagttgctattgtatgtgactttgatcctacaaagaggaaaaaacatgggtaaaaagtaagaaaagaccaaaaacgtcactaaacttcaaaaacccgggacatgatgtgattagaggaacagcatggaacatggcaaaaaatacataacaaaacaacaaaaaccagcaacaggcgcttcctccagacacaccacggcacacttcaacctgttccttacaagactacattgagcgtgctggtgttaaatgcgtgcaggcttccgtgcaggagccctctgcacatggcagagagaatgtggcccgtgctgcactctgacgcgcagaccatcttgatggctcagggacggccaggctccaccacacctgctccctcctgactggcctctctctaccaagccagggacaaggcctcatccccagaaccaccaaaggattaacttaaagcaaaacaaacacaagcaaacagaacagaaatgacttgggttcctgtcactttgtgctcccaagccattccaagagaccagcaattaataactcgcaaagaattagctcacctccaacaaccacgggagcttgaaaaccacttccttccctagttttgttacttgcagaatgaactgattctcaaatccctggagatactgggctgagtgcatttgtcctaattacagcaacatcatcttcctcagtgcaccctcgctcacagggcagcgcccaagatctgcactcaccaaagtgagcctctcacagatggaatctgtgcaaactttaagtcccaacaaaactttgccaaactcacttgttgagcaagaagctcagaaatggagatttctaggaccctccgcatctggctgcaaatcccagacacaaaccatccaaggagatcgcacctttgccttccactgagtggcccaacgtggagtgctaggaagccatcaggagccagacagacctatgtccactcccggaggcaccgccaggaccctgtcctgcgtgatgggtctccctgcaacacacgaggagtccctatcccaggggccagaggggacgtcccgcagagaccgtcctgaccccagccctctgcattgcaccaggtggacaccacagaagctctagcctgaggcaccgagccgtcaatcttccatcaatcgatgaagctctcacctataacggacatcctttcgccaccacacagcatttaccaagctttccagggtgccctgatggacatgctcacaatgcctcggggatttcctctgaagatgtggatgcagaatgaacaccatgaaaacacagctcccactccgggtacatcccaaagtcgcacgtcaggccctccgtgccgccgtcacagctgctctctccccagccaccactgcctttgctggggatgccttgcctgaagatgcaggggctaccctccctgggcctccactggccagtgcaggttgtgaccacccaccccccgggctccatcagggatggctgtgggtgcaggttgtggccacccatgccccgggctccatcagggatggctgtgggtgcaggttgtgaccacccacgccctgggctccgtcagggatggctgtgggtgcaggttgtgaccacccacaccccgggctccgtcagggatggctgtgggtgcaggttgtgaccacccaccccccgggctccatcagggatggctgtgggtgcaggttgtgaccacccacgccccgggctccgtcagggatggctgtgggtgcaggttgtgaccacccacgccccgggctccgtcagggatggctgtgggtgcaggttgtggccacccacgccctgggctccgtcagggatggctgtgggtgcaggttgtgaccacccatgccctgggctctgtcagggatggctgtgggtgcaggttgtgaccacccatgccacaggcttcatcagggacagctgtgtgctgctcttcatttcccaaacgcagtgggatcaggcctggctggatgtctgaactgcgactctgccccaactgctgccctcattgccgtaccccaagagcctccatccatcttgcaatggagctgccactcagcttgtccaccacagtccctcctgaagacacatctctgcgaagctccccccatcacccaggccaaagctagcctaccacgtcacacagtggccatctgcccgggcatgtttcacctcggctgtgcagaccctctgaagacgagacattctccatatgtttcttggctccaggcagctcatcgacagataacatcctgctagatcagcagagacgacgcctgcacgttgggcagcctgcacagccagggagggcggggtgggaaacgcagcgggagacagtgaggtgggggtctggaagtcctgcctcgagcctcgtcagcaggcaggcgtttcagtgttccccagaactacacctcagtatgccctcgcagaaaggagcacttcacacaacatctttagagaccagccacctccaaagcctctgttcctcctgcattgcctcccaaatgatctcccagcctgggaatgtcagattctcagattccatggggtattcttttctgtggctgttactcatgtaatctaaggaagtgttgaagttctgagttaccctgtagcaaaggcatatcttgttccttccacaatctggtcgaagaaaacagcagctttgatctcagatactcttaactactcagtaccaagggaagttgtgggctttgagccaaccacacctaatgtcaatgctcactccctccccattcagctgcgtgaattcgggtaagtttcttacatgagctgagccttgtttttcctttctgtaaattggggatttaaaatgcccacctcactgggtcatggtaagaacctgcaatgggagggtacctgcatttaatctgtgctgttttcgttctcctgatacagaactgtgtcagaatcctgctttctgcggctggactatttgtcaactgcctgttagagcacctggggagcggctggggctttctctggggtcagaccatggcactgaggacttcttgtagcattcaggtggctattgaaatcatacaaaaacaattaataggcaaccattagaaattaggcaataaagttttttcagttagttggtcaactgtgtacacaacacaaagcagaatacagagtgtgtatatgtcctcaaccatgattgtttttacataaagtgtttaaaaaaaaagactggaaggaaacacagtaaatcttaatatagcggctatacttgattatatttgggattttttctttcattttctataaaatgtctaagttttccatccagtttatttttaaaatctgcaaaagtacttcaaaaatgagtaatctaaaagtctggttccatactagataagatgaagaaaaataaaatttcagttcacatccaaaaggttgggaccttactaaccagaaccccacacataaccacacaaaacactcaaaacaaccacacaaagcaaccacaactccagcccataccttccatttagttttgttgtggatgttggcgatgcaatgccccaaatctcattaagcccatcaattaaaattcaaaaatataaaacatgaaaactaaaataaagaaggtctgaaatgccctttaaattttgctgaaaatcatcacctcctcctctgggtccagacagggctagacagaggcttgcctaatgaaagtgattgtcttagatttgaaactttgcctggtttcataaacttgatgatgttttcaagaaaataaacaataagaagttaagtaagtgctgccctgccttgtctattgtgcaccaggcacacatgaagacacaagggccttcccagcccactataacccagatgggactcaggaagaccccacaagggcctttccagcccgccattgacaagatgagactcaggaagacacaagggccttcccagcccaccatcaacaagacgggactcaggaagacacaaggaccctcccagcccaccatcaccgagacgggactcaggaaaacacaagggccttcccaggcagccatcaccaggatgtgactcaggaagacacaagggccttcccagcccaccattgacaaaacaagactcaggaagacacaagggccttcccagcccaccattgacgagatgagactcaggaagacacaagggccttcccagtccaccatcgacaagacgagactcaggaagacacaatgaccttcccagcctgccatcactgagacaagactcaggaagacacaagggccttcccagcccaccatcaataagacgggactcaggaaaacaactgagcaaacatctgtcagtaggacacgggtggagacagactgtgccccggactgaatgtgtgagtcctcccaaaactcctacgtgatggtgttaggagggccctctgggacatgactgggccatcagggtggagcctcaggatgggattagtgcccttataggaagagactcaggagcccaccctctgctcgcccctgtgaggtcccagtgagaagacaggcctctgcaaaccagaagcaggcgctcccagacaccaagtctgctggcaccttgaccccacacttccagcctccagaaatgtgaaaaataaacatccattgtttaagcccgaggctgcagcatatttgttatagcatcctgagcggactatgatgaatagcatagccaaattaggataactggagagggatggcttacaagggcaagggtcaggcataaggaaccacaggaagaggctctctagttcagcagtaatgtcgtcgttagcacccaaggcccaaacgaggaagcagagtcatgcatgagagtcaactgtcaggaaacagtgagctgcagcccaaggacaggccagcgggggctgtcgccagggaggaagtgcagtccacatgccgtctctatccaagctccagctccctctgccattctcctgcctcagaacagggaaaaggtgctctgaagctgcgctcccttccactcagccagagaagaccagcagaccaggggccagaggcaggtgagtcaggacagaggtcaaaggacccacagacctgtgggacacagagcaggacgtggagggtgggcaccccgcagagcacccggcctcatctgccagcccagcaacgagcctggactgtgctgcaaactcgattccttgcatataaatgtgaacattaggctaaatgacccttacattaccagtttatctcaccagcgctttcagcctatttcttatttaggtctctgataaatgacttcatctttatttatgaatgttcctttccctgtaatatttgctagcttcaccttgacctcataaatgtaatttgttgtttcaaattctagtagcagaactgcattttaaaatgctgaaaagccatcactttagagctggtgagagaaaacattactttttttcattactcatttcttctagatttggaagcaaaatctggctttccaagcacggaaggagtagaccaccacagggacagagggtccccctgtggagctctcttccggacgctggcggaaaagagcacagctcgtgcacctttagaatcagtgcccctttttaggggccccctgtaagtggctttgtttctggaaaatgtggggacacttttcatactcgacgtagcccacagccaggtctgtgcaccgcatctcggaaagtgtttcgagacctgctcgtccggtgactggcgcacgctgcgctccctcacaaacactaaccccagtggttctcctcccagcactgcccctcacccctgcgcggcgtgtccctctgggaatccactcgcaggcgacctccagcgtgtgtctacttgctgcttctgtccctgttaccaccaaggctatggctgcaagtttccaaggaaaaagcgcagcctccgtgggtcgtgatttctgtggcttctataatgcgtgtgtgcctctcccagccgtcacacatggcgtctcaagtgccccagcccacccatgggacctgcagagacgcatcccagcgccctaggcactgagaataggtgggcgctcacctgacagtggcctcccatcctccactgccttgagccctttcccatgcactgcactacggacaccccagccactacctcatcccaaaagcaggcggcaccacggggcgggaagaggaactcaggtccgtgaacacctgcctcgtgcagggccctgactccagtgattctcgcagcctcgtaaccccaacaacaggccccggagctcagctttttattcccacttcacagatgagggaacgaagacacgacccacccaaactcacaggtgggcagggggtggtctgactcccagcccagtcccaggacctgctggaagtgaggcagcacgaaccccccagggctcagctctccaaatccaaaatggaggggtttcccttcacccctcagcgctctggagggaacgacaactgcagattccaaggtgtttcagggaaaagccatgccccccgtgtcagccagcacagcctgcaacgaccacactggtaacaaacaagtaactgtcccattttccctgaactatgtcttcaatttcatctaaaaatggaactatgaattccaatgagtcagagaatcttttaaaatgtatatttaaatgcactaagatattgagttgctatatatcacattcaccctctaggcacctgaagacacaagtgacagcaatattggctgtgtgcatttcattaaataggtttacccccaaaactgtccacttgccttttaaacatccttagggttgctgccttcaaaaacaagccttttgtttccacagagaaatgcatgcaagtggctcctccctgcaaatcagaacatctgaccctggcccagcaccggactcctgtcctggatgtggtctcaacagcacagccttggagcaaacccagggagctcgaatgagtgacggtcctggtgtgggttcagccataacctccaggacagatgagagcaggcacttctaaagggtggcccttccgagagggaaaggcctggagccttacgctggagcatgctcactctgggggtctagcgccgagtcccgggtcctgagggacacactgtgagcctggagttggtgacggctggggacatactgtgagcctggagctgatgacagctggaaccggacggtgcactgtgagcctggagctggtgacggctggggacatactgtgagcctggagctggtggctgctggagacatactgtgagcctggagctggtgacggctggaaccagacattgcactgtgagcctgcagctggtgacagctggggacatactgtgagcctggacctggtgacggctggaaccggacggtgcactgtgaacctggagctgatgacagctggggacatactgtgagcctggagctggtgacggctggggacatacggtgagcctggagctgggactggctgggacaggctggtgctgtgtggtctggtcagtgtccccacgtggctgctgcagcgggtgcctgagtggcctttgcagtcacacacaggcagggaccgggtcccatgccctggctagccaagggcctcactctgcatttcctcatggttcttgtctctgcagccgggggctcccaggagcctcgggcccaccaaggcatcaccctccctttttactccaagcgtattagggtctcctgcccagaagtcactgtcaatgcccttaacaaaaagggctgtcagcccctccctcgggccagaggagccctggagagctaaggttcctggggctgcacaagctcagcccccagcctctggggctccatggctgggcccagctagagagtctataaatgtggaggtgacgtgctgggtctcggggggcaatgaggagcccaggctgggccccccacctgtgctccatgggaggaaagcacatggccaagggggggtttctttggaggtggctctgctcccacccatgcccccaacacgcgtaccctccaaagggacagcagagcgtcaccaccccacatccagacgagaccacaagggaccctggggcttcgggcaggggtggggtcgccccagggcccaccgtgtgtgtctgcatggaggaagctctaacacctcccaccgccaaggtctcttctgcccttaaaattccatgagcttttccttcagtgtggaagaaccaacaagttctcggggcctccatcgacctgtggggttagcacttcggtttggctttctccattaggtcaccaaggccaatgtgccccagtggctggtaacaacgtgtgccacgtgtccagtatttaccgagcgccaagcacacaggtgctgcccacaagttaccttctttaatccctactaccacctgcaggataggaatccacttttttgcagacgggcagctgaggctcggagaggttaagtgagctgctcagggctgcacaggtgctaattggcaatgctgggatttgaatccaggtctattctgaagcctatggcctttctatttgccacaaatcatctaagtattcataaacactagtgtgcctggcacctcataaatcggtgcttctcatgtttgtcttgaagacatagggtaaattttttgctgtaaatttcaaagggacattcaaattctttggtttctctagggctttgatcatcagcacgtgcttggaactgtcactcagaactctgggctgtggtggcatttagtgcactgagttttgacctgtcctgagccctacaaacctaacttgttgttttctaaaattaaggccaaaatgccagcaaagcaagcattattccacccggttacctgcccacatctgcaccagacactgccaccgagggtccactggctccgtcctctccctcgtctgtggacctgaaacaaacatcacttccaccctgggcaaggtgtggctcacacagaacatcttcatagtaggaaagctggcttcggttctcagcagtgaatattcagattccacagccatctggctgtcatttcacaagctctttgcaaaatctggctataattctaccaaggtacgaacgttagttaatctgttgaagacttagctaagtgaactaaagaaaattaaaacacttgcttaaagcttgccgcagctcagaacccaaaagggctgcggacgcataaaaggggaagtatcagaggagaaggggccaaggccgctggggaagctgagagactgcagagcaccacgcatgcgcatcacacctgcttccaattcagggagctcagaactggctagcatgaggcttgttaagtctgttcatgaagtaaactggcctagctcacttcagaaaacagcaaggctttattacaaccatgaattaacagactgccaattgatatgctaattactaacatttctatatatttgtcaaataagatccctaaggaagaagagacaatgtgactatctggcttgagttacagtctttaacaaaataaaaccatgagttttctagatttttcattaattcaaaccagccccttctttttttgttgttgttgttttgtgttttttgtttgagatggagtcttgctctgtcacccagcctggagtgcagtggtgcaatctcggctcactgcaacttccgcctcccaggttcaagcaattcccctgcctcagcctcctgagtacatgggattacaggcgcacgccaccatgcccagctaatttttttgtatttttagtagagttggggtttcaccatgttggccaggctggtctcgaacttctaacctcaggcaatccgcccacctcggcctcccaaagtgatgggattacgggcgtgagccacggtgcctggcctttttaaattgatttcctactcttactgggacataagaaagctatgcaaaattcttcagtgcatcagttatgggaaagaaggaaccaaagcgcagaagggatgtgcccagcgccatttttaaatgtagctgaagaggctgcagcagcgtccatccctctcccagcggagcaacgctcaacccaagcaagtgagctccctctctgtcaaaaactctgcaagcaattttttcctctccttctaatattaaattgtttctgagtttgtcaaatactcacaagggaagttttctacgacattgatgtgggtcaacagcaagtccatgtccctgggttctgtttgcagaggaggattcctttcccatctgtcagggcaatgctgtggaattccaaagcccactgtctacggaacagccagcccattactggacatcaaaatgcctggacttctgagctccaaagggcatcaggagatgggggagccgcagagaccacaaagccccagctctcagctcccacgtcctcaccgcaccccaaagacagggaatgtcatgcgccgggttgggtcagaataaggaaaggttagaaactcttattttcaaaatagtctagccacagttttcttaatgaatgcctttatcagatttcatttgaagaaaaggtcttctgctttaaaaaggctgctcttgttcagtccattcgcttttcaaacaacaaaactgaggcccaaagaaatgaggatgtggctgcagacagcacccccgagcacggagctcaccttagtgggttcaatacgccagacacacctgcctccaaccctccccaccccgaggctctgaaggtgggtgggaagaaggaaggcccggagggaagccgccatcagctcagccacccacaacggccgccccgccggctgttcccagcagggctgtgcccctctagtccttggatggattttgcagagccttctaggaggcctgtctgccacacacgtagctcaattcagttttgcactttgttttccttcttgtggtaactaaaaacactctggcatgtaattcaaaaacagcattgagggtaactgcataatgtaaaaaaactgttaccaagatggcagaacatttgaaattatatttgcactttgggacatacagataaaaatgtgatcttatgttaagtgctgcattttccaaaaccacgttaaatttatgtgtgaggcctcgttgaacatgtagtaagtggatgttcttaaaattggctaattccatgtcaaggtttcatcagacatttcatctaccctctaaaattagtttgtcaaaatacacacacagttgagtcaatctctttcctcacaaaaatctactgagaccggatcttgtctgggtctcggagcccaggacaaggaaaggggtcagcctcccggctaagctgcctctgcaccaggctgcccctgcccacaaggcaaccctcaagaagcagctccgcactgtgggtggactgagccactgggcattcctccctccaaagggtccaaaaaccagggcagccccaactggccgggaaagctcctctgggctctgcccctctgcacggcaccagagttgtgcaaggaagcagaggaggcggtgagtgccccacgctcaggagtgcacccggtggagggggatatgtacacccgcctgggaggggccagaacccagtccacactctgcccgcatgatctgcctctccccaaaacagactatcattacccggtgtgactgggccaatgaacccaaaaacaggaacggcaacgttgactctaaagcaagcgtatccagcccacaggccacggcccacgagatggctctgaatgtggcccaacacaaattcataaactttcttaaaacattatgagattttttggccgggtgcggtggctcatgcctgtaatcccagcactttgggaggccaaggcggatggatcacttgaggtcaggagtttgagaccagcctggccaacatagtgaaaccctgtctctaataaaaatacaaaaaaattagcctggtgtggtggcacatgcctgtaatcacagctacttgggatgctgaagcaggagaatcacttgaacctgggacgtggaggttgcagtgagccaagatcgcaccattgtactccagcctgggcaacaagaaccaaactctgtctcaaaaaaaaaaaaaattatgagatttttttgcaattttttaaagctcataagctatcactgtgtgagtgtattttacgtgtggtccaagataattcttattccagtgtaacccggggataccaaaagattgggtgcccctgctctagagtgaacacagaagcactgtctggggcacctgttgtcctggggttcaaagccgctgccaccttcttcccttgcagttttctgctaacacttacacctgcccacactggtgctcacactcacgtgatcacacccactctttcttcttgtggaaagccccacgtggagcagaggggcatctggagctcctgcccagaaatgggaaggtgatctgcatcctcccaggccccctctggaagctccaggtccttcctgactccagcccagccccacccacggcgaggaaggcacctgctcggacacacctgggagctggctctcacttccagcctcaacatccaccgggtttttctggacttagctggctttcactgattttttcttttttgctaaaaggaactagaagatataaaacctcagagcctctatccacccagtcttcatctgagaaaagcacaaataacagattctttcagtttgcctgtgtctctcaccactaagctgtaagaagctccctccaaatgagaacgtcacacatgcagggaccagtcctgtgctgcagaccgacgcagtgggaggccacatgcgttcctcagcagctgcaaatacctgtttcttattcctgttaccattttctcgtattctcaagtagaactgtccctacatttcctttccttttctgcacccttccaggatggatgtgggtcacttttccaccctgagcagccgtctgcgggcctcagggtttgcgctattctggaatatcgttggtggggctgttcacaccccgctccgtgtggctgatgaggagctgagggccactagtcttgtcttggtgaaatcacagagcaagtgaccagcacattctctgaggctctggagttgctgtcacccccagcaatcctgtccctgtttccttcaaaatttcaaatcttgccaggcccagtggctcacacctgtaatcccagcattttgggagactgaggtgggcggatcacctgaggtcaggagttcaagaccggtctggccaacacggcaaaaccctgtctctactcaaaatacaaaaattagctgggtgcggtggcacgcgcctgtagtcccagctactcaggaggctgaagcaagaggatcgcttgaacctgggagacagaggttgcagtgagccgaaattacgccactgcattccagcctgggtgtctcaaaaaaaagaaagaaagaaagaaaaattcaaatcttaattacaggactttcaaaattccaggaggtaatttacctccagcaagggctggagaccaaaaaaactgggccaacggcccacaaacacgtgagccaggtgaagggtcatgcagaaaagcaggactgggtgtgagcatgaggacaggaagggggaaggggctggacacggcctgtctcctccctgagaggaaccatcagggagcctcggtatcagcatcacactcctggtgacagggacagagacggctccttccactggatgtacagagcgcttccagcagcttgagcttcacgcctgcccggagacggggtccgcgaggtgccagctttgcactgtcaaagggaatccctcccaggggaggacggactgagctctcagagtcctttgggcaccacagcccggaatggtgctggaatcacagccgccgggttaaggggctcatggcggaggcaagccccagtgtcccaggcgccatgatgtctaagtgactatagggccatgaagaaggggcctcctgataatccctaccagcagccaggaagcaccctgggaagcccatcgcctgttgccctcccaggccacaccttgacgtgggaggccacgggacagacgccacctctcccgagtagcaggtgggtgactacagaggtgctctgagggtcttaggcagagctggccatgcttgccttggtgaagaccccagccaccagcctgggaggcccggtcaccccacggccagcgcctgccaagttcttgtgagttgagcacgtctcacgtatgcaccaacatgcagatgcacacacagggcatgggcactccagaggggctcagcttatggttaacgctggggctgccttcatctcacgcatgctgggcagcctgggcacctggggcagggctgggggacagcccagccatcttcagggccccaggtgaggccacagccagcccatgcagagctcagagctcacggcagagcggcacagaaagaagctcagacccaggccctcctgccaggcaaggcccccggactcactcaccccacaccaccgatgtcaggggttctgtgcaggcaaagtggccttctctttgtattgattttgggggctttgttttttttaactaaacttttttttaactgtggtaagatgcacataacataaataaaatttactatcttatcagttttaatatacaattctgtggcattcattacattcactactatacaaccaccactgccatctgtctctcaaactcctttcattttgcaaaattgaacttcattccctgtaaatgctgactccccagcccctggcacccccaatcctatgctgactccccagcccctggcacccccaatcctacgttgactccccagcccccggcaacaccaatcctactttctgtcgctgactctgacaacactaggggctgctataagtaggatctcacagtgcttgtccttccgtgtctggcttattccattccatataatgttctcaaggcgcacccatgctgtcgcagaggtcagggctctttgcgtctatttttaaataaaacaccagctctggcttcaagggaaaggggcctgttggaggacggaagaggcagggaccctgctggtggagactggagccctgggaggcactcctgggtcttccagtgggtccagcagaggctgattcatgctagaaacaagggactttccatgcagggtccaggaatgcctcatcagccccccaccgtaccccctgtccacctggcctttgaggctgaaacactgcactcaagagcactactctgtcccaatatcaaggcaacgcttctcaaggacatgggctggcccgagtatcagtttgcagcaaaaactgtgaagattaatcaaaagccacctcccccagggaagctgtgactcccaggcacgaccttgcccatgggggtcacccactccgacccacaggggtggccgaggacctggatcccggggctgtgccatccctgcctccaggccagacatccagcaggtttcccaggaatctgcacacaagatgcagcaccctcggctcagactcaaagcggccagcaggagcaggcgacatccactctgcattgtccatgctctcctcatgtggatgaggagcaggaccagcactggaggagatcaggatcctgtcacaatgtaaggtcatctgtgcctagtggatcagacgctgtgaagaggagtgtgtgcaaacctcactgctctgaacggccctgatccaagagcagccggccccgattgtctttggttaccaggaaatgttagcagatgcagtccatgcactgccaccgaggtcactggtgttccttttctctttcaaggcattggtcaaactgagtgccttccagcatcttccccagagagcaccacccacaagggtgcacatgggctctgccatgctcccgttcctacctgccactccaccgagctccgcccgctcttggtgacccctcagcgatgaccagggggctcttcctacaccaaagcctctggctgcaagcacatttcttcatgactttctctttcttaaaaatgagtgtaaattttgcactcttctttgtaacatatgcctgtgtgccttttatgataaaggtgttttcttccttttcatcagatacactggatgctccaagaacaacacgggttctccgtgtgacttcacactcccccagcatgactctaagcccagtgtgggaccagcgtgaacccaggcggcctctagaggggaggcaggagccgccctgaccaccaaagccagcgcaggagggggctctacaggatgatgtgttgagtgggcacaactccacaaaggagaggaaccgcagtccgtgccaacagcctttcccaggaaagaccttccgggacctgccacccatctcctccttggcaagaccaccccagcccaggcacggccaacgcccggcccccgcttgagttggccttgagctccctccaaagaggagatgcagacagcagtgccaccccaggggggccgagggagcaggactgagaagctggttttccacaggttcttgtcatccaaggcgagcacaagcgggaaagaatggggctggaatgttgggagagaagggagtgtgtgatcagcattgtctgcataaatgattcaggctttttttaatgaaagaatcttatttttgaaactgaagttgacataaaagctcccgaagtgaatcagacggtggtggcttctccccaccatccactcggcaggggacagggtctccacggggagctggtcaccccacgtggacgccgtgccctgcctcctctggcgagctttgtgttcaccgggcggattctggcagacaccggtcccccagttgttgcagcgagactcagacccaacccctgaaccccagggatggcgcctcactgagtccattggatccgcgaagggcaaaggggcagccgtgaataggtaaaattcccgtaagctacggaggttctgctggctttgtcttctcctttgcaaaagcaaagtcctgcggaggctgggcttcgcctgagcgctcgctagggtggaggaagcagctgtgggcctgcagccagggctcgctccaaacgctggaagctccgcctcccagaggagatcagcccaggagtgggagtgaagaacttcgctccatcacaaagctctgaaatacagatggcttcggaaaaccccgtgagaacaccgattcactcctcctgtgagatgggactgcgtgtccccagagggctggcaactggcctccaagttttcctcttcctctttcttcctcccaagagcccaattaagaacttccagagtttagaaatgacttgggttgattatgtgtgcatgacgtgacctcactagacccagcacgaaagggaagcaggcctgggagccctcccccttgccctcgtcctggggtctgtgccgcgcctcgccgtcctcccctggaactcggggctgggagaggtcggcgtcaggaaggacctcatggggctttcacacgagagcacacatcctcagagccccccagcctcgttctgaaaatgaaagacggagatagcctgtgctctgagggctgcgcaccaggcgtcggggtggagattgactcctcgagctcctcggagccccagcgggtgccactgcccgccggctgagcccacgtcccgataggaagcctggggcgctcgcaggaagggtcacggatgctgcccggctccccaccagcctgcccctcaggacatctcctgaggctgccactgggaaagaacaaacttgggaatccaagatggagggcagcaggacgctcccacatcccccactggtcacttttggaagccatgcactcggccccagggcactaggcctgagtgctttaacacccagttcaggtgcctcccctaagacagggctgaggtctgggcagggagaggggcttgcaggcccacaggcccactcatggctggcgtggccacccacggagtctaactgcaatgactgagaacacaggcctgcccgaggctccccgggactcagccaaaggctcccagacgcctcccaggtggtttgacttttgcatctctgggaattctttcagcctcttcgtttattcattttacttcccctttacttgaggtggctttgttttcttttcaatgtctaatctatttctctcataggcgtcgttaatgggctgggacctgacttcctactaagtgtaattacctcgtctttaagtgcccttttcagtttttaaatcctgctgctgaaatccaacactggggagatgtcgtgaagcttttttaactccatcaggcggccgtcgcgcttcccttcacgctttccttcacccctccacggacatctggccctcatcccatccatgagtgacccacacagcacatttccagaactggcatttgtgacaggacacagcagcaaggaggcctgtccaccagcagcgaccgtgagcacggggcccttggagaaggagggaggcatccgcaccagctgctgtggcagaacaccagggcagggcagctgcaacaaccgacactcgctttgcacagctctgagactggaggtccaagatcagggtgctggcacagctgggctctggtgagggccctattcccactgcggatggtcactgccttgctgtgtcctcccatggtgggaaggaggagggcagccggctccctcatgatgctgtctcatggtcttgcctcagagccactctcgtgacctcacccaaccctaatcacctctggaaggccccgcctcctaacccatcccatcagggtggggctctaacacatgcatttgggggccccagctcctaacccatcccatcaggggtggggttctcatgcatgcacttggggggccctgcctaacccattgcatctggagtggggctctaacacatgcatttggggggccccagctcctaacccattgcatctggagtggggctctaacacatgcatttgggggccccagctcctaacccatcacatcaggggtggggttctaatgcatgcatttggggggccctgcctcctaatccattacattgggggtagagctctaacacatgcatttggggggccccagctcctaacccattgcatcagggtggggctctaacacatgcatttggggggccccagctcctaacccattgcatctggagtggggctctaacacatgcatttgggggccccagctcctaacccatcacatcaggggtggggttctaatgcatgcatttggggggccctgcctcctaacccattacatcgggggtagagctctaacacatgcatttggggggccccagctcctaacccattgcatcagggtggggctctaacacatgcatttggggggccccagctcctaacccattgcatctggagtggggctctaacacatgcatttgggggccccagctcctaacccatcacatcaggggtggggttctaatgcatgcatttggggggccctgcctcctaacccattacatcgggggtagagctctaacacatgcatttggggggccccagctcctaacccattgcatcagggtggggctctaacacatgcatttggggggccccagctcctaacccatcacatcaggggtagggttctaatgcatgcatttggggggccctgcctcctaacccattgcatcaaggtgggtctctaatgcatgcatttgagcccccgccaccgcctcctaaccacaccccattggggtggggctccagtacatgcatttggggggccccagctcctaagtcagcctgagaagatcagtgagaaaggtgaccatacattctggcaatacatactgttttttaaaaaataatttttctctagagactaggtcttactctgtagcctaggctggagtgcgggctggagtgtaggctggagtgcactgatgcaatctcagctcactacaatctcttcctctctggttcaagcgatttttctgcctcagcctcctgagctaggattacaggcacccaccaccatgccctgctaatttttctattattggtagagatggggtttcaccatgttggccaggctggtctcaaactcctgacctcaagcaatctgcccacctcagcctcccaaagttctgggattacaggtgtgagacaccgtgcatggcccgatactttcataatcaaaaaagtgtctacatacactgacaacaaccagtaaagaccacacgttttgtgcacttgacatgtgcatccaagggctcctgacaccccagagaaaccctagagagtggacactatcctccgtgtctacacactcaggcttaggagtctgcaccagcctccctgtctacacaaacaggcttgggaatctacatcatctttcccatgtacacacacaggcttgagagtctacaccacccttcctgtctacacctgcaggtttgggagcctaggctaccttccctgtatatttccacagacttgggagtctacactaccttcctgcgtacacacacatgcttgggagtctacaccaccttccccatgtacacacacaggcttgggagtctataccacccttcctgtctacacacatacaggcttgggagtctacactaccttcccctatacatgaataggctttggagtctacaccacattccccatgcatatacacaggcttgggagtctacaccacactccctaagcacacaaaggcttgggagtctataccacactccctgtctacacctgtaggcttgggagtctacacgaccttccctgtgtatatgcacaggcttaggagtctacaccagcctccccttatacacacacaggcttgggagtctagaccaccctccttgtctacacacacacacaggcttgggagtctacaccacctttcctgtctacaccaccttaactgtgtacagacacaggcttgggggtctacatcgccttccctgtctacacatgcacaggcttgggaatttataccaccctccttgtctacacacagaggcttaggagtctacaccaccttccctgtctaaatacgcacaggcttaggagtctatatcacccttcctgtctacacgcagacaggcctgggagtctacgccaccttccctgtctaaatatgcagacttgggagtctataacacccttcctgtctatacacaggcttgggagtctacaccacccttcctgcatttgggggatcccagctcctaacacattgcatcgggggggctctaacacatgcatttggagggctccagctcctaacccagtgtacacaacttccccatgtacacacataggcttaggagtctacaccaccctccctgtctaaacacacacaggcttgggagtctataccacatttcctcatagacttgggggtctacaccaattttgctgtgtaaaggcacaggtttgggagtctacattgccttccctgtctacacacacacaggcttgggagtctacagaaccttccttatataccccatctcttctaaaaatacaaaaaattagccggatgtggtggcatgtgcctgtagtcccagctactcaggaggctgaggcatgagaattgcttgaacctgggaggcggagttgtagtgagctgagatcgcgccactgcactccagcctgggcgaaagagtgagactccgtctcaaacaacaacaacaagaaaaacagagaccgaaaccagagagggtccttgtgcaactttgttttctgtccttggtcctgaaaccaggagacaattggttggttgtttagggcactgatgattctttaccagtatggtaaagagggtaattgctctgggaggtgaaaagtgcgtaagaattttgatcagtatctgtctatctgccatctatcatctgtctcatattgctttatctgtgttctctctctctctctctcccattatttattttctgagggtagagccttgaatactgggttttaaagttcttgattgctctcagcttgttctgggcacagaggatttaaggaatatttgagatttgaacaaaactgaaaaaagaccaactctgctagtcgcggctctggcccccctttttggtggagggggagtgggatgtggggttcttcggcccatgcctgctgctggccaggcccttccaagacgcagtggcctgggactataggatgtggctcccccgatccagcgcaggagcacagcccctccatgggctgtgtctggaatgccgcacatagccatctctgccccaaacagcagccccctctatatgatggggttttcgctcctgccagcagcacagacagccgcctcacctccccagcatcctcccagggaggctgagcccatcctcacccacgacccggggacacgtttaatttatccggcccctcctcgactaccaactcccctcaccggagatgcctgcctgggccctgaattctgaggctgcccacagcaagcctgatacagagtcacacaccagatgcacattacaaagagcgtcacagtggaatgagaggaaagcctgtgagaacaaacggatctccggtgctcagcagactgatctactgcaaatcacccccgacgcaaccaccaactccgccagaggaaatcacaagttttccatcttcagcagctcttacgactgcaagatcccacagctgccttttgggggaggttggggcttatgccttagggcgccagtcaggtccttccaggagaaggcggcaccaagcccagcgtcgaacgaagcaggtccttctcccttcacaagcagcatccacggctcagtggtgcccctcgcccccaccgctctgccctgccttcctcgctgaaacctcccaacactgacgtcaccggggtggggcaggagcaggaagaggcccatgctgccatgtcccatcccaacacaggggcagtcctgctgccctttcgttctctcccattgtgcccttggcagaagaatatatttccactcaactggcatcttccagctgtcccccagacccagcctccctcagctcccatggcagggttaggggcacaagcaccgcccgtcaacccttcacagaagctggcaacagagtcaggaatctgaagggtaaagggagctcttccgccaacaggtggccggtgttgcttcccagcgggttccacccactgcctagcaggccatctacatggggcagaccacagagacaggctccagcaagctcaggatgatgaagacacatcctatcttcgaggacccagctcgcagagaacaaaatctgtgaacaataatcacaacatggcacacacaacacacgtcccaaaataaatcttcactaggtacagagttggcaccaaatggctttctcctacaaaatcaaaacagccttggaatgtccttctttactagatcaacagatggttgtcatagatagatagatagatacctaataggatagactagatgacagatatagatgattgataaatagctgatagacattgttagatgtgaaagactatgttctattgatagatgatgatagataatgatagaggatagatatagatgggtgattgataggtggatatagatgatggataggtagacgattgacaggtaaagatagattagatagatagatagagatgattgatacgtaaagacagattagatgggctgggcatggtggcttacacctgtaatcccagcattttgggaggccgaggcgggcagatcacctgaggtcaagagttcaagaccagtctgggcaacatagtgaaactacgtctctactaaaaatacaaaaattagccgggcatggtggcgcatgcctgtaatcccagctactcaggaggctgaggcaggagaatcacttgaactgggaggcggaagttgcagtgagccgagaccacaccactgcactccagcctgggcgacagagcaaaactctgtttcaaaaaaaaaaaaaaagatagattagaaagataagttatataaatagatgtttgataggtgaatggagatgattcaaaggtagataggtagaggatagacagaacaaaacctggtctcctcccctcagagaacactgcagctcccgcgcaggtcagacggctcccgggcaggtcaggcggctcccgggcaggtcaggcggctcccgagcaggttgctcccacgcaggtcgctcccacgcaggtcaggcggctcccgcgcaggtcgctcccacgcaggtcaggcagctcccgcgcaggtcagacagctcccgggcaggtcaggcggctcccgtgaaggtcagggggctcccgtgcaggtcgctcccacgcaggtcaggcggctcccgcgcaggtcactcccacgcaggtcaggtggctcccgcacaggtcaggcggctcccacgcaggtcgctcccacgcaggtcgctcccacgcaggtcagagggctcccgcgcaggtcactcccaggcaggtggctcccgcgcaggtcaggcggctcctgtgcaggtcgctcctgggcaggtcgctcccgcgcagggcaggcggctcccgggcagggcaggcggctcccacgcaggtcaggcggctcccgcgcaggtcaggcggctcccacgcaggtcgctcccacgcaggtcagagggctcccgtgcaggtcactcccaggcaggtggctcccgcgcaggtcaggcggctcctgtgcaggtcgctcctgggcaggtcgctcccgcgcagggcaggcggctcccgcgcaggtcagacggctcccacgcaggtcaggcggctcccacgcagtttaggcagctcccgcgcaggtcaggcagctcccgtgcaggttagacatcttttctgccatcatgggctctgattccccaacctggtgccatggtccactcagtcgcttcttggccctgcaggtacaagccagccagtccacaaaggtcacggccgccgctccgctcaacccgtggctggctgtgctcgggtgtgtttcctcacctctctctctgaagagctgagaacaggcccctcctggcctacgctttctcatcatgtagctgtatttctgggctcacacctttagaacccactgagatttctaaagctcctcctctagtgagcaacctgggatgtttgtgctcaaagaaaacagcgtttccagagcaccatggcgcctagaagtgggctggccaatgtggtcaggaaggaagggtgacttgggaccctcacactgactgtgcatggaaacccccgtggtccactctcctagtgaggcacctcgccctcttcccagcattcccagcagcactattgataaagctctcctggtaaggcacctcgccatcttcccagcagtagctattggttaacttcatagacccccttttaaataattctttgtatttttgtttttagagacagggtctcactctgttgcccaggctggagtgcagtggtatcatcattactcactgcagccttgaacttctgggcttgggggatcctcctgcctcagcctcccaaggagctgagaccacaggcaagagccaccacaccccactaaatttttcattgttctggagagacggggtcttgctatgttgcccagcctggtcttgaactcctggcctcaagcaatcctcccacctcagcctcccaaagtgctgggattacaggcctgagccactgcacccaggtcttttaaaataattcttacataacaggtaacttcagtccagacacaaatactaaattagtagactccaaatgtattgttggattgtctctagcctatggccatgttctcttctttagatcctgaggccgcagggtgcagctttccatttgtaaactgtccctggggtgctgccccagggggtgctgagcagtgaacactgcccagctaccagttggtcccagggacatgaaggcctggcacctgcagagcccagcggaggcagggtacctccagccaatatttccaggcacctagaggcaggtgtgtcctcacaaatggagcctgtgaaaaaacaggtgcagcaatgagggacccaaaggtgagcagggaaagagtctccataatttggcacagagaggagcaggattctcctcagtattcacgccaagccaggcaggtccttgcaccttctggatacatcagtgctagactaaaaaaaaaaaaaaaaaaaaaaaagcagtaatctggagtccttcctctggggtgccactcagcttctctggacaggaggctctcagactgcacaccaagagatgaggcccagaagacagagacctctcacctcttaacacctccccaggtctgaccaggggttaattatgactgtatgtcatgtttccaatgaggaggagctggatccccgaggtctgcaggcagcagggaggggccacactggggggtccagaggcccaggaagactctcaaacccagacccagtgaggccctgcctggccccagatcccgacagagcagaggccacaaagtgatggttctcccggagcccccagcaggaattcttccagtgcttggaggagattcttctctcatgttttctttgttcttcatcaccccatttaaaaaggaataataagaaaaatattttgtataaaaatgaatttctattgctctcattacacaatgttttcttaaagagaagcaaaaaagaagaaaataaaatgcattcaccacatcctactcatacttctcaacactgtaatattttaacgatccatatgaggtcataccatatgtacttttttgatacctgactttttctttctcagaatgacacacttccatctttccaggccaatacccagcctggcaggactccaccatgaggcacatccacttgttcacctgcctccctcttaccgaatattcgttcccaatgcaaataacgactgtcccatcgcagggtgcagaggagataggctgttcactcagcctgagcagttcctctttctgagatgtgaccacaggaggtgaccgcggggatacctcacccagccagcttttcagggccccctctgaggctgcaatcacccctgcatcaccttttggccccttccctgccactccctctcacagaagtgatgtcagtaaagaatggacacaggctgcctccctcatgactggggtccttggtcccagggaccctggaaggcctggagcaaagaaggtcatctgagaggtgaggcgatgtcaaagaacaaaatcctcccagctgttgtctccccacttacatatttttttattgtggtaaaaatagaataaaatgtaccatcttaatcatttctaaatcttcagttcactagtgttaactatgcacattgttctccaacagatccccagaattttctcaccttcccaaactgaaactctgtcccgattaaacactgactcccctttcccctgctccgttccactttctgttcctgtgaacttgatgattctaaccacctcgtatcaaacagcatttgtccttttaggaccggcttctttcactcagcataatgtattcaaaggccacccatggtgtagcacgctgaagactgggtaataagtccaccgtgtggatggatggaccacatcttgcttaccactcatccgtcagtggacacttgggtggcttctaaccttcggttattgtgaatagtgctgctatgagcatggatgtgccaatatctgtccaggtccctacttctgatggtttcaggtatgtatgtacccagaagtgggcgtgttttaacgcttacctcatatagtttctgatcatgtgcacgaacacttagagtaataggcaaatgttttggcctcgctaggggacaaatggggggtttgcttattttacatgaattgctggactgctaggtgaaagtggaactgatattctttgagaccctactaagtgtcaacatgcagagaacacaacgtgtaagaacggtgaccacttgcgctccgcgcgcaggactgtgctgggaccgtgtggcggttcctcactgtgtccccaggcagtctcacaaggcaggtgtggccatcgcctcaccttcagcagaaacccaccatgagcaggggcacatgggcggcacttttcatgaagccctttgagaacagacatcaaccatgtgaatgttactccttaagttagagccaaagatatttggtttgccaaaaacacatgactagaacactgcatcttgaacagctttaaaagaaggcagctgtcctaacctgcatcctcccagcagggtacaggttaaaaaacctaaagcaacgcagccttgcatcgaagagaaatcttgtccatatgttgttccttcacgtgtgactgggcatcggttgattaatctgatttttgtagtccatgcatgtcaataaggcccattcacatgtcagaatgtgcacagggttattctgttagtgtggcaagaagggcagggcctgggaatcgggagccctgtttctaattttagtgaagtcttccacccttgatcttgatgaatacttgatcaagtcaataaatatcaaagattaagaaagattacgtagatcgggacattagattacttaattctcatagttccttgaagtcagaatttccaatgattctagaagtaataaccccagtaattctcattactacttcaaggtatttttgaaaattacaattctgtaacacccgttgccttagaagtctccccaggtctaagagataaacccctgcctgagaaaatccccctgacagctcttcgggggtgtggggctccttctgtaaagaggaaaatgccgcttctgcaggacatgggtgaccttgagcaactgcatgttttctcaccaaatacaaggaattttttaaagaaaagaccaaatggtgttacacaccagaaggtttgggtgatatttcaattttttttattttaaagcaagtataaactttttctgataattcattggcttctgcactgactcagaccttgatgctctaattgtggcctcaagactggcagctttggcctccccagggctggtcagaaatgcagaatattgggtctaacatacctcagaaaatgcactttgacatttaacaatcctgaatgactcaaaagcatagcacaggtctgtgcacagtccctgtgcaagacaagacacttccgacaggggagatggcccgggccaacaccaggaccaaactctcactaggggggaccgtgccaccccccacagtagcagcagctctccctacctcccatccccactgcccgtggccctggaacaccacaatttgggtgaagcattgcagcccagcaagcgtggtccccaagaagaggaacactgagaggaagctcactgagggctgagacactgagctgcagacctgcctctctctcgtgcgaagagattcacaaaggggccaatgaacacatgtcttttgagatctcatgacctccaagagaagtctctctgtcaggaaatgtcttagctggaactgtaacagaatgccacaggtcgggtggcctggaaacaacagaccttgatttctcacagctctgaaggctgtgaagtcggagagcagggcaccaggagactcggcatcccaaggtcctgcttcctggatcatagatgacgccttctcgccatggtctcactccatgaagggggcgaggaagctctctggagctgccttattagtgactgatgagctcgaatcccatcaggagcatccacctttgagaccttgtcacctcccaaagcccccatctcctaacaccagcatgtcaggagctaggtttcaacacatgcacttgcggggacaaacacccagaccagaacaggaagagggcaaatagccttactcctccatctgccctttacatgaaaaatataatcgtggaatcaactgcggcaacagcagcagaggaaatgcaaatcaatgcagcgaaacccagggcctgtcagcattaagacacccattccacctcccacaaacaaacccagtgttatgttaaagtttcctattattaatagtccatttagcacttgaaagccacaaggctgattgtgcatgaagccctgtgtgcttgcttgggagcctgaaggagagtgtgttgagtgataatggcgtgaaggcaaagctcttggaagaccgctggcctgaatcatacgtgaagccttgccacgtcaggatcaatgacgctcccaggggcacatacctcaacagaatgggacacagctcaacaatcccatgtatggacaatgtgaattaactaaacaacaaagccttcatcatgctgagtgcaggccctttaaagaccagaatgtgtccccatccgttccagcattagtgcatggcagaggccgagagcggagtgtttcccacagcaaatgtttcctggcccaggaaaacctacattgagggggcagggtgtggtcctcctggtttcagagaaatcaaccacggccacagcctcgtccacatagagcctctcgaagccttgcacggacaaagaaggtatctgctggtgcagtgccaccgaagaagagaggtcctacctgaaacctcacagggaaatttgtgccttctcccaaggcaggaccacaagtttgcagctcgagaccttgtccagggtcctaaaatggcttcttggaaaatatgaaattgctgaccgatccccagcatcaacttcgccaatagccttgtgcttctcgttcaaagcaagaagtacccaagtggaacgcagatacggcacgtcagtgagaacaaaagcatcacaaaatgcaagtcttattactgcagcagtttgcaagttggccgtgatgtctcataatatgaagtttgggtgaggcggtgccaaaacccagctggtgcaagctaaaaaaatgaccaagatataaggccgtggaaatgcaacttgattacaacaaacacttagtggagctaatcacacagcattcagatgctcccagcccaccccgatgggagtgttggatgaagaatcctgcagctctcgccggggacatctgaacatccttgttagctcagggcacaccctctgcagagactcacaggcatgtggcgtggcagtacatgagcactgatgtgtgaggggagaagagaggggccttccatctaggggcacagtctccctcccttccccttatccctcagattgtgaagaaacaagtgaggtctttgattagatgcctattttttagggaatggtcttttctgtttataggatctatgcatagcatatatttctaagattggggtcattccttacacctggatttgttctccagtaagtggttagaacttgggctctgatgccacagtgcctgggatgtctacgaaacacacatcatgacagctcctgcatcagggggctgctgggatgattaaacaaaattatacaaagatgatacaaagaaagggctagggcagcacttgcggggggcacagccagctctggatctgagttaactgttgccatacgtcttgttaatcacaggtctagggactgtcccgtacctccacacaaagacctacctcattctttccaacagctgcaggatattctgtggtgtgaatatgatatatttaactaacctcttgcttatgaaaaatcaagttgtttcaaatgagtattatgacaaaaaaaaaggcagcaatgaacacgcttatgcaaacatctttgcacatgtgtgcaagtaagtttgtaaggaaaattcctagaagtgggatttgggggtaatagaattgtacattttgtgatggatacagccaatcgacctgtgagcagctgagctgactcccacctccatcaccaggacgtgaggctgccaggcaccacccccatcaccaacaccagcaaggccagctgtgcggctgccatcccagtgctcctgaagcatggaaccaacacgaagcagcacggggctaggcagttgccagggagccaggagacgggtgcatgccaggccctggccccagcccccaagccccctgcccacccttcatgccccaggaatacctggcttgactcctcaccttccactgcaccctccagctccatctagaccctttccctcagcatggcagcttcacccacacatgtttatttaaagcacaggcaaagaatgccagtggtaaggccagagggcgggcagctcagcacggcagaccacagatcccttctcagcccaggaaatggctctgtggcccatatcagccaggaaaatgaagggtcacagacgccctgctgggagctaaagagaaatgtgtgcaaatctaaggagaaatgtgcaaggctcgtgccttccctgtggtgtgtgcctgctctttaatgagagttgcattctcctgagggagaccctgcgcaggccctgccccacgtaacggctttacacaaactctaaaaagtcatcccagccatgcatggacccagggatgctgacaccattcagaaaattgtattgtggaggaaggcaaggatgaaacaaacaaggcatggaggcttctgctctataaaactatgaggttcccaggaacatgacacagtccgtgctacatcagatctgagtatcaggatccagccgtatttgacttttagagctgcaatctatacaggcatatttgtggctacataaacatagattatcagaatggaactaaatatgcagcttttaaatacaaccacaccaaagggaactttgcaaattaccgggaactttgcaaattcccaggaactttgcaaattacctctcatcctgagaggtgagacagagccagctctgggctgtggctggtcatctcaaccccaggtgccacaggccatctggacaccacctctgctgagcacaaaggtggacgtgtccccaaaatagcagctttgctcagaattccaaacagggcctcagctcaatggtgagaaatcttaactcggacggcaaacttcccgtctgggatctgcaggcttcaacaactgtcaaagcacgggaaaatccccaggaagaaagtaagcaaaggcacggtagacgccaagggtccaggagtcgccctctgttacttcatgactccaacttactttctacacacaagacatagaaaccatctcatgcaagccccccaggaaccctggaggcaggcactgttcccgtagttacccgcacgtctagagactgtcccacatctccaaacacagatctgcctattgtctctgccagatgcaggatattctgatgaggaaaccgaggcatggagcttcttaggaactttccacaggtcacctgacactaagcccacaacactgtcctctaaatatttaggacacctatattttcctttgtgtcagccatttctctccctttaaaaatctctccctgagattatggataattttgataactttgagaatcaataaaattactctttttatccactgacatcagaagtggccaagcttggccgggcgcagtggctaacacctataatcccagcactttgggaggccaaggtgggtggatcacctgaggttaggagttcaagaccagcctcaccaacatggtgaagccctgtctttactaaaaatacaaaaaattaactgggcgtggtggcgggcacctgttatcccaggcactcaggagactgaggcaggagaattgcttgaacccaggaggaggaaattgcagtgagccaagatcgcaccattgcactccagcctgggtgacaagagcaaaactgtctcaaaaaaaaaaaaagaagtggccaagctttagctcctgagcaattccagaagagactcagccatcgagctgactgtagcctcccgaggacaagctttgggaaacaggccccatagcgggcacttggcagccccgggccaggcatcctgccacaagcaccgcacaaaaggtactctgcaggtgactgggcatttaaaggactagggagccctggacacttgaaactgaagtcctttctcaatttctgaattccctcctctaaaggtctccatcctggatcttgttagagatgctatttttgctgttggccacccttcgcggggtttggtaataaaagattgttaaagtggggttttttttgttttgttttgttttgtttgtttgagacagagtctcactctgtcacccaggctggagtgcagtggcacaatctctgctcactgcaacctctacctcctgagttcaagcaactctcctgcctcaatgtcccaagtagctgggattatagggagccgctaccacaccaagcaaatttttgtatttttagtagagatggtttcaccatattggccaggctggtctcaaactcctgacctcaagtgatccacccacctcagcctcccaaagtgctgagattataggcatgagccaccatgcccaaccaaaagattgttaaagtttaaaaaataaataaataaaagtctccaaaggagaaaggatttttcattttcttcttcattttttctgaaggggaggaaggtaaggagaacagctccctgtgcttctaatttaagtatctacattttcacaagtccccattaacatagccaatccttaacaaaggctagaatgtgggactgatcaaacattagagaaagccccattgccctcacgggccacctgcctggcacacacctgtgtgcacttcccacatatttatggtgtttatcccagcgtttgctgggctggagaactggccattctgtcactgtgacaaacaggcctgacgaggccagccgtgcctgcgattgcattttccactctccaaacagaatctattagacatgatgcaagcagagattatttttaggaaggcttttcattacagtgatgtgaaatgtcaaggctgagactcagcaggctctatgcagacctccggctcccactcattaagttcctgccacgtgctacgcccaggctgggccctggacaacacaagtaggtccccaattaacagccaagttaattaactgattggaaacacaggggaaagctgtcttgggcggggacatggccctcgaggagcaagcggactgaaggggtacgggcatcgtgccgaaaggggtagagacagcatggtcagggactctgcaaggggagagaacatcaagcccagtgaacactgggggctgcacccccccacacctgatgaggggcagagaaaaccaaatggtgaacccccatctcacctcatcccacccttccttgctgcccaggtgtgcaagatggggcacgggccatcccaactccaagtctggcctggacacagaaatgaccaacgtgctaacgacagtcagaagctgatgagactcttatctttcctttattaaaaactcttttgcccaggtgcagtggctcacatctgtaatcccaacactttgggaggctgatgcaggcagatcacttgaggtcacaagttcgagaccagcctggccaacatggtgaaacctcgtatctactaaaaatataaaaattagctgggtgtggtggtacatgcctgtagttccagctacttgggaggctgaggcaggagaatcgcttgagccctggaggcaaaggttgcagtgagccaagatcacaccactgcactccagcctgggcaagagtgagactctgtctaataataataataatgttttaaattttatacctgcaaacagtatctagctcaacttcctcatttcaagaatggggaaactgagatgcagagaaaggagatgaaccgcccaagctcacacacaatatagcgaagccaaacttttatatgtcactcccagaggcggtaggaacatcacatgcttccttttggagaccttggtttggagaagaaaaaaaaaaaacagcttttagagtagattttctttttttgaactactgaggaaatctgcaggaaaagagggtcttcaaatactggggtaaatcatatgactgacttgtattacacaaagctgagatttataacaaatactctaaacaactactcctggagcaaacagctttcacctatcacactttacagaaatattctttaaaatagtggtttctatttttttctatctttttaatttcacagactaataatcttttttaacaaactggggtaacctacatgtaaagttgccaaatctttatgtgtgtaactaaaaatgtttaaataaaaaaaaaaactttcctatcacacttcttttaaaaattactaacattaaaaaatattcctccaggcacaggattacacctgtaatcccaacacttcaggaggctaaggtgggaggaacactttagcccaggagtttgaggacagtctggtcaacatagtgagaccccatctctacaaaaaatacaaaaattaagcaggtgtgagggattaggcctgtggtccccgctcctggggaggctgagacaggagaatcactggagcccaaggcatgggaggctacagtgagctgtgactatttggctgcactccagcctgggcgacagagcaagaatgtgtttcaaaacacatataactaactgtacatgtatgtatgtgaaatctcaggaatttaggtattttaaggggaatacatctgacaataggaatgcagcgtttccacgggttgactggcgctggccgtgccctggaggctcctggcccagggaggccccgtgtccctgagcgaacgcaccggctttgggttgtaaaccagggagtttggacttaattcccagaactcaatcaccactgagcgacctcgaaaaagatcacgtgggcctcacaggacgagggccagacccagatgcgcccgcttgggcggacgagactccctgacaccctccccgggacgtcacagcggaggaaggctaggagctcgcgcacgccaggctgtggggccgaggggtccggctctcagggtcctgctctcagggtcctgctgggcccctcaccaggaagaggggacacggaggcagcagctcccagcggcctcgagggcgccactgacaggagcgcggggcacaaggctgcccaacaagaacgcggggcgcgaggccgcctaactgacaggaacgcggggcgcgaggccgcctgacaggaacgcggggcgcgaggccgcctgactgacaggaacgcggggcgcgaggccgcctgactgacaggaacgcggggcgcgaggccgcctgactgacaggaacgcggggcgcgaggccgcctgactgacaggaacgcggggcgcgaggccgcctgactgacaggaacgcggggcgcgaggccgcctgacaggaactcggggcgcgaggccgcctgacaggagcgcggggcggcgccctcccggcctccctcagccccgcgccctggccagcgggtgccgctcgcagacgggggagcccagagcccacgcgccaaggccgccaggcctttcctccctcgcgttccctcaggcgcgtcctccacccgtttcccccaggcagggggaagccccgagaagccgccgcgccgggctgagatcgggccccaggctctccgcggagccgtctccaacccctgcaggccgacctgggcagccaggcggggagcgcgcagccacagcccgcgtttccgggctccgtgtccttctggaggccgctccttggccatgggccctcggtcctcgccctgagcagcgcgccggggtataagggacgccctcagaggcctccaccccacactccaccgcgctctgccaaccgggacaaggtgttttgctgaataaataaattaatacataataaaggctgcgtccaaccagatgaggacagaaccgagcgccctccagcaccctctcccaccatccatcctcacagacggactctgcaccgtgagaaagcggcttcggcagctccgacccctcaactgacgcgtctccccgtggtgggtcccgatcccccggccggctctgccactgaagcctctccctgtgtcctccgtgccccccgagtggcctgctagcccgctctcccacacagtctccttgatgtgaagtgtcacccggcttgctgcggcgtgtctccgccgtaacacgtgtataccggctcagcacgcggctgggtacggtttgcaacgccgagagcccgcggagaagcttgagcctgtgagcccccgtctccgaccacggactcaccgggaagcaccaaggagaaccgcctcctcaggaaccctgtggagctcatggcttttgtgactgagactaaaagcatccataaaagcccgacattgtggaaagacacaaacgtgcatggacctggttacctctggccttcctctgctcagaagcccacccctgcagagcaaagcccgggtcccggatggcaaagccatacgcaggagccttcccagcagccgccgccatggctgacgcactggcaggagccgcaccggacactccacctagtccctcttcaggttttaatccattctgttttatttcatttgattttatttcattttatttccaagccctgtggcaaggcttggaatattttttgtttttgtttttgcttatttttttttaattatgccgtgtgttggcacacttcatgaaaagcacctatttctggccaggcacagtggctcacgcctgtaatcccagcactttgggaggccgaggtgggtggatcacctgaggtcaggagtttgagaccagtctgatgaaaccccatctctacttaaaaaatacaaaaattagccaagcatggtagtgggcgcctgtaatcccagctacttgggacgctgaggcaggagaatcacttgaacatgggaggcagaggttgcagtgagctgagattgcaccactgcactccagcctgggtaatagagtgagactccaactcaaaaaaaacaaaaacaaaaaaaaacaaaaaaaaacacacacctatttctttttttttttttttttttttcttttgagcaggagtgaaagtattaaaaagctttagagcaggaatgaaaggaaggaaagtacacttggaagagggtcaagcaggggacttgagggatcaaatgcgtggtttgaccttttgacttggggttttatatgttggcatacttctggggtcttgcgttacttctcccctgattcttcaaaaagcacctatttcttaaggatccaaaaaaataaaaaccaatttcattgctgctgtttccatttcttggcaaaaattaggaaacacaactaaataaatatccacggaataaaatggtgcatttattcaccaaagtcttatcacacgtggagatgaataagaacttcccgagccaagaacagtatatacaacatggaaaattctctagagttattaagtgaattaacctcatgaaattctactataagataagcactaggaatgcactggaaagagaaaggtgctagtgagcttctggaagcacagaaggttctgaaaggcagggaaggttctagaaggcagaaaaggttcaggagcttctggaaagcagggaaggttctggagggcagggactctgtcttgctcgtgtttgcaagtccaatgactagcacatagtaggtattcagtacaatgttctgaaaagaggtttctctgtctggctgtctagttgggtggaaaactgatcctcttcgttcacagtgagatagaggaacctgaaaaggataaacatatgaattcccctcaaaatgttgttttgtttggtactgggtagtgatgtgaacaactgtggggttaacttaaggctctagttatgctacctcctccagagaagatccactttgccccatctagcggctgaggattccagcagccctgacagccctgacccaccagggcactgagccagctctgtgcctacgaagacagctgtctgctgaaccctttctgggtgcagcctgctgggtcctaactcgagtctctgaggcataccagggacctctgcccaacagctctccgaggctcctgatcaggaccggctgacacctctggaaaacactgaccctaagtgccacatccctacccttctcctgggtctctgccctctgactcatcactgtgatccttcattatttcatacattttgtccagatctgtttttggtgccagggtcattgactcccttagtccaccactactggacacagcactcagagatctttgccacttaaattgctttacactttgttcttcagtaaaaaattattaagctgatataggaacagcagtttctaaataaagatgagactatagtacatattatcagcccactgattttgccagtatagtaagcttgcaagtatgagtttatactttctgaatgatttacattttattccaactaaataaataaatctcactccatgacattttctaagctgaggaatagttgttaattcattttgaaatgttcttagactaagaatctaaatttaaaagagtaattagcatgatgcatgatgaatggacaagagtcttctgaggcacacagtaatgtatttcttccctcattttacttttataaaaatacttaatgggaattaatgatcatcctctggtacagatgcctcatctgatcatcaacatttctttgtatgtcactaacactatacccagctaaacaattcaagatgttcagagaaatggaggggggatgggaaagggaatctgcttcctagaaatgcagaaaacatcaactttgggtgctgaggaggccagaatagatttttaaataaagtcaaacaattttcagaaaaagattatgttacttgtgaaaagtcattcgttggtatcaattttaaaaataaagagtcagcataggggtcttcaatccaatcctagagtagcagagctagaagcggtctggaggagtgaccacttctcctttctgactgccagtgctcaccacagcttcatgtctctggggttctttccttgaaaatcaaccaaccaagagctcgggtctctgtccaggaaggtcaacagcaagtcactccccatgcctgggtctgaatgtccttatgtggaagttacttatgaatcgatgaaactggaccagagactcttttccagctctgagagtctgtaattgatgtattcatttattcagcaaaaattactgaacatatatattgacatatgcccactcttagatgtcctaaaaattaagcttgatatatgggctaatgctggagccccacgagaccccacagcaaatggcctcttgggatctggtgccagaagagtgggcccccttgtgtcattctcaaactatgctgcaatttccatgggcctgtgaagagatttatggattaggtgacccattttaactatacgtaatccagagatttgaaaagattcttagaaaggaatcgtggattgttaataagacaaatacaagaaaatctgtacttccaatgggagctcttctttagacacattttgaagtggaaagcatcacagttagacccacaagaaggcaaccagaaagattaaaaatcatcgttcggactttctcaattatagatttatgcatattttcagtagtgatgagcactgttctcagcatatattgtgcatcgagacagcaaataaccatagattgaagctctccagattagacacttaaaaactaagtatctaaaatgttattaatcacattaataaaaattttagtgaatacaaagaagtttttgtatcttcagcaaaatattttaatcattagtgatgtttaatttctcattctcttaaatttgttttgaattttttattataaacatacaatgagttcagtagagcacatatataacttgtaaataagaatatgtatccggtaaataaatgcacatttctgttggtggcgccatcagacactgagacactgagaggaggggccacaagggggatgaggcagaagcctcctgccagtgagggcccaagagccctgtccagggcttgggcttccttcctaaggttagatgtggggcagctctggcagaagagtgataggatcagattttcagttgtggcagttactctagccagaactggaaggtggcatggaaggggccaatacttctttctttcttttaaagtttgttctgccataatttaggccaaattcttcctctgctacatgtgaggactgcatgcccggcagcttcctccacatgcatcaggctgctggacaggccttgctggcacactgggtgggtggctccgtggagtgtcctgcctactgcaggatgtcgaacaacgtccctgtccgccatccacctagtcccagcagcagaggtgagagccactgatttacacggcagaactggccaccaccagactactcaccctcttctccttcaggctgcaaattaaaacagacttccatcctttcttcaaaggacatatttttcttcccttttgtcatttattttacacaggaaagtagcatcttttaatagtctagaagaactatttcaacatttggaacatgctaacaatatacccacacatggtagaatctttcaaaatgaggctttgattttggagttcgtacttattttatctacaatctttgtcaaacatgttatcttatgtgaaatcacctgtaacaatctgggacattcttttttttcatagtgcttgacttaccctgaatatctgacgttctttcagagtgctatgaaaaatattaaatcattaaacaaatgttatatattatttaaaagtaccaataaaccaaacacgtcactttttaacatttgctattgactgatattgtcaataatgtagttggctagccccataagatgggttttactttttatcactgctcactgtagcctcaaactcctgggctcaagtgatcctcctgtctcagccttccaaataagtgagaccacaggtgtgtgccaccaggcccagctaattttttacattttttgtagagatagagtctcactgtgttgcccaggctggtctcaaactcttggcctcaatcagtcctcccacctcagcctcccaaagtgcttggattacaggcatgagccaatgtgcccggccaggttttacatctatatttcaacccctcagaacctgtggaggatacaagaggcataactacataagtatccaaatttttcacacagttgcatgtttttattttctcagaagggcactaaatcaacacatctcttgagaactacatcttacttcccaaagagacaaaatagttataaccaataataatttcagtattactagaaattataataaaaatttaaaaataagtagattgttttatagaaaactaaaccaagaatctaatctttatttttaaaaatattttccacttgaaaacatttcctttttcaagtgatcaaaatgcttccttcttgttaagctcacagcaatgaaaaactcatttaaaaaatgttctctgagtttgcaacatccccattccatatgctgtcaatactttccccgctggaagagcctgcctcttaccccaaataagcagcaagcaggaactcccaggcctgggtgaggtgtgtcccctggtgtggtcactcagacagagctgtgtgtctgcaaacacaccaagtcactcacagccaggcactgccagcccgggctgcctgcacagcaaccctgtcaggctcatgcagaagaagccgttttcagaccacactcgttttgcaagaacgaacatctctgtaaagttctgcttctgacgtcacagtttctctattccacacaactctgcctcaaagccttttttaagcacattccaggcacaagtgtgagccagaaaaagggctgaaaacatgaggggccctctcgggacaagccccggggcccacagcctgcaccaccagggacatgggggctgctaaggagcctcccaccagcacctctgcctgcctctcccgcagaggcctccggggagtaacatgctgctgatctgagtgaacataaggaacaggaacacaccacaaaggtcccacagaagcacagcatggggagccatggctgacagccagtggtcaagacagaggttctggagcaagatggaaatgcacagggcatctggctcccagtcctgcccgatgccacaaacaccatggggcctgcacaacactgagagctcccaaacaccacaaacagcatggggcctacacaacactgagggctccccaccctgcctgatgccacaaacaacatggggcctacacaacactgagggctgcccaccctgcctgatgccacagacagcatggggcctgcacaacactgagggctccccaccctgcctgatgccacaaacaacatggggcctacacaacactgagggctgcgcaccctgcctgatgccacagacagcatggggcctgcacaacactgagggctccccaccctgcctgatgccacaaacagcatggggcctacacaacactgagggctgcccaccctgcctgatgccacagacagcatggggcctacacaacactgagggctcccagccctcctgaatgccacagacagcatggggcctgcacaacactgagggctccccaccctgcctgatgccacagacagcatggggcctgcacaacactgagggctcccagccctcctgaatgccacagacagcatggggcctgcacaacactgagggctccccaccctgcctgatgccacagacagcatggggcctgcacaacactgagggctgcccaccctgcctgatgccacagacagcatggggcctgcacaacactgagggctccccaccctgcctgatgccacagacaacatggggcctacacaacactgagggctgcccaccctgcctgatgccacagacagcatggggcctgcacaacactgagggctccccaccctgcctgatgccacaaacagcatggggcctgcacaacactgagggctcccagccctcccgaatgccacagacagcatggggcctgcacaacactgtgggctcctaagaaagcccaaacagcaaagtgagcactcaccttgtcttcatttcctctaagaggaagactgttgtaacctgataaaacagacagataaaggataggatgtgaccacaggaatggggtccaccagagccaccgatccccaagtatgggatgtgatgacagggacagggcccatccagggcccacaggtctccccttggactctgacacaatcctaagtggatggagtaagggaaagggccctgtgcaaactctgaatagtgcactgggccctaacacagaccctgcactgcccggccacctccctctccccttgccatccccacaggccaggaagatgggcacagcaagactgcccacccttaccctgcaggccagagggcaaagcaagccagccagacactcacctcgcttcagaagagcaaagggaacaacacccacccggcaagctcgttgacaagaccaaaattcaggcacttaaaaacagtgcaacctagacatgccaagtatactaaaaaacgtgctctgaattttgcatttatcaaatattacataataaaacattttaaaagaaagtgtttagcatatctaaaaaaagtgtatgtactatctctttttattatactttctactcaaacttgtaagaaatttgtatgaatattatttaagtcacctttttttttttttgagattccagaggccaggcatggtggctcatgcctataatctcagcagtttgggaggacaaggaaggaggatcacttgagtccaggagttcaagccaggcatggtggcacatacctgtagtatcagctactcaggaggctgagtggggagaaacacttgagcccaggagttcagggctgcagtgaactatgactatgccactgcactccagtctgggctacagagccagaccctgtctctgtaaaaaaaaaaaaaatcatagattcaaagagtacatgtatacgcaggtttgttacgtgggtgtattgagtgatgccgactgttgggtttatgatgatcctgtcacccaaacgaggaacacagtacttgataagtagttttttgacccttggctccttcctccctcccttctttaggcattcccagtgtctattgttcccttaagtcctacttcttctctttttttttttgttgttgttgttgttgagacagagtctccctctgttgcccaggctgcagtgcactggcacaatctcatttcactgcatcctccatcttccaggttcaagtgattctcctgcctcagccccccaagtagctgggattacaggcacctgccactacaaccagctaatttttatatttttagtagagacggggtttcaccatgttggccaggctggtctcgaactcctgacctcagatgatctgcccacctcagcctcccgaagtgctgggattacaggcgtgagccactgcgcctggccaagtcccacttcttttattcaagggctttacagtcatcaaagggatgatgtgaaataaactccaaagggctgtcaccatcagttactctcatcatcacaacaaaaccaggcctcatccttattgatgtaacctgtttggatatgcctattaagaaatataaatgatattactctttaaaaggtaatggcaatgcttttgcaataatctctattgtcagttcatctgagacttggattttctaaagtaatattgtttctaacaataacaatattccatcctgtcagccaccacctccaacattaactgtagaaacctggagcatccaaaaataacaaccactatgacttatcagaaactctgtggttaccaaggactctcccacccatctcaggtaatcctctcaaaaacatgaagaaccaggtattttgctcaaggtgtaaatccagagagattataggtgaagtctttccatttctcttgacttctaatatgagtgcaagtgcaaactgtaaagattatctgattggaaagataaggtgacctctcaatctgtcaacacgctgcatggaagcagtactgtcatttaatttgtgctcttgaaacagccacatattccctattccctaccatatttgcagaaatcaccagcagtttctgactctgctagaatcctctttctatttcagtgaaaaagccccatttctgttaccttaactgatcataatttcatgttggctatttcatagaatcaaggaccataacagcataacaaagcaggcacatggatgccgcaagtcttctaccacaagaatgggtgccgctccataggaactgatggctgtgcttcccacagcagctctaaccacagctgtatctcagtgcagaacactcaaatcagatggaagtccagtggtctcaaccttggcctgttttcaggaaaagcagagaaagagattcaagaactcttagtaaaagagatgtgagggacaaaatggacttgaggtgggaagtcatcagacagcagctcctgccactgctttacctatgttccatcccctgcctccggctaagaaatggagcttgcgctggtgtgcacagttgagtcctctagaagagcggctatttcagagaatgtacacattgtggggtcagcctcaaattgtaccacagattaactgctgctttgagctggattaaaatcacagcctctgactgccaattttattagcggctccatccatttacaagttgaatgtatttcacatttggaaccagaattcacttgcatgattaatatgaagtcctttcctttcagaaaccaggtcagccttccttctgaaaattccttccgccaaacaaaccatttctaaacatgccctttgtgctgtatacagaacactgcatcagaagccttttcaaaatgacctttcagaaccacgtggtgacggagcacccacatcacatgatagaaaattctacactttccttccaccagcatagttcagaaaagagtagggagtccctgaaccaaccccctgcctgcttgccactctaaacatcaaacctaaacagaacctactcttaaataaatgttcttaggaaagtaatccctctctcatcccttattctgaagtgggtttttgttatgacaagtctgagatgagagctcacttctttggtgtttgtgtcaccacgtttttaaaaacctgacggaagcccagaaagcattcggaacataaaatttttatggacacatcgagtagtgaatcctaagggtggcattttcattccctgccattatgggaaggacaaaagtctccaaaaataagtcgcccatttccaaacatcaaaattccctcagaaggcacaccaaatatttgaatctgacacccaaaacaaaacccaactcagaaaatcaatcccctgctggtgccaaagagcactttaaaatctccgtggcctgaggttgagaagcttctaagagaaaggcagtttgacaagtgaaatggtccccactcctgtaagaacgagacagacgtccttgttctgtgcaaccagagagacatgttctgacagcgtgtagaatcctcggcccatcctgggatgaccactgggagagaaaggaggctccagagacctaggaccccatcccaggactacccaccaggtgtcctgtggtacattccttaaccactccaagactcagtctttctatctgtaaattgaagatagaaatacctatgcgggttattctggggaatacatgtcagtgaacatggaaggctcaggggttcaagatttgggggtacccagaggtacagggatgggagaggctgtcactgtgaagggagcacactgggaagttttgggggtgatggaatgatccgtacactgacagaggaggtggccacctgaatctatatgtaacacagtacaccaaaaaagaaaagtccattttactttatgataatttaaaattaaattttaaaaagaaagctccagaatcggttttgtaactattagttcatcccctgtcacctgccatggccttgaatcaccctcacaagacacagtcctagtcctggcactacccagggaatgcccttggttttctgaatcccagttaggactattagagggaacagacaaaaacaaaggaagtgaaatgccctcttaccacttccagagatgagagttaacactgagtaactgtcaccaaacactcatcatctctcgtttctttgtgttacacacacagaagccgttcaagacaaatgcagctcggtagtccgaggtccagttttccagctgcctgcaaaagccacccacttaccagcctcgtgatgtagagtgacaaacaaaaaaggtatttaaaatgtgcagaagcaggtgtttccaagggagcctcacccatttttacttcctgttctaggtatttaaatagtggctgtggcagagttcttagagataacaggaattaaaagaaaaaaatgcccttccttcaacacactgtttccacactgtttccaagcagcagaaaagtggattaactgttttctgcttctcaggttttctggccttctatcaactaagattaaaaaataagtccagctgggtctacatttatgaaggtcaacttaaactaatgtggaaagagctgccaggtgcttttatgtggtgtggagggttatctgccatgaatttagctgtttgctttctctgagaagtggaacatcatgtcaggaaagataagagaggttctcagccgaggctcatctggccttcgtctcttgggattcggctggatgaaaaccctttctgccatttattaagctttttcttcaccgctccacgcacaaagaatccttaaacctggtcgggcacagtggctatgcacgtaatcccagcactttgagaggccaaggcaggaggatcacttgaggccaggagttcaagaccagcctgggcaacatagcaagaccgtcctctctcaaaaaaaaaaaaattcatttttaatattttttgttcattttttagttattatatttactcatgaacccaaactaagacaaaacttttttaaattagcctggtgcagaggcatgtgcctgtagtcccagctattcagaaggctaagatgggtggattgcttgagcccaggagctcgaggctgcaatgagccatgattgcgccattgtactccagcctgggtgacaaagcgagactccatctcaaaaaaaaaaaaaaaaaaaaaaaaagaatccttaaactagtaatatttacacatatccaggcatatcttagatatctgtcacccaatgccagggagctattattagtttgggtgatgtttggctgcaaacactttttcatgaggaatttgaaattctaaggtaaccctccaagaggcagtagtcatggctcacccgcaaagccagttgcattgagtggaactttcttaatgagaccatgtctgatgacagcttagctgaacccctatgtctccttgaggcttcactccccttcctagtcccatattcctcactttcaaaatctaaagaaaagtcgatgagtaactgcatccaaaaattaggtaatcccgcatgaacactaggacaaaacaaacccagaatgcagaaattattgtcacataaaatgatcagtgttaccacagagttcatcagaagatggggccttgggatgttgagccttggactgcacatcacaccagctaacctttgtcccgtgtaccctgtgtcgatagccctattcttcacaggaagctggagacccaacatgctgacatgtttcatagcacacagagattcccgctgtgcaccatgatggggcccaacaccatctcggagtaaagcagagagaggactatgacaaagtgattgcccacccccacctcccctccctggcaggcaccactgaccttgatcaccaggtacaaaaacaaatcagcttggaagaagagctgccagacgctaacacacagctaagctcagcactgagaagaagtcattttaaaagctcttccattccctgcccatcccttctgagcctgacaccctacatcctgcttcctgaatctagcttcatgagtgaacccattgtctggcacctccttcttccagaagcctagggttacaacacaccccattccttctgcccagaacatcagcccttaggctgatggagaccgagcaggagagacagggaacaacaggcagagaagctcacagatgtgcaaggagcaggctcttcttgggggaagggacaggttgctcattaccatccaaccaaacggaatcagaggctctggaccccaagaagtaaagatagatttgtgcttttgtggcagtaaggatcctttgatttaaaaataaacaatcacgccatctccttcacaaagccagcagagtcctgctccgatggctctgcctctcggctctgtgtgggctccctggtgaatgaaaagtctgtgtaggcaaatcggaaggccaaaacaaaggagcaaaatgaacaatctcctgtcttcacagccaggtgcacccactggttctgaatctggattctcgaagcaaaatctgcatgaaaggctgactctatcattggcaagtgaaagttgtgcttctttagcaaaaggaagggggggcctttataaaactgcccccctaaacataggggccacctgagcaggttcacaagtcagcctccatgtaagtgaagaacagcgtaaagcccttaacaaagggcttatgttcaagttaaacttaaggaaaaagcactgagacctgcacaaaggatgccctgaaatcacagagaaaggcgggccggtcgggaggaaaactcaaagactgaagcatatgaagaaaagaccatcaggctgtctgaacagccctgcataacacagcaatgttattttggctacaagcaaagctgaatcgtgtcactagaaaggatgccatgttcccctgtgttcagcttcgataatggtctcacagataattaattaatgccataagggagcccttccgaccagaaaggaacaggcagagtgggtgatgggagggcaggaaactaaataaatcaggggaaaagagaggaagcagtgagacttccactaccacagggtgctgccaacagctgttctggaaataagtcagcatcgtggagtgcggctcaaggccacgagaataaactcagagacagcagttatcgaccctgggtttcatcaagagctccttcactgtcaacatgagaaaggccccttgctcaagacaaggcatcctatataaaaagaattggtctttaggtcttgttaacatcaacctctagttctaacctacaaggctgtttgacgtaacagaggagcaaaaacttggatctccttgaaccacatgtgttctggaggcctcaacgtgaagttgaatgttaataggtaaataaataaatagattacaaatggcacagctgggccggatttaaggccgctctgtgcatctttaatcgagcctcattatttggaacaatgtagttggcgtgaccattgccaaacaagatccagacaggagagaaagaaaaatagcagcacctgcccggcacaggtaagaaagcttctccttgcattctccgtggattgtgttctgacaaaatggcagcaacactgagtgaggatggtacaaggtggaggggacataggtagctgacacatggccacattctgccccaaggtggctcctgcaatgggaagaccacatatacatctcactctttgtctataccactggggcagtttccaattacctgagaatgtaggtgatgcctttcacctggagtcctcgaaacaatttcaacgatgtctgcatccttaatgttttcccacaaaataagtgtgtccataagtctctttatgacacagccttctgttaccagtgacaccgtgatcagagccgagggaaacatggcaccagttttaattatatgagtcaactttgctggtagccaaaataacactgctgcattgggcattatcattcagtttagcagctttcctctcttcatgcacttccatctttgggttttcctttgctgcctctctcagctaccccccacctttctgactttctctgtgattttggaagaatgctgtgaactagccattgcaatggcaaggaaagcagtcaaggaccagcctccagctcacaccataatgacctaccttccctgggacactccacgcccatgtgtgcttcatgtgtaggtgaagggcggcacctggcctcagagcaaacaactctcccataaggtgactggccaggtcaagccagctggaggaaggaatacaaccccagcaagaggccactggtgcacagctgggccttctttcctgatagggggcaaggcaccaggaggaggcagagtgagcaaggcccccaagcctcccatgcaggactcccccgtgctccagcatggaagggtgagggcttcacctgggccctgggggcacagtgactgggctacatcccagaggtgcgggaccagcacagacactccctcccaggactccaaggcaggtgagcaaggacctcctttcccagcgcctgtgttccttctaacagagacaagcaggttagggagtgtgaggaaacctcaaggcaagggaggaattcaggggactctggcttgagggaggggagcgtcaactcaggagtccagggagactgtgtcaagactcctggttctctgcagtttttgtttgtttgggattttgacgataaagcactactggagaccagaagggcctagaggccgagaggaaggtgccggagcccagctgcactgaggtgggtgcaggcggcgctgggcaacggcgaaggacccccctccatccccgcctgcgtttgcttctgcaccccgtggacaccgattatcctaacctgtcatgtgtaattctggccccgaagccgcctggaaacattggctttatggtaaatcttcttaataaacaagattagcaggaaaggaggtgccggggactggaggttttatgggtttaaaacaggggcgtccgcctgggaaagcagcggcttccactccctcgctgccgtgaagctgccgccctccctttcctcccgcggctgccacggaggaaaaatgtcctctgatttcggcggcgctgcccgcgggggggtgcgggggacgcaggtagaagcgggtgcagcgggacatccgaggcccggcccctcgcggcacacgcggcggaacacgagcggggggcgcacccacgccggaccagggccgcgcgctccagggccaggggagtgccgagtggcggggctcggggcgtgaggcccaggagccggggtagaggcaggaggcggcgccggggaggaaactgaggcaggggcgcgagacctgctccgagcccccagtgaggacagagaggcgcgcgacccgtggccgggggcttgagacccagagcctgggggtgtcgcgctggaaccccgagacccccggagcccccgacccgctcgccaaggcgcgctccccactcactcactgaggcacccctccccacccgccccgtcactcaccgagacgcccctcccctaaaccccccactcattcattgaggcgccccttcccccacgccccgcattcattgaggcgcccctccccccacgcccccctctcattcattgaggcgtccctcccccagaacctctcagaggcgcccctcccccaacgcccccactcatttattgaggcgccttccctgcatgccccctcactcagaggcgcccctccccgcaaccccctcactgaggcgccgcccctcccccccgaacccctcacagaggcgcctctccccccgacccctcagggtggcgcctctccccacccagaccccctcacggaggcgcccctctcacaacgcccccaactaattcattgaggcgcccctcccccggcgccccccactcacccagacgccccgggagctgccggccgcgggggacggacgaaggggcggcaggcaggacgcgtggcggcagcagcagcagtagcagcagcagcagcgggagcggcggccccatccccgcggcctggccggcggcgctcagtccatggccgcgcgggaggcggcgggaggcggccgagtccgggcccagggaggcgcgcgccgccggctcctcccgccgcgcctctcgcgctctt

SEQ ID NO: 246 - DNA, 1048733 bp, Homo sapiens; identical to SEQ ID NO: 245

SEQ ID NO: 247 - DNA, 1048733 bp, Homo sapiens; identical to SEQ ID NO: 245

SEQ ID NO: 248 - DNA, 96 bp, Homo sapiens
acaggcgcttcctccagacacaccacggcacacttcaacctgttccttacaagactacattgagcgtgctggtgttaaatgcgtgcaggcttccgt

SEQ ID NO: 249 - DNA, 33711 bp, Homo sapiens
tccagttaatttttgtatttttttgtaaagacggcatttcacgatgttggtcaggctggtcttgaacttctgacctcaagtgatccacccgcctcagcctcccaaagtgctgggattacaggcatgagccactacacctggctaagaatttactttgtatacatgttaaaaaaaaaaaaaacctaatatgtattaactcctaacacctaagaggaaacctctggtaaaaagagtctttcactccaaggacacggcagagcctgtgccatcttctaagtagatgaactttccagagtccaccaagaggtcctgaatcttctctcttgcatgtctctcttccatcctctccaaggcatccagcagggtgtggatcgaggcgttccgtccagttttgttgacccatttcatcagcattgcatacaaggcatcccctgggcctgctgtaccagctctgaccacatcgatctcatttttcgtgaggtccagctgcctcatgagctggtcccaggagtcaaagggcacgatgtttgcaaacttgtcaaagaacagcatcagagctgggtggagaaagccacagagacagccagatgagttgggactcagttcagaaggggcagaggatcccacatcaggcccagaacccaaggagagaacctggagagccccctgcatgggcaaacctgttgctccattgcccacccacctcccatccacagagagcccacccacactgcctggcctctgtggcccccaaggcgctgacgggcgtcaaggtcaccagagaatctgccctcagagagggctgagaacccacctggggaggatggattgaccctacggaggcagaaagcaaagtgggtgagagcccgagggagggagggagagtggctgcagcgggagctcagaggatgcgggctgcctgggctgcgcttgtcatgggagcatgtcccagggtggccacttctgcatctgtggaaagtgcagggtctggggcaggggacctctgccctccctgaggctggggcagagctaggtgggggcaagcaggccctgaccaagaagcaaacctgaagacagagcaaacctgcccagatctcaggactaccagggattgaatgaaatgagatgtgtgtgcaaagcactgcacaccaccatccacagggatagaaggggccaggagtaccaagctatgttttctaacagcctcatttaaagaacataaaaagaaaaaagtgacattcattttaatgtgtggtactgaatatgtgtaaaatataatttaatatgcaatgagtatacaaaaactgaaactgacccaattgtcccatagaaaggtttttttgataaacagaaattgacccttctggtccttaacgactggaaacttaacatttgttttatctgagttacttcctcaggaaagacctgcaagcatctcaaaaaaagtagcaaagaactgaaactcaccagatcactacatccagaccatgatgggatgtgggacccctcattcatcttgattgtttccttgccccattctagctcctactttcttacacattgttacatttcttgcctcctatataaacccttagttttagttggtcagggagatacagttgagactgagctcccatctcttccactgcagcaccctattaaagccttcttggcaatactcatcatctcagtgactggctttctgtgcagcgagcagcgggacctagaccaaacccctgaggttttggtaacaggttttggttccctggctgggaaagtgttgctcatggctctgctgccatgggccaggagactcagaagccctcccaagcagttgccccgctaactttggctggaggtgagtttcagtctctctcaggtcccactgcagccggccccaaccacattcctgattacttccgaagaactgcctttgaaatttgacatttgcatccagacaggtgattgtcctttgtgggcccagacagcaggatctgctcttctcagtttgagaaatttttaaaggaatttccatttgcaggttgaacaggcccaagtgactgtgagagggaagcactctgcctttcagtctggacactcttggaggcttgtttgtaattgtgtgttgtttcagggcaagtgagtgtcttttgtgggtaccaggcagcacgactggctcctctcaatttgagaaatttgaaagcaatttttgttggcaggttgatcaaacctaaccaatggagagaggaagcaccctgcctgtttcagtctggacactcttggagcttgtttgttgctgcagcagttgtattatgttttggtgattatttctatgtgtttgctagagtcatgggaaattggaattcagtaaacttggtattcttttgtaatactgtttggctccaatattgcttggaaactgaagtttgctgctgaatgagaaagtaggatggagttcctgtatccaggcttttatgttgctgttctaagcagcattgggcctgattagttggttctaggtggtgttctctgcgatgctgtttggagtctgcagaggtttggcctttaaaaatcaaactgccatggaaactgctttacctaaaatttgggttcacaaccttcactgaattatctattggagctaacaaatttcagccatgtgaacatatttgtagactggtgagtttgtattactgtctcatggagagagttcaaaggtaaaagctattggatctttgtgtgtgcatataggtctagatgtgtttatgtgtatgtacatttattattaagttacatgttgtgtctaccaaattgacttataagtaaaagagtactcataaataaagtaaataattccaagcaattttcaagttcatgtgacttaagtaaatccttactaaacaagtcagctttaaaattattggtaaaataagaaaacagaagtgtcttcagaattgtcagcatacatttttgtctgggcttatatttgtctttgctagatattttgagatatcagtttggcacaaaaacttaagactacaagcccaaccaaaacaaaatgatctttgagtcaagcttttgataagtaagattaaattaatgttgttggtttaatgaaaacagctgagtcttctgacttattggtgaaaatatctatatatttaactttgaagctcttaggtgagcacctgatgttcactggctattaaaaaaatggctgacaaagaaattaactaactttaaatgatggtgtctaatatctcaattttcagaagcaatctggataaacttaaaaatgaaagaattgagtaaatgtaaatgggatgttttaagtaaatttttcatataattaaaaattgttgtcattggattacagagaaaacttccagtgcagtaactgaaagaccaatgtgtggccaggcgcattggctcatgtctgtaatcccagcactttgggaggccaaggcaggcgaatgtctatcacttgaggccaggagtttgagaccagactggccaacgtggcaaaaccctgtctctactaaaaatacaaaaagtacccagatgtggtggtgcacacctgtggtcccagctactcaggaggctgaggcgtgagaattgctagaacccaggaggtggaggttgcagtgagatgagattgcaccactgcactccagcgtgggtgacagagtgagactctgtctcaaaacaaaaaaagaagaaagactgatgtgttcataaagattgtgattgttaaccaaacatgaagctgggcaggagctgattgagtggactgaactaatagaggactgaaataattcgtatggcttttgttggtttgaaatattgctgattcttttggttttgttttccagtctggagaacttttttcttctttgctatttatagcctttaagtatactttaagtatattgagtatacttttgtaaacagaatttgaggcatatttctctctctgcctaatttctctagaatttttaaattatttgtgactattaattcatggcaatgtgtttgcttacatatggttaataacaacgttttcttttacaatggaacacagttggataaaatggttattttctcagggctttgattgcaatggcctcgtgagaggttccagcaaagccaacttaggagagcctatgtggacagtgatttttgctgcactttgtgtgggtaatcaggccacgtatatggaactaaacttattttgcaggtacattggtcctgctataatttgtctttggtggaagtggggccgagagagagagattgtgtttcagaagaaacacaatcttttagtattaaattaacctttgattcctgggtggccatgaggtcacccatggtatgtgaagcttcccatgatgcccctcctcaaccatgaagcagccagaaagatccaggaccagactctctgtgactgtgggattgataaatagaaagggagaactgaaatcaacccaatatgtccatcaaaaggtttttttgttgttgttgttgttttgataaacatagaaattgacccttctgttcttaaagctcaaatcttacatttgttttatctgagttcctttttcaggaaatgaccttcaggcctctcaaagtatcaaagaactgaaacttacaaatcactacatccaatgggatgctggacccctcattcatcttgattgcttccttacccctccctagttcctgttttcttacacattgttacttttttgtttttttgagacagagtcttgctctgtcacccaggctggagtgcagtagcgctatcttggctcactgcaagctctgcctcccgggttcatgccattctcctgcctcagcctcccgaatagctgggactacaggcgcccgccaatacgcctggctaatttttttttgtatttttagtacagaaggggtttcaccatgttagccaggatggtctcgatctcctgaccttgtgattcgcccgcctcggcctcccaaagtactgggattacaggcataagccaccgtgcccggcccacattgttacattttatccctactatataaacccctagttttagtccatcaggggacatgaattggagactgagctcccatctccttgcctacagcactcaatgaaagtattcttccttgtcaatactaattgtctcagtgattggccctctgtgcagtgagcaccaagacctagacccaacacctggtgtttcggtaacaaaataatgagtggaatattttccattctttcttgcattaagtctttggaatcagtatgtagtttatacaacagctctgcaaattgggcttaggcacagataaagagctattagcccactgaagtcagtggtgccatgcaggacagggcagcccctcagggctgttgttctcctgaacaacaaaggagaagagaggaggtggagaagaggatagacagagtggctagtgtcattaatagggtgcagaaaggatgaggtagagtgggaagaagagatgggagaagacaatttagggtcttgatggtctatagcataggacccccagtttctggcatggaatgctctggaagagcactctcagcaatggggacaccagttaggacaccgtccctattcccaccatttctgctgcatctccaggagcaaaacacttactctcagtggggtcagcaccatttgctggaaccagcagcctcctcctctgagacccttcagcttctgccggtccctgtaacacacagtggggaatgccttggtctgagtcaggggtcctgcagtctagtactgactctgaccatcagccagcccggaaacctgcagcacatcactttcccccttgggtcaccatggagatggtgaaaaacctctggtcccacatagctcacagccactccccattgctggcattaccacctcagctccacccggtcagatcagtggcaacattagattcttataggagtgcaaaccctattgtgaactgtgcacgtcagggatctgggttgcatactccttatgagaatcttatgcctgattatctgtcaccgtctcccatcaccctcagataggaccatctcgttgcaggaaaacaagctcagggctcccactgactctacattatgataagttgtataattatttcattatatattataatgtgataagaatagaaataaagtacacaataaacgtaatgtgcttgaatcatccccaaaccatcttcacctcccagtccatagaaaaattgtcttccacaaaactggtccctggtgccaaaaggttggggaccattcgttaataatataatgtcttttgtatacacatacactgatgcatagatttggacaaagaatcacaagaaatgatatctcatagttacttgaggaaaaagacccagggcactgcagagtggaggatgctctctttacttactgagtaccttttgatagtttaaattttctcattttaaatatataaactatttgttcatgtcaaagcaccttatcaagctggagattattgacctttttaatgtttgccttcttttttttttaattacatttttggttagaataaatgggtactaatgcaagaaaggaactgaatggaacagtctaggtggaaggagatcattgtctagatgagcatttaacctgtgattaaggagggacccaaagcagagggaaatgggagaatcggcagctcaaaggggttggaaaaaccagacagtgactagaacaattcagggagtgcctcgctttgcactgaaacacaaaacaagttccatttagattataaagttatatgcaaaaatcacatcattgaaaaaaatatctccataagaagttagaggagttcgtcttgtgttggcaaaaggtctttctacagtagtgagcaatgaaaaggtaaaagtatctacagatttcactggttaaaaattaaagcttctacacctgaaaatattagaacaaaaaggggcaagaagaaattaggaatctactgtctgaatgtgagaaaaagcatgagtaggagagcaggccttctcataaagactctgagagacaagacactgatcttacgcaaaaacagtgaaaacaaagaaatgttcgtttaaaacaatgttttcctaaatagcaaaaaaaagaaaaaaaaagaaaagaaaaagcccttcaatgtcaaatcaaaatacatgaactggtacaaaccaacactagggggctgtgtgcatgtgtgtacctgtatgtgtgggtacgtgcatgtgtgtgtgcatgtgtgtacatgcatgtgtgtgcatgtgcgtgtatgtgcgtgtacacagtaagcagcactgttacaggctgacttggaaattgtgcttcttcttggaatcctccatacaaccatatgcagaaatttgggcagagatttagatccaaatatgtttaatgcaataataatttcagagtaaatttaaaatccctgctgttatgagcaagggctccctaacttctgtaggagcacacagtggagaccgtgcagccttattcagtcatcaacaaaccctgtgacccccactctattcctctggagctccagtttctgaggacatggcaaggacaggacagggactaagaagcagacatttggaagagtgcctgtccccttgtgagggtggctgctttttcccacgcagccccgtcccctgcagtcccatctccctcaggctccacttcccctttgaccaggagagccgaggcatggccttcaccccctgcctacaaggtcttggaggggcctgtccccaactcaccagcagacactgtgcctcccctggggactgtacagtgacacctgtcaaatctgccggctcctggctttccatttgctgctcagagacgaaagtggacagcgagtctgcgttgctcagaatctcgttgtgagcattgtcctcagccccaggccctcgtaggagacccaagcgccagaaacacaccttaggaaggcaaagagccaactcagaagcccacacccagggctccccacggggtccgtagggcacggctggacctgctgccaccaccccctcccagtgaggtcactccaggaagtccatgctcagcacatccaggacctgctgctggggccaggccctggtgctgggcttgggggctcaccccatccccagggtacaggctgtggggtaagggtctcacctgggctgtaggaagcacagggctacagaatggcccaccagcctgtatgatgctcaaaagggcctgtgtcccccatagtcaatgcacagcatccaggccacttcagagactcagggcagccatgagagcacggggacccacccacctggactacactgtgggcaagaagcagttcctgagcccctgatgcccccagctcctggagaaatcaactcaccctgtccatgcacttggggtcccctccacaacctagaagagaagacggttcccttagtggccagggaggggcccatgcagcactccttcttagagggcagtgttgggcaggggtgggctgggggctgggacactggacaaagatccccgggcctggggatccacatgaggccctgctaactcgggagatccttcaggagcggggagcataaagggaagtaggctaaaaacaaacaagtggaacatcactgttttctgctctgtgttttgctctgaacaaagctacataaatcccacaaccacttctcgtctcgactcttgtcatccagttgaggagctgactgccccctgcctggatgggcctgaccagtggaggaactggccctgccttcccagacttggctgggagatgaggggacccccagccttgggagagggacggatgacaccagggccctagggttgcacaggatgggaggatggggggtgatcacaaggaggaagatagagcccggccagagacactaggacttggggcaggggtgagcgtttctgtctgtgggaacagaagaaggcagggcagagagtgcccagagcccttgccctcagccagcacctacctgagccgatgcaacaacagacaatcagcacagccaccaacagcaacggaacaaccaaagtcacaaccaaaatcacccatatattatgtccattgcctgagaaaagacaggaaaagacaggagtctcgggctgctggtccctgtctcctctgcagctggggcttccccagtgggctttgtacctgattctttgtggacacactcgatgtcactccagggcgtacaatccttgaccttgaccatccctctggggcacctgggtacacacagggagggaggggggggactcttgatggaaagctggccaggtgggatgaaagaggagccactctccctgcccaatgtccctgagaaggcgtcaggggaaggatagtctcctcgtatctgcagggggtccccctatgctcccttgtttaggctggggaagggtctgagcatgcacactttacccccttggcctccctgctctggggtcagagctgcagttccaggagccttctgtgctgggcacacactaatcttccctgggctgcaggggaggcctgcgttaggaggaatcacactccaggggaagatcacaagcccgtgtggccacaagctgagccccttcctccagttaacccacagtacaagtgagccctcgcccccacctgtctgctggttcctctcaatcacagcaaacactggaggaccagagaagagcaattactctttgcttccaaaaccaaaataggaaaaagacaggacttattgagaaatcaggggccaggggtgaggctggctgggtgggctcaggtcctcatgggaacttgaaggagctccacccatggccttattatgatttttgcgggctgtgggcatttctgtcttcttgaattaaaagcaaatattaaaaattacattttatgactcaatttgtttaaatataaatataaccccagctggattctataccattattttcttatgatttcaagataaaatatttcatgtacctctgttgtgggccctaagtcatggcctcctgtgcctagtgaacaagtcagcctggccaaggggactagtgctggggaggggtgagaaggggccactgcaggggacaggggtggggacaggcagatggaccaggaggggcaggttgcaggctcaggagacgccacaggctcagggacacctatgggggtggaggcaccatggggtcagggctgatagatacgggtacaaggagactcgggtctttttagggttccttgcttctgtgggttctttgaggctgctgggagccccttggctgttgtctcaccctctgctgcacttccggcacatctcagcagaattgtcattccggaaagttcctggtttgcactgacatgctgtgttcctggtcgtggtgcagggacttctctcttcttcatctgatgacagagtacaaggttttgggaatgtgtttccctgacgtgtcccttgacctttcctcaccaccccaactccctccccctcagctcagctcaactcagtttgccaaggagttctgagggccagattctgcaccagcacactcgggctcacacaggacacccacccttcagctgtcaccaacacttggagtcatacaaaaggaccatgattcattatttattacatcagattagggaaaaagcaccatttagatcgcatggtcagtagcaaaggaggcacatggtatgtgagagagtctgcaagaagaggagcccttgggtgacttcccaaaaacccagcctgctgaggaagagggaggcgcctgagaaactgaaggctgagtgagcctgagaacctgccaggagcacacagcccagggggagcgtggccccagagcagacccgtaccaccgctgaaactcagccctgtccactcagccaggccttctttgtgctgtaatgatgcccctaccctcttggagctgatagtttgcactaccaggtggcatgcattataaaaatgatttctttctgtttcattttatggacctaagacataaccatggaacagggtatgatgaagaccaagttgggctggaacttggttccctgactcacattggctaccactcccacctcactgcccctcactccacctctggacaagaggtccacacattctgtacctgatttacaagctgtacatgggaggcaagcaaacaaattgttggaagcattggtgtaacccacaccctctgtgcaccggttacaggctccaggatgttctgatctatgagatcctgggaagggagagaaaagccaatgaatgaattgccacagagttcccagaggatcgtggcggtggctaggaaactcttcttttggccatcagtagaccccagacagagaaatcccatcttcttggcttggtcttgtcgtcaattctgcatctatacacacctctgactggcgctgctgacagaaatacaatacaaaccacatgcaaaattcaaattctatgagagccatattaaaatagtaaaaagagaatgaggtcaaattaattttaacaatgtactttttggacctaaaatatccaaaacattagcatttcaacatgtaaacaagataaaacattgagatattttcttttattttgaatactaagtgttcgaaacccagagtgtatttttcactcactgcacatctcaattcaaagtggctgtgttttaagtgattaatggccacataggcctagagaccagggcaatgccacctgcatccctggaaactcacaaaaagtcctaatccctgccctcagtgagctcttggtcagtagaaggtacaaacaggcgcagaaacaatacagcgatgaggggaaggcttcagatacagcccatgccacctgccatgggaggaaaatggaaggaaaaagggtcctccctatacagagtcaaagaatgatccacagaaagaaggcctacctcatgctgccctggattgcagagggtctccaggcactgaggtgacagcctgcaggagctgtcgccagcgggagcccatgtctggaggctcgaccttcacctccagggcttcgccccttcaggtgacctcactctcccctttcagtgcccatttatttatccctctcctctgattcatatttactgatattgaaagatactcttagaaaacccaaactgtggaaaaaaaacttccttgataatgtgttacgatgacgacactaccaattataaaaatgtggttattgagtaatagtgctggggcaactaaggttactactgaaaaataataaaggcttttttttttttttgagatggagtctcgctctctcaccaggctggagttcagtggcgtgatcttggctcactgtaacctccgcctcctgggttcaagcgattctcctgcctcagcctcccgagtagctgggactacaggagcgtgccaccacgcctggctaattttttgtatttttagtagagacggggtttcactaggtttcaccaggatggtctcgatctcctgacctcatgatccacctgcctcggcctcccaaagtgctgggattacaggagtgagccaccgtgccactgtgaaggaaaaacttccttgctgatgtgttatgatgatgacactatcgatgataaaaatatgattattcagtaatggcgctggggcaactaaggttactgctgaaaaataataaagcttcttgcttatgctctccctataaggaaatagagactaggtctatcaaggtgtcaactgtaaagtatgaaatcacacaagtactgcatgagaaatttttcttacaagtttggagagagaaaggaccttctcagtctcacgagaaactaaaaagttgcataaagttaactatatgaaaattaggaagaaaactgcatggaagaaatcttgactaagatgaaaacaaagtaggagaaaatacttgcaatgaaaaccacactgcaaagcatagtttccttaacctataggaattcataccaaaaaaatctagaaagaacatcaacaagaaagtagtagacttgaacaacactattaacaactagactggacagatgtctataaaacactctactcaatcaaaacaagatacacattcttttaaagtgcacatagaacattctccaaaataaaccatatgcttggccataagataaacctcaatacacttaaaaggatagagataatacaaaatacactctcctaccacaatggaataaaattagaaatcaatagcaggaagaaactggggaacatcacagctatataaaaattaaatagcacactcctaaataaccaactggtctaaaaagaaatcaaaagagaaatcagaaaataagacgaatgaaaatgaagacacaacataccaaaacctatgggatacagctaacgtagctgaagtttacagagaaattgtctattaaggaagaagaaatatccttcctaaatgtctattaaggaagaagaaatatctcaatctataacctaataatccactctaagacactcgaaaaagaagagcaaactatagataaagcaagcagaaggaagaaaataatacagattagagcagaaattaatgagacggagaacagaaaaacaacagagtaaattaatgaactcaaaatctagttctttaaatagatcgatatattggcacaactaattgtgttaaaaaattagcacagggaaaaaataagactcaaattatagtcacgcactgcatgatgacgtttcggtcaacaatgaaccacatatgtgacggtggtcccataatattataatggaggaggaaaattcctatcgcttagtaatgtcataagtcaatgcgttactcaggtgtttgtggtaatgctgatgtaaacaaacctacttcactgccagttaaaagtatagcacatataatgaagttctatatataatatttgataatgataataaatgacttactgatttatgtatttttgatactatacattgtaatgttattttagagtgtactcctacttacaaataaaaaaggtaactataaaacagcctcatgcagttttccagaagaaggcattgttatcagaggacataggagttgacagctccatgtgtgtctgcccctgaagatcctccaacgcgacaagatgtggaggtgaaagacagtgatgttgatgaacctgtccttgtgtagacctaggttaatgtctgtgtttctttttttttttttttttgagaaggagtcacactccgtcacccaggctggagtgcagtggcgcaatctcagctcactacaacctctgcctctcaggttcaagcgattatcctgcctcagcctcagcctcccgagtagctgggactacaggtgcctgccaccatgcccagctaattttttgtatttttagtagagacagggtttcactgtgttagccaggatggtctcgatctcctgacctcgtgatccgcctgccttggcctcccaaagtgctgggattacaggtgtgagccactgcgcccggccaatgtctgtgtttctatcttagtttttaacaaaaaaatttttaagtaaaaaaaagtttaagttaaaaatacaaaaatgtttatagaatacgaatataaagaaagaacattttttgtacagctgtacagtttttgttttttaagctaagtgttaaaacgagtgaaaaagttttaaaaattaaaaagtttataaagtaaaatagttacacgaagttaatattgaaggaaggaaaaaaaaatttacagatttggtgtagcctaaatgtacagtgtttataaagtccatagtagtgtacaggaatgtcccaggccttcacattcactcaccactcactgactcacccagacaagatccagtcctgcaagctccattcatggtaagtgccctagacaactacatcatcttttttaaccttttataccatatttttattgggccttttctatgttcacatgtttaggaactcaaatacttatcattgtgttacaattgtctactagtacaggtttgtaatctaagagcaataggctatatcacatagcctagggatgcagtaggctatatcatctaggtttgtggaggtacactctatgatgtttgcacaatgatgcacttgtcagaatgagttcccatcattaactgaggcatgactgtattagaatcagaaatgagagagagcacattactacagattatatagaaataaaaaaattataaaagaatactatgaaacctgtacaacaaaaaattaggtaccttggatgaaaggggcaaattcctagaaagacacaaactactgaaactgaatcaagatgaaagagacaatgtgaatagacatatagcaagtaaagattttgacttagttatcaaaactactcctaaagaaaagtcgttttcacaagatggcactgaaagcaaagaaggaagctcctgcccctcctaaagctgaagcgatgcaaaggttttgaaggccaagaaggcagtgtagaaaggtgtccactgccatgaaaaaaagaatatccatacatcacccaccttccggtggcccaagatactgagactctggagagcacccccaggagaaacaagcttgaccactatgctatcatcaagcttccactgaccactgagtatgccatgaagaagatagaagacgacaacaacacacttgtgttcattgtagatgttaaaaccaacaagcaccagatcaaacaggttgtgaagaagctctatgatgtttatgtggccaaggttcaacaccctgattaggcctgatggagagaagaaggcatatgttcgactggctcctgattaccatgtcttggatgttgccaacaaaattgggatcatctaaactgaatccagctggctaattctaaatacatgtatatgttttcaccagaaaaacaaagttgaggcccagatgcctttaccactgaatgataccaaccatttcaagaagaattaataccaattattcagaaaccctttttaaagacagcagaggaaggagcactttccaattcattgtataaggacaatattactgatatgatttggctgtgtccccacacaaatctcatcttgaattcccgtaagttgtgggagggatccaatgggaggtaattgaatcatgtggggcaggtctttcccttgcagttctcatgataatgagtaagtctcataagatctgatggttattataagggggagttttcctgcacaagctctctttgcttgctgccatccatgtaagacatgacttgctcctccttgccttccatcattattgtaagacttccccagccacgtagaactgtaagttcaattaaacctctttctttgtaaattgcccagtcttgggaatgtcttcatcagcagcacgaaaaaaaaaaaaaaaaactaatacagtaaattggtaccagtagagtggggagctgctgaaaagatacctgaaaatatggaagcaactttggaactgcataacaggcagaggttggaacagtttggagggctcagacgaagataggaaaatgtgggaaagtgtggaacttcctagagacttgttgaatggctttgaccaaaagcctaatagtgatatggacaataaagtccaggctgagatgatctcagatggagatgaggaacttattgggaactggagcaaaggtgactcttgttatattttagcaaagaaagcaaagagagtggtggcattttgtcccttccctagagatctgtggagctttgaactgggaagaggtgatttagggtatgtggcagaagaaatttctaggcagcaatgcattcaaggggtgacttgagtgctgtaaaaggcattcagtttttttgtttatttgtttgtttctttgtttttaaccaatgttgcattcctaggataaaacttacttggtcctggtatataattctttttttgttttgttttgttttttgtttttgagacagagtcttgctctgttgcccaggctggagtgcagtggcatgatctcggctcactgcaagtccgcctcctgggttcacaccattctcctgcctcagcctcctgagtagctgggactacaggcacccaccaccatgcctggctaatttttttgtatttttagtagagacggggtttcaccgtgttcgccaggatggtctcaatctcctgacctcatgatccacctgccttggcctcccaaagtgctgggattacacgcatgagccaccgcgcctggccggcattcagttttataagggaaccagagcattaaagtttggaaaatctgcaacctgacaatgtgctagaaaagaaaacccattttctgaggagaaattaaagatggctgcataaatttgcataagtaatgaggagctgagtgttaatccccaagacaatggggaaaatgtctccagggcatgttagaggtcatcatggcagcccctcccatcacaggcccgaaggcctaggagaaaatagtttcctggtaggagtccagggtcttgtgctgtgtggagtctagggacttggtgccctacattccagccactccagctgtgactaaaaggggccaaggtacagcttgggctgttgcttcagaggtggaagccccaagccttggcagctcccacatggtgttaagcctgcaggtgcacagaagtcaagaattgaggtttgggaacctccacgtagatttcagaagatgtatgaaaacgcctggatgcccaggcaaaagtttgctgtaggggcagggccctcatggagaacctctgctagggcagtgtggaagggaaatgtggcatcagagcccccacacggagtccctactggggcactgcctagtggagctgtgaaaagagggccattgtccttcagaccccagaatggtagaactgctgataacttatacaccgtgcacctagaaaagctgcagacactcaacaccggcacgtgaaaccagccaggaggggcgctataccttgcaatgccacaggggcggagctgcccaagactatgggaacccgcctcttgcatcagtgtgacctggatgtaagacaaggagtcaaacgagatcattttggagctttaagatctgactgccctgctggatttcaaacatgcatggggcctgtagccctttgttttcgacaatgtcacccatttggaatggatgtatttatccaatgcctgtacccccattatatctaggaagtaactaacttgcttttgattttataggctcataggcagaagggacttgctttgtctcacatgagactttggacggtgaacttccgagctaatgctgaaatgagttaagactttgggggactgttgggaaggcatgattggttttgaaatgtgaggacatgagatgtgggaggggccaggggtgatagggtttggatacattctcactcaaatttcatgttgaattcccacatgttgtgggagggacctggtgggagatatctgaatcacaggggcaggtctttcccatgctgttctcattatagtgagtaagtctcatgatatctgatggttattataaggtggagttttcctgtacaagctctttgcttgctgccatccaagtaagatgtgacttgctcttccttgtcttctgccatgattgtgaggcttctgcagccacatggaactgttaagtccaattaaacctctttcttttgtaaattgccagctttgggtatgtctttatcagcaccatataaacggactaatacaattagcttaatatgaagaccagaaaaggacctcataaagaaagaaaactacagactaacgattcttatgaatattgttgcaaaaatttgcaacaaaatactagcaagttgaatccacaagcatacaaaaagaattataggctgggcacggtggctcacgactgtaatcccagcactttggaaggctgaggcaggcagatcacaaggtcaggagatctagaccatcctggttaacacggtgaaaccccgtctctactaaaaaatacaaaaaattagctgggcgtggtggcaggcgcctgtagtccctgctacttggaaggctgaggcaggagaatggtgtgaacccgggaggcagagcttgcagtgagccgagatcgcgccactgcactccagcctgggcaacagagtgagactccatctcaaaaacaaaaaacaaaacaaaacaaaaaagaattatataccaggaccaaataagttttatcctaggaatgaaaggttggttcaacatcccaaaataaattgatgtaacaaattatatcaatagaatgaaaaccaaaagtcacatgattatctcaaaaacacagagaaagcattttactaactccaacaccctttcatgataaaaatcacaaaataatctaggaataaaagtgaacttcctcaacctgataaagaatatctacaaaaacccacagctaacattatatttaatggtgaacaactgaaagatgttctccaaaaaagatatctgttttcactacttttattcaatatggtactggaggctctagccaggacaattaggtaagaaaaagaaataaaaagcatccagattggaaaagaaaaggtaaaactttctctatttgcaaattatattttcttatatagaggaaatcctaaggaagccattataaaaacattaagaataacaaacaagttctgcaaggttatagaatacaagatcaatgtacaaaaatcaattatatttgtatacactcacaatgaatcctaaaatgaaattaagaaaaggttttatccacaatagcataaaaaagtattaaatatctaggaataagtttaacaaaatcaacccaaaatttatagtctgcaaactacgaaacattattttaaaaattagagatgatttaaataaatcaaaaaaactcatgctttgggatcaaaagacttctcattgttaagatgccaggaacctctaaactgagcaacaggtgcaacacaatccctgtgagaaactcagctgattttagaaattggcaagctgatcctaaaattaatatggaatttcaaaaagcccagcataaacaaaataattctggaaaaggaaaacaaaaaagaaagattcatacttcctgatgtcaaaactcactacaagactgtgtggcactggaaagaggacagatatagatcaatggaaaagaattgagagtccaaaaatacacccatacctttatggtcaattggtttttgacaaggatgccaaggccatttaatgggaaaaatcatcatttcaacgaatggcaactggatagccacatgcaaaagaatgcagttggacgcttatctgatgccatttacaaaaattaactgaaaatgcatcaagagttaaagtacaaaactcttaggagaaaacatggggataaagcttcataaccttggatttggcaaaggatcaataagtatctgttgaatagaagaaccagaaactgtaggaaacagaaaacttgaagaacatggaaaaggaatgttattgatgaattttgagataatttttgtatatagtatagggtaaggaaaagagaggtgtaaaggattagagatcagtcttagaatgtacctggtggacacaactctcccaaagggctatgttcccattgctgtgtgccaattgattgatcatgaagtttgatggttgcagctgagctaggtacgacctgtggggacaaagcagggactggcatgagtggcttccagatctcacccattacaagatcaatctcacattccattcccccaagcctccaaaattagacagaacttgcatctttctcccagttctaaaactcaaccatttgtttgtgctcatctttgtctctttgtccccatgcccccagcctgtggcaactaccattctactgtctgtttctatgaatttaactactctacatacttcatataaatggagacatacagtattttatggttttcttgaggctgtcatatttcaattagcataaaatcatcacgatccatccattcggtaccatgcattggaatttcattcctttccattgtgtgtatatgtattacgtttatccattcatctgtcaatgggcacttggtttgtgttcacattttagctattgtgaataaagctgctatgaacacgggtgtacaaaatctctttatgccctttctttcaattcttttggatatataccccaaggtaaaattgctgttttcttacaagagttgtataattcttatagatcttacatttggaggccacatatgaaaagccaacagctaccatcctactcaatagtgaaagactaaaggttttttctccaagatcaggaacaagacatggaggcctcctttcatcacttctatattatcagggtaatgcggggcccacacgaagagttagaaagtgttccctccaactcagtttcttggaagaatttgagaattcatgttagttctttaaatgtttggtagacgtcatcattgaagccaactggtcctgggcttttctttgctgggaagttttggattatggattctatctccttactatagttctgttcaaaatctctatttcttcatgattgaatattggtaggtagtgtgtttttagtaatttaccagttttatcaatgtgctctagtttgttgacatgcaattatttatagtattttttataatcctttggatttctgtaaagttgttttaaatgtcccctctttcatttctggttttggttatttaagttttctgtcttttttcttagtccatctaagtaaaggtttgtacattttatagatctctcttaagggtcaactttcagtttctttgagtttctctgcagtttttctattctctatttctgttatctctgatctattttttgctggtttgggcttagtttgctcctctttttttttttttttttttttttttttttgagacagagtctcgctctgttgcccaggctggagtgcagtggtgcgatcttggctcactgcaagctccgcttcccaggttcatgccattctcctgcctcagcctcccgagtagctgggactacaggcgcccgccaccatgcccagctacgttttttgtatttttattagagacagagtttcactgtgttaggatggtctctatctcctgacctcgtgatccgtccacctcggcctcccaaagtgttgggattacaagcgtgagccaccacgcccagctgtttgctcttcattttctacttcattatgtaaaaggtagattgttcatttatttcttcttttaatgtggtgagcatttacagctatcattttccattataacactgctttcatatcctgtaacttatggtatattgttttcatttgtctcaagatattttcttttgaaacatttttctaatttccataggtttgagggtacagctgctttttgttgttgttgttgttacatggataagttctttagtggtgagttctgagattttagtgtgcctgtcatctgtctcaagatattttctttcttttttgaggggggtggggcctcccacaatctgcccaccttggcctcccaaagtgctgggattataggcgtgagctacagagctcagcctcccaagacattttctaatttcccttttcatttatttttttacccattggttgttttaaaatgtgttgtttaggccgggcgcagtggctcatgcctgtaatcccagcactttgggaggccgaggcaggcagatcacgaagtcaggagatcgagaccatcctggctaacacggtgaaaacccgtctctattaaaaaatacaaaaaattaaccgggcgtggtggcgggtgcctgtagtcccagctacacgggaggctgaggcaggagaatggcgtgaacctgagagacggagcttgcagtgagccgagattgtgccactgcactccagcctggacgacagagccagactgtctcaaaaaaaaaaaacagcaaaaaagtgttgtttaattttcacatatttgtggattctccagttttccttctgctattgatttataatttccttttattgtgattggaaaagatagtttgttttatttcaatttttaaaattgtattaagacttgttttgtggcctaacatatagtgtgtcctggagaatgtttcatgtacccttgagaaaaatggatattctcctgtgattgggcagtgttcacatacacacagacatacacacgcttttactaatgagggttaggtgatgtgtaaattttttaaaaagcaggatactgaatcaaatattaaataatgaacttcaggtttaaaaaggcactttacaaactgtcccccaaaacagcctgccaatgtcccatgaaatactagagtcagaaaaagatgaaagagcagtatagttattcaggacaggatttctgtgcaataaattacattataaagacaagtgaaaaccattggggtctgaggattagctggtagtaatgtactgatgcttactgtctgatattgaggattgtattgtggttatacgggagaatgtccttatttgttggaaatatccactcaagtgtataagggtgatgtgcgttctgtgggtagcttgctctcaggtggttcaaagtaaagggtatagtataatttttgcatcttttctgtaattgggagattttttaaattagaaagttaaattagaaaaggaagagcaggggggccgggcgccgtggctcacgcctgtaatcccagcactttgggaggccaaagtgggcgaccacctgaggtcaggagttcaagaccagcctggccaacatggtgaaaccccgtctctactaaaaatatgctgggcgtggtggtgggcacctgtaatcccagctactccagaggctgaggcaggagaatcacttgaacccaggaggcggaggttccagtgagctgagattgcaccactgcaccccggcctgcatgacagagcgagactccgactcaaaaaatagcataactaaataaataaataaataaataaacaaacaaaacaaacaatgaattccaattcatagacagctttaggaatatttaaattatctttatttcttgtggctattttgctaagtagtgttttttaagaaatttgtctatttaatccaagttgtcaaattgattggcataaagttattcataagatcccactattttccttttaatggctgtagagtttgtaataacatcccatcattaattcttgatattggtatttcatgctgttgttctttttttcttttaaagtttggtttattacttttttttttttttcctgagatggagttttactcttgttgcccaggctggagtgcagtggcgtgatctcggctcactgcaacctcggtctcctgggttcaagcgattctcctgcctcagcctccggagtagctgggattacaggcatgtgccaccacgcctggctaattttgtatttttagtagagatggggtttctccatgttggtccggctggtctcaaactccagacctcaggtgaatcgcctgcctcggcctcccaaagtgctgggattacagggatgagccatctcgtccggccagtttattacttttattaattttgttgatcatttctgagaaccaactcttagcttgttgattccttttattgtttgaattctatttcattgatttcagtcttattatttccttgtcatgttgttactacctttgagtttaatttatacttattttacgggtaagtaatgcacacctctgagtcattgattttgataccattcttcttttaatccttaagaactttactgagatatactttatatatgatgtaattctttcctttaaatatatttatagaagtgtataaccatcaataaaatcaatttttgaagattttcatcatcatccccaaaagaaactccaggccaggcacggtggctcacgcctgtaatcccagcactttgggaggccgaggtgggtggatcacgaggtcaggagttcaagaccagcctgtgcaacatggtgaaaccctatctgtactaaaaatacaaaaatgagccgggcgtgctggcaggtgcctatagtcccagctactcgggaggctgagacaggagaatcacttgaacccgggaggcagaggttgcagtgaaccgggatcacgccactgcattccagcctaggcgacagagcaagaagccaattcaaaaaaaaaaaaaagaaatattttgaattctctttgatttcattcgtgaactatgagttatttataagtatgttgcttaatattcacatttttggagtccttctagatattgttattgcttaacactttaatttcattgagatcagagaacatattttatattattttgttttaaatgtatttagatttgttttatagttcacaatgtggtctatcttggtgaagtaccatgttcatagaagagaaggaatctcccatagatgttgcatatatgctctataaatgtcagttaagtcaaggtggttgacaatgttcagatctgttattttactgttttcatctgatcgttctatcagttgctgagaagggggtgacatgatctccctttaatccttttgagcgttgcttcatttattttaaagctctactattagacatatacacatttatgattattatgccttctgatgaattcattttttttttcttttttgagacggagtcttgctctgttgccaggctggagtgcagtggcacaatctctgctcactgcaacctccgaatccctggttcaagtgattctcctgcctcagccctccccagtagctgagattacaggcaaatgccaccacacccagctaatttttgtatttttagtagagatggggtttcaccatgttggtcaggatggtctcgatctccttgacctcgtgatctgcccacctcagcctcccgaagtgctgggattacaggggtgagccactgcgcccggcctgaattcacttctaacactaaaaatagtaccttaaaaaaaaatctctactaatagcaagtgaaaacctgacaacgagctcctggtgactctggacctggacagtgctcagccttctgttcagctgttcttcccacctctcacatgaaacatgtctatgaaaggctgaggacgtcacatctgcattggtgcgggcttcctagaacccatgttactcattcatccaaggagggcatgtcggcgcctggtagaaacgctgtgcaaggaatcgtggggtatcaagaaaaaggcacgaccctccctttccttaggacagttccagttcccagggagatgaggcacagccatcaataacccgagtcacgaggggctgcccaggcagaggtgacaaatgccactggtggcagggacaccggtagacatagagggaaaggtccacatagagggaaaagtccacacaggcaggttcctaggcagatacgaagtcaaggcagtcggggagggcagtcaaaacaagtgatgctgggacacaactctgaggtttgtgggcgtctgattaagggagatggaaggtgaggtcagagaagtgaggttctcagttcacagatttgggctcatgggggtgtgaggttgtgtgtgtgtttgtgtgtgtgagagagagagagggagagagagaaagagagcaagagagagaggtcttgttccaggtcttctcctccatagactctcctgaccctgccctgcctcttcctgagatgagtcattcaccagggggtttccttgccttgttcctctcggattagcattgtgttaggctgtttcagaggtaagtttgatattcacactgatttcctctctcaggcatacacaccctaaaaaaatgccttattgatcttaaaatgagcaactcagaattgttctgaggttggctgtggtcgaaaatctgcttcctttgagtctttcgtggcttttttatttctttgttcttttggtataaaaagacccctgggttaagaagcaagccatctgtcttgtagtctcgggccagcctcatggtctgggggaagccacttcttctctaaacatgtctatcattctggaaataagaggtggctttacatgacttctcaggtacccccagcagtgacccagcgctgggtgaatgcaggcctcatgaaaaagcaccaaatactcccctgggaaaggtcagcagaacccagtgacccaatcactgctgctgccccgagggttgctcatcctcctgcccagcccctctactgaacaaatgttctgagtctcatgctgtttgtctaaaacaaagacaatgagggttcctgtacagtctggttgtatgaggattaagtgtgttcatttacatatgaagtgctaagaacagagcttggcacacgcaagtactgtatttcagcacatgctgttgttagtacaatcattcccctcaatgttgattttaatgaaaccacatcctctaagccaccaataccatgacctggggccttgcaactgctggagtcaagtagggagggatggcatccctggagccggcacagcctctctggaggtggggggtgggggaggtggcccccatgcttcctgatagttatttaggtccctagtgacacctcctccaccagactgtgggcttcagggagcaggactgacacagggctcatttgtcctcccaccaccaccaggcgcagacattctcagagtaaagtgctcatcacctacttcctgggtgagtgactttccctccaagcccatgaggtgagcccagtggtggcctcagctcaccgcctcaggtcacaggttccaggctacagcacagggatgggaccccgaagagtcctgtggactctgctaaggaaccctaggagctcccagaggccaagtgcagggcagagatgtggagaagcagctgctcagaggactttagccctgcagaagccaaaacacggctgctattatacagaaggggagaccaaaaatgctacagacatggctccggcagattatttttgccaccatcgaagtgctgaaaccacactgttaaggagaaaatcttaaaagcagccagagaacaaagatctcctccccacagacaagccaggtgagaggcgcagcctaagccctgaaaaaccacacaggaagaggcagcggcagaggccccaccccagccggtgctgctcccctctcctcttcatcaggactgtccccgctccctccacccagtgctgagaccaacagcagacatgggggcgagggtgtgatgcacttaacatgacctaagccacacaaatatattaccaacaaactccaatgacttaactttgagattctcttcatctaagtttttaaagtggtcattcctagtttctctcattcctaccagtgctctggacagacttgcctgtggccaggtgcacacacgttccccctctgagctgcacacactttccctctctgagctttggtcctctcctctgtaaaatgtgatgattcacatcccctcctggccacaggcgagtgtctgaggtgccgagtgcaccctgctcttccctacaaagcagaccctttctcctttccccattatcacagatacctgcctgggaatccggaagaggcccttcccagtccaacaggcagctgctattatcaagcaggccaggtcccaaatgctggggacttcctcctcctaaatctcattttctccccagacaaaatgagagcaacaatccccacatccctgggttaggaaaataccctgaatgaagatgtgcagtctctggctgggctggcccaatctctatgccaggtccttccacctcacctctctctttagcaaagtagaaattgagaaattctgaaggctctgaagcttagacactcaggctatcaaagagcccagagattggaggctgaagactgccagggttggccgtgctcctcttcagctgtgactctgctgtggccccagctccttcctataaactaggcagatataaaatctgcagcggccctttataaaccacagtggtctgtgttggcagatgtgtgctgccgtgtaggaggacaaatcacatgctcagggctggtgtcagtcactcatgactctggatccccagggcacctgtcctaatgaacttgaaagagaactgaaggcactggcatttttccagactaagtgacaccaactgcccaacagcacaggctcagggcatggcactgtccccatctccgacctggaagctaaagccttgctgccctgtcactcctggatacaggacagaggaccagaactgggactgttgcctctcagtaggggctgggtgagcagccatctgcagccacatggatggagacctttcctgctcactcttcaaactgcaaccagtgccgggtgcccaccagaaggacaactggaaggaaacgtggcaggtaagccaggctgtggccctgcagtgacatctttgtcctaacttgaagtctggctcctctgttcctccacggcccctccccatggcgctccaccccattccttagaaccttctgccccaagctcagagagccagtatggaggtgcaggtgggagcaggtgcagcctctgctgggtagaggacaggtgctctggggatccagagtcctgagtgactgacaccagccctgagcatgtgatttgtcctcccacacgacagcacacatctgccaacacagaccactgtggtttacacagggccgctgcagacttttatatccacctagtttataggaaggagctggggccacagcagagtcacagagctgaagaggagcacggccaaccctggctgtcttcagcctccaatctctgggctctgatagcctgagtgtctaagcttcagagccatcagaatttctcatttcctactttgataaagagagagacgagacgaggtggaaggacctggcacagagattgggccagtccagcattgacagagccaggacctggggtgagaaactgagctcagctccaggctcatctgatgtcatcctgacagtctgaggacagagacattatctccattcacaggcatggcgggtggcaggaactggccccagccgaccacagtttcctaagtgcagaggtgcgactgcagtcttccctgctccctccccaacggtctaatctggagtctctaggtcatctactcccagtctcaaaaaattcctggatccttgaaaatctctaataacactgaaacaaaaaatacaacattgaggtctatcattttttacctcttagagtagcaaagaatgaaagttccatgtagtaagggtgcagggacacgggcacgcttgtgtattcttttttttttttcttgaaacggagtctcgctcagtcgcccaggctggagtgcagtggcgagatctcggctcactgcaagctctgcctcccgggttcacgccattctcctgcctcagcctcccgagtagctgggactacaggcgcccgccaccgtgcctggctaatttttttcaatttttagtagagacggggtttcaccgtgttagccaggatggtctggatctcctgacctcgtgatccacctgtctcggcctcccaaagtgctgggattacaggcgttagccaccgcacccggccacacttttgtattcttggtgtgagagtaaaactggcacaatcttctcccgaagtacaatttagcaatatccaaacaaaattctacattgatgagctcatgtacctaaaaattcctcttctaaagggctgcccgatacttcagggaacattgacatatggacatatgacacatacaagggttctcactacaatgctgctggaattagaaaaaacaaaagcaggacataatgttaacaattgcccatgggatggaagattaaaattaactgtggttcacgccatgtgtttcacccatgcactaaatattatgatgctgttaaaaagaatgagatacttgcatgtactgatagaaaacatccaatgcgatttgttcttcagtcagaattttaaaagttaaggtgcctataaatgcacaggaagaaggctgagggatggtgggatgagagggtcctgtgggatggcagaaggccttggtgtctgctacgggtcctttgtccctgccagggctcacgttgaaatctgaaccgtaatgtagctggtggggcctgttggggtttggggtggatccctcatgaaaggcttggtgccataaccgccccctcccacattcccccaggagttgtcaatcttagttccccatgacacctggttgttagaatgaacctggcccctccccgtctcccttccggatctcatccccctcctcctgccatcctccccaccccttcccctgatgggcagaatccagctgtccttccccttcaccaccagtggaagtttcctgaggcctcaccagaggcagatgctggtggcatgcttcttgtacagcctgcagaaccatgtgccaaataagcctcttttaaaattatccagcgtcaagttttcttttttattttttttcttttccgaaacggagtctccctctgtcgcccaggctggagtgcagtggcgtggtctcggctcactggaagctccgcctcccaggttcacgccattctcccgcctcagcctcccgagtagctgggactacaggcggccaccaccacgcctggctaattttttgtatttttaatagagacggggtttcaccgtgttggccaggatcgtctcgatctcctgacctcgtgatccgcccgcctcggcctcccagagtgctgggattacaggcgtgagccaccgcgcctggcctcaagtattcttttatagccacaccaacggactgtgacatttccaaaaccaccaaattcagatgtttcaccttgtctatacaggtgagccctacatccacctggaatcgcactagcctgtcaaaaagaaagccatttaataagcgtattaaaaataagagtcaaacgtgggttccacctaacataaactgacgtttaaaacataaattctgtaattatttggagatttcaaaatgctattggattcctggattttgtttagtttgttaaacaaaaacacgtaaaatttcctgacacttgtaagactggtttatccttcaggtacttagctttcgttttgtttttccttaacatagaaggaatctggatgagaacaattggtagagccttaatgaacttgaaagagaactgaaggcattggcatttttccagactgagtgattgctttcacaggaaacgctgcctcctgaaggaagggcgtgccccgctcctggctgcctgcctcgtggtggtcaattcgctgccctgtacctgttgatgcgcaagaaagtggctggaaggaaactgctgccggtgtgctcagtggactcgaaacggaagacaacgagcagaggagagaaagttactttttcctgccgggctgcgtgtttaaccaatttgtctaagaaaagaaggatggagggccgggcgcggtggctcacgcctgtaatcccagcactttgggaggccgaggcgggcggatttggctaacacagtgaaaccccgtgactactaaaaatacaaaaaattagccgggcgtggtggcaggagcctgtactcccagctactcgggaggctgaggcaggagaatcgcttgaaccaggaaggcggagcttgcagtgagccgagatcgcgccactacactccagcctgggcgacagagagagactccgtttcaaaaaaaaaaaaaaaaaaaaaaagaagagaagaaaagaaggacgggggtggggagggaatcagggagtggggagaatggcgctccccttcacgcagctggtgtggctgggagttggcttggaagtttacacacttgagctctatcgattccgaaacttcccgatacatcgtgaggtgtgggcaggagggagacgcgccaggcagcagccaacggggtggagtccccgggcccagcctcctgcgggagggggctctgctgcctccaggcccgggtcgctcctgcctggccccggggaccccgttcttcctccgactccgacgacgggctcctcctgcccggacatgccccgccacaagtgacccgggccaggcacccccgccgcgtccccctctctctctgccccctcccggtgccaggcgcgcttttccccaggcaggaccgcggtggggactcacctgcagcaggaccccgacgacgacaaacttgaaggtcttgtggacccggagccgagggctggcttcccgcgccggcctgggtcctggggcgcgccctgcccgggcccgggcactgggtccgtgctgtcccatggaggtagggagcgctcctcggcccccgcctcgtggttcaatcctccccgcggaagagccccacactttgctgggtgtggccgcggctgcctctgtcccactcgctgcgctcccgggattcggagtcactgccaggaacgcacctagatgtactctagctggtggtggcgccatcctgccaggtcaatccaagaagcagcgtgcttggctatgacaagacagaacttcgcattcggagttcagggcacccctgaccccgcccccttttcggggcacctgc

SEQ ID NO: 250 - DNA, 81437 bp, Homo sapiens
agtccagatgatagttaagaaagcagtaagaatacagagagtccacaatgagatgaaaatgcactgccagttgaaacatcctcctacactggagctttataaatattttaaagacaaggattggattagatttgacattagaaatgtaccataatacagaaggcaatggacacctaaagaacagaatgaaaaccttcttaggaaatgaagcttgacacttcacccaccaggccaccacaagaatgttgcattttcattattatggtaagtacactggtaacttcttttctaacctcgtatgcataatgtaaacatcaagactgacaatttggggctagcaactcaattggaaaatcactgttctctattgtaaaattcctaattatgtttccctagaaattgcaaagtgcacatgtacttgcatttaatgtttggtccatgggctgaatgctttgtgcattacttttctggttgttgttgttgttgttgttgttgttgttgttgttgttgttttgagacagagtctcactctgttgccaggctggagtgcagtggcatgatctcggctcactgcaacctctgcctcccaggttcaagcaattcttctgccacagccttccaagtaactgggattacaggcgctcaccaccacaccctgctaatttttgtacttttagtagagacggggtttcaccatgttggccaggctggcctcaaactcctgacctcaagtgatccacctgctttgacctcccaaaatgctgggattacaggcatgagccaccttgcccagcctgtgcattacttttgaggacacatttgacaatggcacagtcaagaacaccacataaagtagtattggcagattatgaaatagcaattgttttggaagacagcaaaacctgaagtattttcagacatgtacattatgaagtattataccttctttaactatgtgcaagttaaaatcagtcataactgaaaatcaaaagggcaataatgaacatacttcatccagaagaggtatccacaaaacttctgaaagaggtcttagtatatccagggatggagatattattacaatgtattatccaaatgatggaagttttctcttgctgatagaatgcatccacctactaacatcagtaagtacaggtttaacaatttaccagaaatgtactggaggaaatatgaatatgcttccagatttattctacctaaaggatctggctctattttacaaggtcatctattttacaaggtactgtagatgcattttgatgaaaaaaattaccctgctattgattttgaggtctggtattatgatagagcaaaaactatccaaaagagatttaattcaagtcattgcaaaatcttggaaaatgtgtgagaaatcttacacatggaaaggaggaagtaaagatggtagcttaaacatgtgttccactgtgaacaattctctgcaaacccacccccaaaagtcaaggaggctgacaggctgaagaaagaggctgtcaaatctagtttctcagaaaaagaaaaattaatagggacttaagaacagaagccatatatctgccctgagatgagctggtggatcctcacactgttacccccagacccagggcttatataccacagggaaagacaattgcagtaatttgcttaacggcaggatttacggcaagtacatgctcttaagagtagattaagtagtaaccttagaggcattcctagaactggagttaatcagaagtcaacacagtggattagcatccaagatggagttgctttagcctccacaaagagaaaatgaagataaatttggtccatgctaattagggggtgttccatttgtttgaaactgaaatctataatttccaaagaagaaaataaacgtggaagtcgtccttcctttttggtatgcatagacaatctggcagtgttaggcccctaaggccttatcacctcctccttctgtgggtcaaactttacagtgagaggaaagacatcttttaaaagaagaataatcatgactagtttaatcatgactagttcatcttccctgcaatagatacccatatttaacatacctattgtacaaagaatatgattgcacagctacaactttgggacaaactccttttctgccgctttcaatgatcgtcttccaaaatcagaacagcttttgaattttattttgtgaaaaatgtcgtttgagtgacacagtaaactctgtggagctctgtggatacagttgaatgatggctcccagtttatcatgcaggtgggattatattccaacagttatgtttcacagaaaggcaaaataaccaggtacggaaaaaatgaaaaatttgcagcttacatcaaacagaaattgcagtgtctttcatctctttaaagttttctaatcaaaattctagttttcatcaattaaaactttatttaggtagatacatttaataagtaactttttgttggcttaaagggaatgaactttatgtaatgtaactgtctatttcaggaagcttttctatgagaatttaaaactacaccaaaatatcttcttttttttttttttgagacaaggtgtcacattgtctctcaggctggagtgcagtggtgtgatcctagctcactgtagccttgaattcctgggctcaactgatcctgctacctcaaccccccacgtagctaggactacaggcctgcaccaccacatctggctaattttttatatttttgtagagaaatggtctggctacgttgcccaggctggtcccaaactcctggcctcaggtgatcctcctgcgtcaacctcccaaagtgttgggattacaggtgtgagcaaacctgccatctcaaaacatgtgtattttaatgagacaacaaagatcaagggaactttagtccttacaatgtaatgatcaaaaaagtgaaatagataatcaacataacattgcttgtagaccatgcaaacaatcttattgcatttgtatatttgtaatgaactgttttataataacaaaatgtaaaatgtgtattttatttgtccttttattgttttcctacttcttagacatgttaagaactatggaaaaagatatgggagtttgtgaaaatttaaataattcatatttatattacaagaaacagatattagaatatgtttgttttatatttcttttgtagcagaattttctagccaggcattgtggcttacacctgtaattccagcactttgggaggctgaggtgggacaatcacttaagcccaagagtttgaaatcagtgagggcaacatagtgagactctatctctacaaaaaattctctatctatatctatataaaggaattttgtgaggaaaactatatattttgtatataaatgaattttatcaggaaatatatctgtaaatgaattttataaaatatagcatcactttatccttgatttatttcatttaataattattttaaagtaatatactaataaactcattttaaaaactgctatgaccataaaactattagagataacataagagaaaatctaggtgaccttgggtttggagataactttttatatataacaccaaaggcgcaatcaatgaaaaaaaatgacaagctctatatcacatatcaatattaaaatgtgatctgtgaaaggcatcgtcaagagaacaaaaagacaagccacagactgggagaaaatatttgcaaaagacatatgtgataaaagacaattatcaaaatatacaaataattcttaaaactcaaaaataagaaaatgaacaactcagttaaataatgggcaaaagatctcaacagaaaccccatcaaagaagaaacacagtggcaagcatatgaaaatatgatctacatcatatgccattaggaaattgcaaattaaaacaatgagataccactacatttctacattggtgaaaattccaagtactgacagcactctcagtgctggtgaggatatggtgcagtagaaatccacactcatgccgggcacagtggctcatgcctgtaatcccagcactttgggaggctgaggcgggtggatcaccaggtcaggagtttgagatcagcctgaccaacatggtgaaaccccggctctactaaaaatacaaaaattagcccggtgtggtggcgggcgcctgctactcgggagtctgaggcaggagaatcgcttgaacccaggaggtggaggttgcagtgagccgagatggcgccactgcactctagcctgggcgacagagcaagactccatctcaaaaaaaaaaaaaaaaaaaagaggccaggagtggtggctcacacctgtaatcccagcactttgggagactgaggtaggcggatcacttgaggtcaggagttggagaccagccttgccaacatgacaaaaccctgtctctactaaaaccacaaaaattagccaggagtattggcacatgcctgtagtcccagttactcgggaggctgagacaggagaatttcttgaacccgggaggcggaggctgcagtgagccgatatcgcaccactgtactccagcctgaacgacagggcgagactctgtctcaaaaaaaaaaaaaaaaaaaaaaaaaaggaaagaaagaaagaaagaaaaaagaaaattccgtgattgcagtctttacgtatttatttgttattaagtacagtaaaataaagaaggatagatgtcatggaaaatgtcacgaaaataaaagagttaaaaaaaaaaaaaagtaggctgcaatgccagatgcctgaaaagttaatcaacgaaaggacttaaatgtccccattgaatttaggaacaaagaagtaattaatgaactgggcaaaaacactcaatgtaccagcgttatcgatttagaaactgaaactaagtatatctgatgttgcttttaggaaacaagtaaatgaggtcctaaaaagttaaactgtgaccatattttctttcctttttctaatttctccttgggccatttccaaaaagccctaataccccgactgatagaaatggataccttgctgtgcactggtactactgtgattcatggaaagctgatcatgcaacccaagacgccaaaattcccagccttactgttacgaaagaaagtttctaagcacaattgtctctagccaacttcctcttagtaagaaagaggccaggcagggcttcatgcagggtacagccctgagtttcttactgcgtggtaagtttctggggctgggagtaaagcagcgtgaccgaaagcagtacaaagttctaccggacacgcagatcccggtcctacaaatatgaggtccataatgagactgagatatcattcatccaacaaatatttattgaataccaaacattgggcttacggctaaaggaaaatacaaagttgtgttggatatgggttctgttttcaaggagcttataatctaataggaaagatgaggttactacattagtagcaatcagaccagatagaactggaagtgtgatgtaaatgaggtacagattgattgtagaattttgcagaaagaaaacaattctgaagaaatgttcatggaagtattagcagttgagatgtatcttaaaagataagtggggttcctgttggaaacattcaaaactctctcttctagctattttaaaatacgcaatatattattaactatggtcaccttactgtgctatagaacactagaacttattcctactatctaactataattttgtacccactaaccaacctctccctgtccctcctccccctattcatcccaccctctggtaaccactgttctactctctgcttcccaaaacaaagaaatgatcactgtttcggtgatggagatgtcaattaccctgatttgatcattacacattgcatacatgtatagaaatatcacatgcaactcttaagtatataccattcttatgtaccaaatacaaataaaattgaaaaaaaaaaaaaactttggctgggcgcggtaggtcatgccagcactttgggaggctgaggcaggcggatcacctgaggtcaggagttccagaccagcctggccaacatggtgaaacccaatctcttctaaaaaatacaaaaattagcttggtgtggtggcaggggcccgtaatcccagctactcaggaggctgaggcaggagaaatgcttgaacctggaaggcagaggctacagtgagccgagatcatgccactgcacttcagcctgggtgacaaagcaagactccatctcaaaaaaaaaaaaaaaaaagcctcctgagtaactgggactacaggcatgcgacaatactcccggctctctttttaaaaatgagaagtagaagtagtggtgactgtcaagaaagtattttggaaaaatactatgaataaccagaccaaagaaaccaaataccagttgtttcaggagcagtaaatcatttttgagggcttgagcaaaggtcttgctagaaaggtgcttaggggtcagattttggacataatgccaggccaagaaaatttgcactttatttcattaacaatgaggagctcttgaaagttttattggcaggacctaagatagttacagacccacaagtaacatgggtctagaccttgggaacaagaaaagtcaagatcgagtatgcagacttgggaaccgagtataactaatggttaagattaaataaaaatacataagaacactgagatagagaaatggctcattaatgctgcaaatgtctgcatgtttagggatgaaatagaaaaagaagtcagaaaaatacagttcaaacaataggaaagaaaaccagaaatgcatgattctaagaaatgaatgggtggacatggtggctcacatctgtaatcccagcactttgggaggccgaggcagaaggatagctacagcccaggagttcaagaccacccagagcaacacagcaaaaccccatctctacaaaaaacaaaaataaaaattagccaagcatggtggtacacacctgtagtcccagctactcactcaacaggctgaggcagaaggatcacttgagcccaggaggtgaaggatacagtaagctatgattgcaccattgcactccagcctggctgagagaatgagagcttgtttccaaaaataaaaaataagaaagaatttttagaatgagaggaaaacaacatgaaacatgagaaaaataacattccctgttatatggtaggtgcttcgcttatagtttctcattaattcatcatgtaatgtctctgggataaacattatggatttcctgcagaaacagaagctcagaattttatgccaggtgttgaaaggccatgtagctaatagatgatagaacacagactcacactctggtagtcctgagttaacagtagaaaagtcctgggctgggcgtggtggttcacgcctgtaatcccagcattttgggaggttgaggcaggcagatcaccagaggtcaggagtttgagaccagcctggccaacatgactaaagcctgtctctaccaaaaccacaattacccagcgtggtggcgggcacttatagtaccaactactcaggaggctgaggcagaagaattgcttgaacctgggaggtagaggtttcagtgaggcaagatcaagccacggcactccagcctgggtgacagaatgagactctgtataacaaacaaacaaacaaaatcagtaagaaagtcccagactaagaggcatcaaatcaggattctactccaactctgatgccagcttccaggaatacacttgataagttgtttcattcccataaatcttgggtgattcgtgtttaatgagagcattgaactgaatcatttattctatgactcagttctaatatttcacaattctatggttgtataatattacaggaaattcttgagaaggtgcagagggaatggatgaaaaaaaccacatgactaacataaaaaataatggggccatcttttcatttgagattgaaggaaagaacgagaggacaattaaacatgcagagtctgagaacttgcatttaggaggcataagatgctgaactgcaaaattggttagatattgggctgaagagaattgagaattttttaataataaaaactcttggcagggcgcagtggctcacgcctgtaatcccagcagtttgggaggctgaggtgggtggatcacttgaggtcaggagtttgagaccagcgtgactaacgtggggaaaccccgtctttaagaaaaatgcaaaaaatattagctgggtgtggtggtacaagcctgtaatcccagctacttgagaggcttaggcaggaggatcacgtgagcccaggaggtggaggttgcagtaagccgagattgtgccactgtactccagtctggatgacagagggacactatctcaaaaaacaaacaaacactcttaagaaattaggtgtagaaagaatgttcctcaataccataaaggccatatgtaagaaacctatagctggccgggcgcggtggctcaagcctgtaatcccagcactctaggaggccgaggcgggcagatcgcgaggtcaggagatcgagaccatcctggctaacacagtgaaaccccgtctctactaaaaatacaaaaaattagccgggcgaggtggctggtgcctgtagtcccagctactcgggaggctgaggcaggagaatggcgtgaaccccggggggcggagcctgcagtgagctgagatcgcgccactgcactccagcctgggcgacagcgagactccatctcaaaaaaaaaaaaaaaaaaaaaaaggaaacctatagctaacatcatactgaatggtgaacagttgaatgctttcgtctaagaactggaacaagacaagcacgccaactctcaccactcttactcaacatagtactttaagtcctagccagagcaatcaaacaggggaagtggataattgagaatggctcgagaggtgctgtggctcagtcctgttgtcctggcacagaaggagctgaggccaggcgttcaagaatggctcctagatgtctcataaggaaccataaatcaaacaactttcaaaactgaaacctgcgtgagaacggttgcattagttaatctgggagcttcctgcttttttttagctttcatatttatcttagagaaagggaggaaggagagatgtgtatggatacataagcattcaaatacatttgtgtataatcttatgaccagaattcaggtccaatgaacaaaaaggtagggtcttcggaatttccccagtgagatctatgacctgaatattattacgcaaggatccactttgggattacaggcgtgaaccactacacccagcccaggactttcctgctgttaactcaggactaccacaatgtgagtctctgttctgtaatgcccaaccttgtttttactaaccccgcttttagactccccgttttcctttaatcacctagccttgtttccacctgaattgactctcccttagctaagagagccagacagactccatcttggctctttcactggcagccccttcctcaaggacttagcttgtgcaagctgactcccagcacatccaggaatgcaattaactggtaagatactgtggcaagctatatccgcaattcacaggaattcgtctgattgataacgcccaaagccccgagtctatcaccttgtaatagtcttaaagcccctgcacctggaactgtttactttcctgtaaccatttatccttttaactttttgcctaatttatttctgtaaaattgttttaactggacccccctcccctttctaaaccaaagtataaaagaaaatctagtcccttctttggggctgagagaattttgagcgatagccgtctctcggtcgctggctaataaaggattcttaatttgtctgaaagtgtggcgtttttccaactcgttcaggtacaacagttctagcatctattagctatgtggcctttcaacacctggcataaaattctgaacaatggcttggaaattaagataccttagctctagtccttgctctgctaataattaatagagtgaaactggacagggttattcacatgtgtgtgcctcagtttactgttaactgaagaatgacaaagttcataaatttgaaaaggagaggtttcttatatggggttgcaacctgcagggtggccatgctacagtctgggaagcattgcctctggctggaagccagaaacaggcactttcagggtcagaagaataagacagagatttatgctgaatggggtgaccaaatatacatattcaataggctataggaggagttatgaatatttatgaaaggagaaatgtgtacatgtgcaatttggcttcatgccccttcatgggacctacattcaaaaaatggcagccttagcatgatctgagggaggatctttcagccctctgaggtcaaaagtgaaggagaggacaggaaaccctcactgtgtgttctccgtaggggccagaaccactgcatgtttggtgaacctggctggttgttatgttgaaactgcaaaagggagggataacagtcaggtgcttgtttgataccaggggtagaggagactttcaaaagggctggtttctgtttagcccttagggaagaatgtctaaagagaattacctacaagggtataacgaggagtgtctgacattccatctagtaatgaactagaactcagttttcaagttaactctgggaccctcttagccaagaagaggtccattcagttggttgaagagcttaggatttcatttatatctctcatcactaatctgcaaaagctggtagtgaaaccgcctttgcaaaattatgactgagacagcgaaagagatctaacttaatcgattccgtcttgcttctaacctccaagctgtccttattcattcccgggcataggctgaactaactccgggagaagcttagtttatagtttttagtttaaaacaaagatagtaacagccctttcccaaagcagacctccttcttgccttggaactagactgcctttagtgggactaacattagccacaagattagaaactgtggcttaggagtcatacagctggaggctacaagattctgactctccctaaactgctcctaagatcagtccttgagatattttgcagaccctgtacttgatggatcaggtggcaccacccagattgataaagtggctcatctgatcttgtggcccccacccaggaactgactcagcacaagaagagagctttgactctctatgatttcatctctgacccgtcagcactcctggctcgctggcctccctcaggccaccaagttgtccttaaaaactctgctcccactgggcggtggctcatgcctgtaatcccagcactttgggaggccaaggcaggcggatcacaaggtcaggagattgagaccatctggctaacatggtaaaccctgtctctactaaaagtacaaaaaattagctgggcatggtggcacgcacctgtagtcccagctactcgggaggctgaggcaggagaatcacttgaacctgggaggcagaggttacagtgagccgagatcatgccactgcactccagcctgggcaacagagtgagagacttcatctcaaaaaaataaatagataaataacctccgctccctgaatgaatgctcccggagactgatttgaatcataataaaactccagtctcccgcacagcctgctcttcatgaattactctttctctattgcaaatcccctgtcttgataaattggctctgtctagacagtgggcaaggtgacctcactgggcagttacagtagtacccacttcataagtgaaatcacttatcttagtggtagggtcccaaaagttgtttggtaggagagggttgaggctgggagaggtggctcatgcctgtaatcccagcactttgggaggccaaggtgggtggatctcctgaggtcaggagttccagaccagcctggtcaacatggtgaaaccccatctctactaaaaatacaaaaaattggcgtggtggtgggtgcctacaatcccaattacttgggagactgaggcaggataatcgctcgaacctgggaggcagaggttgcagtgagcagagatcgcgccactgcactcaagcctaaccaacaggggcaaaactctaggactagagctaaggtatcaaaaaaaaaaaaaaaaaaaaaaaagaagtagagtgtttaattaaataatttgttcttgctgtaaaatgtaaagtagatattcctcttcaaagactttcctccccgtctaattaggaataaatagtaacttctcttagaagcaaaatttattcaaagacctgtgctaacattcttaaatatctgctagccacaataaggaaatcaatgtactttatgttcttagctcccacaatttagcctaaatattttccctggcatgtttatactggtctaagcaagcattaggtcatagcctgttcctcttccttatttaaaagtgtttttacctttctcagcgttccacaagttacttcctccttcctttgttctcctctacctgtgcctcttttaaaaagttctaagttgctagccaattgggacaaatacagaatgtaaggtcccattccagccaacggaaactggacacagcagtagggtggatgtgtcaggttataaatgaccctgtctcctttgtttggtgtactctagtggcaaaactgctggcaagtgtaccttttctgcaggaagtaaaaatggccttactaaataaattaaatttatgttcaagtgctatttcttttttttttttttttcgagatggaatttcacttttgttgcccagcctggagtgcaatggcgcgatctcggctcactgcaacctccacctcccaggttcaagcaattctcctgcctcagcctcccgagtagctgggattacaggcatgcgccaccacgctcggctaattttgtatttttagtagagatggggtttctccatgatgaggctggtctcaaactcctgacctcaggtgatccgcctgccttggccttccaaagtgccttggccttccaaagtggcgtgagccactgcgcccagcctcgagtgctatttctttacggcacggaagaacaaacatttcaaacaatgctattaccaagtttgttagtatttattatctcatttgctaaacctaaaaaatatatatccttctttaacgtgatcgaatatttcaaaaagttattgtgttgtttcttaaaataaatcaatcataatcctagactatgttgctcaaactacatacaacaccttctgagcttctggcaggcccttcctcccctccctgctcaccacagatcactggaataattgtctgcatgtaacttctaattttgaagtggttgtggtttatcaaacctggaacatggcacttccaagtacatgagctaaggtcacagtaagactcaagccccttcaacagaatacctggaatttctctgttaaagattttctcctttacctgactacatgtttgtaatgcagatccctccaggagcgcttacttataaactgtcctggatcactaacgcgacattttgatgtaaattagtttatcttgacgtgctaatggtagaaaaaaagagaacatgaggaaacttgggtgctttcagggctggtaggaaggattaaatctttgcggcaatttctgagaaggggaaggaaaccttgctaacaattttgatagtttactccatttggctggagtaactctgatccatttgtcaaattcacgatggagcaggtacctgttagggtacaggtttgataaaccacaaccacaggtctatttcatttctccttttccaaagtggaacaaatttgtctctggggttaaaactgcttttctcatattggtgtgtaagagaaaatgagggaatttctttgagtttgtttggtttgtctgtttgtttaagcagcattttttaaataatttactcagccctgtctcagagaaagtccatgatgatctggaattcaacctcagggaaaagttctctcctgtgcctgagacactgcgcaactaactggaaccgaaggatggaacctgggtgtttaatttattaggaacaattgattcttcagtgacactttccatgcagatacttcaaacaaaataatggagccccacagaccgaatgtgaagacagcagtgccattgtctttggaaagctatcacatatctgaagagtatggctttcttcttccagattctctggtaaggatagagccttggtaaggataggtcagaatatgtttcttgagatgttggttggtttgttttttaaaaatgtatgtgattattaagagaccaatataaatatcaagttgtttacctgagaaagatgctacaaagagcatagattatcattactatcaaaagagaagtgacagataccacagagaacaggtcaaatggaacattttttgtttcagtttcttttgactagattgtcaggccagagaaattataagcaaacctgtagttatcaagaaaaagcatgaacttaaatataaataaagaacaaatatagagcctcagcacctggaacatggcacttccaagtacatgagctaaggtcacagtaagactcaagccccttcaacagagtacctggaatttctctgttaaagattttctcctttgcatgactacatgtttgtaatgcagatccccccaggagcgcttacttataaactgtcctggatcactattgcgacattttgatgtaaattagtttatcttgacttgctaatggtagaaaaaaagagaacatgaggaaacttgggtgctttcagggctggtaggaaggattaaatctttgtggcaatttctgagaaggggaaggaaaccttgctaacaaacaatacctctttcttaattctacttagggctcaaattgtaatgcaaatctttttcatcatttagcccttataaacactgtttttctcatctggtgtggtccaaggcctagaacattaaaactatcaaagcttttacagaccatcaggtgtcatccccctctttctacatctgagctagctgaaatccagaggaaatgacttgctgaaagtcatgagtggcaaaagcagaactagttctgcttataactcttgacttttagttattattattattaattattattattacatcctaaatgagggccaaggccactcagttaaaaatcgtggggtccaggccaggtgcagtggctcacgcctataatcccagcacttttgggaggccaaggcaggtggatcacttgaggttcaggagttcaagaccaggttgatcaacatggtgaaaccccgtctctactaaaaatacaaaaattggccaggcgtggtggcacatgcctgtagttccagctattggggaggctgaggcaggagaatccttgaacccaggagggggaggttgcaatgagtggagatcatgctgttgggaatgaagtttttggtgtcacagaaaaagaatgaacatgggaacaaatgatctctcagcaaaaggacctttactttctgcagaaagggtgctactcaatagctgtccagccacgagagcacaccaaacaaaggagacagagttatttataacctgacgcatctaccctactgctgtgtccagcttccattggctggaataggacctcacattttacactttacccaatcggctattagtttaaaacttttttaattggataagggaacagaacaaagaaagaaaagcaagttgcccagggatagttaaggaaacatctccatataaggaatggcatgcactatgggctggggcttttctagttctgtccagacatgccggagcaagctacgacagctgatttggacagccactaatagtggctagcaatcttatagtaagaaattgtgactttttataatctttgaagaactttcccatttctgacagtgccactgcactccagcctgggcaacaagagcgaaactcgtctcaaaacaaaacaaaacaaaacaaaacaaaacaaaacagctctctactcttggaagcagcagagtttttatcttcatttatatcactccggtaacactcagaagtagacaagcctcagggtaggtattcagtaaaagcccactgaattccacactattctttaatcatagttaaatggcaaattaggctggagggtgggggtggaacctctccaaaattactgcaatgactgcaacatcggaccccaagattttttttttttttttctgagatagaatctctttctatcgcccaggctggagtgcagtggcactgtgagaaatgggaatggaccggactgtttcctctgacactgccactaggttgaccaagtgtccctatttgttaggtactggatggacgcctgacatgcaagactctcagtgctaaatcaggaaagtgctgggacaattcggatgagtcggtcacgctaagttgcacttaatagctcttgtgactttgactgaattacaaacatcccctgaccctcaattttcacatttactggatggagatctggtgccacctccactagattgctatggagaatgaatgtgaaagcattttcataaatccagtgtaaggaccagaagccagtcttctgaccttgagccagtgcttgttaaaaactccactctatacatctaacccaattcaggaatatcctgcctagttccaaaggaagaaaagaccaaattgctcttattgggattaaatgcgtacactgagctgaggaaaaacagtattacaaatgagctaaacatgacgtagatccacagttgtagaattcccctctttgttctttcctctttcataactacggaaacagatgagaaacatttacggcatcaggttcttgtgatgctccctgcctgatatgctatggttttgttaatggaatgtccattcctgagcttatgcagaaaaaagtcccttgggaaagtggttttactgtgttatgttcattttccccatagttctcaaaatgtacttccttgtttcagttttaattttctttcattggtgtgaccattttcaactgctccctttctgggaagaggtagcagacggacattttcatcaaaatctgccccaggttgcttcacagataaggagggacccagccactaaaatcaccaggcagagtgttgcaagagtagatagagaatcacaattggctgccctgctcaaggggacaccagatcttactttcgtttagttgaaaggcaagcgtcagagtcgggaggctgtaccttcatgtccagtggcctcacagaagttccttcagtatctcttttagatgaaactcttttagaagttccttcagtatctcttttggtttctcactatagatagttacttgaacatgtctgaagaaaacgtggtcaagacagtgaataaaaaaaattctggttttgggaagcagtctgacttagtttcaaatattctatcccactgtttctgtcaatgttcaaacctttccaagctccaacatttattgtggaaaatgtgtgcctcaccaactcatgcaaataaatgtttcatgtgccctacgtgtgtagagggggcatggatgtgtgtttttggagggagggctaatttttctttagacatggagaatacgaggaaattagcttggcatcaagaaggttacagcaggagacaagagtgaagagaactgagagagcccggaaatgaggctctggagttcagatttttttttttttgagatggcgtcttgtaccccaggttggagtgcaatggcaaaatctcagctcactgcaacctccgcctcccgggttcaagcgattctcctgcctcagcctcctgagtagctgggattacaggcatgagccaccatgcctggctaattctgtagttttagtacagatggggtttctccatgttggtcaggctggtctcaaactcccaacctcaggtgatccaccctccttggcctcccaaagttcaaggattacagccatgaaccactgcgcctggcctaatttttgtatttttagtagagacagggtttcaccatgttggtcaggctggtcttgaactcctgacctcgtgatctgcccacctcagcctcatgaagtgctgggattacaggcatgagccacagggccaggcctggagttcagatttaacacatcctgtaaatgacatgatgcatctgatatttgaagagttttcctcaaagaatgttacatgcaaggtggtttagagttgttgtttccggctatatagcaaaagtacttggggagttttaaaaaatactgatgccgaagctccacctagaatagttcattcagaatctctagcataattgacctcagtacttgaaatatgattattataaatgttagtcaactgcttttttaggctctatgactgatagaaatctttcacttttatatcatctccagttaatgagtcccataaattgaaatctagtgtttaaatttttacttcatatttatttttactgattgttttattattattatttttgagacagagtccgctttgtcgcccaggctagagtgcagtgacgccatctcggctccctgcaacctccgcctcctgggttcaaacgattctcctgcctcagcctcctgagtagctgggattacaggagcccaccaccaaccacacccagctaatttttgtatttttagtagacggggtttcgccatgttggccaggctggtctcgaacccctgacctcaagtgatccacccgcctcggccctctgtctcaaaacaaaaacaaaaacaataacaaaacttttctcttctacccgagatgtttaagtttaaatcacaccatttgtacaaaaattccctgtcttgtccttaaaaataatttgtaatcactagctagttttgagatcgattgccatctaaccgaatgccatttgttctctctctctagtttcaacttaataaccctttctgcattttctattctttcaaaatttttccggccattttattgtttctatttagtgaaaatttattcactggtttctatgcctaagggcatttaggaagttgcttaggatacagacgtgataaaaagaccagtgtaaaaactctccactcctagacattatattctagtcctcatctcctgtcatttaagtcctcagtgattctatgcacttttgcttttggtttgggcagatgctctgagtttaatgtttctctgagatgaggaccccctattcaactcacaaatcccataaggaggcctctgtgcctttgctggtgccccagacagggtgctgatgcttacttatcttcaagattgtgaagtcagatttaatagtatagtcgtttgccagagctgctgtaacagtagccacaaacagttgggcttaaaataccacaaacaggagggcttaaatcacagaagttgattttctcacagttcttgaggcaggaagtccaagatcaaggtgtcgtggagttggtttcttctgatgtcttgctccttggcttgtagatggcctccttattattgtgtcctcacatggtcttttctccactatgcacaaattccctatgtctctctctcttttttttttttttttttttttttgagacagagttgcactctgtcacccaggctggagtgcagtggtgcaatctcggctcactgcaacctttgcctcccgggttcaagcaattctcctgcctcagtctcctgaatagctggtattacaggtgcgcaccacaaagcccagctaattttttgtatttttagtagagatagggtttcgctattttggtcaggttggttttgaactcctggcctcaagtgatccgcgcacctcggcctctcaaagtgctaggattacaggcataagctactgtgcccagtctccccctgtctctttgtgtccaaatttcctcttctttagggacaccaatcagattaaattggacccaccctaaaggcctcatttcaatgtacctccttcaagggcctatctccaaatacagttatatttttaggtactagggctagggcttcagcataggaatttgggggagacacaatttagcacatagcagaaaatataaggccaggaaaaaatattctggcatgctagatggactcattaacaaatattaaccaatataaaccaattaacaaatatttctttaatatttgccttttttttttttttttttttgaaacagagtttcactcttgttgcctaggctggagtgcagtggcacgttcttggctcactgaaacctctgcctcctgggttcaagtgattctcctgcctcatcctcccaagtagctgggattacaggtgcgggccatcacacccggcttattttttgtatttttagtagagatggggtttcactatgttggccaggctggtctcgaacttctgacctcaggtgatccacctgccttggcatctgaaaatgctggggttacaggttgcctggtgatttttaagaggaatgactgagctctcatgccaggtggggggaggggacagagaaagttgaatactctgacgatagccatgatccatagctctgaagcttagactcgaatctacccatcccgcaaggaagaaaacaaagaaataaaaaagaagaaaagaaatctcccaatgtcaggtcccaccctctttagaagtaatttcagcaaaactttgttgctattttggcatgtcctctactgtagtagcttgtcaaaatactgtccccaaacgttttctatatttctagattttactgtttaatgtataataataatgttctaacattaaaacgtaaccatagcaatgctccgactcacttgatctttaaatatattgttgaactcaattttgtgacatcttcagaattgtctttttgtattcataaatagcaacagtggatagttgccttggttagtgttattatttcaaggattaatctttaggttacgttttcttcataagatgcattagatgacttttttttttttttttttgagacagagtcttgctctgttgctcagactggagtgcagtggtgcagtctcagctcactgcaatctccacctcctggctcaagagagtctctcgactcagcctcctgagtagctgggattacaggcacgcaccaccatgcctggctaatttttgtatcctttttagtaaagacgggatttccccatgttggccaggctgatctccaactcctgacctcaagtgatccatctggcttggcctcccaaagtgctgggattacaggcatgagccaccacacgcagccaattagatgccttctcatgcttttctgtgttctgaaacagatcatctatccgttgatatagcatagctcttcagactacagacattttaggctataagttttgaattacattttctattccctttatgcttcttgttctagttaggttttttatttctaaataaaaatatgaatttttgcaatttcccaaatgcgaactcaactgaaattttcaagtgtattagcaaaatttattcatagcagcctcttacatttcattaagaattgattttttcttattccctgttgaagtttgtttataaaatatagtaatagtaataactatatagaaagtgttcactttgtagtaggccctgtgttaactttaactacactttttaaatctaagcctcatagtagtcttggatggatgcggtggctcacgcctgtaaccccagcactttgggaggctgaggcgggtggatcacgatgtcaggagttcaagaccagcctggccaacatggtgacactgtctctactaaaaagacaaaaatcagccggacgtggtggtatacacctgtagtcccagctatttgggatgctgagtcaggagaattgcttgaacccaggtggtggaggttgcagtgaaccgagctcacacaagtgcactctagcctggatgacagagtgagactccatctcaaaaaaaaaaaaaaaaaaaaaaagagatcaataaataaaataaataaataatcctcacaatagtcttcaccatttgcaaatgatccatttgacaataaatgaattcagcactatcatggaaatatatttccaaggtgaccagttttctccatttccaccccacttcaatccaccttcatgtagccctaggactattgtctcctccccttgtttccttatttccattcctgttcagctgtaacacattctgttcatagcagtcaagtgatgcttacaaatggaaatcaggctagaggtggtagttcacacctataattccagcattttgggaggctgaggcaggaggatcacatgaggccaggagtttgagaccagcctgggcaacatagcgagaccccatctctacaaaaataaaaaagaattagctgtgcatgatcctatgtgcctgtgttccagctacttgggaggctgaggtgggaagattgcttgacccagggagtttgaggctgcaataagctatatttgtaccactacactccagtgtgggtgacagagtgagatcctgtctctaaaaaacgtaaaatgaaaataaaaccttgatagtttgctctttaaaactcttcctacagggcccctgtgatgctcacctgtctctagaagggcatgtaatagctctttctccttcactttactttgatgcaatgtcagaacagcttctttccatcaaaacttaaacctttgatttcatttaaaatcatctgcttcaaattctaatctttctgatagtttaggttctaatttttctgatgttaatattgtcacccaagtttcctgttcatatttacctggtttattttatttttatttttatttatgtatttgagatggagtctagctctgtcacccaggctggagtgcagtggtgcgatctcagctcactgcaaccttcgcctcctgggttcacgccattctcccgcctcagcctcccgagtagctgggattacagggacccgccaccatgcccggctcattttttgtatttctactagagacgtggtttcaccgtgttagccaggatggtcttgatctcctgacctcgtgatctgcccgcatcggcctcctagagtgctgggattacaggcgcgagccaccgcgcccagactttattttattttttgagacggagtcttgctctcttccccaggctggagtgcagtggcttgatctcagctcactgcaacctctgcctcccaggttcaggcgattctcccgcctctgcctcccaggttcaggcgattctcccgcctcagcctcccgaacagctggggttacagatgcctgctaccacacccagctaatttttttctttttttggagacagtctcactctgtcgcccaggctggagtgcactggcgtgatctcagctcactgcaacctccgcctcctgggttcaagcgattctcctgcatcaacctcctaagtagctgggattacagacgtctgccaccacatcaaactaatttttgtatttttagtagctgagattataggctcgtgtcaccacgcctggctaatttttgtatttttagtagagacggggtttcaccatgatggccaggctcgtcttgaacctctgacctcaagtgatctgcccatctcagcctcccaaagtgctgggattacaggtgtgagccactgggcctggcacctggtttatttttgtgcatgcttttatttttaattttcctatgctactttcttagccaaaatttatacttaatctaatcaagcattaatctaacaaagagtttagtgttcatataaaatacagttttacaaatctgtttttctttaaattataaatttgttaagaaaattatccaaagaatgatccagaaacaaaagaatggctgtgtgtcttttcaatatcatcctggagcattgtctcaaccatctcactttacggtgactaaaacatctagaggttttccctttgttttctgtacttcttagtattgattaatactgttgtgctacttcagtctgaagttccatgttaatctgtagattttttttttttttttgagacagtgtctcgctctgtcgcccaggctggagtgcagtggtgcgattggctcactgcaagctctgcctcccaggttcaggccattctcctgccttagcctcccgagtagctgggactacaggtgcccgccaccacgctgggctaattttttctattttttttttttaggagagacggggtttcaccgtgttagccaggatggtcttgatctcctgacttcgtgatctgcctaccttggcctcccaaagtgctgggattacaggcgtgagccactgtgcccggctgttaatttgtagatttttatacagaaaagcagcaaaatatttctgttgagtagaaaatataactcattatgtgtctaacctagcaattttatgtcaacactattttctcaaacctctataaactttggctgggcacagtgggtcacacctgtaatcttagcactttgagaggctgaggcaggtggatcaccttaggtcaggagttcaagacaaggctggccaacatggcaaaaccccatctctactaaagatacaaaaaattagccaggcatggtgacatgcccctgtaatcccagctactctggaggctgaggcaggagaatctcttgaactcaggaggtggagccaagatcatgccactgcattccagcctgagcaatagggtgaaactgtgcctcaaaatgaataaataaaataaataaataagtcagagattgtgaataggatgttggatatacccaagttatgaattaattaggagcttgaacccaggaggcagaggttgcagtgagctgagatcgcaccactgcactttagactgagcgatagagtgaaactgtgtctcaatcaatcaatcaatcagagattgtgagtaggatgttggatgtacccaagttatgaattaattaggagcttgaacccaggtttgtctcagatcctcagggactgaagacttccaagtgaattatgggtaatgtataggtctatactactccaaatttacagttttcagacttccctgggttctcatggaccttccatgtcatttctatgtttaggttgaggtccctggtcttttctcctctgtaattaatttcacacccacccctatctcaactcacacaacttgatcttcactcccatctgctaagaaattgagtccataaaaagtgaactcctttaaactctagatcttctactgctgcaaggacagacattccattctggctctctctctcctcctttgcttcttccagtcctttgctccttctgcattctgttactctcctctctcctttgtcttcaatctctccctcttgcaatagccaactataaactgctcaagcttctcattcttaaaagatctctctgaaatgcaaattccctactgccttatggctctccttcaaaagtaatctacattttctctattttctaattcctcaacacactaacgtttgaaccctgcttctatgaccctgacctaaatttctattaaatgtacatagataaactaatatatatttgtgacttcctaatattgttttgttttttaaagaggtcaatcttactttaactctgtaatgatgcggttgaccttctgatgattctctacttctgtgaaatcctctactgtcttgactttttaattaatttatttttttttgagacggagtctcgctctgttgcccaggatggagtgcagtggcacaatctcggctcactgcaagctccacctcccgggttcatgccattctcctgcctcagcctcccgagtagctgggactacaggtgcccgccaacacgcccagctaatttttttgtatttttagtagagacggggtttcaccgtgttagccaggatggtcttgatctcctgacctcgtgatctgcctgcattggcctcccaaagagttgggattataggcgtgagccaccgcacctggccctactgtcttgacttttatagggtcattctattcaagctcattgagcgtctgtcactatgtttttgatctgtattgctggaatcagttcctctatctgccttgtgaatattctccattgtgctaatctaggcttctcctttcatttttcatattccctcacatggctttatacactcttgtggttttaaccacaatatagggtttttactgtagttatgctttcaaattgtatacttctttttttttttttttttttgaaatggagtgttactctgttactccagtctggagtgcagtggtacgatcttggctcactgcaactttcgcctcccaggttcaagcgattctcctacatcagcctcccgagtagctgggattacaggcatgtgccaacacgcctgcctaattttttatttttagtagagacaggatttcaccatgttggtcaagcccgtcacaaactcctgaccttaggtgatccgccctcctcggcctccccaagtgctgaaattacaggtatgagccatcgtgcccagccccaattgtatgtttctaatatgacttttctcctgaactttaaactgtgtatccaacttctcagcacagtcatatcttttgattccacaggtaatttaatgtcaatatatttaaaaatgaatttaccacctttatccccactctttgactttcacctgcatttctgtttcaattcttgtttccatccattcatttgctcacctaattcataaacatggaaatcatcctcaattcctcttcttcttagcccaaaaattcaattgtgcaggttatgcactgagaaaaagagcctcaggttagggggataaatcagagattggtgaactttttctgaagggccaaatactaactgctttaagcttgcttaccatatggtttatgttgcaactaccaactctcctgctgtaatgtaaaagcaaccatagatagcatgtaaacaaatgagacaggctgggtgccaatgaaaattcacgaaaattaatgtagtttactgtcccttgggtgagagttgggggtcactgaaattcggactatgtcttacttggctaaaccacaggcctagagtgggccataaatggagctattgggctagtgattttcttgccttaagcccccagccccaaatttaataatcacatcattttaatttcattttccaagtgtatctttaatatatggcttctcctttccaaattcactgtcattacctaagtttagtccttgaacaatattttaaaggcttccttatctgactttatatcttaaagtcctacaaatttatcttcctaaaattcaaatcaaaccatgtcaccaacttacagaaagggaaaattcatatattctacacacagcacatttcatgtaactttctaggctcatctttcatcatccttttgatgcaggattttctgctcctcagctcagcgaaatccaggatcttgtctcatgaccaggaagaattaggcaggtggacatagtgaagggtgaggatgacggaatttattaagcaaaaggggagttctctgcaaagagaggggtttcaccagcagtctcccacctcacaatggagcaccaggactttcacacacaaactgaaaaggctaggctcctccccagcataaggcatgaattcctggtggttccaccagttttcctactatgcatgtgggtgtgcccaagcaaaccataggtagtatcagaaaaggcaacatttgattggttaaaaggcattattcacccaagcaaaccataggtagtatcagaaaaggcaacatttgattggttaaaaggcattattcagaaagaatcaatcgggaaagggtgagccaataggggaagttctccctctgggtcacgggtttcatctgggaccaggagtctggcctttcagcctttagactgttttaggcttgaaggtgggtttcacagggacccttccctatctgcctaggcatctgtctgcctcctgcctctatcactttctcttgagttttatattttagcaacactgagtcatctttgtcccaggaagcacctacatctgtttatctgctgtcccctctacctttactaccttcccttcttcacatttatacccagaaaagtcacttcccctccaaaaattgggatcaactgtcatatttttatgaatatttcactttaattcctcacaacagctgacagaattaactacttcctcttctttgcaagttatttggctcacacagatatcagtaattaaacatattttactgcattggcatatatctgactaatgtgtttttctcccgtactaggcaatatgctccttagtcatctgtgtatctgaggtgagcacagggcctaactagcatatggtgcattctcaatgttcgttcaactgcattgacttgaattcccctgaagactgaaatgtgaaaatagctactctcggaagcccctttccagagaggtctaaaatatttacatgtttctattttaaatgcagaaagaacttccagatcattataggccttggatggaaattgccaacaaacttcctcaattgattgatgctcaccagcttcaagctcatgtggacaaggtattcttctcttcaccccctcatcacattctgttttcatcatcataccacttttctttcttagccttgtggaagtgtgtcaattgtcctgggaaactgttcattaccattgaacttatcagcaaagctatatcttccttcctgaaaaacagaatgaccccttcgtaatctgatacatgtgttttcctaaggttttcagagccagcacaaaacaatgcctgacacatgccaataactcaccaaatgtttgtttaaagaagaatctgggtgggaatgataaactaactaatggacaaggtatcgcctaagaaggtcagcttggaaattctcaggttcctcattccatgtacgtactcaaggctctgttgttactgagggggtctaacttgattttgtcctaggtgttatagaatagttaaatggagggaatttctgaattataaaattggccatgggttctacaaaacatccaataagcctgtaaattccacacaagtgttgattaggctgatacaaaggtaattgcagtttttgccattacttttaatgacaaaaaccacaaacacttttgtaccaacctaatagctatgtaaccctgaaaaagttactcaactctgtaatcccatttccttatttataaaatgagagaaactctggtctcacagtattgttatgggaagtaaatcactttcaaagtggcccttttgtagttcttgtcctataatagcattcagtatacattcattacttctctgtagtctcttctccatctgtcctaatctatcagtttggagtaccacataattgcggaagtccatgaaaagttttccgctctccaaaatttccctttgctgatggataatatttaatgtctagaattacaaattctttttaaaatactcattgaatgtttgctttgtgcaaagcactagaaccttgtaaaagatgagtaagggactggcttcaatgtctgtgaagatagcaaactaaacagagtaatttctttgcctgatagataaaatgttgtgttgacatgaccaaagaaatccaaaaataagaaaaaaactatctgtaaacacagaaaaatagagaaaagttccaatgatggaataaaaatttaaaggatttttttgaacgtattaagcaaatcatgtataaaatccagaaataagtttacaggacccatgtcaaggatttaaccaaagcagagggagatccccatgagtccccttttcccatctcagaatagcagagaagagaagcaagggaagcctggaacagttggcaagagggcaggttagaattcagtttgtgaattatgaggtcgtctgccgtaggcatttaccaggctttatttgatttaactgccataaaggaagagaaggacttgttaaattggggctcctcttagcacagcattgaaaccagtccctattccttcttggccttttggctaaaattgagtgtgaaatctatcacctaacatttgtactgggtttaggctgggtgtggtggctcacgcctgtaatcctagcactttgggaggccaaggctggcggattgcctgagctcaggagttcgagaccagcctgagaaacatggtgaaaccatgtctctactaaaaatagaaaaaattagcagggtatggtggcacatgcctgtagtcccagctatttgggaggctggggcagaagaatcacttgaacccaggagacagaggttgcagttagctgagatcacaccactgaactctagcctgggccacagagtgagactctgtctcaaaaaacaaaacaaaacaaacaaacaaatatatatatattaaaatacaaatttttactgggtttaatagtgtcttcctagaagtcatgttcatgcataatctgtgaaagtggtcttatttggaaatagggtgtgtacagatgtattcgagttaagctgaggtgatactggattaaattgtatatgatgagtgtccttataagaagaggaaaaattaaacacaggaacatagactcaagggaaaacatcacgtgaagatggaggtagaattggaatgatgcattgacaagccaagatgtgccaaggattgctggcagtcaccaggagttaggagacaggcatggaacagaatggaacaaattctccctcagaggctccagaagaaaccaaccctattgataccttaatttgggacttctatgacttctatcttccataactgtggcagagtacatttctgctattttaagtcatgatgtttgtggtcattagttatggcagcgcataaaactaacacaacactcttggtctctatcgcttcttttttttttttttttttttgagacagagtctcactctgtctcccaggctggaatgcagtggtgcaatcttggctcactgcaacctccagctcccaggttcaagcaattctcctgcctcagcctcctgagtagctgggactacaggcacccgccaccatgcccatgtaatttttgtatttgtagtagagacggggtttcaccatattggccaggctggtctcgaactcctaaccttgtgatccaccagcctcagcctcccaaagccctgggattacaggcctgagccaccatgcacggcctctatccctactcttaattgcctggaaaatacctaacaaatgaaggccagtttttagactttaccaccaaaggctgaaattgaaacaggaattgtttgtgagaagcaaacacaatagtttcgagagactgaatcagttagcaatttcctgtgagaggcaaatgtaatagtttctagaaccacagatggagctataacaaaaacatgtgttctctggatcctttacttgctacagacaacacaataagtgaatttacagctttgatcttacagtgcacctaagccaaccaccttgtcttagaatgtctcaacatacctatctgtatcttgaaacaaaatatattaattgccttagacccattcactcacatttcctaggaagacatgatcagagggagctatgcaagaagaaatccagcagaactctggaaatacaataagaaaatccatattagacactaatcttaataaaactaaccttcgttcatgaatttgaatagacaaaattaccaaataatatggaaaaaatgggcaactcaaaaagaagagggtagcccacttggcattcaggaccaatggcctccaataaataagatgatattagtgctttaaatattttatttagtgtatccagtatattgccttcctaaattaagtgaaagctgatatataaaaagaactattagaaataaaaaaccacacacatcccagaactcctcaatataaacctaacaaattcagtaaaacattgattgcaaaaaatatatatagtgacttagggacttccttgataaatttcataaagcataaagaaaaatcaaagagtgcaaaccatcagaaaaatacaaatatataaaaaagagaaatacaggtgatccaaattccttttaatggaatcccataagcagatgggtggaggaaaagtaaaacttccaacatataagcacaaaatttttagaccttaagaaatatttgagttttttatatcagaaagacagtgttggggtgagggttggggggcacatgtaaatactcagataaaattgtgaattttctagggtaaagaaatctgcatattcatagaaaacaaaaatgaaaaatagtttatttacagagtaaatacatacgactgtttacctgtaatgctaaatattaaaagacagtttcttttcttttttttgagacagagtttcactcttgttgcccaggctggagtgcagtggtgctatatcgactcactgcaacctctgcctctgggttcaagcaattgtcctgcctcagcttcccgagtagctgggattacaggcacccgccaccacacccagctaatttttgtatttttattagagacggggtttcaccatgttggccaggctggtctcaaactcctgacctcaggtgatccacccgccttggcctcccaaagtgctgggattacaggcgtgagccaccgtgctggcctaaaagacaatttcatacctatttgtatggctaattttttaaaaatctggccatatcaaaatactgaagaggacgtatagcaatagagactttcattcattgctggttgaaatgcaaaatggtacagccagtttgaaaactagcttggcagattcttataaaatgaaacatagatttaccatgcaactcagcaatggcattcctaagcatttatccaagtaaatggaaaatgtatgttcccagaaaaaaaatccatatatgaatgtttataacagctttattcataatcaccaaaaaaaaaaaaaaatctggaagaaaacaggatatccttcaaccggggaatgaataaaccaaattataataattgtaaattgtgggatggatagtggaatagtattcagcgatacaaatgattgagcaattaatttgtgcaatgacagggatgaaccttaaatacatttacctaaatgaaagatgtcaggcctatattgtatgattcttttcaaatgactttttagaaagggcaaaactagaaggattaaatatagctttatggttactagagacaggtaaggagtgggtagttgactgcaaaggtaatatataggggaatgtttagcatgatgaaactgttttatatggcactcaggtgatggatatatggctctaggcactgaaaaacccatggaattgtatgtcacaaagaatggactttcatgtatgcaaattttaaaaaataaaccagaaaattgggagaatactaggatggaatgcagactgtgataaataaaactaactggactctcagcaaactaacacaggaacagaacaccaaacaccgcatgttcttacttataagtgggagttgaacaatgagaacacaaggacacagagaggggaacatcacacaccggggcctgttgtggggtggggggctaggggagggagagcattaggacaaatacctaaagcatgaggggcttaaaacctagatgatgggttgacaggcgcagcaaaccaccatggcacatgtatacatatgtaacaaaccagcacattctgcacatgtatcccagaacttaaagcaaatttttaaaaaagtaaaaaaaaaaaaaacaaacaacaacacctaactggactacaaatgcactatataacttcgatgaagagagtggggagtagggaaaggaacggacttaaattactccagaaaatagtgttgtgttgtgactagaatctataaggcttacggtaaatgaaactttacaggatcactatactctaattggtaaatcagtttttcatggggtgcgggtgaacagttgtgaaactgctttacatgtagtcatacctttgcattttgcagatatttcaatttttacaaattgaagattcgtagcaaccttgcatcaagcaagtctgtcaaccccatttttccaatagtgtgtacgcatttggtgtctgtgtgtcatattttgataattataacaatagttaaaactttttctttactattacatctgttacagtgatctgtgatcagtgatctttaatgttactatcataatcgttttgaaggtgccataaactgtgcccctataagtcctgaaacttaattgataaatgtatgtgttctgactgctccactgaccagccattgccccatctctctccccctcctcaggcctcctgatttcctgagacataataatattgaaattaggccaattaataatcctacaatggcctctaagtgttcaagtgaaaggagttgcatgtctctcactttaaaaatctaaaactagaggctggtcatggtggctcaggcctctaatcccagcactttgggaagccaaggcggggagatcacctgagttcaggacttcgagaccagcctggccaacatggcgaaactctgtcttgactaaaaatgcaaaaattagccaggcatggtggtgcacacctgtaatcctagctactcaggagactgaggcagaacaatcgtttgaaccctggaaatggaggttgcagtgagcctagattgtgcgattgcactccagccagggcaacaagagtaaaactccttctcaaaaaaaaaaaaaaaaatatctaaagctagaaatgattaagcttggtgagaaagtcatgtcaaaaccagataggcttaaagctgggcctcttttgccaaacagccaagctgggagtgcaaaggaaaagcttttgaagaaaattaaaagtgctactccagtgaacatacgaatgataagaaagcaaaagagccttattgctggtatagaggaagtttgagtattttggatagaagatcaaaccagccacaacttcccttaaaccaaagcctaattcaaagaaaggccctaattctcttcaattctacaaagtctgagagggctgaagaagctgtagtaaaaaagttttaaaccagcagaatctggttcatgaagtatgaggctagaagccatctccacaacataaaagtgcaaggtgaagcagcaagtgctgatggagaagctgcagctaattatccagaagatccagctaaaatcatcaatgaaggtggctacatttattttttatttttgttatttattaatttatttattttgagacaaagtcttgctctgtcccccaggctggagtgtggtggcatgatgttggctcactgcaacctccacctcctaggttcaagcaattctcctgcctcagccttcccagtacctgggattacaggcatctgccacaacgcctgactaatttttgtatctttggtagagacggggtttcaccacattggccaggctggtcttgaactcctgacctcaggtgatccacccgccttggcctcccaaagagctggattacaggcatgagccaccacgcctggccagtggctacatttaaaaataggtgttcaatgcagacaaaaccatcttttattggaagaagattccaaccaggactttttttttttttttttttttgagacagagtctcactctgtcgccaggctggagtgcagtgatgcgatctcagctcactgcaatctctgcctcccgggttcaagtgtttcccctgcctcagcctcctgagtagctgggactacaggcacgtgccaccatgcccagctaatttttgcagttttagtagagacggggtttcaccatgttggccaagatggtctctatctctgacctcgtgatccaccccccttggcctcccaaagtgctgggattacaggtgtgagccactgcgcccggcccaggactttcatagttagaaaaaagtcaatgcctagcttgaaaggacaggctgactctcttgttaggggctagtgcagctggtgactttaagttgaagccagtgctcatttaccattcctgaaatcttagggcccttaccagctatgctaaatctactctgcctgtgctctgtaaacggacaataaggcctggatgatggcatatctatttacagcatgctttactgaatactttaagctcactgttgcgacctactgctcagaaaaaaatattcctttcaaaatattactgcttattaacaatgcctctggtcacccaagagctctactggagatatacaggaaataaatgttgttttcatgtctgctaacacatttgttctgcaacctatggatcaaggggtcattttggctttcaagtcttattatttaagaactatactttgtaaggctattcctgacacagataatgatccctctgaagaatctgggcaaagtcaaatggaaacctggaaaggattcactattctagatactattaaaagcattcatgattcatggaggacgtcaaaataaaaacattaataggagtttgcaagaagtcaaccctcatggatgactttgaggggttcaagacttgagcagaggaagtcactggagatgtcgcagaaatagtatgagaactaaaattagaagtggaatctgattttataactgagttgctgcaatcttacgattgaacttttcttttcttttttttttgagacagagtttcgttcttattgcccaagctggagtgcagtggcgcaatcttggctcactgcaggctctgcctccctggttcaagcaagtctcctgcctcagcctcccgagttcctaggattataggtgcctgccaccatgcccacctaattttttgtatttttagtagagatggggtttttccatgttggccaggctggtctcaaactcctggcatcaggtgatccacccaccttggcctcccaaagtgctgggattacaggcgtgggccaacaccccggctgcatgattgaactttaagagataagttgcttcttatggagcaaagaaagtagttgcacaacacagaatttactcgtggtgaaaatactgtgtttgagctgctgttgaaatgttgctgaacattgttgaaatgataaaaaaaaattagaatgttccataaacatagttgataaagcatcagcagggtttgagaggattaactgcaattttaaaagaagttctactgggtgccgagcgtggtggctcacgccagcactttgggaagccgaggcaggcggatcacttgaggttgagtttgagaccagcttggccaacatgatgaaataccactacctctactaaaaatacaaaaattagctggtcatggtggcaggctcctgtgatcccagctacttgggaggctgaagcaggagaattgctttaacctgggaggcagaggttgcagtgagtcaagatctcgccactgcactccagcccgggtaacagagcaagactccatctcaaaaaaaaaaaaaaaaaaaaaaaaaagttctactggggaaaaaatgctaacaaacagattgcatgcatgcaatggataaatctcttgtgaaaggaagagtcaattgatgtggcaaaccgccttgttttcttaagccaccccaaccttcagcaaccaacatcctgaacagtaagtagccatcagcatcaaagcagggctctccaccagcaaagagattatgactcactgaaggctcagatgatcattagcatattttagcaataaagtactttataattaaggtataaagtactttataatgtacattgtttttctagacataatgctattgcacactttatagtgtgaacataacttttacatgcactgggaagccaagaaatgtgtgtgatttgctttattgggatagtcactttattgtggtggtctggaattgagccctgactatctccagggtatgcctgtacatactggggttgaacaataagtaaatagatgatggatgatgtttcactgtgagtgagggaagttatagatcagcaaggggtaggagggaaagctagaattaataagtgccactggattagagttggagacatcagtatgaagtcatgttttgtttaatatttataaatatataagaatgtataatactacttacatatgcctatataatgagttatatgtatttatatatacacacacatgcttcctagatctatccactgcaaggatctagaattagtgacatcccagtagcaatgagcaaacccactgcccagataaatacccttctccaataacaggagcctggtcttcttgaagaaacagctgataatttcctttccttaggaaaggaaactgtaagtatgtaagaaatactgtgaaacaatgaaatcagtaaattttatggtcattataatcattgacaatgtgactgtgaaataagaaaataatttataaaatattataatagcattctaattgtgcattgtgtgtaggtatatatacttgtgaccaagttgtgttaaaatgatacagctaaactccatatttctttttaacaaaactggggacatagtggagtgagagctgtaaaacgaaaatcatgggttttcttgtgtttcgttttcttcttttttttttttctgagatggagtcttgctctgtctcctaggctggggtgtagtggcacaatctcggctcactgcaacctccacttcccgggttcaagcgattctcctgcctcagcctcccgagtagttggtattacaggctcctgccaccacgcccagctaattttttatatttttggtagagactgggtttcaccaaaatcaggctggtcttgaattcctgacctcaagtgatccacctgccttggcctctcaaagtgctgggattacaggtgtgagccactgtgcccagccaaaataatgtttgtattggtgtgctatgccagattataaaacaaatgaaccagaaaaataatatacagttaacagcaaagtaagatttttcctatcagttttcatgacatgttataaaaccatagaaattctgaccagatggcatcagggcagcaataaacaagggaaccaaaaacttaatagaggacctacatacagacccatgtgtgtatggaatacatactaaacatatgacagggtgaaatgttgggaacacgatggtaaaaacatgaatagtaatccatacatagagttggcacatagcaaaatgattaactggctctgctcttttcaccacaaacaaaaataaattcattcaagatggatacaaacttaaatgtcaaaatcaaaaatgtttcatctgttggaagaaaatgtaggagagtatctttatgtactgggataaaggaagaattttctagggcccggcacggtggctcacgcctgtaatcccagcactttgggaggccgaggtgggtggatcacctgagatcaggagtttgagatcatcctggccaacatggtgaaactccatctctactgaaaatacacaaaattggctgggcactgtggctcacacctgaaatcccagtactttgggaggcccatgtgggcagatcgatcacaaagtcaagagatctagaccatcctggccaatatggtgaaaactcatctctactaaaaatacaaaaattagctgggcgtggtggcacgcacctgtagtcccatctacttgggaggctgaggcaggagaatagcttgaacccgggaggcagaggttgcagtgaactgagattgcacgacggcactccagcctggtgacctggtgacagagcgagactccgtctaaaaacaaaacaaaacaaaacaaaagcacaaaattagctgggtgtggtggcatgagcctgtaatctcagctacttgggaggctgaggcaggagaatcacttgaacccaggaggcagaggttgcagtgagccgagatcgtgccatcatgccactgtactccagcctgggaaacagagaaagactccgtctcaaaaaaaaaataaagatttttctaatatggcacaacattggagtttttttttttgttttttttttttgtgacggagtctcactctgtcgcccaggctggagtgcattggcgtgatcttggctcactgaaagctccacctcctgggttcacgccattcaacattggagtatttttatgacatacttgatatccttaaaacaggacctctgttcatcaaaacaggccaaaagacaatgaaagccaagctacaaactgagagaagatattgtcacacatataaatgaaaagaagatttgtatcctgaatatacaaaatcttgtaaattgattggaaaaacaaccaaataaaaaacaatgttcaacagacattttgtggaatagaagacacaagttcccaatatatcatctgaaaaatgcaagctatcattaatagtcaagaaaatgaaagttaaaaccataatgggatagcattttataaccatacaactgaaaaatgcttaaagtctggcatgaacaggtattggcaggaatataaaacacctgaatcttttattcactgtgggtacaacctctctcaaaaactgcttgtcattatctggcaatgttgaaaatataaatcctattaagaacttccttcttgtctatataaataccttagagcttcctaggcctgtgtaccctgaaaggtatgaaagtatcgtttatcatagcaaaaaaacataaaataactgtgaaaataaataaactgcagatgcatccagtaatgatgaatgtcaaagccataatggtgatgagaaaaggaaatcatagaatatcctgtattcagtataattctattatgttaagttcaaaagcattcaaactaaataaccaatatattttgagatggtgtctcactttgtcctccaggatggagtgcagtgggaccatcctggctcactgaaacctccacctcccaggttcaggctattcccctgcctctgcctcccaagtagctgggactacaggtgtgcaccaccacacctggctaatttttgtatttttatagagatgggatttcaccatgttggccgcttgtctcaaactcctgacctcaagtgatctgcccgtctcagcctcccaaaatgctgagattacaggtgtgagtcactgtgcctggccaataatatattgttcagtgatcatacatatatgaattttgaaggatatataaatagcgaggaaataacaaatacaaaattcaacaaatagatactctcaaggagcaagcaggatattacaatcaatgagaggtacacagagggttgcaaaaattttggtcaagttctatttcttaagctgagtgatgagtaaataagtgtttacttatgtctactctttaggttgtaaatagatattacatgtgtttatattcacggtgtacaaattcatgaaatgcttctaataaataggaagttataagatgcatttcaaagtgttcagcagaaaatagtgcaaacatgttgccctgaatcatgttgcagattctaaagaaatgttcacaatggttccgagaagctcctcaaactgcatttttgcttttagagggaaaatcacatatttggccctcccaaactgaggccagagactgtcaaaatgttagctgagtagcattaagaaaagggctgaaggtagagtacctttccattttgatggaaacccacaaattagtatttctgtttttagtccgatattatttctattaattcatagacttttaatacacctgtcatcagggacaaataattttgtgctcatgtcctcaaagtcatttacaattcagaacaaattgacttagaaataaaatgtgattaatattttttatttatttgtgagaaaagtattaataattttctaataatgtatctttcaaatgtgtctagacgtaataaaaataattatataacactcaaaataaattattaaacaacaatgaactaaaaaaaattttagaacatttatatgaaagattaagatccataatacaaaatgtattctatgaaatcagtaagatgaatgattgatggggaaagatgggcaaataatataagtagttaagacagtgaaagatatttgaattgatgataaacaggcaaaaatgctcaatctcaagaataaaacaaaaatgccaatgaaaacaatgaactacctggtttcggctaagagagtgtcaataaatttaaaatgtacttaataaataactgctgttataatgctcacctggttcttgttaaaaagcaacatctcaaggctgggcataagtaagcctagcactttgggaggccaaggcgggaggattgttccaacccagaagtttgagtttgagactaacctgggcaacatagtgagacccccatccctacaaacaattttaaaattagccagatgcagtggcacatgcctgtagtcccaggtactcaggaggctgaggcaggaggattgcttgagcccagaagttcaaagctgcagtgagctatgattgctgtactgcactccagccagggtaacagagcaagatcctgtttctaaaacaaaacaaaacgaaacaaaacaagtaacatctcaacagtactccctccttccagctgtgcctcccctgcaagcctagggcacattctagttgtgattctgaaagccaattttatttttatttttaatttttgtgggcacatagtcggtgtatacatttatggggtacatgagatgttttgatacaggcatgcaacatgtaataatcacatcagagtaaacggagtgtttgtcacctcaagcatttatcctttctttgtgttacaaacaatccaattacactttcagttatttttaaatgtacaatgttattgtagcctcctgttgtgctatcaaacactagctcttattcattctatctagctgtattttagaacccctggggatggtgaatgagagctcatttttgggaggaagaagtgcgcagtctggccatggggaggacagcgggtgaaggaccagcctgaggataccccaacctcaacccgggcctgcgctggaggagccccagctctgtgcccacgtggcggtgcctggagattaaaaggacaacaaaaacaccccctgccgccctcctttctggcgcttcggacccgggaggggaccacccgggaagatccagatcagtctgtgtctagagctggggagtgggctggggcgaggggaagaggcgagcagaggggacgcgcctggtagccgaattcagaggccgctgctgtcaggcagggcagccccgggcagcgcggagaaactgctgatacttgtttaccaagtgttgctttcaaccatgataccgcctttacgcgtcacagtgatgctgtgtcttccccattatggcaacagggctataggcatggagggcgggggtggagggggtgtgaaaagccccaggcagcgtcaggggttgtgctcctgctcctgtttgatagagagaggaacacccaccgcacagggctgttgcagggtcagcgatagcaagcaggccacagtgtttggataagacaggcttgtaaaagttgccatgcaagactcctaggaaataagtccgctcagtcctgggagttaagtatcctacaacattccagccaagcagtggcttcagggatggagacgggaggctgccacagccatggggacaaactgtgggctcgggtgggcggttaggttcttcctgagcaaagtcgtgtggaccacctcctatactacagggtcctgggtctggggataaatgggtgtgtgtgcgggctctttgtaccttcattaaaatataacccattgccttccacccaaaggtcccttcacatcccaggtccccggcccccgttacctcccctgtcccggttcccatccctcctctgacggcatttggactttcatgaacagatgcccctgctgagctgccagttcctgaagggtcaccgggagcagcgcctggcccacctggtcctgagcttcctcaccatgggttatgtctggcaggaaggagaggcgcagcctgcagaggtgagggccagagagcagcttctcctgttacccggcaggttacctgcgcctggagtaacgtgctccctgcttggtgctaccctgttttcctggaaaatgggtactttcttcttctcgatgggcatcagtttaagcaacgatgaagggctcatttattatttattattattatttttttattttattttgagccagtctcactctgtcactcaggctggagggcagtggggtgatcttggctcactgcaacctccccttccaggttcaagcaattctcctgcctcagcctttcttgtagctgagactacaggcacccaccaccacacctggctaatttttgtatttttagtagagatgggtttcaccatgttgcccaggctggtctcgaactcttgacctcaggtaatctgcctgcctgggcttcccacagtgctgggattataggcgtgagccactgcgttcagcctgaagggccatttaaatgaaggatttttttattttaatttttctgactaagagctaatttgttttttaaactggtagctatttcttccttttataagcttttgaatgtttgtttgtttgtttttggcactctcttccaagaatgtttgaagacctgcatttgaaggcagattgcctttttgctttaaaacagggttgcaccatgttgcccaggctggagtgcagtggtgcaatcatagctcactgcagcctcaactcctcccaggctcaagcaaccctcccacctcagcctcctgagaagctggggctaccagcatgtaccgccacacccagctaatgttaaaaattttttgtagagatgagggtcttgctgttttgcccaggctgatcttaaactcctggcctcaagtgatcctcctgcctttgcctcctgtgctgggattacaggcgtgagccaccatgccgggcctgaagacagactctgagaattcataaaaacctcacagcattttgtactcttatgtatataaattatctaggttgctcttcataatcctgtaaagtaacaagagccataccggcccattttacaactgaaaagcacagacacttatttccttaatcaaggtcagacagcaaattagtggaaaagccaaggccagaacccaggtcttctgattttactagtgcagccttctttccccaggggacacattgacatttacaacactcatctttattttttttttaatactgctttctatccagccaattattagtctgtcttttaataattcatccaaatctcttctgaatcattgcataactttgtacagtttccacccacagtgtcttttacttttatttttggaagtaactgtttttaaaagttactgttatttttaaaagtgtgccttccccagaaatcagggagttacccatgtcctagaactccacggtgaagagaacagcctgtgcccatcgtgtttgcctgattgatcctacctcttgtctctcggggaaacacaggagactcagggaagaggaaaagtgtagagtcattgcagccttgttatttgtcaatgcatctcttttctttttctttttctttttttgatacagagtttcactcttgtcgcccaggctagagtgcagtggcgtgatctcggctcactgcaacctcggcttcctgggtccaagggattctcctgactcagtctcctgagtagctgggattacaggcacctgccgccacggccagctaattttttttgtatttttagtagagacgggtttcaccacgttggccaggctgatctcgaactcctgacctcaggtgatccacccacctgagcctcccaaagtgctgtgattacaggcatgggccccagcacccggccagtgcattgcattttttttttttttttcgagacggagtctcactctgtcacccaggctggagtgcagtggcacgatcttggctcactgcaagctccgcctcccaggttcacgccagtctcctatctcagcctcccaagtaactgggactacaggcgcccaccacaacgcctggctaatttttatatttttagtaaagacggcgtttcaccatgttagccaggatggtctcgatctcttgacctcgtgatctgcccgccttcgcctcccaaagtgctgggattacaggcgtgagccaccgtgcccggcgtgcatttttaaaagtgtgtctgatgctgaaaagtttgaagtctaggcacgtcccagtgggtcctctttataccatcccctctgcaaaccattatcctaaattggggtttgggggagagaagagtgacagtggaaagaagtctccacctcccagctgtgccctggtagttccaggggacccggaggctccccacacccaccaccccgcctcagatcacctttcactttctttgtttctcctcccttgacttttcagctcagaaagtacctggctctccaatgccttctgaggaaagtttacccgaggttcacattgcaagactcattaaagctctttagtgttttccacccgagaaaaaattcaagggaaaaatgaagacaaaagcagggcattcttaatggatattttatcttaaggagaaatgaaaatggagatggaagagggggcacaaggatggggtttgaatctagactcgttcagcctttacctccgatagagaacctcatacagcttttctggacttctggctgataaagagccgtggagggttccttggataaaaaaggttgaagggggtctgtcctgtggtggcttacttgaaggtattactgggtttgacttatggagtaagagacggagtcagtttccccacaggctgaggcagtctgtcctcatgcttttctagggcactgtggtctcccaggctcatacctaggtgcacacacaggtttctgcatctagctttgtatctctatgagtcggtcaatcaataaatctatctatcatctgtctactgatctatcatctatctatctagctagctatcatctctctatcatctatctatgtatctatcatctctctctatatatgtgtgtatatatatatatatatgtatatatatatttctatccttccatctacttacctatctatcaaaatttttttccgttgataatattctcgggccccagtttatgtttaattgttttggtaatgcctttctttgcacagtcagtttacagaggttattttatattctatatgtatgtgtggtccagcgttgtaattttcacatatattgcaccgtgtactcataagcagtatttccactgggtcattaacagaaagatatgtgtgcggcatatgaatgtgcatcactcaggtaattcaagcttggttcccagatcatttctgtaccacaggattgccgaaataaaagacaaccatggttatttcctctgctgcaagctttctagaatatgctatttgtctggatttatatctgaaaggtcctgccaaggaatcttgcccttccatttgtcgaagtctccaggaacttggggctccctcctatcctggtccactcagacttggtgctgacgaactggaccaaaaaagatccagacgggtaaggaaggaagagaatgctttgaatttccataactttcccccaggaaacacccaggcttttttttataattagggaagttcatatttatggtctgccgtatggttccaaagaaggggtgagcttgaccaaaaattcaaatatcacaggccccagaagtttcctcttaatccattctgaacacattggctcagaccattttgtcttgtttgtttccacatgacgtgtgaatttctcaacctgaccttcaagctcctgcaaaatcagcttttatttgttctttctcttcaaactgtttattccctaagatgccctccattcatatcaggttaaaaccagttggctttgataagtaatcattatataatgatcagaagagaatgattatggatgaattcagagcagatgctccaggtgggttggattgagaatttgattaataattccatctattccaccaaagtcacatcattcctttgacagttgggctgggaataggggcatttgtctacagaaggaatagcatgagattttaacaaacaagaaattcaacaaacagaattagacagatgatctgagatgttaaattttcctttcaccttaatttttgcagccaaatttatttcagctctagatgaaagagacagcactttcttttgtggctgactacaacagctgaagattcactgaggtttgatatgaggaagaacttcctcagccatgggattgccagaggcgatgatgggaatctacttaaaagggttacatatttagtagacagcctagattttaagactaatttatgtgccccggccgggcccggtggctcacccctgtaatcccggcactttgggaggctgaggcaggtggatcatctgaggtcaggagttgaagaccagcctggccaacatggtgaaaccccgtctctactaaaaatacaaaaaaattagccgggcatggtggcacatacctgtaatgccagctgctcgggaggctgaggcaggagaattgcttgaacgaaggaagtagaggttgcagtgagcgaaatcatgccattgcactccagcctaggtgacaaactctgtctcaaaagaaaaaaaaattatgtgccccattggaagaagtgagattcggccatctcatctctctcgggagctctgagccctggagttttatgttttctgcaattatgaattgtgatccttgattaattatgctttaataataaaatgggtgactactgaaagctgctgaatctgggtaagaatttggatgaaaaaaataatatatgtgcgtaatttattctgttcaaggtactgaatattgaataagctggatttattactcaaagagaaagacagaataagagaaggttgaagggaaaaatgactgtactagaatggtagtcaaaaatgcaacaacaggcaggtgcagcggctcatgcctataatcccagcacattgggaggcccaggtgggcaggtcacctgagatcaggagtttgagaccagcgtggccaacatggccaaaccccctctctactaaaaatacaaaaattagccaggtgtggcagtgggtgcctgcaatcccagctactcaggaggctgaggcaggagaatcacttgaacctgggaggcagaggttgcagtaagctgagactgcaccactgcactccagcctgggtgacagagtgagatcctatctcaaaaacaaacaaaacaaaacaaaacaataacaaaaaagctattaatagcttcctagggagtaagagtgaagggctagtttaattccagagatgcggacacagtcctgggtctcaccaattattctgcttggtaattaccttttgaagccttttaatatgcctaacacagagctaagtgctatgaagaaatgaaagaaatagaagcaaagtactccccatgtggttaaataacaagacactacatgacaaatgtcaaagagtgactcaaacaatatgtcctttagaatttcagagaaatgacatcaatgcaggctttacaagtcagtaaaaatcttggtgatgaggcagaacttgatgtaaggcaaatcctaaaagttgagtaggaatcaactagctagaataaaatgtggggttgtggtaaatacaaaaatgtaagatgagtgaaataacttatttatttatttatttattttcagagacggagtctccctctgtctcccaggctggagtgcagtggcatgatctcggctcactgcaacctctgcctcctgggtttgagcaattctcctgcctcagcctcctgagtagctgggattgcaggcacctaccaccacacccgactaatttttgtatttttagagagatggggttttaccacgttggccagtctggtatcgaatcctcgacctcataatccacctgcctcagccttccaaagtgctaggattacaggcatgagccactgtgcccagcctaataatatattaagatggccacaggccaaatattctggggctggaatgtgagtggaaatgtcgctcaccctttatcacatagcaccccatagtccagccacaacttgcagaattcaaagtaagtgtggatgtgtgtgtgcctgcagtgccttgcacacaagtgtgcatgcctgtggacatgtgaccctagaagttattaatatatctggtttacaaactgaattgttcttttattttttttctctcttggtggtcatcaataactgaaattgggctagattcctggaaattgggtaagttctcagaaatcatttacgcactttagaatccaggccaaatttaaaatcttacaataaaacaaagaacaaagcatgctaaattatatgtataatataatatcaaccatataaaatgcataaaaaatatactagaaggaaatgtgcctaaaattcacagtctaaaatttaacagtgattgcctcttccttgtatagataagggatttttttttactgtattttccagtctgtacataataaaacaagtaatgtgcaatgcaaacaaaacaaaatgaaactttatcaaatttcagtaactccttgaagtttaattttttttttgagactgagtcttagtctgttgcccaggttggagtgcagtggtgtgatctcggctcactgcaacctctgcctctgggttcaagggattctcctgcctcagcctcccgagtacctgagattacaggcacccaccaccacacctggctaatttttgtatttttagttgagacagcgtttcactatattggccaggcaggtcttgaactcctgacctcaggtgatccacccgccttggcctcccaaagtgctgggattgcaggcgtgagccactgcacccagttgaagtttaatagtgtgaaaaaaatatttctcatctcactatatcttctatgggaggccagattgcagattgtctacagaaaaatcccttcaaaagaccttgttattacatagactggagctcatggggcaggtctggtccacacatccttaggctccgcttctcctggaaaacaaaaatagcctctgatccagtgttgcctctcccatcaccaaacctcagcttctatcgccaaactcatcaaataagagtgtccagtagaaaaactgggcagatgggggcacagaaggtgaagacatcatttcccaagctaatgttgctgctggaacaatgtaagtcttgactttgtcttggtttggtttggtttgacattggtttgtttttcatctttgtctcatgcttaaaatgtgaagggcaaatatgatccttagagttaaggttttaggttttgtagatgttttactccatttaaatgacagcagatcatttagaaatgattcctctgtaacagccttccagatcccattcgattgtacagcattgagatagatagatagatagatagatagatagatagatagatagatagacggaatttggccctgtgttcccacccatatctcatgtcaaattgtaacccccacatgtcaggagagggatccagtgggaggtgacaggatcatggggttggatttccccaatgctattctcatgatagtgagttctcacaatatctcattattattattattattattattattgcaacagagtctcactctatctcccaggctggagtgcagtggtgtcatctcggctctctgcaacctcttgcctcagtctcttgcgtagctgggattacaggcatgccccgccatgcccagctaatttttgtatttttagtagagacggagtttcaccatgttggccaggctgatctcgaactcctgacctcaggtaatctgcctacctcgctctcccaaagtgctggaattacaggcgtgagccactgtgcctggccagttctcacaagatctgatggtttaaaagtgtggcacttcccccacctcctgccgccatgtaagatgcttgcttacccttccaccatgattgaaaagtttcatgaggcctcctagccatgcttcctggtaagcctaaggatctctgagtcaattacacctcgtttctttataaattacccagtctcaggtatttctttatagcagtgtaagaatgaactaatacacacataaacagattagaggcagcactggcctgagttgtgaaactcttcccagcctggtcctgcgattagctggctatatgaccttggacaagctgctttgcttctctgggccatggtttcatacctgcaaaaaaaagagcatggacttggctgttgcctgggtctctctagccctgtggagaatcagctacatctcttactaggaacttctcattcagccagttattccactgcggagatggtccaggaccattagggccatgctagacattgggaggctgcctgtcaggtgaacatgaaattgaacttatctgttctctttcctccctgaatgttgctgaaggtagatgcccatcctcagggctgtcttacggagaggagaaagttgtgcagtgattccaccctgcagttatctaactcggcagggaactctgggcagtgagtactcacggtacagtctccacacctctaatcatgtgctcctctccttcccaaggaacctggagaccatcatctcatttcctgggggagagagcctgcatggttttatactggtgactgctttggtagagaaagaagcagtgcctgggataaaggtatcttctcacttgatagcaccttttctttttaaatgagcttgagctttacttcccactcagtgcctttcctgcagtggatttctcaacacaaatgaacatagaccttgtcctgcttagttcaagtctgagagaagagatctaagctctaggccaccatatttgctcccttttctcaattcctataaaactcggaatggaccttttgtccattcaacaaacaggcattggtttgggcaatgggaaattggatcgaacaagacagacattttcccagccctgacagaagcttatgatggatacagtggatgaagatggattaacgtggattacaggtgtgagccactgcaccgggcctcaaactggaaattcttcaggagtcagacaggtatcaggaaggctggatagaagacaaaagacagtgatgcagcttgtgatcaactacagcgttaatgccttgcctaaaaatatttcagttagatttctgccttcgctctgtcgctcaggccagagtgcaatggcgtggttttagctcactgcaatctccacctcccaggttcaagcaattctcctccctcagcctcctaagtagtgcacgccaccacgcctggctaatttttgtatttttagtagagacagggtttcaccatgttggtcaggctggcctcgaactcctgacctcgtgatctgcttgcctcagcctcccaaagtgctgggattacaggtgtgagccaccctgcccagccaacactacctcccttgataagcatatgttgagcacctactggtcctcaatagggtgacccatttctgctatattatagcgctttctttctctctcagtagttaaactccatggttactttagttctcatccatgtgtttagtccattagaagatacagagtcaaatatcggccttccaagtgtagttcagatgaagtagagactcaaggaagacaaggaagtcttcccagcagaggggattctagagctgggggctctgtagaatctgtctgtgtattagtccattttcacactgttataaacatactacctgagactgggtaatttataaaggaaagaagtttaattgactcatagttctgcatggatggggaggcctcaggaaacttacagccatggaggaaagtgaaggggaagcaagaacctcttcacgaggcagcaggagagagagcaaaggggggagctgccaaacacttttatacaatcagattttgtgaaaactctccctcgtatcatgagaacagtatgggagagcccacccccataattcaatcacctcccaccaggtccctccatcagcctgtggggattaccatccaagatgagatttgggtggggacacagatttcaacacagatttaaatctgactttatatgagagcttcggagcaaggatgccccagttggagatgcagtagaactgatcataacgtgacaaatccgagagaagaagagtaaaataatagtactcaggcccttgggaggtgcaagaagtaacagccagatgaaattccagaaacacttacctaggggtctgtctgggaggtccccagggagcttctggctgtcaggccaaccccacagtggatctagcttaggacgttcccaggaagctctgacaaactgtccggtcctcccctgggttccaacagtatgaggcttactctgcctgcatggactttaagggagtgctaataagttgtgtacatgcatctcatccctaggctcttgttcaggccacgaatgctatcttgcagcccaaccaggaggccctgctccaagccctgcagcgactgagactgtctattcaggacatcaccaaaaccttaggacagatgcatggtaagatgcttccgaagctcctgaaggatcccccaggggtcctgggctctgcttaggggaagagggcctggggaccaggcatgtcctgaagggggtgataatacattcatccaccagatgacgctggtggactatctttgttttaggttaaacacatattatcttggagagctattgtcacagctttgtattctccctctcctttatattctcccgtgattaagatggtttcccttctgcagtggccagatatttcttaggcatgttgaggtcttgcctgaagcttgagaggaggggatgggatgcacagtaatgttggtcgcgcgtgccccatcctgcagtgttaggtactgcagagcaggttgtctacactctgtaatgccccttttattctaaccccctgtgttggttcctgagatgtctgaccttggttttaagccttgtctaatggatggcctgtattccctttctgtagctagggcaggctgatttgtcaaaggtaggaaagttgtcagaatcaaaatggagtcacttgtgttgaataaaaatttttaaaccttgacaaatagagctggggaaggctacaaagagagagctcccgtgtataaatgcctgataacaaaatcttttccaaaggactgaaaaaatcaccaccttgcacaaaggccatcacaaccttacatacacaaaaaaatacttacacaacgacatctgcccagcaactgcctttccaacattggccttgtgccaccctttttattgatgctcatagccaaggttaatgatctcaaaacagttacataattgtcctcatttttcctttaaaaacctttgtcttcctttatctttctgaatacccacatggtttattatggcacatgtattcccattgcaatgccctattccagaataaatatcagtttccattagggagcctctccctgttaatctgcttaacacaggcatggtcagttacggggcccaaccttcctggaccggttacatcttattctggttactgcattcagtttccaacatctgggaggctcttcaaattcttctctcagaggaatctgaagaatgtatgtgtttaggaggatgtgagagaggggtgtggtttcttaacaagagaatatcagagtctaagtatcattttccctgaatcttgcttccctgcaggaaagaaagattctgggaaaagagagtgtttacaagaagcaggactggagggagggagaaagacgctaggtactgccaagctttattatcttgtattaaaaaagtaaatataatttgtcatcccagcctctcagcactagtagaaatctatctgaagtcacaggattaggtattatccacttcctggttttatagtttatatttgtattttctctatttccttgaattttaattttaaagccctcatgatcacatcagtaggtcttctgccaaacagctcccttaagttgtatggtggctttgccaagctgaaatgagatgagatgtgttttagctttgccaagaaagcctgagtccatcacttaggatagcaaggctattagggagatagtgcaggtgtcttcagatcacatggatgagcaaaaggaagcaattttggaagattatgagaaaccttccaacaggtcccagtgtacatagcagtaagatggtgcatgcagtgtctaactgtcacaggctttcctagggctcactttcagactcacttctttttttttttttttttttttgtgagatggagtctcactctgtcactcaggctggagtgcagtggcacgatcttggctcactgcaagctctgcctcccgggttcaagcgattctcttgcctcagtctccctagtagctgggattataggcatgcaccaccatgcccagctaatttttgtatttttagtagagatggggtttcgccatgttggccaggctggtctcgaactcctgacctcaggtgatctgcctaccttggcctcccaaagtgctgggattacagccgtgagccactgcgcccagctcagactcactttttaggcccaggccaacctgctgtgttctcctgctcagcttctgcaggaggtctcatcgtctaaggaggtcccagggctaccgcccttgttttctcaaaaggcacattttcccacacagacataatttcgtttcagtgttttactcctagtcacattcatctatatggacaaatagctgaatggattggactgtgttttctaaagatggccccatgccatcctgcgcgctcctccacagcgtggcctgggcattcctttcgaccaggggtggactctgtgcccctacttgtgatgtacgtgttgccaatagaatgtagtataggggatagcacagacttctgaggcaagactagaagaggtgatgcaggtttaaccttgtgtcctgagccactaggtaaaaagtccacctaccctgagatcactctgctgtgcaaacgacacaggcaaaccacatcaaagagccatgtgggttctccagttggcttctgcccaggagtgaaggtgccctcagatggttctaggctcccatcccaacttatgtcctgtcttgaagtcttcccaactgaggcaccagccactgtggagcagagtcaagccattgccatcttgttctgcccagattccccatcaacagaatatagtggttttttcacacctctatgtttggagtggtttctatgcagcaatagtaaccacaagaaataaagttataaaaatagtaacaaacactagaaactgcaagatttaaggaatcacctgaatgctccagtcattgtctctggtttgtaatgataaactttcttctgcgtgataaatagagcttggctggactttttccctctgcttccattccccaaaatggagcgtaccaaacaattgcttctttcagagcccagctttagcaagagtcatgagctctaatcccttcatccataaatacttcctttccaggcacgtagagcccttcacactcagggctgagtagaaaatgcctgttgcagactgcagtggcgttttggagagccaccctcctggtacctgagtcactagtcctttgcccagcttttctcagttttgtaaagcgctcacttctgagtggaagacagaaccagcccggtctattttcataatctgcccccataaggcagaagtccacacggtactggaaacataaccatatctatgtcagtctgccactgcctgccgcctgtcaaccgtgcgtgtctgcatccagtccttctttggagctgctttccagcgactcagccagatctgagctttctgactcattggaaggttaaactattttcagactttcaagtgttgagattattaagacatgtgtttttttttttcttctttttttggcatgcttactgatcgcccctgttctctaggaagtaatgttcttcttggaaaaggtgaaggatatttttctccccaaaaagccatggaaatgtttgcctttatttacttccaaattaacagaatttccagcttttgcttgacccatcggcgcattggcagcgttaagaattttttcttttagcagtaatgaggagtcgaagggtttcttcctaaccatttagtgtatgcatttaaatcaggtttctttttgagtaaattggggctaagctgtagtgtgaacttctgctactgttcctttctcattagttcacttgatttcatggaaggaattttccatctcagcctgtgaacttattttgtctaaactcaattggaaagtaattaacactgagattcttctttaataaattctatatgataataaaatcatacaaacatctctttatttttctttttgacctagaaaagatgttcacaggccagacctggtggctgaagcctgtaatcccagcacactgagaggaagaggcgggtggatcacatgaggtcagtccgagggcagggtagccaacgtggtgaaaccccatctctagtaaaaacacaaaaattagctgggcatggtggcacatgcctgcaatcccagctactcaggaggctgaggcaggagaatcacttgaacctgggagatggaagttgcagtgagcctagatcctgccactgcactccagcctgggcgacagagtgagactctgtccccaaaaaaataaataaataaaagatgttcacaatatattgttaagtgaaaaaagcaggctacataacttgcataatatgagtgcattttaataaaaatatacatatttagcaaaataaaaggacaaatggtatttattaaaatatttacgttgattatttcaacacagaggatgatagttgattttgcttaatttcttccctccttcttttcaatttgaattttctataatgaagattgtttctttttctttctttcttttttttttttgagatggagtttcgctcttgttgcccaggctggggtgcgatggcgccatctcggttcaccacaacctctgcgtcccaggtttaagtgattcttctgcctcagcctccctagtagctgggattataggcgtgtgccaccacacccggctgattttgtatttttagtagagacgggctttctccatgttggtcaggctggtctcgaactcctgaccttaggtgatctgcccacctcagcctcccaaagtgctgggattacaggcatgagccaccgcgcctggactgattattttttaaatagggttagaaagtgaggaagttactaaactccgattagcccaaatatgccccagtgggtccttctggcagagtaaatgtctcggttcagcctgaatctgggaaattgttcctacggttcagcctgaatctgggaaattgttcctaccttataaactggagtatccttcagaaatgacatttactcaaacttccttttaggcagactgcataatagcaatttttaatattaaccatttaaaaaaaaccttcagattaattaacaccaaaagaataattgggaaaatacaactcctcactttaaaaaagaaacaaccaaagtaaatactaaaaaactatatgatgttatattatctaagcttagtttactgcaaagatcaagagcacactactagttgacggcctctattcacactgttcatagccctcgctcgcttctccagccattcactcactcatgcaaaaggtctgtacacacaatgatgcctgatggtataataggaaccttaacatttcaattaaaaggcaaaatgaggacacttaccatcagcctataaaattattcttattattcttcttcttcttctcctcctcctcctcctcttcttccttcttcttcttcttcttcttctccttctccttctccttctccttctccttctccttctccttctccttctccttcttcttcttcctcttcttcttcttcttcttcttcttttttttttgagatggagtcttgctctgttgcccaggctggagtgcagtggtgtgatctcggctcactgcaacctctgcctcccaggttcaagctattctcctgcctcagcctcccaagtaactgggattacaggtgcatgccaccacgcccggataattttttgtatttttactagggatggggtttcaccatgttggccaggctagtctctaactcctgacctcaagtgatccacctgcctcggcctcccaaagtgctgggtgtgggcggcaagccacccaggtgccaaggcaagagacagagggcacgagctgttccagtataatgaggaaaatatatagaataagaatagttatactagaaatagattatagatatgattacatatgaatatcattcttcattagtttgtagcactactctttattccagtattataataatctttgttctacaattataacctaggaaaaaccaggccatacagagataggagctaaagggacagggtgagaagtgaccagaagagtgtgagccttctgttatgcccggacagggccactagagggctccttggtctagcggtaacgcccgcgtctgggaagatgcctgtcacctaacggaccgtggtctagcggtagcgtcagtgcctagaaaaggcactctttttaaatatactttttatttttgtttaatcttccctgatttcctatagatctgagatatgtcatgcttattttcattgctatctaaaaatctcaataaactttatacctaagagtaaaaaaaaaaaaaaagaaaagaaaaggcgctcgttacttagccgaccgggaaagggagtctccctttccccgggggagttagagaagactctgctccaccacctcttgtggagggcctgacatgagtcaggcctgcctgcagtcatctggaggcctaaccgtctccctgtgatgctgtgcttcagcggtcacgctcctagtcctgaacacctggctccgccttttagatagcagtagcagaattagtgaaagtactaaaagtctttgaaatgcagaagtaatggcgtaagctgtcacgtctctctctccgcctcagctgccaaacagagaagggtcccctgtccagtggacacgtgacttgggtgaccttacctgtcattggagacgactcatactccttaccctgccccttgccttgtatctaataaataacagctcaatctggcatttggggccactactggtctccgcatcttggtggtagtggtcccccgggcccagccgtcttttattctatctctttgtcttgtgtctttatttctaccatctcttgtctccgcacacgaggagaaaaacccacagaccctgtagggctggcccctacagctgggaattacaggcatgagccaccgcatccagccagcctaaaattcttctgaaggataataatatagtacttgaagacacggtttgaaaaaaatcatactaaatgaaagggcaccattttacaagcactagaactacattaaacttaaatgaattccaacactcttaataatgtaactcaaaaacaagtctagtgttaacaaaagctccaataactaaaactacattaacaggcacaatgaacattgtaaacgccgctaattggcaccaagtttaatagggcagacaatattttcttctgcattcacacttactcagttacactgttgaaaaatgctgctgctcaagctatgaatgctttacaaaagaaatcattttaataaatacagtaaatgctaaaactctagctaaactattatgcaagatatacaaccaagacaaatacaaattcataatacaagcaacttgcattcaaaatgaactctaccactatattttattaaaagggcagactttatgaattaacccagctgcttcctgaattacaaaagtggcatgactcaatatgaaaataagaaactgtctacaaatttctgacagtaataaattgtaatatacaatacatgcaggagtcttacggaagaataaactctcctaggaaacaaaaatattttatacttttaaaatccaaagtaaaaaaaaaagaaatcattgccagatgcggtggctcatgcctgtaatccaagcactttgggaggccaaggcaggatcgcttgagcccaggagtttgagaccagcctgggcaacatagcaaaaccccatctctacaaaaaaatacaaaaattagatggtaatggtggtgagcgcctgtggttccagctacccaggaggctgaggtgggaggatgcacctcaaggctgcaatgagccaaggtcacaccattgtactgaagcctggggacagagtgagaccctgtctcaataagtaaataaataaatatcttttatgaaaaagattctctagtcagaattaacacctcaactagccaaacatcaggaagttacattacagctacttaatacacaaagggacacattttcaccagtcgttgtcttctgatatttctattccagaaacacacactctcacttccctacactccccatcccatcatttcttcagagcatggaaacagaatttgttgaacaccagaaatctcttgctatggtggtacataagtcataacatttgttgctgcccagcagcaggtatgaagccggctggtgactggctagcaaatgcctattctgtaagctcctcacttagcccatctgtagctctgacttctccaccaattcccttctctcctttcacagcctttctgagtttctgagggataatttcagaggttccatataactgtcaaagcctatggtagacatggcaaagtgaaaatcctctccactggccatttctgtttctcttgggggcatctttcacttgcctcaggtgttataaagctgatgaacacacgtacacgttgtttaacactttcttgggcatttcccatttgagatatggcatgtttcattatcctagtgacatgtgcaatcagaaaatgtatattttgttctctgcaactttcttttgaaaaatgtatatttgaacaaaatatacattttttgtatcttcatgaccattcatgctgtcctcactgtcatcatgaggctctatataacataatgactcctccagggcagtcttcggaaattcccagtgcagaagcacgtgtcatacagcagtccccattcatctccagtgcagctctggctggctcccatgtctgatcagctgtttggttggacagaaaatgactgcaagggaatcagttccagtgtgagctctgtttgcagaactcagactcccctccctcccatgttaatgctttttttcttcttcttttttttttttttttttttttgacagagtctcattctgtcacccaggctggagtgcaatgctatgatctcggctcactacaacctgtgcctccccggttcaagcaattctcgtgcctcaacttcccgagtagctgagattacaggtgcacaccaccacaccccactaatttttttgtatttttagtagagacggggttttgccatgttgccaaggctggtgtcaaactcctgagctcaggaaatccaccttcctcagcctcccaaagtgctaggattacaggcgtgagccaccatgcccagccccatgttaatgcttctaaagtttgccctcacttctttagaaattccttcagtacatcctttaagacttcctctagtgagtgtctgctggtggtaaactctcccctctaaaagttgctttatttctcctcaattcctgaaggatatttttgctagcagctatattcttttagatgttgaacatatcggtacaaaagcttctggtttccatggttgctattgagatgttagctgtcggtttatctttctcccctgactatgtgtacctgtttctctgtatctgtctactttttgggttgctcaatttattggccttgggcttcattctgctgctgctttttttttttttttttttttgagatggagtcttcctctgttgcccaggctggagtgcagtggtgcaatcttggctcaatgcaacctctgcctctcggttcaagcgattctcctgcctcagcctaccgagtagctgggattacaggcacctgccaacacgccaggctaatttttgtatttttagtagaaataggatttcactatgttggccaggctggtctcaaactcttgacttcaggtgatccacccacctcagtctcccaaagtgctaagattacaggcctgagccaccacgcctggccacaatttttaaactttttatttttacaggcacctgccaacatgcacaactaatttttgtatttttagtagaaacaggatttcactgtgttggccaggctggtctcaaactcttgacctcaggtcatccaccaccttggtctcccaaagtgctaggattacaggcgggagccaccatgcctggccaaaattgttaaactttttattttcttcctcaagaggatgagaagaaaggtcaattgtaagctttagaagtcttgcccaatagccaatctgagaatattctccgtaaacattcaccagaggcagccagtgaccatgggatacttttggtgagaggaattgattgctggggtcaggaatgggaggaaagcatacttctcattagataccttgttgaacttcgtaaattgtgtgccaaatgcatgtcttacctagacttcataaattaatttctttaaaaataatcaaagacaattttttaaagacttatttaatttaaggtgattataaaacatccagtatactttcactattaaaaaagtaagtattcctgtctgggcttggtggatcacacctgtaatcccagcactctgggaggctgaggtggtcggatcatgaggtcaagagattgagaccatcctggccaatatgatgaaaccatgtctctcctaaaaatacaaaaactagctgggcgtagtggcgtgcctgtagtcctagttactcaggaagctgaggcaggagaatcgcttgaacccaggaggcggaggttgcagtgaactgagatcgtgccactgcactccagtgtggcaacagagtgagactccatcttcaaaaaaaaaaaaaagtattcctaaacagcatattatcatgatatattattttgttttgtagggttttgaaccttgtctaaaaagaattaaaatgtataaatttcttcctgcaatttccctatttcactaagggtcattcacattggtcatatagacatagcacattttcaccactatatagcagcattttgtacaaatagactacaatttacttattctgcacttatttctgtttgtttgttttgctatgaaaagcaatgtcattacatatattcatgcccatagctacaagtttacatatttcaggttttctgtagggtggacaccagggagttgaattgttcaacaggactttacattcatctttagttttattggccaacaccaaattgttcttcacaatgtttgaactaagttgaaattccacctccccatcacatttagttttgtcaacttcatttcttcattcattaattcattcattcagtcttttgtttatttgtttattgccagtctgataggcgtatagtggtgcttcatcatggttttactttgcatttctctgattttctttttaaatttttaaaaaattatttttatgtagaaacaaggtctcgctacatggcccaggctggtcttgaactcctggcttcaaatgatcctcccacattggcctttcaaagtaccgagattgattataggcgtgtgccactgtggccagctgatttccctgatttctgatgagttaacaatctcttctttctctctctctctctctgtgtatacaggtactcaccattcgtgcctattttctgtaaaatatgtggctttcctcattttttttttttttttttttttttgaggcagagtctcgctctgttgcaggctagagtgcagtggtgcgatcttggctcaccacaacctccacttcctgggttcgagcaattctcctgcctcagccttcagagtagctgggactacaggcgtgcaccaccatgcccagctaatttttgtatttttagtagagattgggtttcactatgttggccagactggtctcaaactcctgactttgtgatctgcccacctcagcctcccaaagtgctgggattacaggagtgagccactgcgcccagccatctttcctcatttttatactaattaggcttttatcttacttgttttttttaatgttttttgtacactctgaaggctgatttttgttaattgtatgtgttgcattttttatggtttgtcttatgccttttgaaagtaaaagttcttaatttaaatatagccaacctgtaaatcatttgtgaaagtctgtggtttaagaggtcttgaataagaaattatcccatcatcataagtcataaatacttttttgttgttgttgagacagaatctcattttgttgtccaggctggagtgcagtgggttgatctcagctcactgcaacctctgcctcctgggttcagcaattctcctgcctcagcctcccaagtagctgtgataataagcatgtgccaccacaccagtctaatttttgtatttttagtggagacaggatttcatcatgttggccaggctggtctcaaactcctgacttcaagtgatccacctgtctcagcctcccaaagtgctgggattataggtgtgaaccaccatgcctggcccataaatacatttttatgtattttcttctaaagttgttttgtctttcactttttagtttttaattcacatataattactacttgctacttataattatctgtaagtagtatgagatgagaaataaattctatttccctcctatggataagcacaaacctgcagtattagcacagtcttatgtcagattttctaaaatgaatgggtgtgttttctaggctctctgttctgtttcattatctgtcttttcctgcaacgatatcatctgccttaaaaactctagccttgtggtattcctcattttcaagcagagcaaaccccgtcaccttgcttttctcctccagcatcgcttgtgctatcctggactaagaccttcatatagactgttagaatcatctagccaagttccattttaaaaatctatgttggagctgggcgcggtggctcacgcctgtaatcccagcactttgggaggctgaggagggcagatcacttgaggtcaggagttggagaccagcctgatgaaaccccgtctctactaaaaatacaaaaattagctggacgttgggcacttgaattctagctactcaggaggctgaggcaggagaatcgcttgaacctggcaggcggggggtgcagtgagccgcgatcatgccactgtactccagcctgggtgacagagtgaggctccatctccaaaaataaataaataaataaaataaaatatctatgttggaaattttgtacaaattttattaaatgtctacattaatttggagaaaaatgacttgattttgattatctattcaatatttctgtattatgaataaggcaaaaagagaggcagagaatagcataaaataataactaaaattcctgggtaaaccacctcaaatcatttcttcatatggctcaatattcttttgtgacatggcctgaaatatatccagacagagaactcttctcttcaatacatttcttcttttaggtattcatattgagttttcctgtccatgaacatggtataagagagtatatcccttcgggaggccaaggtgggtggatcacctgaggtcaggagtttgagacgagcctggccaacatggtaaagtcccatctctactaaaaacccaagaattatccaggtgtggtgacacatgcctgtagtcccagctactcaggatgctgaagcaggagaattgcttgaaccaaggaggcggaggttgcaatgagccaaggtcatgccattgcactccagcctgggtgaagagcgagactccatctcaaaaaaaaaaaaaaaaaaaaaaagaaaacgagaatatatcctttcatttactagtttttcttcaatttctttcaagataaagggcttacctatcttctgctttattcatagttacttgatatttttgtttctaataaatatggtgtctgtctatttacctgcctcttacctgttcatttccagtttcaaaaatgatgttgatatttgaatattaaccttaaatctagcaccttggtaaacactattattcattctaataattatcagtagattatatgtgttttttatttataaatcatattgtttgagtagcatgctttgcttcttcatttataaaatttacaacttttatttctttttaataatttttttcttattctcctggctaggacttctaacacagtattgagtggaagtgctgatccttgtttagtttcacatttgaaaaaagattgcttttactatttcactgttaagtataatatgcaccataggctttctgtggattccttttatccatttaagaacatctcttattcctaattagctgaagttttctgcatgtttgttttcatcatgagtggatttttttacatctattgaaatcattttacatagaagatatttcacacctattgaaatggtcatttcacttttccttctttaatatgttaagttgggcaaaatattaaagtatcacctgtcattctgcttcagcaaaaagtagtagtgtcttagcagtattggtgaaaagacagcatcaaataaaaaagatgtagaagtaggacccagtaaaaatctagcgcatggggcattgtcacatgtaagcagacagaatgtgacaccaccaaggagcatctgaagggctggaggctgaaggaagacatgagtcacccaggctcatggacacttcagagaaattagggagcaggaagaagaaataggatcaaagactacgtatgttggttggaaaaggaagctgatggtatggagatgttattatttaggtctcacataaaagatgtagataaataggtagataggtagatagatgatagatagagagatagatagataaatacatagatagatagatgataaatagatgttgttatttaggcctcacataaagatgtagacagattagacagacagatgatagatagatagatagatagatagatagatagatagatagacgatagatagatagatagataatctcagaaacagagacacagtgatctcagtaagataggcatatgccaggtgacagaattcagaggggtcccactacgtgaaaacaatagaacaaccttcgaaaagaaatttagtacaaataagagggcaggcttccttacatacaagttagtaaactggaagaatcagttatcctcaaacattggaatagatcaaaaatagttgtttatattaatgaaggtagctaaacatgaagctaagtgaacctgtctctgacctagtgtggcaatccctgggcaagggacacttgctccgctcttgtatccttcactgaatattcagactttcagttaagcatcggtgaatttagttttcatctcttgtgaaaaccttgagagaggtaattctctctgcttttcttcttttcccttccttcattttctcaaacattgcctgtttaaaatacgaaattttaaaagatggccttgttctcttttttgttgttattattaagtacagagaaaggaagaaccacaaatagcaaagggcaacatatggaatagtttagaagttccgggagcacccatgagggcaactgcagaagagaacattctatcccccgttgctgcagctttcattccaggtctccatgcatatcagatagggaaggaactccgggacagcagcagggcccatgcacatgtaaccaattgctttctttgcctgtagtaaagttcacattttgattgcttctccagattatgtagatccagacatattttatgcaggcatccggatctttctctctgggtaagtatagttcagttgttttcctgtgtgaagtctctgtagcattgactgaatgtataaggggacgaagagacagaagcttcctagcgtaagaaacataccaagtgactcttgctagggatccactctcaggtaaaagaagtgggataccatctgcacaacaaataacactgagggctaagtatttcagttaagagtgtttgttcctaggcagttcagatccatttatattcacttttcttagaatcctagctcaatgacagaagaagaaaaacacagtatgtcactcacacagttctatcacttacatctactttttcttcttgttattaaggcatgtagaaggctggggagtgtagtatagagttggatagcatcgaagctttcttctaaagttcctggaagagctacactgtggtttgaacgaatgtgtccctccaaaattcatatgttaaaacctaattgtgatggtgaggtattcgaaggtgggttctctgggaggtgattatgtctcctctgagaggagaagacaatcccctgagtggaactaatgcccttataaaggggctggagggagttcacttggccctttttgctccttttttcttccattccttgtcccttccactatgtgaggacacgggagttgaggcattaccttggacgtggagaccaggccctcaccagacactgaacttgccagcaccttgatcttggacttcccagcctccagaactgtgagaaatacatttctgttatgggtagtccccaactcaatacagtttgacttaccattttttgactttatgttggtgcaaaagcatacatattcagtagaaactactttgagtacccatacaaccattctgtttttcacatttggtacagtatttaataaattccataacatattcaacatgttgacataaataagctttgcgttaggtgattttgcccaactgtgggctaatgtaagtgttctgagcacatttaagggcagctaggctaagctaaggtgtttggtaggtcagatgtattaaatgcattttttgtcttatgatattttcaacttacattgggtttatcaggatgtaacccactgtgaattaaggaatatctgtatttacaaattacccagtctaatgtattttgttgtagcaacaggaacaaactaaaacactaccccaaaccatttttttcatattttctgagtactcttcttttgtcacatggcttgaaatttcttcacatagagaactctactattattttattttattttattttattttattttttgagacagagtcttgctcttttcacccaggctggagtgcagtggtgccatcttggctcacggcaacctctgcctcctggattcaaactactctcctgcctcagcctcccgagtagctgcgattacaggtggctgccaccaagcctggctaattcttgtatttttagtagagacggagtattgccatgttagtcaggctggtctcgaactcctgacctcaggtgatctgcccaccttggcctcccaaaatgttgggattacaggcttgagccaccacgtctggctgataactctacttttagatactctctttgcttaaacaaattagccattccttccttgacatgttttaatcagattgccttcctattaacttcggaaattaagagtttctgctatgtttttgtttaatttttaaacagtgaaaaatgaaaggtggaggcaatggctggatgaggtgaatatgtcaaatagatatcatctagtgggccatcttattaactaggagacacctgaagtgctatcaatagaaataatctgaagctgtgtctggatacagcaagagacatgcaaatgctaaaaatctactatattacattggtgcaaggacagagtagcaacacatactaagtattttctccagattgggtgtgtttgacgtgtgaagcacttcaaacagagtccagcctgggagggagtggggatggaatcctccttgtagagggtacagagtggaagcaagaaggtttccaagattgagagtaatgggtgtatggtttatgggggaaagggaaaacaaaaagaagggtgcagaaatggagctgggagtgtgttttagtatttaggctttctctgtatacctttgataggattagaaaaagaaaaatggaccatttttaaaaatttcatgctaccacatagcaggcttatactatagatgcagaaacagactgggatttaggaagcaccccaattctggaaaatccctttttgcttcacattgctctctaaatctgtatgttttcccttgttacgtaacaatttaccacaaatttagcagcttaaaacaatatgcattcattgtttcacaattctgtaagtcggaatcataggcaagctcaactgacttttccatttagggtcgcaaaaggccgaagtcaatttatctattgggctgggctcttaactgaagatctggggaagaattcccttcaaaactcatttaggttgttgtcagaattcagtgttttgtggttctagaactgagatctgtttccttgttggctgtcagacaggagctgctctcagcttcttgaggcatccagtattccttatcatgtgtttttttttttccatctcagcactggcactttttttttttttttttttgagacagagtcttgctttgtcacccaggctggggtgcagtggcacgatctcggctcaccacaacctccatctcccgggttcaagtgattctcctgcctcagcctcccgagtagctgggattacaggcacccgccaccagcccggctgatttttgtatttttcatagagatgtggtctcaccatgttggccaggctggtcttgaactcctgacctcaagtgatcctcccacttcagcctcccaaagtgctgagattacaggcatgagccatcatgcccagccagcactgacaattctaatccttctagcactttgattccttctcacctctccttctgcctctagccagagaaaactctctgattttaaaggtcttatgtgattagattcagcttacctaggtaattcaggataactccctatgtcaaggtcaactgattaataaccttaattacacctgcaaagtcccctttgccataatatatcatactgacagacatgctatagcataatactaatagttctaagaattatgataagaatcttggaaaaccatttttagaattatacctaccacagtatccttcaagggataaattgattctacttcttctctatgtcagaagcatctgatgaggatgaactatatattctgaaatccccatgattagatgtgtactagaaggtgattttactttcattaaaataaattcggagtcattgacacattttatctttgatttacataaatgcctccgctctgtttcttaccctcaaaatatttcccatgtagctaagtggccagtaccgaatcctacatgcattaataagtgtagatggacaaaaatatctggattactgagaattcccattagcattgtctagaaaaatgtaaatttgcttttttgttcttgatttatcctatttttgatttattatttatatttatttatttatttatttatttttagatggaggtctcgctttgtcgcccaggctggagcgcaatggcgcaatcttggctcactgcaacctctgcctcccaggttcaagctttcctcctgcctcagcctcccaagtagctgggactacaggcacctgccacagtgcccggctaatttttgtattttcagtagagacagggttttgccctgtgggccaggctgttcttgaactcctgacctcaggtgatctgcccaccttggtcccccaaagtgctgggattacaggcatgagccaccacacctggcctttttgcttactttttaaaaacatttttatttaggagaatggagatatttcatatgtagatgacacatattcattccctttagttcccacacacattcaatttcttgaggaagttagcctttgcaaaaaaaaaaaaatgatctcatttttttttccccactaaaacttctcattttcttggggttgctagaaagttgctacaagaaaggctaaaaataattgtgcctacagatatttgaaaggaaaatagttcctcttttttcacagtagcagcttggacctgagaatgtatgggagcaataattgggctgctcaaagaaacacaatttcccttcctcagactagaattaccaacctagagaacatgagtttttaaagtagatgtgcttcttttatctttttggacttgtatgctggtgttttctctgtcaccttcactgtggaaatcctcttgagggtgaggcactgaaagcagattgattaatgtctcttggccatttgagacattggatggctcttttaagttggccacgttctttcaagaactatgcttgggctacatattctggatatataatacatacttgtaggatgttatttttaaatcattcatttatcacatatttagtgagtgcctaccccatgtcagttctaggtgctggaaatagagcagtaaaaccaaccctcaacttggcccctctggagcttacatttcaatgcggtgggtggggggatggacaattaatacacaagtaaatctaataaaagcgtcatacaatatacattacaatggtaagcacaatgaagaaatggaaagctggatagagagtattagagactgtcgaatgtagtggccaaattttcctgtttattgtggtccaagagtgccacagccctctatgacatttgagcagacacctggaggaagtgagggagtgagccgccaagaaggaatggcaagtgcaataaccctgaggtgggagcgtgttggtcgtggtggaagagctgcaggaagccagcagggccgcaacactcaggggagaataagaaagagtgaggtgacagtagagaccggatcatgtagagctttgtcagcttcttttctgagtgagatggacaacacggacacgttttgaaaagaataacaatgtgatctgccttcagttgcaaatcatctctgtattgactgagtaggaaataaactccaagaataaagacggaaacagggaaaatatttaagaagcgatcattacaatccagggtggtggcttgtactagggtacaagggctaaaggtgttgagaaatggtcagattctggatatatactgaaatcaaagttgatggaaagatatgagtcaaagataatttgcaggttttggggtcctggttcactgaaagaacagagacatcatttactccaatgaggaagactataggaggaacaggtttagcaaagaagaaaggaaatcaggagatcagtttggggacacggtcatatcaagtaggcagttggatgtatgggtctggaatataggggagtggtctagctatcagtgtaaatagctttttacatttgtaaatagtcaggatataggcttttctttttctttttgtgagacacagtcttgctctttcgcccaaactggagtgcaatggcacaatctcagctcactgcaacctctgcctctgggttcaagcgatactcctgcctcagcctcccgagtagctgggactacaggtgtgcaccaccataccaggctaatttttgtgtttttaatggaaatggggtttcaccatgttgaccaggctggtgtcaaactcctgacctcaatcgatctccccgcctgggcctcccaaagtgctgggattacaggcatgagccaccccatccagctgggatatagttgttttctaaatctatgaggctagagaagaccatttgggaattgagagcagtgagcagtccacggactgaccctttgagagtgcaacatttagcagtactcaagatgggaaggagctagtgaaaaagccccaaatgactacataagaccatcaaccagattacaaagaaagacccgaacatgtgtgcccatatatcacccaacagcagttatgtctttcatgtttcttccccataaaatgttgttcatcaactttattagactagggtcttaacattggacaaatcacaaaacctctctggagcctattttatttttcaacagctgtaggaagcaaatacaaattggaaatctaaggctcagaaagatttgtacaaagttacacagtaatgaaaggggagccgggattcccactcactctaaagaatatgataaaatggctagtattcactgaatgcttaacatgttccaggccctgggcaggtattattttaattagttctcacaataatccaataagggagatactaatttactcagatgagaaagctgaggctcagagaggttaatgaactaagccaaggctcactgttaataaatagcaaaggtaaaattaaattccatatctgcttgagatagaggccttgctcctaatagctgcagcctgtcagggcctggcagcagtaacctctcctttcctcttcccaccattcccctgcactgctttctgtaccgcatctcttttcagagtgatgttgccccaattgcggaggccactgtgctgtttatccagtgaaagctgtagcacagccaacccaaagcgtccccagtgaaaacaacctggctccttacagcacttccagcctcagagcagtatttgaaaaatatcatgaacagcaaacacagcagtctgtctgtggcttttatatgtgtatatggtgtgtgtgtatgtcccttctcttgagcaaaataacttttagaattatagaaaaaaaatgtgcaacatcaatgtggatctgctgtttaaactcataacagagaaagtagcttgtttctggctataggaggaaaagacgatattccttagtaaaaatggaaatccacatatggggttcttgtaaaaatgaagatagaaaattgcaagtttggggatcaagttctggttctatcatcctttaacagtatgaccctggaaccttaattgctttgagtctttgttactttatctatgaaatgaagtatttaaaaaaactccaaaaatctgtcctgatgtacacacaagaggtcaaatgagaaaatgaatgtgaagatgctttataaactatacagcatggtaggtgcaaatgtgacatgaacttgttttggacacattataaagtcacccccacaaactgtgattgttcaagactatgcaaagtcagacacaggaaaataagtaaaacagatggaggcataaagagggggaactcagagaaaacagtgaagaacaggaatcaggaagacaaaggagaggaaaggtggggaggagaggagaaggaaagggggaagggaatggaggagaggagaacagctgcttcacagagcatggccggcagcccagtcccagcctttctgcatgtccctgacttcagcctctggcgaggcacaggcttactctgtgcttcctgctgttactcttcttatccatccttattatcaatacctgtggtcaacaaagtatttgataaaggcatcctcaaagtcaggtaacatctgtacgttatagattacaaagttgagtaatatccagaattggtagtttaacgtgatgacttcttaacaattatcactgtttcagggaagggcaaaggtgtgtgtgtgtgtgtgttcatctgtgtgtatctgtgtatgtaattgtgggtgtttgtgtatatttgtgaggctctttacttggcggagttaaaaagtatctgctcatcaaggttgagattagcaaaggaagtgaagatttttccagagcccctaaaatgtgccttttgaccaacactgaggacatctttataactgagtatgtgcaataaatatgtcttgggacctgtgccacaaattcctctctaaatagcctttacctctctggaataaccctttagatgaggaagaaaagggctgtgattttatagcttgttatgaagctggagtgaagatgatgcttcagtacttaccctacaaagatacccccaatccctcaccctaaaattaccattgaaatcatgttccctttctcattcactctcagtttccatgtcagaaaatataccattacctccctgcacccctttcatctctctcacttttctcttgcttagatggaaagacaacccagcaatgcctgcagggctgatgtatgaaggagtttcccaagagcccctgaaatactccggcgggagtgcagctcagagcacagtgcttcatgcctttgatgagttcttaggcattcgtcatagcaaggaaagtggtaagtcagacattttgttttcccttgagagtagagggaggaagaggagaggtgttttttttttttccaattgataaaaccaaatataaattaaaatgtcatgaagtttatacttctctaagtcagccaagaaactgcatgactgccaatgtttttgtgtcaagccaattaatattggaatatcagatgtcagcttgatcttgggttttacttccaaatcttaaaatgttgctctgtttccaactgttcactatcactttggtttggatctttagacactagcttcctttttctgaaatgggggagagatgtggagtttgaaggctatgagtctgggccagctggaaacaggtctgggatcttccaagaaagtccttccccacaaaatggtgcaacttctagccaaatctatttataccagcagagggatctatcaccctggaagcttgaaattgttcattttcttacctgccaggatcaagttaagtttttaacagttgcaaaaagacacttcatactatggagttttcaagttggattagaagaaaaagaatcaccagaacttagtgtcgtagattcaagtcacttctctaaaactgtcataatttttcacggattttggcatttggtgacattaatggttgatttacttaccatgcataatattaaacccataacgaatttcctataaatatctattgatttgatttttaaatcacttggcttcaagaggctattactaaaacagtgactcattctttatcttttttgccttcacgggctttatataactttctccttttcttgtgctccctccaaaacaaagcactgagaaaacaaaattcaccagagtattcagctagtcagttcaagggtttgtgttctacatttgaagatattccttatagcagctaccaacgggatactttgtttacatttgttgtgtagtaaatatttatatattggcaaacaaatctagttccaactctgtcatctgagatgttcttactttgtttcctcttctccatctcctgtcaactgttagaaatatacatttgagtacgtgaagtctgcaaacaaaagggccaaggtagatttgagttagaacaccagcaacagtttctggtgcattcttgtctgaaaaagcagagaagattgggcaccgtgggtcatgcctgtaatcccaaaattttggaagtctgaggcaggtggatcgcttgagcccaggagttcaagacaagcctgggcaacatagcaagaacccgtctctactaaaaggaatacaaaaaaatattagctgggtgtggtggcgcacacctgtagtttcagctactcagaagactgaggtgggaggatcacttgaactcaggggcagaggtggcagtaagctgagatcacaccactgcactccagcctgggcaacagagcaagatctcatctagagaaaaaaaaaataaaaaagaagaagaagcagacgagctctgctatatttccatgtggagctatgacgttatgctgtattgtttctttcaggtgactttctgtacagaatgagggattacatgcctccttcccataaggccttcatagaagacatccactcagcaccttccctgagggactacatcctgtcatctggacaggaccacttgctgacagcttataaccagtgtgtgcaggccctggcagagctgcggagctatcacatcaccatggtcaccaaatacctcatcacagctgcagccaaggcaaagcatgggaagccaaaccatctcccagggcctcctcaggctttaaaagacaggggcacaggtggaaccgcagttatgagctttcttaagagtgtcagggataagaccttggagtcaatccttcacccacgtggttaggaggctgccctctccccagcaatgcagagcccccatggagggcaggtgggcctggagaatgagggtcagggttctgcctgggatcatccaggaaggatctcagccctattcatgtttctgctctacagagcactatattctccttgttgagagctgttggcttcacaaaggagagttgatgtggccaagcctttccctccctacctgatcactgcttaacggcatgtataatggatacttcctcatgcagaacccccagaggagtgactgtatgccattctctttgccaagtaatagaaaaccaatctaaatgtcaaaaatcagataaaattgcctggggatacattacttgttgattttcttaaaaaacaaattcacttaacaattcattaagttcatactgagcactgcctccaagattaaaaccaggatttctgtggtcccagaccagccctcttctccctgaatgtgttgagttggtggcaggaggttggaaatgctccagtggagatgggaagatagaggatgctgacaataaggacttggaagtcactagtgtgaaaatgagcagttaatgatatgggaacggatgagactttccacgtggtacctagatttgcaaattctattgtaatgcctttatttttagaagaattattctctcttcttactctgaaaatctgtatttgtaaaatgaatgaatggatcctatataagtaaataagaaaactgggaataagtagtaaatcaatgtgtttagtgtgcaaataaatgtaaatgcttttattg

SEQ ID NO: 251 - DNA, 371041 bp, Homo sapiens
tatgctgggtggcacagtgaaatttatttgtctttatgatttacacataataattaaacacacaaaagaaaaaacactgtcaagatggccatatgtagcttaggaaatgactggtcccaatgcaatcatataaatgttcattcagcgtaaaaatgagtttctttttaatggttttaatcttttttttttcagtccccaaggcttgtaccactcagtacaaatgtttttgctactgggttatcatcaggaacatgatgtttaccaattcccaggaaatgaataaaatcaacagaaacatcctgtgacaacagagcacattttcatagaaatgaaattgatgagcttattacagtttgaatcagttcagctattagatctacacataaaacatgaaacaatattaacaaattacatttgtattaagtttttatttaaaaatatttatcacacttttttgtgcaagggttccattgatttctttggttttaaacacgatagatctattttacctaaatatatatagttctatttgtaccaaacatcaaaaatcaaaaaaacaaaatttcaaagggtaaaaatggaattattgcttcaatataaaaaaggcctagcccatttgagaactactgccattattgctttcctatttgaaaaactatcctggaaatcaaggaatgtaccccatagctccctgcagaaagtataaattggttgcacattatcatcatattaatatgaccctaccttcaccaaagctatcctgatcttgtccttaaaaaatgaaacaaagcaaaatagcataaataaataagtttacctaaggggatacaataaatagcctagtatactagataggaataaagaatattgtaacataaagcccttcagtgctgtacaatgcaacaatagctttggattttcaaggtttagagaccttgaaaatccatttcataacagttttattactggtatgcagctgacagaacaagagaatacacttcttttgttctcctcatcttagagtgaatgcacagcagatacaactgtcaattctgccttttgggaatttacctgggcatgtaccattgtcactttttgacctctgcctaattgtagggcaaaatcttaggattaaaaatatccaaatattccttcaattcctagtggtttcttggtctccagaatagttaaaaacagagaggaaattagactcaaaagttttgctgccttcttttctttgcatccatcgcatccagaatgggctgtcttttcgcagtgtatctctgacgaagttcttctatctcccgttccatcatggggtccagtgcttttaaccgcatctgtagttcttctaaacttagatttttcaactagatacagaaagaaagataccaatacaatgaaattatccacattatccacaatcaatacaatgaaattagactttaatgtctaatgagttttaacataaatatttcagcaaattctttacatcatctttgaagtatagttcaacaattaaaacaggaatttcttccttgaagaactcagaggtcatatcttgcaagaacctccagtaatctgcaatgaagcaatccgatcctctgcctttaataaagggcaaatgagaaaaatacgctgatggaatttgtaaaaaggtacaaagacaaatccaccactgccaacaaacagattttcagaatatgttccaggtatattcactctaactttttacatctttgccagctactgagtgctacaataatcatgaacacttgcagagatcactcaagaatgtgacaagactgaataaaggttaaattaaccattctatcctccattttactaaatgcttaataaagaagatgactgtggtagggggcgggaagtaaggctgaataggcctggtggggccccaaaagcaggaagccatgatcaattctggagtaggacagttatgtaagagtaatccagatttggttttcttttcttcttcttcttcttcttattttttttgacacaaggtctcaaacttctgggctcaagagatcctcctgccttgacctcctcagtagctgggatgtgccactgcacccagctcaggcttggttttaaaatgataaaacttgcaacttactttttgttttaagaagataattgcctttggttattttatgagtcaagctaggaaaaatactcattacttatagtcatccaaagtagcatttctcagcagatccttttactcgccatccctggccctatcgtgacttctgcttccaaaaaccaaattcactcttagctgaaaaagactctgaggatactgaaaagaatgagtcatagactctctgaaggaaattcaaaaaaggagttccaaaaatattttgagaaatgacagtgttatggagaagagtatgcaggcttccatgatgatgactttgaaggtgaatgccactcacttcggtgcataagaagttctggtatgtatattaataatcagccctgttattttgtagtcatatgtcatgaaagaacctagcttttaatattatgccataaaacatacatttatatatcatatgtagtattatacactttcttcattgatttttaatccaagtagtgatcttgcatctgttacatgctcagtgctgttcaaatcactgtggagatacagaataagacaaacagggaaactccaaactttgaactgtacacatcggtaatggccacattgaaaggccaatgtataccacacaaccacatttcccaagaaagacatgcccaactatgtctatgtaggatccagttccacttctgtgttcttcaacatcatctctatttcagcccatgttaatctttcccatttctaaatttctatgtaacactcataatttaaacaacacaatttagtatttgattctaaatcatgtactattttataattgatttttatgcatgagtttcatgtccctagatattccaaaaaatacttagactttagagactgtacatacaccaagaaactatcctactatactgcaaataacatgacgtaaacgtagatagataaatatgaataagaatatatgacccaaaggagtgggttactctaagatcagaagaactaacatattatataaagcaaacaattatcattactttaattctgaattaagatattcctgtaaatatcttgtactacttttactggggcaaactgccaataggtttataaatattgtattgcagtaatagactgaactcagaaaaagaagctacttagaagaaaaattttcttcctttaacagatttttatattatcaatgcgtaaaatttgtgaaaaacaggtctgtgatattagagaaacattatctaacattattaaggaattaggtgttcatgtaagtaaattaatgaagtacctaaatcttagttctttaagtgataaaactttgtctcaatatcacatacacacacatatacacacacacacacacacacatgtgcacacacacatgtatttacatatgctcttttttggttctatgtgacttttaggatttttttctaattttgtgaaaaatgatgttggtattttgataggaaatgcactgaatctgtagactgctttgggcagtaaggtctttttcataatattgattcttccaatccatgagcatgggatgtatttccatttgtgtcatgcatgatttctttcaacagtgttttgtagttctccctgtagggatcttttaccttcttggctaagtatattcctaggtaatttattgctattactattattattattaattattttacagctattgtaaaaggggttgagttcttgatttgattctcagcttggtcactgttggtatataatagtgctactgatttgtaccactgattttgtaacctaagactttactgatatggtttggctgtgtccccacccaaatctcatcatgaattgtaatcctcataatccccatgtgtctagggagacacctggtgggaggtgattggatcatgggggcagtttccctccatgctgttctagtgatagtgagtgagttctcacaatatctgatggttttataaggggcccttccttcttcaatctcactctgctctcccctctcaccacgtgagaaggtccaggcttgcttcaccttcaccttccaccatgattgtaaatttcctgaggcctccccagtcacatggaactgtgaatcaatacacctctttcctttgtaaattacccagtcttgggtatttctttatagtagtgtgaaaatggactaacacagttaactggcactgaggtagtggggcgctgctataaagatacttgaaatgtggaagcaactttggaactgggtaatgggcagaggttggaatagtttggagggctcagaagaagttaagaagatgtgggaaagtttggaacttcctagagacttgttgaatggttttggccaaaatgctgttagtgatatggacaatgaagccgtggctgaagtggtctcagacgaacatgagaaactcactggcaactggagcaaagatcactcttgctatgctttagcaaagggactggtggcattttgcccctgccctagagatctgtgaaactttgaacttgaaagagatgatagggtatctgggggaataaatttctaagcagcaaagtgttcaagatgtgacatgggtgctcttaaaagcattcagttttatggattcacaaatagatggtttgaaattggaacttatgtttaaaagggaagcagagcataaaagtttggaaaatttgcagcctgatgatgtgatggaaaagaaaaacctgttttctgggggagaaattcgagcctgcagcagaaatctgcgttaagtaataaggagccgagacaatggggaaaatgtctccagggcatgtcagagatcttgccagcagccccatttcatcacaggcatggaggcctaggaggaaaattagtttcatgggccaggcccaggggccctgctactctgtgcagccttgagacatggcaccctgcatcccagccatttcagttccagtcatggctaaaaggggccaaggtacagctcgggccatggcttcagctcaagccttggtggcttccacatggtgttgggcctgcgagtgcacagaagtcaagaattgaggcttgggaacctctacctagacttcagaggatgtaatggaaatgactggatgtccagtcagaagtttgctgcaggagcagagccctcaaagagaacttctggtagggcagtgtggaagggaaatgtggggttggagaccccataaagagtccccactggggtgctccctagtggagctgtgagaagacagccactctcctccagaacacagaatggtagatccattgacagcttgcaccatatgcctggaaaagctgcagacactcaataccagcctgtgaaagcagctgagaggagggctgtaacctgcaaagccacaggggtagtgctacccaagaccatgggagcccacctcttgcatcaatgtgacccggatgtgagacatggagtcaaaggagatcattttggaactttaaaatttaatggctaccctgctgggtttcagatttgcatggggcctttagcccctttgttttggccaatttctcccatttggaataagagcatttatccaatgcctgtacccccattgtgtcttggaagtcactaacttgcttttgattttataggctcttaggtggaagggacttgccttgtctcagattagactttggacttggacttttgggttaatgctggaatgagttaacacgttggggaactattgaaaaggcatgattgtattttgaaacgtaaggacatgagatttgggaggagccaggggcagaatgatatggtttggctgtgtccccactcaaatctcatcttgaagtgtaatctccataatcttggtttgtaatccccatgtgtctagagagagacctggtgggaggtgactggatcatgggggcagtttcctccatgctgttctcatgataatgagtgaattctcacaagatctgatgggtttatgaggggctctttctccttcactctctactctctcctgccaccatgtaagaaggtccaagcttgcttcaccttcaccatctgccatgattataagtttcctgaggcctccccaggcacgcagaactatgaatcaactcgatttttaaaaacatattgagacttgttttaggcctatcatatggtttatcttggagaatgtttaattttggataagaagaatgtatattctgcaattcttgggtagaatgttctgtaaatatttgttatgtccatttgttctacagtgaagtttaagtcctgtcttcattgactttctgcctcgatgatctgtctagtgctgccagtggagtggtgaagtcccccactattactgggttgcacctatctcttttcttagatttaagagtaattgttttatgaatctcagagctcaagagttaggtgcatatttatttaggactatatcttcttgttggattgatccttttatcattacataatgtcattctttgtcttttttttttactgatgttgctttaaattctgttttatctgaaataagaatagctacccctgctcacttttactttccatttgcatagaatatcttcttctacccctttgagtctatacaaatccttatgtgttgggtaagtctcttgaagacagcagatatgtggtttgtaattttttatcaattctgccaaccagtatcttttaagtggagcatttagaccatttacattcaacattaatactgaaatgtgaggtactgttccagtcatcacgttggttgttttctagatactctgttttcttcattgtgttattgtattacaggccttgtgagttttacgctttcaagaggttctattctggtgcatatctacctttcgtttcatgattcagaactccttttagcatttctcgtagggatgctctggtagtgacaaattctctcagcatttgcttgtctgaaaaagaatttatttctccttcatttatggaacagttttgctggatacaaaattcttagttaacggttttctgtttaaggaggttaaagataggaccccagtcccttctggcttgtaaggtttgtgctgagaaatctgctgttagtctgataggttttcctttacaggttacataacgcttttgtctcactgctcttggtgacatcttttttgcaacgaatctcctagaagttcttttttaattaaaacactttttttttttgtgggtgcataccgggtacctgaaatgttttgatactggcatgcaattgtgaaataagcacctcattgagaatggggtatccatcccctcaagcatttatcctttgaatacgatccaataacactcttcaagttattttaaaatgtacaattaagttattattaactatagtaaccctgttgtgctatcaaatagtaggtcttattcattctttttattttttattttttttgacagagtctactctgtcacgcaagctggagtgcagtggtgtgatctcggctcaccgcaactgatgagaaagcaaaaaatgtccatcaaaatatgaatggataaagaaaatatggtacatatacacaatggagtacattcgtgtgccatatctgtttctactcatgctgttttccttctctatcctatttcccattttatcatcttactcatccttcagtgagttagctgtgcatgggcctatcttgccagctagattgcaatcttgttgtgggagatagagtgttttactcatctccgaacctactatgctgtatttattttaaaaatatctgatttcagttttgtggttgtatgaggttgagtttacaggaaatctgacttctgcataagctacatatatcgctaggtcttcaggtgggctgtcagagaacttcaaagtactcactgacatatttattgagatttttctatggaccaagcatagtagaatgaattttcattcacatcttgaatagtttttcaaacttctttatgttgtttttcacctttctctcgtatctcctttggtagcttaataatcaaccttttgaattctttataaaaagatatttcaaagatttcatcttggtttagatcaattgctggagagctaatgtgatcttttcaggggtgttatagaaccctgttatgtcatattgccagaattgtttttctggttccttctcatttaggtagaaatatatggaatgcttcacgaatttgcatgtgagccttgcacaggggccatgctaatcttcactgtatcattccaattttagtatatgtgctgctgaagtgagcaccgtctcaattgttttgaacagaaaatctttataaagtgttccacagaatatactgccttctaagcagaggacatagaacctaaaacagtttccttgatatgagttatcattatttttattatggatggatgaatattgtttttagttaaattaaaaagtcaaaactactttttaatatgagtcaacactttgtttgtaaattgatatggtttggtacatgagtgacagcttaaataagaaattcattttgttagtgatagcccttgataattacatttcattcaggagatgaaagatcaatatacaaaactatgacatttctcagtatttctaaaaaaaaaaccaagtaaaagatacgcaaattaataactcagttactagctcttgtataaaacaggagcataaaaaactcagtgatatgagaagttagggtggaaaataagattaaatcaattcactgataattctgacatttcaaacctttaataattagaattatttctgaactctacaagaagtattgaaagtctgcttattactgatcagaaagagttgtcagtaaaattagaacttcctttaagtttacatatctagtctactataaaaacctaaaatatcacagtcaagtgataaaacttacttcataaaataattcatcttaaaatctctggggaaaaacactaagatttctatataattttgttttgtcaaaaatagtcgtaattacatgagcgatttttaagaagtcaaatctcaaatagcagaaacgggaatatgaaggttttgaatacatcaatgtaataacatttcaagacctaatgattctatgagttgctggaacaatcagtctgtcaaaataaatgagacactactacaatgaagcaaatggtcttacatgttaatgttaacacatttagtcaaacagtcaatcaagagaatcctaaggtttgctgtgtttactgggaaaacaaactcttcctagcaactgtttaaataaatcttgcagatgctacagaccttattagtggcctttgattaaaaaaatatgggttgctaatactgtatcctgactcatctattttcccatctgctagcaattctaacaatatgaactatcaacagaatggctaacaacaagaattttctatggcagttttgatgctgaattgcctatagcatttttaagatttaccagtgcatgtctcagactgttttgagtttcttgtggcctggagcaacatactcttttttcccttaatattccattttagctgaaatttttactgtgttgaacagaatcttgtttggttttagaaaacactgttgatggaggctgccacacatttaactaacaatgagaacaggaaacacaacaaagcactagtaaaaatccagtcaggtccactgattggtttagatatacataaacaggcaaggggccttttgcccataaggctgagccacagggataacaggtagtacttaaagttaaaaaaaaaaaaaaaaaaaaaaaagaaagaaagaaagaaaaaaaaagaaaagaaaacattcatatattaaggcattttcctgatttaattcctggcactgagaagcatacaaaaaaggagcattctagtcaatccaaactactatgaagcctgtttaaagaaaaccctacatatacatttaaaatatgcatttacaaaaataagatagtgataatttcaggcacttgataacactatagaagaaaagctgaattcctcactgtaaaaatgtgatcttaaaagctgcattaacatcaaatctactggcagaccccccttccccaaacagacattatttatcctgttctgagctgagaggcccaggtcttcagctgactgaataactaaaaatattctgggattacaattggaaactaccatgaatcattctgttttggctgtttaacttcagagcacctagaagaaacttaggattctagattttcattcccaaagaaaaggaagaatacggtttctcatgaatatcaatgaaggagtaggagaaagtgccaattactgattatttacaatgtgctgaatactatcctaaggtcctgtacactaagtcattgaagcctagcaatcaccttagggggcagatattaccaaccccgtttgacaggtgaggatgcttagagagatcaaatgatccaccctaggtctctcagctagaggtgcttatgtaggccctcaaaggcaacatctaacccacataaatttgaactgcagtctactgatagctgtttcatgggtttcccatgaactacaaaagcactacaaaatccaatgatcatgtgaaacagttttttcacaaattgtttataggttaaaaatagaaaaaattacttaaaaatcccaactttcctgtcagattgtacctggtgaagcattttacttataagctattcatgtattttagccatcactggccatatgaaataagtgcatatgtgttaattaagcatttttctatttaaccagctctttagccaaagaaacacatttctacatagccctttgggatagatttcctaatgttatcaataaatgtaacagagataccctgacaaaaccaataaaacatgtctccttcacattccagtgagactttgcctatgtctgttcagactgttccacagttggtttggtgctgtgtttaccttgaatctagtgcaggagttacaaactgatgagcattactataattatcttgtcttagagaaatctcggccacccatttaaaaaaggaatgatgaaattttcgttgcattcctcaatggcagctgagcacccatttcttatgtgcattttccgtttctggtaagtagctttgcttattaaaaatatcaggaaatacttaatttgggcacacttctgatatattgtaagcagctctaacattctaggcccaggacaacaaaatttaagtaactcaaaagcaaccagtaattaaatctttctggatctattaagggcagatgaaaaattgtattacctttgatttcttatctcagcgattctgattagcactttgaatagtttaaaacaccaatgaagccgtaaataagaggttaacaaattaagtgattaattttctttttatacttcaatttaagaaaaacattatatgagaaatatttgttatggaagatcacaaacattacaaaaacaacagtggttaaagtatatctgtaactagcttactgggtagtcaaacctctgtggagcaataatataaacttaaagtaatttaatttttctccaattacactctttcggctatgcaaagtcaaatttccttgacatatcccacagtaaatcttgggatgatttcactgatttctggtcacttttacttattaaaagtccagaccaaatataaacttcaatctcttattaagtgcaaattttgtcccttcccttagcatgagcttgcaccaatttacagtggggaaggatgatgtctatatctagaaccttctcgccgtctctttctaaggtctggttcctctagtgctgggagcaggaaggagaccggatgttattatgtaaatggtgacttgtcagtgaggtatgtttccctggtcttgctctggtttgtttgattactagtggtttgtgcacagaaagcgtgtgtatgtatttcctgatgttgtggttagtattatcctagtgcccaccccttttatagaggggctgcccaacatcttttctgagttagatattgtctcctctgacctgaaagccacctgggcagcattatgacttctgacctcctcttttggagtaaagagatcatggaagttctctacactctccagggactagtgggacccaaggaaggtaagggtcactactccaatggcccttagttatcccgcaggcctcggctctacctacagaagtctcctacctacaaaaatctttgggagagaagcagatatcagtgtctatgctaatataccttccaaacttccaggaactaaaggctctgcctttagtggcacaccagtgggtctacagattcagctagctcagtaagcaccttgctggggtaccaggtaaccgtatccctttcctgcaggcaccaccattctctgtgaatggatctctggaaggctccttatttgactttaggtaaggagagaactattttcttcccctcccaccaggttataaattccatttggatagggcctttgtctagtaaacagctacatctctagtgcctagaacactgcttgaaacatagtaggtgcttaatcaatatttattgaatgaatgaaaaatggtgggtctcttagtaatcgctggagggaggcggctggcttcagttgttggtggcatgctttagaatatcgggtacttaacacctgctgttttcagctgtggactctactaacaattttgtggtaacagaaagtcccttttgatgtcatagtacacatctattaactctatttaaaaaatgtgtgtgtgtgtgtgtgtgtgtgtgtggcatcaagttggtaaatttgcagttgaagtaaagcaaaaagagtatctgtgaagatgagggtattttttcagcatgtttaattaatattactacaggatagtttcatgctccactacatgtttattctgcatgtctgatgatacatttatttcaataataaggggctcatccttttcttagaataatggcttctctcaaaaaattctccaaaacaataataaataccatagttgactctttgaggaaacatgcatggagtgaagtgtgctggaagagcatcattcttactaatgtcacaattttctgcttcactgacatcacaatacttagtctaacaatttaaattatactatcttcatatcataaaaatgtaaatatttgtttcttgaaaatctataaagtagttttaaaatgaaagaggttagctaaaacccacaaatcatgcaatttagattgtaatagataatttttaatagtgaagcaacatctagaaataaacaagagtctcatattttagtttcgaagcatctaaatccacagttcatttaaaacagttcagaataagaatcgtggtctgttaactatttttaaaacaataaaactcaaaatatgccaaaatgtttctaaaacacttcaaaagaaaaaataaattcgatcatagttctgcattctcacttgccacatgggccttagaagataaaatgtaccaaaaaggaaacattttagcattctcaattttagaatggcatggtttgtggctgaaacaatatttaattttcccagctactgacagacaaatgtacaaattaaactaaaacacccatgaagagattcagatatttgtaaggacacaagaaaaaaggataggaggctcttatgaaaatgtttaaaaagcaaaattgattttgtctaccttaataataaataagctgtcttgtgcaaacttaaaagcaaaatcgtcgcctgaatgaaactgagattctattgttttttcattaatatttgttttaaaatatgctcacaaatgctatgaatttaaggtaaaagaaggtagagaatgagaataaatgaacataagtcctgctagttattaacttagatgtgtctcatgggggaagaatcaactttcaaatgtaaatgtttcaaatcttcaactttctgaattggggaaaggacaacagtgtttgtgggttatgtcagcattttagactgcgcaactaatatgcagaaatcacagaaaataaagatgagagccgggcatggtggctaacgcctgtaatcccagcactttgggaggctgaggcaggcggatcacgaggtcaagagatcgagaccatcctggacaacatggtgaaaccctgtctctactaaaaatacaaaaattagctgggcgaggtggcgggtgcctgtagtcccagctactcgggaggctgaggcagcagaatcgcttgaacctgggaggcgggggttgcagtgagctaggatcgtgccactgcacttcagcctggtgacagagtgagactccatctttaaaaaaaaaaagaaagaaaagaaagatgagaaagtaatatgccaccattacttccaaaaggctgagtaaacattgattacaaactaaaattttcacacttagatgattataatacacgaatggtccaaaaaggcttttctttgcgggggcgggggggcggtctgagaatggcgccaaattagatttttagaaactgtttttcggtatcaactaatttaatagagaacatggcatcaaaattttatctctaataataccttgcaaaatgagtgtgttcccaaatgttcctgcaagtcttcagcgctggggctggaccaagctgcacctcttgcaaaggcagcaaggctttggttttatcctcccttgagccagacacctgccttctgagtggcctcactactaatgtggacatggaagcagaggcagagaactgaggttgggggacagcacaaagaatggctgatcttactttacatctactgggaagccgggagactgtggtcatgagtggaaatttggggatcagaatttcagctctggtttgaataatatacattaatatggagtagttttgctagtaaatcttcacatttttattttacaagatgaaatttcagttcagtcttaaaaagtccattttaataaggataaaaggaaaaatgcatctttaattattgaccatatgaaagacatattgttggtttacctcctgtggaaaaagtaataacacagctatgtggctgctgaattcaatgtgctcttgaggaactttccaaaaaatattagtaactgactgacatacactgttattcaaggaagagcttatccactggataattattctgaaactggtttatattcacatacaatatatgtaactctcaatctgaaataaatgacccagcagacctagtgctgagctgctagtacctggtactaacagatcctagaattctccaaagcattcttagacaagaacaccgtgagtgaactttccattattagagtcagagtagcggtgcaataccagaaatgatcaactaattttgaaaaataccacatgcaaagaaattaccttcaaactgccaaaaacactgcaagctggtccacacaacactgcccatttctggatacccatgatttacctaagttcttctagcctattttcagttaggaatgcccatttgaatgaacctcctcctgctacagttctcttaaccacagtgcatgatcttgtgactctgtcaggtccaccctagccctgccaccgccaacccacagatctcttctaattaccccagttgtgagagacagtcatagtcttaatcattttcttttcacaggggtgttcactgcctcatctcacccgtactcagtacaaggccttttaagtaggccaccctcactctcacagttgtttctatagtcagaatagtcagctgtgctggaccaagctgtcaaaagaagggagagataactcttaaatactgaggaaattgcagattctgctagctattttttaatttttcaatgaccagaaactgtctttcattggtctttagtgagtgtcatccttaattatatcaactaattttaaagatgacatttttcctagacaattttgctagggtgacagcataagcttccccaacccttggtaaatctctgctctaagtataaaaaacaagacactgtttactgactcttaagaggtgtgggtttttaatcttgcagggtgaccaagtgttgaatatttggtaacaatttcgtaaaatcttttatatcccacttagaaattaactgatagaacacctgagggagagtggtaaaagtggaagcagtacaacagaataaaattaaatgatcctaaatcaactgcaatgtaccaaagccttctgaataggcaggtggcttctgaaaagggtaagggtgaatgaagttacagcttgactggctcagagagtttataggtttgtagaggatgagtggcttacagctcgatcactggctcctgaaaagttaggaagctgggccactatcagatcaatggtatcggaaactgagaaacatgaagtcactgagctctacagatatgaatagtggcatccactgaacccgctcataagggcaagatttcaacctctaagagagggctaagtcgctggctatacagtaccctctggtggccagatttgacactgcagatttttctgccttttaagaaaagaggcctggtttttttccttttcttttttttttttttttaatgcatagacttaccattgggttacgtcttgataaagccatcataaactaaaaatatctgcatttagtacagctaacctaccaaacatcatggcttaacctagcctaccttaaacatgctcagaataattaacattagccttcagttgggcaaaatcatctaacgcaaagcctattttataataaagtgttgaatatttcatgtaatttattgaatactgtactgaacgtgaaaaagagtggctatacgactactccaagtaccgtttctactgaatgtgtatcactttcatatcaccaaaaaactttaagtggaaccatcatatacctgggactgtctgtaattcaaaatctttctagacaaggaaggaatcaccagtagcactgctgggctatgggtaggtgggcaactacctactaggtgtaaatctgtcaaccaaaaaagtaaattatggtggctttaagggagaaaatgttcctctgaatgtgtttaaaatcccatgggtgtagctacttaaatgaagaaatctggtgagtacttagctatttaaaatttaattctttgcaggtacttactttacaagaagtattcttatatagagagattcatattgctataaatatgtacataatagctaacatgcgcttaccactggcagacactatgctgttatttaataggcaataatcctatgaattagtattattagtatcaccatttttcagaatttaagttttcagaggcaccaagagtttgaactttaagacatttagctaataaaaaaatgtggccaggatttgaatccaagggaactgaattttggagctggcactcttaaacactatacaatgcagttaaatatatgtagtttactgcccataataaatttttccaaaaaagagatggcttcttaaaaattttaaattagattcagattagtatagacacttgcaagtcaatgatgcttaaaaactaaactaaaaccctatgccagttgagtgtttatttcctggaatgtttactcacatacaccttatggtggagaggggagtttataattggccacagagcctgagacctaatatttttgaaatcataatatattttacagtacttcacaatttacaaagcatatttacatacattgtatcacatgaacctcaaaataatgctgtgaaatggggcagataattctgtaaacaggcattattcttaactttatagatgattaatgaggcttacaatgataagtcatttccttaaataacacaattctctcaaaatctaagatgttccaaatgactgaatgcattatgaattagcctatcataggctttatcatctgtcacataacatttaaaaaaagatttctcacaataaaccaaaataaaattttactttattttatttctgctttatctacaataaatattataattcaacagtaattactattgttgaactagcaaaacccacataacaaaataaaaatcagaacatgaaaagctatagtaaggagaatgagaacaagtatggatcataaaatccagaattaggagcgaaatggtccaaaaattatgagattaagatcaatgattacataaagcactcagcatttttgtaattacttaaatttgtaaagtgccttcaaaaatttgttactcttttataatccctaagagatcactgagagacaataatagcctttacacagcagatgaagaacattttgaaagtactatgaaattcagttattatttttgtttaaaagaaaacatcttgtgattctaaatcacaagagcccgaaattctttctgaatataagcaatgccatttacaaacattcctgctgcacccatcttctacaccccctgttgtaatgaattcgcatacctgcctccgattacaggctggattgccccaaagtagtcttctcagaaacctatctacacagttagcttctttctcttgtgcatcttcaaactctctttgtctttagcatcaacatgatatactttctgatatttcccatcttaaacttttattgttttttcttatctcaagaaaaccctgccttgactcacggccattcctccagttgtcacaattccatccctcttctcctttagaaagtcaaacttctcaaagtatggagaaaacaataaccatattttaaattggcaatcaaacttcaacttgctccatactggcttctgatcccctaatgctctccaaattcctcttgttaggtcgccaaagttaaatgaattctttttagtttctatcttatttggcccctccagctgtacttgatactttgtccacacctttccttcttgaaacctccctctcttggctcctacaacaccatgctctcttttctcctaaatttatggccatttctcaatctcctttattggcttcttctcaactactaaatgttagaactactcaggactctgggcttttactatatactccatttcctaggcagtctcatacatgccctgggctttaaataccatctatctgatagtatctctaatatagatctgtcttctgagttccagaacttagcaattctattagatgtctcctgggtattgcaatactcagtaagttcatatctgacagagaccttctaaactgtttatcttttaacctttcctatttcactaaatggctcttccaccatccaactagttgcaaatgctaagaacctaccatattcaaatgttgccatgccttgtggtgttcatactacttaccaagatatgtcaaatcgatgtcctcctcttcatctgctgtcatctccccagtcaaagccctcttatcttgagcacactgtttcaatagcttcctaactagtttccttctatctttgctcccctccaattcactctccatacagcagccagaattattgtttaaaaatgtatactgggtcatgtcctgcccctaagatacggaaatggctctttcttgcatatgaaatccaaatgcggccttgcctgaatctaatcctgcctaggtctgcagcttcagcttgtgctactctagccattactcctatgtttccatcatgactgattctctttcagtttctcagattcaccaagctctttgcatgtgaattgggagtaaaatcgtccaaaaattaagaggttaggattaaatgattacatgcctttcctttgcttagaatgttgttccacactccccactttggcttcaagactttgttaacacagttctgtctactgagagtgtcctttccctcatctctgcctgatgaagttctattcatctttaggactgatcttaaatgtcatcttcataaagtcttcctggtcaaattttccctgtaagcatactgagttacttttttctccatatacctaaagataattttgcatatgtctctgttataacatttatcaccgtactgcaatcattttttaaatttctgccacattagaactgtacaatatgagatacgtgaatataggactgggccttctttagatccccaaatttagcaggtgcctaacatcatccaatctgtcacccattaatattgctttaagaataagagccatcttacatggcaacaaccactagtgaagattgtatttattaacttgttagtgtttgtcatcacggtgacatacacatattcagaaaaatgagtcaatattaataattaaagacgttactgtgatgaagtttcctgaaatctgagctcatctgtatacccatatccaatgacttgaatgtctcaatcaattcattggctagcacaattctcaagccttattagggaccataatttctatggttgacatcttaatgctgagtaggagccggaagctttgtggactctcaggttcatgcacctgaaagtcctgtgcttaagtgtgtgcatgatcttgctcagaagcaccaagaacaggggtgagaagagagaatgtagaacatccattgttatacaagaggcagtgacaacagagatggcctatttaacttacttcaaaagcctttaattctcaagcaccaggaaaacaattttagagctgactacaatagatcttttgctagactgttctgaagactagttttttagaaagtaaaaccatattaccagaatattaatccacaataaggttgaatacaatttgttaaagaacagactccatgtactattacaaaaatgaggtctgacctgaaacaccatccatttgaaatatttaaaaataaaaatagacaactctcttaaggaggttttttaaagcatcatctgatatctacgctatgataaaagtcagcatcaagtttaaagaagtgaaacaaaacactgtcaccatgcccctatgagctaaaactttgagaattataaatggcggatttaacaatgataacctttccattcttttgccagacgcgaaacaaattatgctagttcctcctctagaatttcttgctttttctgcctatgaccttctcagctcacccacaagcagcaccattcattgactgaactgttatttgacagtttgtcataatcaaatacggtaagcagagtatcacgatgttctagttcactttaaagcaaactatttaggactataaattccatctaggccttagatacacttcaaggcaaaggtagggatactgggcagagaaaacaccaagatttgacttttactccaacatgtacctaagtgtagactggaagtttgtattcaaaacattgggggagaaaagtttaatgttacctgtgtattcaacatataatatcctctgttttatccagataattcatcaaaatcagaggcatgcaaggaaggtgagaatcaggctgtgatttgcttacagatatgaaatcttgggagcaactcagtccagtgaagagacttttattgccccacaaactctaatattgggcagacttgggtttttactggttaggtgatgaaaagtccaaggtaattatcaggactaattagaattacaaaggacactgacacggggtcactgtaataaagttatactttatatttaccagcagtcttagacggctatgggtaaatgttctggctctgcggccccctgaaaagcaggattttcattccaacagaaaaaggaaaaaaactgattccaggtggaaccaatgttgcttccccacccttttttcagttcagagttgacaatcatgttataaaatgaaaaaggcaaatgcatgaacagattttagtgttgcataaaacaaaacttaccacaaaactaatgtggctttgttaatgatatgaataatagattctgggtaaatggtaattattcataattaatttcatttcaaaaacagccatagccaaaattatttttacacagtcaactcaaaatgtttccaaattctctaacatctataaattaaatcactcttgatgatttccactacaaccatgcaaggcttaatacttttacaacaaaggaatttagaatatgtcaccccaaaatacattactctggcatactgactattttgagtaaaaggtacttgaaaaacagcaactgcaagaactctctgacctttcttcttcataaaagcaggaaatgaaattcccgtgtgaaagacagcctccctctaccagaaggaaagcatcattcttatcatcaaggacgggaagctgagaccgaggaaaatctgtacaaacaaaccttgttaagctaacccttatcttcctcgttacttctctgcccaattacctactctgcccaagctcctctgccttgtcacagtttcacaatttactactctttcgccaaaagagtagtaaattcagtatataagttttcaattctaactgcatctgtgggtcttcatttccttacaaaggctccttgccatgtaaaattcataagaaataaatttctatgtttttctcctgttgatctatctatgtcaatctaattcttaggcctagctgaaataccccaaaaactggtaaaggtacaatttcacctcacctacaacacatacatatcctttaaaaacatctttctcaaccccaactccctagcagccatggtgcaccctcaatgtccgtgtttgagaattaagggttcctgagcttttctcctctgcaaatcccactcatgggtccttcaccaaatgtccattagcaattcattcagccatttcctatctcagtctccaccagaaagggccacccctgcagctctgaaatgcttgaggggcttgggaagctgaaattctgtggtataaggtttcaatggctagcctcgcataatcatcacacttggcggggggggggggggtgggcgggggggggccctaatgaaggcaagggagagggaagggaaaggacacagagaaaagccttcaggagtctgtttcagggcatctcagtcttggcactaatgaacgtttggtggggtcaggggtaattcttggttgtgaggggctgtcctgtgctttgtaggatgtttagcagcatccccagcgtctattcacaagatgccagtagctttccccaagtttggacaacccaaataaatcacccctggttgagaaccagcagtctactctagagtcttgagcatagagaggtataggaagaaaattaaacagaggaaagaacctgaattcagacagacccctgggctatgtgtagaagaagcaagtggctcttggtcacatgctgctctttgtgaacatgactcaatgtagcggaaatttgagagtgagcacaaggacaagaggaatggaagtcaggaaatgagaggaatctgtaaggaagaattccaacccaaatactctgcccctcactcacaaggtgatccctatgtatctactgaagagtactcaaactctttttcttaaggcgctggtttataaaggccatcaggaagcagactgagatttgggggtggggtggaagaaggggagttgggaggtagagaagggtttcccctacctaaactaagcttgggcttaagatccatcgagttcgcctcccgagcagagcaaagaactgaaacatgcgagagggttgctgtgaagcattttagccaacttttccaagccagatgcctggagttctcactgaggaagctggcagaacctagaaaaatccttattactccctcaaatttgcagagggacttcagatgactaaaactagctgcaggaaagaaaaaagacattttcttttctgcctagccatttataaagttttttaacttgcagaaaatcactgaagttctttcagtttcggagcctctaaaataaagtggaaatactataaacacatgtcacagagatgttctgaagattacatgagaccacagatgttaaagggcctagcacaaaggtggcataggtggctccctaccctctgtctctccttcatttttagttttctttgggctcatgcaccacatgcccacatctgtgccaccagagctttctctatctgctcttatacactatatttacgagcttctgtcgttatcttgttctgcgattttcctctctccctatgttcctgatgaggtggcagtggtacttgctgctaaatacatctaagtcctttcatcactggtgacaagagttcatgtgagaggtagcagtggagaagatgcaggaaaaagaatgccatagtgaggatgacatacttcatcactgttttacccttggcagctctcactccacctgcatgaagacatgaaaaaatctctttctgcgtgatagtgcaggtgtgtagtttagcaggaaacttgacaggcagttaaaagacaaagaagcggccgggtgcggtggctcacacctgcaatcccagcactttgggaggccaaggtggggcggatcatgaggtcaggagttagagaccagcctggccaacatggtgaaaccctgtctctactaaaaatacaaaaattagctgggtgtggcagtgggtgcctgtaatcccagtgactcgggaggctgaggcagcagaattgcttgagtccgggaggtggaggttgccgtgagccaagatcctgccactgcactccagcctgggtgacagagcaacactccgtctcggggggggggggggggcgggaaaggtgaagaagcatatcaggagttcagcttttgctaggtcagagaaagttcttaacagactaactcttttgcagataataaactgtggacaaaacacaaaaaccaactactgaagtctctaaagaatgaacaaaaacacattcttccccctccacaagaaaacatttacaatgtctgggatgtaatccaaaattacttgacatatgaagaatctggaaaatgcaatccacccccaatggaaaagacaatcaacagaagccaaccttgatacgacccagatatcagaaataacaagactttaaagcagctataattactgctgaggtaagagaagacatgctcattatggatgaaaagaatgggaaatctcagcagagaaactagaaatataacaacaacaaaaacaaataggagctttaaaacttgaaaaattcaatatctgaaataaaaagcttactggataggcttaatagcagaatgaagatgacaaaaaattgattggaaaaaggtcagtgaaaattacccaatctgaagaggagagagaaaaaaatttaaaaagaaagtgtttcaggaccctctgaagtcccagaaggtggggaatgagagaaagtggtgggaaaaaacatcagcataaattatagctaaaaacagtcctaaatttggcaagagataaatttataaattcaagaagctcatgaactgtaaagaagattaaaaacaacatcaatcacaaaaataaatgcctaggttgatagaaaccaaaaataaaaaagttgtgaaaggagacagagagaaaaaaacatatacagggcaacaattggaatcatcggacttctctttagaaaatatgaagtccagaagacacctggaacaatattttaaactttctgagataggagaagcacacttcactttaaatataaaggcacagacaggttaaagtaaatggatgtaaaaagagcatgcaaacagtgaatgattatcgtactaatattggagggggaagcatatcacctgcctagctgccacagtatgatttcaaaaaaaacaagaacattcaccaagaacaaacaaaaaaacctcttcaaatagaccatggaactgaattcaaacttgtatctgataacagcgatgacaatatctctctataacaatcctgaccagcatatatcacaattactacagaggctactgacaagaaatccaaccttggtatgctgtacacgactgtcctcccaccctcccagtgaaatcaaacaaaattaataatagtctactacatcagagggactccatttgggggaaagtttcaggctatgctcttgcctcaaaattggtggggaaaacacatagacatatacatacacacaaagcaaatacagcaaaatgttcaaaattgttgaatctaagtagtaaatgttaagtgtttattgtactatttttcagctttttgaatatattaaaattttttatactgaaaaaagagaaaaattagccagaagagctttattcaaaataccttcccctctctttccttcacattttgatatattcttgttggggaggtgtatcaggatattaactgtatcttttgatacgaaaaaaagtcacatgattctggtatatttcaaccactgctagaaaatccacatggataaatgctagaatgagggctaggactttttctagtttgtccattactgcatctagtatattttcaaggaaaaaatgttcaatgaataaatgaaaaatagctaccctagatgtttaataaaaaagacatctgcacttgtatgtttactgtggcacaattcacagtcgcaaagatatggaattaacctaagtgctcatctacagatgagtggataaagaaaatgtgttatatctatatcatggaatactactcagccataaaaagtaacatcttttgtagcaacttggatggaactggaggccattatcctaagtgaagtaactcaggaaaggaaaaccaaatactgcatgtttttacttataagtgggagctaagctacggatatgcaaaggcatgcagagtggtataatggacattggagactcagaatggggatgtgggactgaaaaaatcacctactgggtacactattcgggtgatgggtacactagcagcccagcttcactattatacaacttgcccatgcaaccaaaaaccactagtatccctaaagctattgaaaaaaaaaaaaaaaacttagtaagcctcctagactttataatctcaagacacgactttttaacataaattctgaacattatctggaaaaactgttgactggaatacgtttgtttggtattttttcaaggatagaatgatgttttgataatcagacttctcctttacttgtcacttagtaaccttctatactaaaaaaatttagtcattgaagtgtaacatgtattcaactgaagctagttgaattctcacgtttctcacactccccttgagctggcatcaaagattaacttaaaaggtcatgaaggaattcaaattcaaggaattcaaatttccagcatgcccatcttgacactttgaaataaatataaacacatcctgatgtcacttcattacagcattcccttcccaaggagctctaaaaagaaaataacctgcaggtgaatttttgacatgcaagtcttgaagataaaacaatatagcattcttccagatcagttatatgctttaaaagcattatttctccctgaataaaaatgaatccaaaggctgtgattcctaagaacaactgaagttaaagctaaatgttctcaaaacaattttacatagctcattctaaatgttctttaccaacttttaaataagaatgacaaataagagacagtcaaatgtttttatggatcttctgaataaactacgtaaagataaaaaatacatgtaagtataaaatacaatttgtaaatgagggccgggattagcaatgccaggatggataaagacatgttttctcgcatttaggtaactttgtcccctatgagatgaccctcagaagttgtctcgacgtttgctcagcagtgatttgattcaatgaccaatattcaaacagcactcccttagagactctacgcatgacctctgactgcttggtgcctaactctccacatatgtcaaacagagggaagaataattgctagctacctcccagcaattctagaagatttaatgaggcagggagccagacctccatggtgagtcaattattccctgggtagaagttatgttatttgtgaggtgccgtatttctaaggataacagagtattgtacaagcattacaaataggtatttctcgattcctcaaagtgttgacattaaatctttcagaataatatactcacctagtaacaaatagtctaatattttataaaacagtttgaatttgatggaatgaaagcatacggattttataatgttgtttcttttctgattattagtgagagagaacaatcttttaggacaaatgggtttaaaggaatagacagataagggagaagctctctaactgaatccagacctattaaaatggcgaccaggtaccatgacctatgtatttcattgagctggggccaagtccagagtccactaatttcagcttgctcaagtcaaggctaggatgctgccgtgatagaaaagatatggaactgctgaagaaatgtaattcaattcttataaagaaatggggcccaatattaacttacatgattaatataacacacataaataaaggcagtaacaaacacttaattttggattagtgatgtcacaggatctttaaatagttcatacaggatggtcatgctctcataagttaaaatggagaaaattgattttttacaccagattagccacacaatattaatcatataaaatgtttccctgaaagtcttggcataaaaatgggccaatgtgctctgttttgcctttttccccaaagtaaatttagatgggggtgaggagggaaaactttagaaagcaatcacaaatttcaaaatcaataaattcaaattgtttttaaggcagtaaatacatagtcctgccaaatgctgcaggaaattgatgtacaatctgtctggcagttggaccatgtgaaaaaattttaaaaagaccttaaaataaccaagattctgaaggctcaacaaactttgttttagtaagacaattttcctggtccataaaaaagataaggaagtaaaaggtgggataaccaatttaacttagggtgtggtgaattatcttgggtatcttaaattggtacttaatttggtctgggctcagaagaaatggtttaccatggtgattaagaccagctgctaggtgtcatagatttaaattatacaacagaacacaggagtgtgtttgaacacagacgggtaggacagtctccaaaaagctaagagtgccacctctgttcagtgaaaattaagtcagttttttactaccctttaagagctgcctccactgatttggccttgaacatagactgaatgagaagatttagtttcccaacacatgtgccaccatgacttaaagacttaatactaagtctttaagtattaaagacttaatactaagtccactaagtagacttagactaaagtccactttagtctaagtcccacaatttttcagaaagaccaggaggccatttaaacaaagaaaataatttctttcctacaaaaatcaggggaaatactaacctttgtcattcaaaatagttttagtttgataccaaagtatccttattaacactttgagcagggacaccaacatattttattttattgttcacttagaagttataaaagtagtctacattaaatgaaaaaattcaaacaataccaatataaaaatgtactaaatagtgtaagttcacttttgactctgaacccccagctaccaaactcaccagggaaaactactgtgatttgttgaagtgaagggagcgaagagtccacattaaattagaatataacagtacaagtttatggactttttacatcaatatatgtactttcaatgtgactaaacgatttcaccatttactatgctttttctttttcaaagtaactataaagacaggtacctttggggaagaaaaaagaaaagaaaaaaagtaaatataaagaaaacactggaactagattttcaatggtgcagttaataaggattagaaaatactatatataatagaaaatataagatttaaaattttaagatcttcttgttatgacaaataatatctatatgcataatacacatatgtacatgtgtatacatacatatacacaaactacatattacagcatacaaaatactgagtaacacaatgaatatgatctttttggatattcttgaaaaaagtaaacttcatcatttgatttatctagaagaattttattggccgggtacggtggctcacgcctgtaatctcagcactttgggaggctgaggtgggccgatcacctgagatcaggagttcaagatcagcctagccaacatggtgaaaccccatctctactaaaaatacaaaaaattagccaggcgtggtggcacacacctataatcccagccacttgggaggctgaggcaggagaatcacttgaacccaggaggcagaggttgcagtgagccgagattgtgccattgcactccagcctgggcaaaatgagggaaactgcgtctcaaaaaaaaaaaatgtatttataaatctaatgctttagtggcagaccaggagacaacccacatacaagtggtcaatttgaattttatctagaaccattactgttgccctgaaagccagattcactttagtcagctaaattttatggagtgtgttttataaacaaagcattgtatgaagctctagaaaatagtcagcagaagacagtccttcttctcaaaggctttccaacacattatcaagaacatacacagtcacaagcaattacaatttgaaagtagcacacagataaagaaattaattaccactggtggggctggagaccgtttaacagaacagataggtttaagctgggtaagatttcaactagcaacacaggaatgaagggtgcttgaaaacagcacagaaaggcacaaggaaatagtacagacaattgtacaagtaaagacaaagaagtaggaggctgccatgtacatgtgaaggataatgaagtggcagggcaagactagagttcgggggcacagagaaggcaggaatagaagatgagcctggagaagtagatgggggcagattttggagcctattagctataaaccaaaaaatttagcatttatattacagaagtagggggccatgaaagtctcaaagtgaatgacatgatcagaataatgatgcatgagttaaaatggaaaagaacagttaggcagagtacgacccatgacaaagctccaaagaagaggtaatgttgcgtagattaaggacagtagcaatgaaaactggataaaggaaacagaccgaaagacacattctgaaggcaagttgacataaggaaaagatcttaggccccaggctaaagatttgaattctggctcctccaactatttgccttttggcgttgggcatgtttcttagctcctttaacatatagtttccttatctataaaacaggaataatgcacttgcctgtgtgtgggggaaaaaaaactgtgagaaaaatacagaaagttgtctagataattcatgtcaacacacttatttattcaacatcatataatgataaaaagaataaaacgtagccccaatctggttggggaaacagacatacaaacaactaaagtgacaatgatctgatgtaactggacctatattaggagtaagatccaacagaaacacagaggataaggtgtgtgtaaagccactaaagaccgtgtaaaagtgctgaaaaggttcaatgaagttccacagaggtgatgtgtgaaccaggctactcacaacttttaatgtttcttattttcacatcaaatcaccaggtccttcaccacataaattatagtacacaaccccctaggacccagtggtatcatttgaattctggagtgtgaaagtccaaaggaaatggtggaggaaaaaaggggaggtgaggggagaggaagaaagattagaggagtatgaatgaattttaggcaaataacttctcaggaaacaatacttgaaagaaagccagataatacttagattctcagtgtgatacaatattaaggcagcaaaactcaaatgaaagaatgtaatgagttccaggtgtcgtttagtagatttttttcagtaggtgaagttgagttgaggtggctactgtcagtgtcaatgccctgtctgaacaagttttaatttaacttcaagcaatacataggcttttgtttagactgtttgcatatatttgtctactgctgctaagaggcaaaataacctctttctcgagaaagtgagataaaactatgattgcaaaaatgtttattttttaatcttttcatgaatcaagtaattttatctaatttattcaacaaatatttattgaatagttactgtgcataaggcccagtggggaatatgagagaatataatatgatatagattttatcaccaagaaggtctgagtctcataagttcactataaagtagaaggtaataaattcaatgagaagtatacagataaagtgccacacagtataaaggaaggagattactttgagctgggaggataaggatttggcactggcactaggacagaggggactatgttgtgttactcatgcaacaaacatttactgagcacatacaatgtgcatgcacttacctaaatgcaatgagactttgaggtgatttagtccaattccttcacttaattcactagaaaatgaaaactcggaaacctaaatagctaattcaaggccaagatacaatttgaattgatatctccagtctgcaagtccaataatttctactacttaccctgtcacctccaaaactcagtctaaattttttgtcaggtacaatcattatttcaaaaggcattccattccacttataaattaatttgttataaaatgtgttttctaacatttagttaaaagttgccttcatttttaactaaaaatgaagtggctctagtggctccccctgtagttacacagaacaaatagaatcctgtggccatgtgatcatccttcacatatatgaagacaatcctcacgtcccccactctagtaggcactcagtaatcactatagttggggaataagctccggaattagatgggcctggatgtgaatctcagcttcaacattcacttggtgtgtgatcatgagccaagttacttaatttagataatctgtgtgtttatttagacaatgggaatgtttatgtccttcatgccttccattcaacgtaatggccaataactatgatcaagaattggcacaacttttggtgtaactgtcagaacactagagtttctctatacacattaagctggcactgaatcataagaggaaaagttgcaaaactgaaaaagatggcagcacctgtctttctctcccacttctcttcctctctggcataactagtctgtgagtgacagctgtgaaatactaaagactgggcgacatggcttttccagataacctgtgaagaatggtgaagcatggcttcatcaaatgacctgtgctaatagagctgctggcaaaagtgcagtcattttattgagataaaacattgaaaataattttcataaaataaggcacagatgctttaattagaaaaaaatgtccttgagggtgggattcagatgcagttttataacttgtacggtgccttaaatgcattaaaagatagacaatggtacaaggactattctccctagtggtaacaaaactgtttcctagttactagggtagggtagggaggaaatgaaaggaagaagagaaaatctagagtttattcttttcctgcttctaatgttataagccaatgctaatgtttagtagtcacaacctcgtctgctaggcactgcaactaatttcccgtatttgggtagaaaaaaatgcatcatgtctcaaagaatgaactactgacagaaatttagtgactgatactaaaggtagatacgtagctgcagggtatgagaaagaggagacacagtcctaaaaataacagcaaaactaagatgaaaatgcagagaagtggtatggtacattggtagctatcccctaatatctattctacctttcttccatagaaatatcgttttagccaggcatacagtcattcggaataaaagcaacactttcggtctctattgcaactacatgtagccctatgaccaagtactgacccgcattatatggacgtttctgggcacctttctcaaaagatggctggggcatgcccatttcacccctttctccaaccagctgcctgaagtggagatgcctccacctttgaccatgaaactgagagcctcaccctaggcatggtgagtggtgagctggaaggagtggggctctcgatgcagaaactgatttttccatttttgttaaacaatgctgtcaaaaaggccctaaaaactatcttttgcacatatctatttccttagattacattcctagaagtgagtgagaggatatgaaaacataatctgtcatggaactagagttaaaaaaaaaaagaatatgaaaacattctaaagctcccaacacatatggtgaaattgttcttctgaaagtttaaatttacatgttctctacatgccttcccagcccaatgtcaggagttaattttatcattaattggtaagagctctcttatattaagggtgtgaataccatgttataaatacctcttcccaattaatttacctttcaatttagttactatttttgttgttgtgcagtaacttaaaatctttatgtaataaacctttttaaaaagtggtttctgcccttactattatatagtaaaaagtcttcccacgtatcaagattatgtacatatccacctatattttttctattacctttttgctttcacttaacctttaatccacatgaaatttatttttccacacatttagccgattgtaccaacaccaagattccacacattcaataatagatgctattgaatataactattcctaataactgaaaattccacttttatttattctgatatcttgaattagtattattagactgttttaattattgtggctttagaaaaaaattttatactcacttatgcaattaattcacattatttcttttttttacaaaagtgtgtttggtttacacctctaagtgaactttagaaacacattgtcaggtttggcaaaaagaaaaaaacacctgaaattttaactggaattgtattaatgatcaatagagagcaattggggtagggaatgcataactttaaaacattaactctccccattattcccacaaatatgagatgtttccccatttcttaaactgtttttatgtcccttatgttctatagtttatttcttatagttagtcgtagagtttacttgcttaaacttgaggcaagtttccttagttacagatcttttatttatatttgtgctattataagtaggatctttaaacacatacttgtctgtgctggtatagaggaaacactaatttctgaatttattttgtaattgaccatcatcttactggtatgtttttaataatgctcataagtgttagttgattatcttgggttttctagttagataactgtattttcaatttcaaataatgatgacacttctcacttcctttgcaatatttaaacttcattttcttgtcttattgcattagacaaaactttcaaaacaatattaaataatagaggtaatagctgacactcttttttccacccctgactttacttcttaggacattttcctattttaacccataaaacagctgcatcgtatcagtctttcatctgtttttacactggtcccaacccccaatccctaactatactgtaagttccttgaaggcaaaaactgtgttttgctaattttttaaatcactgtagcatccagcacagtgtctggcacagagaaaataaatcattaaacggatggttctcaaaactggtgagtcactggaattacatgggagcctttgaaaaaaaccaactgcaagtttcacaaaccatttacaagtcagaaattccctgttcgtgggggtgcgaatctagacgtgtcaaaagcttcttagatgatttctgacggcccacaggtttgagaaccactagtctagtatttttatcactcccggagattctgtttcagagtcaggggcctgatttttagtaaatcttcctgagatgattcagatagaagcaggtttggaaactactgggttagacagtaattcaaagaagggatcagagttttatttttttcctttatgttgtctgtatatttttcacatacaaaagtggaaaagatagcaagatatataaagaaaaggccaatctctcctacctctatcttctaaaagtagccatttattactgtgtagtggcatccttccatccctcttttcttgcttacacaaaataaacacgagagagagagagagagagagagagagagagagagagacagagagagagagagaagtactctttctgtttttattaaaacaatcagacacttattttgtaatttggtagtatttaaaaaaatgttatttcaaataaatgatgatgaaaccaatatctgttctcttgtctatatagatttaaatttagcgatgagtataaaaacattttcatttcatttttaattctttagcaggtataggaacaatttgggaagattcacctaggaaattttttttttttttgcgggggtggggcagggacgaagtctcactctgtagcccaagttagagtgcagtggcacgatctcagctcactgcaacctccacctcccgggttcaagcaattctcctgcctcagcctcctgagtagctggaattacaagcgtgtgccactgcacccggctaatttttatagtagagatggggtttcaccatgttggccaggctggtcttgaacgcccaacctcatcacctaggaaattctaaaactatcagttaatatactaaaggatatgggttcataggtcaaacagcatcttaaaaaccaggaggacagtattaatacaggaaggctaaaaatggcatataaagccttcttttctatacttataataaagtaattaaaagctacaaaaagaaaaccttttatgttacttatgcttagctattactcattttttagataaaagatatttttaatacaaaagcaaaactaaggcacaactgatctccacttacatgctttaacaaaacataaaaggcagcactcaaatgtacaccagaaataaaaattctaaaatagaactactaataaaaggaatgtaaattactggctaagacagaaacatcatattttagaagactaagccatgattttggtgaaatcagtacatcattcgtttgttattattaaattttcataaagcatctccaaaaagctcaatgacacacactaataattgttaaataatgcaaatgaatacttctaaattctccagtactgtaaattagcagacagtgtgggagttgcagagaacaatgagagagagaagtaaaaacaaagcaagcagtaatatgatatcttaaattaagttgcaatttctgatttactccaaaaggatctttctgggcaggcaggatttaaagagttttaagaaatgatgtctttctgcctgtcaggagtgtgttagaagtatatttaattctgtgaagttggaataggaaagagaacatgggggagaactaagttaatctagaagaggtgtgaaattggagaaaggcctaaaaatcaaatgcaaatatgctgaagatagtaataattttaaaaaggaaatagtttaaagaaagggaacaacattcagtgtggtaaagaagtggtattaaaaatagtgttttgtatttttttttggcaggaatggaatggattttatggttagataaatcaagaagacctacaatggcagttaagatttgaaattgctagatatttggcaagagaactgataaaaagagaggggagtaattatcaggtgtcacccacaccctgaaggctgcacccactcttatcctctaattcctttgacccagagtaacacttctccctcttcctgtccagatgtggtttctctactagtgctctaggtcccatcccctcctctttccttaggaacttcattccattgactatcttcagtcaatcctccaattcctgccattagctctttcagcatataaaaatcatcaagtatgccaggcatggtggctcacacctgtaatcccagcactttgggaggccaaggcgggaggattgcctgagcccaggagtttgagaccggcctgggtaacatagtgagacccaactctacatttttttttttttaatttgccaggcatggtagtgtgcacctgtagtcccagctacttgggaggatgaggcaggagaattgcttgagcccaggaggtcgaagctgcagtgaactgtgtctgtgccactgcatttccatcctgggcaatagagcaagaccctgtctcaaaaaaaaaaaaaaaaatcatcaagcgtttcatatctaaaagcaatataaaataaaataaaaagtttctttaatcttatgttctcctttaactattatatctcttcttttcacaagcaacttctaggaagaagtctacttcttccctccttgattcacttcccgctctgaagcagtctggctttaggcgtcaccatctcatggaggctgcttcacttaaaagcaacattgatctccttaacaccttatccaatcttcgggttttagctctcctatgattcgatcttgctgaagctttttacacattcatttcctctttcttgaaatgttctcctccctcagtatctaagatgtcacattcctttctctgttgttgctccacagggacccatctcagtctaatattattctccctctatactgatgacttgaactataccaattaaaagatgactcacaatccagaaatctctagcccagatctctgtggaactccaattctggttatgtctaagaagcatctctttctgaatgtctgatggtacttatataaccaaaatgaattcatcatattccaccttaaaaagtcactattccttaaattgaatggatccaccaacccctcttctctccttcacctagttattcaggtaatctgggacttatctgagatcttccttttctcttacttcccagatctaatcactaaggactagagattctctcaaaactgtcccctaatatcaatttcattgcttttgttcatttctcatttggactatgtcatattgcaacaatccccttaatgatttctctacttccaatctcaattttttgcaattctgtttcaagaggtcagcttgctgtaatttttcaatggctttcagttatccataagcccaactcccaacctccttgtaaggtataaacgctgctgcctactctccagcctcatttctaccactttccaactcaatttcatgctctagcaacactgaacatgctttcttatggctagtccttctgtaaatactgcagcaccattttttccacttgtctatctggtacattcttactcattcttaggtatctgtttaaatgctaacttctctaacagcatcccttttctctcaggtgaactttggtgttccttatatattcctaactgtagttttgaagactcttccattaaacaatgatcttattgcattataattgtttgcatgggcatcttaacttcttaactggcttagattagggaattaaaatagacattggctgggcacagtggctcacacctgtaatcccagcactttgggaggctaaggtgggtggatcacttaagaccaggagttcaaggctgcagtgagctataatggtgccactgcacactagtctaggtgacagagtgagaccctgtctcaaaaaaaaaaaaaaaaaaaaaaaaaagagagagagagattatgaaaacatttactgggagacctaacccattttttgcttcaggaaaccaatcttaaacagtgccaagaaaggcaagccaaagacagtggatgaagacagtggtggtgatgctggaaaagcccaggcaaactgaagcacagctactgtggaagagagaacagcaggaaaaaactggagagacaccaggagcccaactgtgaagggactgctaagagaaggttcagctttgtgcttccagtcactgattcaaactttcttcatgaatccaaccactaaattaaacaccagctttctaaaagctgcacattctcatactataaaagaaaatatatttcaaataaaatactttccaggctttccagaagaaaaaatccatcccatgtcacccactgtgactaagcacggaggaaacagattaaattagggatattttgcccgtacatctccaggctgcatgaaatgaaaacaaatgagagtcaggactctcaaaagtttcacagttctaaccatcaacgcaatgtgccaagcaacatagtaaatgttcacgtttcaaacaggaggaatacattttaccttttctatctgggatagaagattagattctaatcttttttggttttccactcagatgagcaccttaagtgggatcatatttctatattacaggtacttttttttttcctgaaagtctgtgaatacttaattcaaaggccatggacagcaacctagaggagctctgaccatgaaaaatgttttataaatagttccatgtgcactgttcatctggagtctcactagagatggataatgaccttgtattttgtactcatttactctgaattagccaaaccttctgtttttaattacatacttaattcacctagcatggtctaattacataaaacaaaacatcatttaaacaaaaggtggccttgaacttaatctatcaaaacaccagttagtttttaaagtttttagttcttaacaaactgccaagacatgcaatagcaattttccaaatgtgatcatatgcttttatagcaacagatttactacataatcaaacatctgtatatacttttgtctcactattaatgcaaatatgcttaagttttgatagacttaaaaatcttaaagctgaagttcatactacacaataatttttaaatatccatagtcattttggccttgaaatgacaagttatcataaccatggctacttatttacaaaatggtccagaactttgtaaaaactcatgttcagaattttccttaattcttcacagtgtaaattagtagcccttctctgtgttatcatagcaccttatatattttcaatcacagtatttataatgctgaatagttattggtttaaagatctgacccccaactagattgcaaacttcatgaaagcagagtttatgccttttatctctatcttgccaacatggagcacagtgcctagcacagagcaggtcctcaatatatatttgctgaattaatgtattaaaatacaatgttgtaaaactatctcaatttatgaatatgatcttatatgtagaaaatcataaggaattcaccaaaaaattattagaactaataaacaagttccaaaaggttgcaggatacaagatcaatatataaatatcaattgtatttctatgcagcagcaatgagcaaacaaaaatgaaattaagaaaaccaattccatttacaatcaaaaccgttaaaatattttgtaataaatttaacaaaagaaatatacaacctatactctgaaaaccataatcctcaaattgatctacagaatctagagatccaatgcaatccctatggaatcccagctgacttctttgcagaaattgacaagctaaacctaaaattcatatggaaattaaaggaattcaaaatagtaaaagcatataatggaatcctattcggccttaaaaaaggaacaaaatttgtcacactacaatattgatgaaccttgaggatattatgctaagtagaataaaccagtcacaaaagataatactgtattactccatttatatgaggtatctaaaatggttaaattcatagaaacagaaagtataatggtggttgccaggggctgatgggaaaggggagctgttatttagtgggtttaaagtttcagatttgtaagatgaaaaagttctggagatctgtctcataacaatgtgaatatacttactatttaactgtacacttaaaaatgatgaaaatggcaaattttatggttttttttaaccaaaataaaaaaaatttttaaagccaaaacagtcttgaaaaagaacaaagttggtggacacacacttttcaacttcaaaacttactacggagctacagcaatcaagacagtgtggtagtggcatgaagatagacatatagatcagtggaacacaattgagggtccaaaaataaatcttcatatttagagtcaattgattttctagcagggtaccaagataactcaatgagggaaagaataatcttcaacaaatggtgttggaacaactgaatattgacatgcaacagaacaaagttacttctatctaacaccatatacaaatattaactcaaaatagatcaaagacctatatgtaacagctaaaactataagactcttggacgaacatgtaagtgtaaagctttgtgacctggagctacacaataattttcttagctatgataccaaaagcactagtaaaaaaaaagaaaaaaggaaactggactttatcaaaatttaaaaatgtgcttcaaaggacaccatcaagacagtgaaaatacagcccacagaatgggagaaaatagttgcaaataaaatatctgataaggaacttgtatgtagagtatatacagagctcttacaactcaataataaaaagactaataaccaatttaaaaatgagcaaagggtctgaatagacatttctccaaagacaatgtgcaaatggacaataagcacacaaaaagatgctcaacatcatcagctattaggtaaatgcaaatcaaaaccagaacgagataccacttcatactcactaggatgactataatcaagaagatagacaatagcaagtgttgcgaggatgtagagaaattggaaccctcatacactgctgacaggaatgtaaaatggtgcagtcactttgaaaaacaacctgacagttcctcaacagagcatttccatattattcagcaattcttctcctaggtatactcaagaaaaaggaaaacgatgtccacacaaaaacttgtacaaaattgttcacaacagcattattcataatagtgaaaggaataaagtgttatctgcacttcatccttacacggcctcatagtattccatattatgtatgaacacaccacattttgtttatctgttcatcaattgatggatatctgggttgtttctacctttttttttttaaaagctattatgaataatgctgcaaacttttctgtctttaaatcctgacatgaagatctgggctgaggcaggggtagaggggtagagaaaatgcctatcatcaagttcttccctatgtctatggcctagatggggtgggtgtcggatggtgctgaggcaggaagaggagaggagaactctcagtaagttgctaatgagaagagatcccagaagctagttcctgtgttccattctgcagtaacatgtcctctctaccatgagtgatacaataggagaatgggtgaacactcccactgtggtagatcctaagcaaagcatgacatggccctgccctccaagaaattttgtccataagataagtcactatttcatgttactgtaataatttttgtcattatctggagcaaaaaggaggatcttttgcaacaaaagagtttatgaacctaaattgctcttgtcaagatcaccaatgacctccttgttgctaaatatccaatagtaaattataagtcctcatctttcttgggcattaacaaaatctgaaccagctgatccctctttttagaacactttcttctcttggcttccagaatatcacactctactagttattttcctacttcgctgatttgttccttatctgtcccctttgctgattcctcgtcttctccccaatctctcaatgttagagtgccctggggatcagtccttaaaccatgcagtgagctgaataatggtcccttgagataccatgtcctaatccctagaatctctgaatgttacctcatatggcaaagactttgcaaatgtgattaaattaagtctcttatgatcctaagaatggggagataattctgaataacttggatgggccctaaatgcaatcataaatgttcttttaagagggcaggataggaattcaaacagaaaaagacaaccttggaagcagaatcagagggaaaagatgctacactgctggctttgaaaatggagaaaagggctatgaaccaaggaatgcaaggaatacagatctagatactaaaaagggcaagaaactctagattctcccttaacagtctccagagcaagtgtggccctgctgaaaccctgatttagccccataagacttagtttggatttctggtccacataactataaaagaataaatttctgttgttttaagccaccaagtaagtctgtcataatttgttatagcagccataggaaactaatacagattttggagcctggaagtggggtggtacaaaaacaaaaacctaaaactatgaaagtggctttggacttgacagtaggcagaggctagaaggagtgggaggtgcatgatagaaaatactcagattgcctaaaacagatttttggtagaaatttgaacattaaaggcactgctggtaacagctcagaagaaagtgaggagcatggtagagaaatcctaattcatcttggagaacacatatatcatcataagcagaatgttggtagaaatataaacacagtaaagatggtactggtgagggctcagaaggagatgagcaacattttattagaaactgtaggaaaggagatttgtcatatagtggcagaaagcttagctgatgtgtgtcctacaattatatacaatgatgaacttagatttagatgatttggatgagatcttggacttttgagctgattatatttaggtgagattttgggttgaaactgaaatgggttgaggcttctggagatactgggatggggtgaatattttgcatgtgagatagatgtaaatccttggagacaagagggcagactgtggtaagctcctcaagatattcatgccctgatgcctggaacctgaaaatgctacctcatatggcaaagactttgcaagtgtgattaacttaagcatcttgagatatggagattatcttggattatctcagtgggccctcaatacagtcacaagtgtccttagaagaggggaggcagagaggttttacacaaaagaaaaaggtcatgtgaccaaaaaaaaagaaaacaaaaagaaacagataagagagaaaagatgctatatcactggctttgaaaatggaaaaagaaggctggtgtggtggcttttacctgtaatcccagcactttgggaggccgaggcaggtggatcatccgaggtcaggggtttgagaccagcctggccaacttggtgaaaccccatctctactattttttttatactttaagttctagggtacatgtgcacaacgtgcaggtttgttacataggtatacatgtgccatgttggtttgctgctcccattaacttgtcatttacattaggtatttctcctaatgctatctctacccctgccccctaccccatgacaggcccccatgtgtgatgttccccgccctgtgtccaagtgttctcactgttcaattccaacctatggtggtttttgttgccactgcttttggtgctttagtcataacctatgagtgagaacatgtggtgtttgattttccgtccttgtgacagtttgctcagaatgatggtttccagcttcatccatgtccctacaaaggacatgaactcatcccttttttatggctgcatagtattccatggtgtatacgtgccacatctttgtaatccagtctatcagtgatggacgtttgggttggttccaagcttttgctattgtgaatagtgccacaataaacatacgtgtacatgtgtctttatagtagcatgatttataatcctttgggtatatatccagtaatgggatctctgggtcaaatggtatttctagttctagatccttgaggaatcgccacactgtcttccacaatggttgaactagtttacactcccagcaacagtgtaaaagcgttcctatttctctacatcctctccagcatctgttgtttcctgactttttaatgatcgccattctaaccggcatgagatggtatctcattgtggctttgatttgcgtttctctaatgaccagcaatgatgagtattttttcatgtgtctgctggctgcataaatgtcttcttttgagaagtgtctgttcatatcctttgcccactttttgatggttttttttttcttgtcaatttgtttaagttctttgcagattctgggtatcagccctttgtcagatgggtagattgtaaaaattttcttccactctgtagattgcctgttcactctgatagtattttcttttgctgtgcagaagctctttaatttaattagatcccatttgtctattttggtttttgttgccattgcttttggtgttttagtcataaagttcttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctagccagttttcctagcaccatttattaaatagggaatcctttcccgatttcttgttttcatcaggtttgccaaagatcagatggttgtagatgtgtgttgttatttctgaggcctctgttctgttccattggtctatttctctgttttggtactggtaccatgctgtttcagttactgtagccttgtagtatagtttgaagtcaggtagcgtgatgcctccagctttgttctttttgcttaggattgtattgcctatgcaggcttttttttggttccatatgaaccttaaggtagttttttccaattctgtgaagaaaggcattggtagcttgacggcgatggcattgaatctataaattactttgagcagtatggccattttcacaatattgatgcctcctatccatgagcaaggaatgttcttccatttgtttgtgtcctcttttatttcgttgagcagtggtttgtaattctccttgaaaaggtccttcatatcccttgtaagttggattcctaggtattttattctcttagtagcaattgtgaatgggagttcactcatgatttggctctctgtttgtctgttattggtgtataggaatgcttgtgatttttgcacattgattttgtatcctgagattttgctgaagttgcttatcagcttaaggagattttgggctgagacaatggggttttctaaatatacaatcatgtcgtctgcaaacagggacaatttgacttcctcttttcctacttgaataccctttatttctttctcttgcctgattgccctgaccagaacttccaacactatgttgaataggagtggtaagagagggcatccctgtcttgtgcaagttttcaaagggaatgcttccagtttttgcccattcagtatgatattggctgtaggtttgtcataaatagcttattattttgagatacgtcccatcaatacctagtttattgagagtttttagcatgaagcgctgttgaactttgtcaaacgccttttctgcatctattgagataatcatgtggtttttgtcattgattctgtttatatactggattacgtttattgatttgcatatgttgaaccagccttgcatcccagggatgaagctgacttgatcatggtggataagctttttgatgtgttgctggattcggtttcccagtattttattgagaattttcgcattgatgttcataaggaatattggtctaaaattctctttttttgtgtgtctctgccaggctttggtatcaggatgatgctggcctcataaaattagttacggagaattccctctttttctattgattacaatagtttcagaaggaatggtaccagctcttctttgtacctctggtagaattaggctgtgaatctgtctggtcctggactttttttggttggtaggctattaattattgcctcaatttcagagcgtgttattggtctattcagagattcaacttcttcctggttttttggtcttgggagcatgtatgtgtccagtaatttatccatttcttctagattttctagtttgtttgcgtagaggtgtttatagtattctctgatggtagtttgtatttctatgggatcggtggtgatatctcctttatcatttttttactgagtctatttgtttcttctttttcttctttactagtcttgctagcagtctattttattgatcttttcagaaaaaccagcttggggattcactgattttttgaagggttttttgtgtctctatctccttcagttctgctctcatcttagttatttcttgccttctgctagcttttgaatttgtttgctcttgcttctctagttcttttaattgtgatgttagggtgttgattttagatcgttcctgctttctcttgtgggcatttagtgctataaatttccctctacaaactgctttaaatgtgccccagagaatctggtacgttgtgtctttgttctcattggtttcaaagaacatctttatttctgccttcatttcgttatgtacccagtactcattcaggagcaggttgttccgtttctgtgtagttgtgcagttttgagtgagtttcttaatcctgagttctagtctgattgcactgtggtctgagagacagtttgttgtgatttctgttcttttacatttgctgaggaatggtttacttccaactatgtggtcaattttggaataagtgtgatgtggtgctgagaagaatgtatattctgttgatttgggatggagagttctgtagatgtctattaggtctgcttggtgcagagctgagttcaagtcctggatatcctgtcttgttgatctaatattgacagtggggtgctaaagtctcccattattactgtgtgggagtctaagtctctttgtaggtctctaaggacttgctttatgaatctaggtgcccctgcattgggtggtacatacatatttaggatagttagctcttcttgttgaattgatccctttaccattatgtaatggccttctttgtctcttttgatctttgttggtttaaagtctgttttatcagagactaggattgcaacccctgcttttttttgctttccatttgcttggtagatcttcctccatccttttattttgagcctatgtgtgtctctgcatgtgagatgggtctcctgaatacagcacattgatgggtcttgacgctttatccaatttgctagtctgtgtcttttaattggggcatttagcccatttacatttaaggttactattgttacgtgtgaatttgatcctgtcattatgatgttagctggtcattttgcccgttagttgatgcagtttcttcctagcattgacagtctttacaatttggcatgtttttgcagtggctggtaccagttgttcctttccatgtttagtgctttctttaggagctcttgtaaggcaggcctggtggtgacaaaatctctcagcatttgcttgtttgtaatggattttatttctccttcacttatgaagcttagtttggctagataggaaattctgggttgaaaattcatttctttaagaatgttgaatactggcccccactgtctactggcttgtagagtttctgcccagagttccactgttggtctgatgggcttccctttgtgggtaactcgatctttctctctggctgccctgaatattttttccttcatttcaaccttggtgaatctgacaattatgtgtcttggggttgctcctcttgaggaatatctttgtggtgttctctatatttcctgaatttgaatgttggtccaccttgctaggttggggaagttctcctggataatatcctgaaaagtgttttccaatttggttccattctccccatcactttcaggcacaccaatcaaatgtagatttggtcttttcacatagtcccatgtttcttggaggttttgttcatttatttttactcttttttctctaaccttgtcctctcactttatttcattaatttgatcttcagtcactgataccctttcttccacttgatcgaataggctattgaagcttgtgcatgtgtcacgtagttctcctgccatggttttcagttccatcaggtcatttaaggtcttctctacatgtttattctagttagccattagtctaatcttttttcaacgcttttagcttccttgcaatgggttcgaacatcctcctttagctcagagaagtttgttattaccaaccttctgaagcctacttctgtcagctcatcaaagtcattctctgtccagttttgttccattgctggtgaggagctgccatccttttggggagaagaggtgctcttgtttttaggattttcagctttctgctctggtttctccttatctttgtggtttttatctaccttttgtctttgatgctggtgacctaccgatggggttttggtgtagatgacctttatgttgatgttgatgctattcctttctgtttgttagttttccttctaagaatcaggtccctcagctgcaggtctgttggagtctgctggaggaccactccagactctgtttgcctgggtatcaccagtggaggctgcagaacagcaaatattgctgcctgatccttcctctagaagcttcatcccagaggggcatctggctgtgtgaggtgtcagttggcccctactgggaggtgtctcccagttaggctacacaggggtcagggacccacttgaggaggcagtctgtctgttctcagagctcgaacaccatgctgggagaaccactactctcttcagagctgtcagacaaggacgtttaagtctgcagaagtttctgctgccttttgttcagctatgccctgcccccagaggtggggtctatagagtcagcaggccttgcagagctgcagtgggctccacccagtttgagcttcccaggctgctttgtttacctactcaagcctcagcaatggcggatgcccctccccctgccaggttgctgccttgcaggttgatctcagactgctgcactagcagtgagcaaggctccgtgggcatgagacccgccaagccaggcatgggatataatctcctggtgtgccttctgctaagaccactggaaaatcacagtatttaggtggaggcatcccgtttttccaggtacagtctgtcacggcttcccttggctaggaaagggaaatcccctgaccccttgtgcttcctgggtgaggtgatgccctgccctgcttcagcttgccctccgtgggctgcacccactgtccaaccagtcccagtgagatgaaccaggtacctcaattggaaatgcagaaatcaccgtcttctgcgtcaatcacactgggagctgcagaccggagctgttcctatttggccatcttggaatggaatccatgtctctactaataataaaattagccaggtgaagtggcagatgcccataatcccagctacttgggaggctgaggcaagagaactgcttgaacccaggaggcagaggttgcagtgagctgagattgcaccacactgcactccagcctaggcgacagagcaagactccatcaaaagaaaaaaaaaagaaagaaaatggagaaagaaccaaagactcaacgaatgcagctccagatactgaaaagtaaaagagattctctgctagagtatttggagggattgtagccctgctgatagcatgatttagcctcataacacttagttcaaatttccccagagaaggtgtggccctgctacaactcaggtttagccccgttaagatttagtttggattcctggctccagaactgtaaaacaacacatttctactgttttaagccactcaatttgtggtaatttgttacagcagccatgggaaatgaatacagaccccttcccttctctacatatactcatttctttgttacagcagccatgggaaatgaatacagaccccttttcttctctatatatactcatttctttggagagtcctttgaagatcccattcagtctcatggttttaaataccatctatatactgattaccacaaattccagcctagaactctcccttgaactcccaatttggacacacaatcgtatatttggtatgcccacctggatgcagaagaacttcccagccaacaagttccacccacagtcttccccagttcagttataggcaacaccatcctggctgttcaaacaaaaaaccttggaattatcccggatctttcattctcatattcagtcagttatacaattttgttgcctatatattaaaaagttatcaggaacctgaccagttcttactgtctctggtgctctttgcccggatgactgcttctacccttgccccactcaatcaattctgaaatgtggtcagagtaaactttttaaagtcagtcagttagagatcaagttatttctctatggctacatatttcttttagaacaaatgcccaaatctttacaataccttcagaagcctaccatctggtgcaccctaccacttccctatcctgctctccaacttcatcttcttatgttctggccctcactcattcagctgcccaaaatcaatgtatcactttagtgttcccccaacacaccaaaggaagcttccacttcagagtctttgctggtccctctacttggaatgttcttccttcagatatccggatggctcactccctgcttggtcctttacctccttcaagtctttattcaattgtcactttctcaatgaagccttctccaaccattctactcaatattgcaagccctttaccccaacaccggcctcattaccttacgtggttcttttttctctccaaagtacttatcgtcttttagcaaactgtatactttactaatttattatggttattgactgttttctccattacagtatatgctttgtgaaggtagagatttttgtctggtttatttgttgctatatcatgaatatctagaacagtgccaggcatgtattacatataactgatttctagtatataggaagtagactgcactaccctagtatttaaggtcctgatgaatccattacaaatattttatttcagacttcaagtttttatctatactgcttcaggaaacactttatgttaactattatcataggtggcaaattcctaagttacagcaatattacagtcaccctgctgtaataatcacctatctactagaaaggtagaaggaatagttgtggctcatattgtatgattctacttacacaaaatgtcaagacaggcaaatccacagagacaagaagtagaccagtggctgcctaggactagaaaaagaaaagggtgttgggaggaaatgggaagtgactactagtgggtacagggtttctttttgggataatgatgaaaatattctgaaatggattatagtgccagctacaaaactgtatatgtactaaacaaccattgaattacatactttaaatgggtgagttatatggtgtgtgaattatatctcaataaagtttttattaaaaatttttatgtggctgtggctggttatgttttggattgcttaagaaataaaacaattttggggaaaattatgggaaaacaaatttaaaataaagttcttaacaatttaggactaacaattactatcacaatttgacagtaattaattaaagtaagcaaaattattaggattctaaaaactttcaaataaatattttaactgcatagccttgttctatttaatgacacaaaagatttaggaaaggtcaaggtaagaactaatgatgtattcttacataccttataaattgagtaaacaaaaactcagggaaactcatctaaaaaaataaaaaggttttcaaaactcgacccacatttgcccaatcaggtactaactagtctttccccaaccatctttttttttcatctgaaaagtttaatgatctaacctgctagagattcagcatatgatgaaagggagcttgcagaaggcaaaataattatacgaacaaaatatctttccttttcttaacttggacaaaatatatttagacagaattaaatggcagtttcttgggtggttctttaaagttttcctaggcactcttaagattggtataacaatataaattttattatatctttaagcatctcagaaattacacttataatttatgctcataattataaatagatgtgtctatgtaaaatgtacagtgtactcatttaaaaatctagattcacagcattaaaatacttaggctgttttatataaactacaaacaaaaatacaagttttacttagatgactattgtgcagattattaagagactggtaagtttaatgaaaacatcctaatggaattattttattaaggagaattactttgacatttaaatttttacttgaaagaatcctacctagtaatcgaatagctttttaagaacagtgtataaaataaactataccataaacttaagcctagagttcatcacagattaaaacttttaaactttaaactaatcataaattaaagtatacactgaggaataagacatatacagaaagagaagtactatggccaacagctttttaacaagactgtaaataaaccttattttaccaatattaaaggattcacctaccatattctattaaaaattctatttttctactcataagttacctcaataacaaagatgtgaaaatctaatacttttctaaaacttactaacattttatttaaagtataatatctaatgcttattgacatttattcaaatcacttctttttaaataaaaacaagttctctattttgaaattttgtaggactcaatatcaggtattttgttaaatggtaacttagaataaattcaaaagaaaggtttaaaaaagaaaagttctaagcttttaaatgatcctatcaatattggtgtccgggttacacacaactataaatcaaagcagaaactggcaaaataaaagaatgatgttgacatacattattctaatacgtaatggatttctgtaaagaagaattactagagacaatagatgccccttttgttatgctgctattaagtattattgaacagtcacatttagtttaatgcctaatccagaggcatgccacaaatatgcaagtcctatttttgtctatgtctgaagacggttatgtgtgttctttttctccttccaatttcctaatcagttttgcaaatagttacaaaatttttaccaggccaaacagccccctgctccctaccctcacccatatatttgccttcattttcagcccctgtaacatcagagggtttttttttaaaactgtaaataaatcctgactaattatgatttattcacagctgctctcaatgatattatgaactagtatccttttccactattaataatttctataaaatatttaaatgcagtttttttttacaactagaattctcatttgaacaaacaagaaaatgtcatactgaaggtaaatacatcaatttaaaaatttctcttataaataagtatgttttaagtttaataaagtagctagcacagctgggaacaggaaaaatgctgtttgcttcaattttgcaagcatttgatttgattggatggcaaaatcagcttgactgtgttagaccttaaagcctaacggtgacataaaataggtaaaataggataccctgtgagtaaggtgggtgaagtaattgataatacagagatattttgcaagtggctcccttgactgcattactttctaaagggaggtgaaaggcacatagaagtcactgaaaatacttttgttgaacaaacgaacattaaaaactaaaaaggagttttgttagtgtgttattctagaaaaaaatataaaattagaacattaaatattaatttatacttaaaccaagtaatcctaaatcggtctcaaaaaatatgaataataacatattctaacctcaatgtgtataccttattaatattttctcatgttctggaaaattaattaaaacaaaagtggttcttattaaataaatgaataaaatctattgagacaaatgcttattcatattttttgaatttgaatcacttcaaatggaatatctaataattcagtatttacatatcccataactttaaaaatataacaatgtaagatactgaatcttaaacatacaagtagctactacatgttttgcacacctataatttgcatctattaaggattaaaaatattaaatttctttttattctaaaattcaaaaaaagactatattttaaatatagtcatacctaagtattttagaacattttcgcttaaaggagagctaattgatgctaccctaaatacaagaagctaaatatattaagtacatcaatatgaaatggagtatgaactggtatgtttcctgaatgccttctcttacattgttactaattcattttataatttaccatgaattaaaataatagtttcctaaaaatgactcatggaaatatatgggtgtataaataccatccactttctcctggaaatgtattatcaatctgaacacagaacacagaacctgaagagagaagctcaagtgttttaaaaatatttcgcctctcctcagcagctgatttttccatgcttgttttaaatattaatataaaacaggttttccttaaattacaaaataaaggtaactttaaagaaatattcatttaagttagaggttatgtattaaattgttgccagtgatactgttttaatgttttagttacgaaacagaaactgaagtgaaaaaaatcccacttgcataattttttttttaaattttttaattattattacactttaagttttagggtacatgtgcacaatgtgcaggtttgttacatatgtatacatgtgtcatgttggtgtgctgcacccattaactcgtcatttaacattaggtatatctcctaatgctatccctccctcctccccccaccacacaacaggctccggattgtgatgttccccctcctgtgtccatgtgttctcattgttcaattcccacctatgagtgagaacattgcataatgttttaaaacaacctttagcttgtaatctagatgtaatttgtttttaactttcagaacaataaaacaataaatagagactatagtaattgattggtctgaattgttctaagttccttagtatgaattctgtttcacagttaagccttagactcaacttgtttaaggcaaatagacaaagtataaaatattactttggagatacaagataagtataatttttgaagaagtctcagtttagaattttagatgacataaagaattaatacataaacaatatgtgccacatgtgagcagtatgcacttaataaaatatttgtatgaagctaaaaatttcttaccaaaaagttagtaaaaatagacattattattattccttccttgaaaaaacctaaaactaaatctttaagtaaatgatctataagaattcttagtctggtccatgtgattacatggtcctatgtacccagggccactggaaattctgtaagcttagatagcatgaattctgaatgttagacattgctgttcaataaaaaataacttgtattaaaatttcgtattttcactttcatggttttatttccaagtctggttattttcactacaacctgattttccagatcagtggtgtctggtcaatttatctatgggtaaaataattaagtgttcatatgtctatacccaaatgctcctccagagcagcaatttgcttaagttggcagtgcctaccgcttggcatgcaacaaggctgtcacaaaaaaatgtttactgaataaatgatgaatgaaggaaaaaataaactaaaatatttctgtagagaaagaaacatgaaatgctctaaaatgtcagtcatgtcagtaatgtttatttttacagaagaatgctgactgaaagtgtttaactgtcccctgaattgtgagactaaggctcacaacaaagacaaaaataatgtacaagcaccacctatcttgaagacagccaccaaccaaatggggccaaatcgccaaccttgagtttactcagaggttgaatgagccccaccactcccaaatcatcacccagcctacataagagggcaagggtacatcaggagcactggggtgcagtttttgtcataggagcttcctcactcaagccaagttgcacagcaccaagatattacatcaaagacacgttgtggtttcctgcaagaagaggagactggcatctcactttccagctggactgaatactgaataaagaacctgcaaacttgccctggtgctgccagtggagtagaatttagcctgctgaagtgttcatagatgacctggcatatgtccctagaagttggggaaaatatattggcctagaaacttgtctacttcttatctagagatttctgaagatgggaggcttgggtagagcagcctgcagcagcagacctaatagggccacagaaatagtatacctgggtggggcgggggagaagtggagagtacctctcacatttcccctatctacccactaattctctgagaccctagaaaaagaacaccactgactcccatggctcatatgagagaaccaggactggggaagaagcaagggctgctggtcaaacacatcaatgccccatctagagagaggggaggagtttgaacttatgaaacagaaaggagatatagctacccatctctgaggaagagctcagtgataaaggaagccaagataaagctatcatcccaagaaaaccacatattccaaccacatgaacatcatattgtcagagacattttgcagcacttagaaccagattatgccagagtgagacccactatcttcagataaccacgttcactcagatgatgacctctgcctctcttgtccttcctccatgctgcctccttcccctctctctccaagaattagacctaggaggggagaaagcatgccaacagtcttaggccacttaggtggtcttctctaagatgtagggtggggaaggatcaagtgagacttaaatcaaatttgagattaaaatcttaaactacccagacttttactaaatgaaagtgaccaaaaagttgtagcatttgtccaaaggcatagttaagagtcagaaaagggagattagaaagagcatgcttcaaagtatgttttttaaaaaaagtaatttcagatatattgccaatgagttgtaactgtttaaaagttatttacaccctgtggtaggatgaatgctcaaaaaactgctaacaaaaaacttgatagctaaaactattctttaagttcaagcatagactgatacctgcccccacactccccctacctccccacaaaaaaaaaaaacagtgaaatcctactcatggtaaattctcaggtgacagctgtaatcggcctacatttaagcttggttcaatatatccatgggtagatagagccagcctctgctcactgttcctgccccactcaccttacatttgggataccctagaaatccatttttggtaatcatctctcttcaagggtctctctggttgatctcatatacttttttccatgccaaatagtcccaaattcatggttccattctgtactttcaactatctaatagatttatatgtcctccagacactgaaaactctatacatccataacatatcttgttagcttatcctccacacacacccagtctctaaaatctgttcttccctttttctattctttatctcaaacaatagcaaaaccatcaatctaattatctaaatcagaaaccttcttcttcaccctaatcctctatataaaactgatgatcagatccagatgattctaaatgatctaatctagatgatttcttgaatgtagactctcttctctaattccactatctttgccttaatccacttttaacaatttcaacagtctttaatccagttatcctaggtctccagggtctccagttcctctctatgcttcactttgacaccaaaaaacaagtttgataagagttttcccctcataaaaattttttattagctatccattactcataggattacggctaaacctagaagcctcagcttggcagttaaagcctttaccacctaggttactactgcatcatatccaatactagtctgttcagcagacatggttgcctttaggacctgttctctgacccagctgaaatgtgcaaaaaagcattctgtgttgctggctaagccaactcagtctgcaccccgcacctcggcctgctccatgtctgtattcctactttattcgaatgggcttcagttttgctactacccagagtttggattcagtgctatgatttatgcatctcctctttctcttgactgatggctttacttctggctcaggctaacctcttcactaaaggcttagtgatagtatcattgttaaatagtacaaagtaaactcttaagtcagatttcctgggttcaaatttttgctctaccacctacaagctatgagattttgaccactgaacttaatctctccaggcattagtttcttcagtttttttttttattcttgcagcttttatgaaagttttcttttttaaaattttattattattatactttaagttttagggtacatgtgcacaatgtgcaggtttgttacatatgtatacatgtgccatgtttaaaggataataatagtaccttctgtaaaggatctcctgcattgtcaggaaagtgctttaaaaagtactcactacatactaagatctcaatatgtgtcagctgctgtttttcccaatacttattagtttattagccaaaacaaaaggacaggacaccctctgagccataaaattatatatgtagataaacttcacacaccattttcaatataaagactggctacttagaaaaacaatttcagatgctgaagtttccaacttaaaacagcctcctatcatgagtcatagcaaaatgtggcatagttgcccaaattaatagaagcctaatagtttaaatatggcgtcaagaggaaaaaaaagtataaatgaccatagacaaggaagaaattcttacaggtgagagtaactgatatacaatatggaaagacaccacaggttgactaattctggaaaattctttaaaaaatgacaacaaaaaagatgaatttccacatatcgaaagagctgctactaaatgatgactactagacacccaagggttacagatacttaataatcttcttcagttatttgaagaatattttttctagaagaatatacctctaattttataataaaagatggaagatagaatttatttgcagacttgagctataattcactgttccacaaagcaaggggaaattatctgcactttatttctattgtgccttatacagatatgctaaggggaaagtattttaatgttcataatcaaaacaaaaatgattaaatggtcaaaaccaaaagcaacgcaatttcaggaattctgtactatcactgaagttctaatgaattagtatatttcttttcatcaaagaatataggcattaaaatgacaattttagatctttcattagcaaagataatccagaactcgctagtcgttccactggactagttagtacaagaatatggccgataattaactttttatatatttatatatttgtagccttggctattaggtagtttcatttgcattctcaaattaagatagagagttaaaaactaaactgaaggtctgtgagaatgaaacttgatactctaacccaggttactgagccttttataagatgccttaataattaataatactatactgcatatcaaatttcaacatgcaccattactgaattcatgaagaaaaaaaggtctgttgagaaccatgtaaatgtgtcttcaaaataaatcagtaaggtatcttttttccaaaatactttcatctgctatgagaaacaacattagtttgaatgcccctatcactcatttatctccttaaggtctgtctatcgttctggaaaggtgtttcaacaactgatgaacacaattacaaaacaagactactttggttttgaatcaagacaactagattctggatttttaaaaaaagtctattatttactgaaaagtcttccaacatgaagaaaccaacctaatgagggctttctatttttatgaatgagaggtactatggaaaaggctaccaacctaatggcaggaaggaggaaaaggtgtcagcattaattcaagtaggccaacaaatatgataggcccccaaacaatgatgtgcatacttctaactgtggaagatagacatgagaagtatgatggaagtcagttatagaaagatttctgatagtgaactactatgcatactcagaaaacctgaattaagtataaaattacaaaaataattttagatttaaagaaatttcatgacagttcaagtacaaaactattccatcatcaaaacacaacctgatatatgcattactagtttcctcaatcaatttttaaaacttttttgaaatcgaatgctttatttatttcaaaaggtaaacactgttgggctatcagtcttaaattagaagatcataaattacattgtccactctttgatcctaaattccactattggttaacatctcttttgatgtaatcaccccaatagtccccagtgcttactgactaaacatccaaaattgggttatgaatagaaagcccacatagtcaaaataacttccttagacatcaacattagccacaacatatgcttggagtacaatatcttgttttaaaatgtagagtagtcaatttttcaatgtaatcttctaaataaatgacattttaaaaagagcaaactactatgaggagagtttgtgcttcttggagctctttttgtaagtcatttttcttttgccatgtgctttaaacatcttaataaattataacatgttgacaagaaaccacatactgcacctgtgctttctatcttaattaatccaataagtacaggcctgctcacttaaatttgtaagggaaatgatgatataatgagttttaacttaaggtattaattacctaaataagcagaattagcttaatgtttcagtagactttgcctagacacaaccaccaaataaaaatttcagaaattatggaagccttaaacagcaccattaggaataagaaagtgaaacgctcattctacctcagatagccaagtggattaaattctactaaagaaaaaaattttaaaaaccagtgcagcagttcagagacactaaaatctttgttgcttttaccgaagaatcaattaaatctagtttagctgcccagtgactaaattattattttctacttgtacataaacacttttctttgaagcaggtcactttcctttcaaaacaaaggttatgactatcttaaatgcctcagcagacggatggtcaaaacctcataaaaattctacatggacctagacaatcacatgacacaactgtgcacacgccacaccatctgttggatatgactgccagcacagatttcgtgagctggcaaaggactgaaatagtcaagaattctgcaactatttcaaagtgcaggcttctcattaattttaatttcctgttggctctacaaggaatgactgagtagtgaaagcacaatatgccacatacacttgagttcatgccacatgtacacctgtaatcataaactcttatccaaagctatccactggaacatttgggattttgtgtgtttatttcttctttaccctagaagaaataaatctgaaatatctatagttgtcttttcatactttgttaatactcttgcaaacatctggaaatacttgacaataatcatttaattaatgcaaaggtaatcgatgacaatatgcttaaatacttcactcaactgaagtggtttcctcagtccacagaactaaggactgtagagaacaagcagttctttgactaaggagtacactacaaggaaaactatagccaatatctcttttaaaaccagaaacattacctgcatttaaacaaagcagataacatgctgctatactggtaaaacaaacaaacaaacaaacaaacaaaaaactggtagatgctgctggcttaagtttttaccttaagctgtctacagggtctgtgttgctgagggcttactaaaggggtggccctgctcctctttttcggggctactctagtttctttatcactccttcacagttgctggctatagaggagggtgaaaagaccctgagaaagaaacatttctccagaacaagtgaagattcctaaaatgtccatgggcagctccagcagcagggttggtactttctctgccaaccctttactgttttctgcattttgcaacagtgacttttgttttgtttccctgtaatcatactcacttgctaatgcaggcaacaaaggtaggactgcggaaaaactaggaaagccccaggcaactttatacttggggagcaaagttagtttttttcccttctctgccacaatttttgggactttttcttcagtgtggccctggaggattcttgtgtcccttagctcaaaagaacaccaccaactgaataaatatttaagaatcagagtaattaagaaatgttaacttactattcagtatgagtcacaaccaaaaatggttgatttacctaatttctcttatactagtaattactgtcaatccaatttctttcttttttaaaatttggaaccaatgtagtgggttaacagatggcttttgaagtttttgttcttattccaaaatctttacattacccaaaatatatctatttaaatatgatactgtaatttctgcaaaacattatctacatgctctctatttaacactaaacaatctggatgttaaggctgtttggaaataattctaacaaaaactgaaacattagactagtgctataataaacagacttgccttttacatttgttttagaaatcttcataagcacatcctaaacataacttttttccggtagggttaaaaataattcaattagcccaaatatattttatctcctatctttttatgataatccccaatttggtgacatcataaattcttttatcatctccttacattcaggaacataacataagaaaatccatagaaaatcccaaagacaaatgctaacgatttaaaaggaagtacacaaattctattgcatacaggctttaagacaaggaatgcttcctaccctgcacatctgtctagcaggtgcctttccgaataagttttgtcctttaggaatctgctctgagtacctcaaaagacaataaagtgttctctttcatttttttttcttagaacccattttcctcaaggcagaaggatgaagccttctctgtcctgaaaatatggtcaaaacaactttggcttattttaagcaacttctatcaaatagacttaggaattatataaaatacagttctcttctagaaggcggcctcgagatgcatcatgaagagggaagataaacacataaaccttagtatgctttatactttaatgagtcatattttttaacattctgtaactaatagatgagggaatgaataagaccagatttccctcattaacagctggtatctttgcttttagtccacttccccattttgtgagcaaagcagtccaccaaatcacttacgctgtgctccacctatgcttcttcttttaaccattctctctttgcccctcttacacccttttccttgtcttttgccatactcactactactcttggcaattatttgttcatcttctggcaatgcttcctttattcatctcttatttatttccatttccattccgctcagtggcgattacaaacattttccactttcctcaaagtgatgagagggttgagcagttccagttgacaggtgtaataaatgttgagaaaggaagaactgttctagtcactccgtccctcctgcaattccctttttaaggctatctgccctatataagtcaaaaataaataactctgcaaaaattggatccagtcatatgatctcttgatatccctttccaactgtgagaacatcttcctttattatttttttttggtactgtcaccatttatcatttggttcctcaccttaactaatcaaaatagtactcttcaatctagtatttcagctatttctgttaatctttcctcctcattcttgtttttcttttcaattttattcctatattattttaagcttgtgccacataaccgatttcccctaccctgagtctcttcctatcaatccttcatgctatcttcaatattaatattcttaagatacttttcatcatgtcatcctccaacttaaaaccttcagtggctttccactgtctattaaataaatattcagactctgtaaccttgcaagctttcaccctctgatctggatctacttttccattttatctctcgtatttttccagattaactaccacagacttgaaggtctctatttcattgccacccaacacagattatgctttcctactgctaagctttttattacacatcattccttgtagttcctgccttctctctttctgctatccatttatcaatgcttagacaaagtcctcttccacattataatttcatatacaactccagccttcatcaaatctccctcttattcaaaaccacatggcaatgtctgagttattgttctggattacaatttaccacttcattaactcataccttgtcctcttaataaatcagtataatttatttttacccacagtgcctagcacaatccaaagtaaaatatttgttaaattagcttaatgttttctaacaaattttggaatttccagatagaatgactacaaaatctatgaggggctaaaaatgtttccaaaagttactttcaggagttagccattggaaaaatagattcacaaaactaaaatgagtctaagacagacagtagaaggctacatgtcaaaaattgtgtgtatgtgaaaaatctgaaagtagagtactgcaatggtcattatcaaaatcattaatgaactctgatttcctaaattcaacattctaatttctgttgaattttaattaacaccctttctattagattgtctgcaaagtatactgtaataattccttccatctcatagcaccctttgccatgtaactttgctgttccttccatcatgaggtgaaatttatttccatatcttatgaattaggactagacttctgacatattttgacaacagactatgacaacagtgacactgtgcaaattctttcccctcttctcttatgcattttttatgcaaaaaaatgcataacacaaaattaaccattttcaagtgttcagttaagtggcattatttacattcacactctcatacaagcatcactaccatccacttctggaacgtttttcatcttgcaaaacggaaactctgtacccatcaaacaataactccctatttctcacccgtgagaaccaacattttattttccatctcgatgaatttgactattataggtaactcatataagtagaatcatatagcatttgtccttttgtgacctggcttatttcacttagcataatgtcttcagtgcttatccatgttgtagcatattgcacaatttctttcctaaggctgaacaatattccattttatgtattacaacatttttttaatccattcatccatcaatggacacttgggttgcttctacctttttgtcattgtgaataatgctgccatgaaaaagggtgtacaactacctctttgagaccctgctttcacttctttggtacatacccagaggtagaattgctggattatatgataatgctatgttagtttttttgaggaaccaccatactgcttcccatagtgactacaacatacttccaccagcaggtgcacaaggaaaggttccaatttctctacgtcttcagaaacacttgttattttatgtgtttgtgttttgataatagtcatttgaatgggtgtgtagtatcttattgtagttttgatatgcatttctctaatgattaatgataattattgaatcttttcatgtgtttattagccatgcttatcttctttggaggaatatctatttaagtcctttgccctttttttttttttttttgagacagagtctcgctctgtcacccaggctggagtgcaatggcacgatctcggctcactgcaacctccatctcctgggttcaagtgattctcctgcctcagcctcccaagtagctggaattacaagcatgcaccaccacaccccagctaattttgtatttttagtacaggtggggtttcgccttgttggtcaggctggtctcaaactcctgacctcaggtgatccacccgcctcagcctcccaaagtgctgggattacaggcatgagccaccatgcccagcccctttgcccatttctgaaatggactgtttgggttttttttttgttgctgttgagttgtaggagttcattatacattatgaatattaacctcttatcagatatatgatttacaaatgttttctctcattccattggttgccctccactctgttgatagtgtcttgtgatgcacacaagttttccattttgatgtagtccaatttatctattttttgttacttgtttttagtgtcatagcctagaaatcactgctaaatccaatgtcacgaagtttttctcatatgtatttcctactaattttttagttttatttcttactgtaagatctttggcccattttgaattaatttttgtatatggtgtaaagtaagactccaacttcattcttttgcatgtggatatccagttttcccagcacgatttgctgaaatgcctcttctttgcccccactgaatggtcttggcatccttgccgaaaatcatttgaccatagatgtgaaaagtttacttctcagctctctattccattggtctacatgtctgtctttctgacagtaccacactgttttgatttcagtagcttggtagtaagttttgaaatcaggaaacatgagatcttcaattttgtttttctttttcaagattgttttgactaattagggtcccttgagaatccatatgaattttaggatgagtttttttctagttttgtaaaaaatatcattaggattttgacagagatgacaatgactctgtagattgctttaggcaatattaacatcctaacaatattaaagcttataatctatgaatatgtcttttcatgtattgatatctaatttctttcacccatatttttgcagttttcagtgtacaagtcttttacctacttggttaagattattcctaagtatctcattctttttgatgctattatcaatggacactgtgcagatcctacgctgatgtcaagaggccttacaaccttgttttcaccttcttggaaggctactactgccacatacaaactccaggcttgcctgatgagatcatatgacctagccaatagttagcacaattgccaacacatttgggaagtaattttagagagagtgttcagccccattcaagtcagcagatgactgcagtcacttaagaaaccccaggtaagcccagcagaagaaacacttagataaacctagacaaactattaacctacaaaattgtggttttgatgaaagtaaaatagttgttattttaagccattaaattttggggtggtagaaagattaactgaagcaaagttaaatcattttatttgccatttcttaaccatgataatttattcattactttgtagctcatttcaaagtgtttctcagagcccattaagatgtattccatactactcagccataaaaaagaataaaatcttatcttttgaagcaacatggatggaactggtagctattatcttaagtgaaacaactcagaaacagcaaagtcaaatactgcatgttctcacgtataagtaggagctaaacaatgtgtacacacggacacagagtgcggaataatagactatggaaacttggaagggtgagaggggaagaagggagtcagggatgagaaattacctaaagggtacaatgcacattatttgggtaatggttatactaaaagtccagacttcaccatgatgcaatatatccatgtaaatttaaaaaacagcaatcgtacccttaaatttatgccaaaaaaaaaaaaaagatttattccaactgacacaagacaactctttgaggctaaatactctacattattcattatattcatgaataatttaaagcttaaatgtcagcattctaaataatttataattttaaaaaagtagataggttaaaatgaaatcttattaggactaaagatgtattgattttatttttctaactgcttactacaatattgaaaaaatattaagtagacattgcaatgatgtttgcaagctaacctgtgaattatactgctaatatttgctagcaattagtactaaatttattggggatagattttgaaactttattatctgattatttaaaaactcaatcacaatattgaggaaaaaagtacttaaaatatttataattgcaaagcatttagagtcatgttgtctaagcaaaatggtttattattacttaaaaattcttaaatttaaaaaatgtacatatttatatttatctaaaattgtatttacttatccatacgtttattaataaataaaactataaaggattataaagttattttgtttgggaaaaaaaatcttccagaacaatatgcaaaagtaacattattatttaaaatgtggttaagtaaaaatttactccataaaattttcactccattaaataactcattttgagaatttactctctcaagttctggaaacagttactttaaaatagttcatctgtattttatgtattctttaaaagaagtaagaagaaccagggtagaagaaataatgagaaaatgtaacaaaataggtgataaggcagttttatactgaagtttatatgctcctaggtacagaataggactattatttctgagaaaccaagtggaattaacacttactcaaatagaaaccaactcatatactttaaaaattgaagcaaattctcaaactctatgtcataaatacctttgcttcattaattttggcaactgagtttactgaatgtcagaagtatctcatatttgcattattgaaaacatcttttaaaatagttgtcattttagttttaaggagtcctgaatatttatttaaatttgagctatgatttatttaactataaaaaagtatttctctgcaagtacatttctataagcaagctacagtttcacaatttctctaaccatgtatatggctgtataatgaatattaacatatggtctataattgtatatacatacacacagttcatatacatatgaactatgcttctcaatttgatgataaaatatagaaggagaaaacataaattgaagaattaaaatgtacttacaaagtcaaagtctccatcttgaggaactttccagttatcaggaaaaacgtttttggacatagggaagggttcatgcatgttctgattacagttttcgtgactcttattcttgaagtcttgcttatcaaagtagtccatgaaagatggtctttgtacttgtggtgaggttgcatttccttaggtaaacaaagaacataaggaaggtataagttcttacatttaaggaagtattttctttgaagtatgatttttttatgaagccatataataaatttgcactggtcagattcaaggccaacataattaatttcataaagaacaaagtgaaataaaataagaattaaaaaatacccagaccaaataaaaattaagctgatgattaggcaaaggtctggaatgtttagattgtagaaacatttcagaagtttagtaaaatcattatcagaattttattaaaaatcatttcagctttatttcaaatttctcaaagaaagtaaattttaaaaactcaggtgtttttggtgggctttttttctttgcatttaagcctgcattgctattgttattgtacattttcagctgtaagaaattatgaggacttggctaggcatggtggcctgtaacctcagaactttgggaggctaaggtggaagggatgcttgagcccaggagttcaagaccagcctaagcaacatagtgaaactctgtctctataaaaaatacaaaaaattagccaggtgtggtggcacctatctgtagtcccagctactttggggacagaggcgggaggatcacttgagcctgggaggtcaaggctgcagtgagctatgattgtgccactgcactccagcctgggcaacagagcaagaccctgttcaaattaaaaaatatatatatatgaaatacataaactttaaaaaaattaaaaaaaatcataagaacttactcagtttcctcttatatttatcaaactgcttcctcagtctttctgattccctctgtccctggacttccatggcttcgcctgccacacttacatccatgtctcccaacactacttctctagcccagactttgcgcctaagttccataactaactttgctagctattagacaacttaatctgaggtgagttgccaattaatttaccagttctaaaactaaattcaagatctttcccttcaaacctacagctcccccgacatattctatctccactaaagtcaaccttatttactcaatccccaaaataataaagttgagaattaattcagactcctcccttcccaccatagcaaactgattattaggtcttttaattctacttctcagtacagttaactataaccccttttctctacttatcattgcaactgtcttagtttagcttctaatcacttcttgcttaggccattgtagcagcctccaaactagtctccttgcttccaatatcacagttttgattttaatttccatattgtcaaagtggtgacctttctaaatacaaaccaaaagatgtcattctgctcagaatctttcaatggctcttcattttttatactgaatgactaaataggaaataaatatttggaataactagatttttaatctggctatattggtcttgatcagtggttttcaaattggatccttaaagccccagggctccaaataaatgtcccagagaccaccaagaaggcatttcccatataattctccaaatagaaagtaagctactttcctttttcttttctttttttttgagatggagtttcgctcttgttgtgcaggctggagtgcaatggcacgaactcagctcattgcaacctccgcctcctgagttcaagcaattctcctgcctcagcctcccaagtagctgggattacaggcatgcgccaccatgcccggctaattttgtatttttagtagagatggggtttctccatgttggtcaggcagtaagctactttcttaagaattttttgtggggagtacacctccccacaagggaccctgatgggcaactgtaagttacaaaaagtatttttaaaacgtaaaattgaaatctttccttccgtaatttacactcatgttccaaataaattactctttcgtataattgtccctcaaatatctgaagacagaggtaatggctcctgtcttggctgtctatttttaatataaaacatccccagttcctttcataggatatatgtttcagattcatcatcaacttgtttacttgcctatggagacattctagtctactgttcctctaaaaagaaacataatattcataacagttatctgaccaacctagattgcatttgtaatagtcctagcacagttgaaaactacagttactactatgacaactaagtaacaatgttagttgggacgagctttaaggtcattttggtcaaaagaaagcatgttaagacttatttttagtctttaaaaatatgagggaagcctaaatcgatgcctactttatgtggcaaatcagagagtccggaattcttaatcaaacttcaaaaaacaaaagggggggggacggagattgaactgacaggtaaacgtcctatctcctctttcctttctccctacttttggatctctatgtgtgttatttgacagattggaagcctaggtgaggcggcttaggtgaggttataagagagagtggtaatggtgatatttattcatcaaaagaattctgtctcattgccttaaaataaaatggtttgccatatcaaaacagaggttttattgacttcaccttatgtgttttaaaaaaatttttataagataaaatttaccatcttacttctgggtatatatccggaactgaaagccaggtcttgaagagataactgtaaccccatgtctattgcagcattattcataacagctaaaacatggaagcaagccaagtgcccattagcaaaatgtgaggaaggaaattctgacacatgctacaacatggatgaaccttgaggacattatgctatgtgaaataagctagtaacaaaagaacaaaatactgtatgattccacttatgtcaggtatttagagtagtcaacatcatagagacagaaaacagaatggtggttgctagggactaagaggagtgggaaatggggagtcggcgtttaacaggtacagcagttgagttttacaagatgaaaagagttatggaaattgatggtggtgatggctgcacaactttatggaagtgcttaagattaatactattgaactagatacaggcatatttcgcagttattgcaggtttggttccagaccactgcaataatgagaatatcgcaataatgtaagtcacataaattttttggtttcccagtgcacataaaagttatgtttgtttgtttgccttcacaacgtcaattttcttaaaaatttctttttaacttttaaggtcaggggtacatgtgcagatttgttacataggtaaacttgtgtcatgggggtttgttttacagattatttcatcacccacgtattaagcctagtacccatttgttttttctgatcctctccctcctcccagcctccactctctgaaaagtcccagtgtgtgttgttccccagatgtggccatgtattctcatcatttagcttccacttgtaagtgagaacatgcggtatttggttttctaaaagttatgtttaggagtgacatcagaaagatggctgacaagagaggcctggtgctagtccactctcaacaaaaaaagaccgaggcaacagataaatagctaagatttgactggagtgtcagtgggagaaccctggagaataacgagagagtgcagaggcacctgtgctgcttagaagtccagtttggggtggctgtagtgtttcttaaataataccgcagtgaagtttgctgtatcagttaactcttcctttcacaaaatgtttctctgtagcatgagatgctgtttcgtaacattttacccacagcacagtgtctctcaaaattgtagtcaatcctctcaaactctaccactgctttatcaactgagtttatggaaaattctaagtcctttgttgtcatttcaacaatgttcacagcatcttcacaaggagtagattccatcgcaagaaaccactttctttgctcatccataagaagcaactcttcatctgttcaagtttaatcatgagattgcagcaatgcaggcacatcttcaggctgtacttccaagtctagttctttcgctattaccatcacacttgcagttacttcctccactgaagtctttaaccccttaaagtcatccatgagggttggaatggacttcttccaacctcctgttaatgctgatctttttacttcctcctatgaatcacaaatgttcttaataacatgaagaatgatgaatcctttccagaaggttttcaacttacttgatccagatccatcaaagcaatcattatttatggcagatattgccttataaaatgtatttcttaataataagacttgaaagtctaaaatactcatggatctatgggctacaaaatggatgttgtgttagcaggcatgaaaacaacattaatttccttgcatatttccatcagaccccttgggtgaccaggtgcattctcactgagcagtaacagtccaaagataatctttttttctcagcagtaggtctcaacagtgggcttaaaatattcagcaaaccatagtgcaaacaaatgtgctgccatccaggcttcattattccatttatagagcacaggcagagcagaatgagcataatttttaagggccctaggattttcaaaacagtaaatgaacattggcttcaacttagtcaccaccaccagcctgtcctttgaagctctgaagccaggcattgacttctcctctgtagctaggaaagtcttagatgacatcttccaatagaagacttgtttattctatattgaaattctgttgtttagggtagccaccttcatcaattatcttagctacatcttctggataacttgctgcagcttctccatcagtacttgctgcttcactttgtacttgtatggtctggagatagcttctttccttaaacgtcatgaaccaacctatgctagcttcaaacttttcttctgcagcttccttacctctttcagccttccagaattaaacagagttagagccttgctctgggttagactttggcttaaggaaatgttgtgactggtttaatcttctatccacaccactcaaactttctccatatcagaaagagaaaggctgtttcactttcttatcattcatgtgttcactggagtagaacttttaatttcctttaagaagtttttctttgcattcacaacttggctgtttggtgcaagaggcctagctttcacccagtctcagctttcaatatgccttcctcactaagtttaatcatttctagcttttgatttaaagtgagagatgtgtgactcttcctttcactttagcacatagaggccattgcagggttatcaatgggcctaatttcaatattgtgatgtctcagagaaaagggaggcctgaggagagagacagagacaaggtaatggcctgctggtggggcagtcagaacacatactacatttatcaattaaattcgccatcttatataggcgcagtttgttgtaccccaaaacaattacaatagtagcaccaaagaccactgatcacagatcagtgtaacagacataataatgatgaaaaggtttgaaatattgtgaaaagtaccaaactatgacacagaaatacaaagtgagcacataacattggaaaaacagtgccaatagacttgcttgacacaaggttgccacaaaccttcaatctgtaaaacacagaatgtctgtgaagcacaaaaaagcaaattgcaataatgaggtatgcttatgtttaaaaatggttaagatggtgaattttaggttatatgtattttaccacaataaaaaaaatttttttaattaccatcaaaaatgtgccattcagtagcatgaagtattgtgtgaccaatcttcaccttgcaaaatggagactcttgtacccaatgaacaacttgccattttcccctacctctagcaaccaccattttacttcctgtttttatgaatcttactactctggatatgtcatataagtataatccattaaagtggtatttttttgtttttctttgttttttttatgactggcttatttcatttaacataatgacctcaaggttcattcatgttgtggcatgtgtcagcatttccttccttttcaagaataaataacattcaactctatgtatatactacattttgcttatccatttgtctgtcaatgaacacttgggtttttctacttttgttgaataatgctcctatgaatattgttgaataatgctcctatgaacatgagtatagaaatacatcttagagatcctgctaattatgtggctttgtgttatttactcttttttaaataagtttttctctatgtgcagatctttagttgcaagtaatcttattttttaatatctatccagaggccttttttgctttctaatgggtgttttgatggttgagcctaatctctgattaaatgaatgattacaatacaatgtaaacatgtgaataatataattattggtaaaagtaatttttatttttaccctatgagtatgttgtatgtatgtatgtatggatggatgggtgggtggactgactgatttgattgcctgacagggtctctccttctgtctcccatgctggagtgcagtggcatgatctccgcccactgaaggcttgaccttctgggctcaagcgattttcccatctcagcctcctgagtagctaggactacaggcatgcaccgccacactcggttaatttttgtttactttttgtagagatgaggtcttactatgttgcccaggctggtttcaaactcctggactcaagcaatcctcccattttggcctcccaaagtgctggcatcacaggtgtgggccaccatacctcgctgagttatgtcttttaaatgtgtttccatctttacttttcattaaaccgtaagttccctaatgtagaattccaaatcctttacctaaataatttcacagataactctattaatttgtgtttttgactgtctacccagatgttgaatacctatgaacaacagcaggagccatggtttttcatcattacttttgaattagtagatgctatatgtatttcattactagcattggtgcactgctgataatgtatttgagaaagtattgtgactactacaattattattaggctggtgcaagtaataacagaatgatctatcccagtagagtcagaaagaacctgattttcagaatatacatgtattagtggaaaaatagaaaaagactctcaacacaactgtttatctaaggaccaatcctctaattacagctgttccagctttagatggctagaaaatgtgacaagacatctgggacccaaatggtacccactgtaaagatattgagacattctatgaaatttaagatagtataaaacaccaatatttgtggtaaacctttagaacttagaacactctcatatctcacattcaaagctcatgaaaaagaaactccttagagacagttcagcatgaaaacagccaaagctgcctttagatttcctgtcataacagactttacaagtatgttaaaaatgaacaaaatatatagaagagaaggtgtaatatttcaacgatcaataaatatgctaaaaataaagatatggtgtctatggtgttcatcttcaactttgttccctgaaatcaacaacaaaaatagaaattggttaatttgatgggttacattactgacatttagacaggacacatacattccattaacattttcagcagatttttagtacctttgatttgtctctaggcttcatcattacaagacgtatttctctatattcagaattgaaactcggttcccatggtaacctcttatactaaaatagagtctaggaatttaacctgttattctccatttctgccccattttgtaagtttaaaaaaattacaagtgtagctcaacttacacatattttttataaaccaattgagtaaatcaaaccataaagctgggagaagggggataatcccttaaagaaattctttgctcaatattctttttgtttctttttctttttaaagggaagattaattctgtaatagaattatatatttagttgtaagttctgttttcatcaagaagtcttaaaatgtgtcacacacataaatacatctgaaaactttaacattcagtattatataataagggttatcaagtttgtcaaggaaagtcagaatcagggaggagagaaaaaatggtttctttagaaactaactgctggaaaagtaagaaactcctaaaccaccattatcaactgcatttgataatgaaaagaaaggtttcactgaagcgtatttctagatagcattctttaaaaagtaaatttagtatttgtaggtgctttggtaagaacaaaacaaaaacaatagaaactacaaaaagcatgcattgtagcactactaatccagtgaagacaacagcactctgtgacctatgttcctccccagatcatcttcctctctccacaccaagccaggaccacattgctttcattaattttttttttttttttcatccagcactggcttcactgctgaggctctcgttatggtcttgttttctcctcaactgggagataagaaactcttcatcccagaatctttacaaactccccagtgctgtaataaacagtcagggttctcttgatataccactgactcttactttggacctctatctgagaaaattcacccaaaccattattggagtaaattaaaaactaatcttttcctaccagaaactaacatttatagagcacctattctaatatgacctacatattaagagtagcagcatacactgggaaggagaaggagaaaaataaaatctcagaagttgcttttttcactacaaagaacagagtgggggaaattttaatcttctataaaaaccttcaaaacagaaagatgggctgagcaggcatttcctttagaaatgaggagagtaagaaaaaggctgaaggaaagacaatgttcttttctgcaatgagtcagagaagaaacagtttgattagagagaagtggtagcaacagaaaggggagaagcagactactccttggtgttgactaaataaagaaaggaaattactaggaaatttcattccaggaatctactcttccaaccccaacagccttgtgcgtgctcctgacaacatcccaatcaggagcttctaactgaagtcacataagccaccaccaatgttgtagtgtctcaaagtgaaaaatttgcctccctaatatctataatccctagcttcctgactaggggtgagaaagtatctatctcattggaaaaagtggccatgtaatacaattctggctaatgacacataaaaataagggtttaggccaggtatggtggctcatacctctaatcccagcattttgggaggttgaggcaggaggattgcttgaggccaggagtttgaagctgcaataagctatgggctatgatcacaaacaccatattccagtctagatgacagagtgagacccttctcttaaaaaaaaatcaagtaaggttttctaggaaagttctgttttcttgatataggcacaatcctttctgttttttgctcttttctactgcctggaatacagacttgatggctagagatcctacatttactctgcaggcaggagaacaagcataataccctaaaagatggtgtcacagaaatgatttctaatgacatcatgaactcactctgccagtgccggatactctgcttttggatttctcatcaaatgagaaaagaaattaatcttattttgtttaaatcactgttatttgggtttattggtacatacagtcaaattcagtccttaactgatacatttctattcccaaatggaggatgtagggagaagcagaaggagcagcaatctgcagtttcactgcagaaacatcccaatttcaaacttgaagtccactattatacagagtagtttaaatatcactacgtctcagatacattatagttttaaaggtttttttacaggctgacctaaaaaacctatggcaaaatgccttttggcttccatactcaaaaattttaaaaataacccactcctaagataaaaataaacattcttacagagttaacaaaagttttaaaagcaacttaaataaaagaaggagtctattctgtcagatttttctttttggatgatttaataacaagatactattaaccaagatatgtttacacttaattttttattcaaatgtataatgtatgtgcttatacttctaaatattttccattgcttaatttaaaacctagtattaacatttagagtatctctttgtcatacacacaaaaaaagattaaaaaacaatttttaaaaaattttaaagaggaaaacaggttaggtttgttttaaaagttaatgggagggggcagctgcaattgcccagtaatgtttaactacacaatatgaaacacatgccacaatgcgcagctgagtctccagggagatacatgttcacagaagtgggacagagaggatgatgtttctgacttacaatttattaaaaaaaatactaggctcttcaatgagaaaataaagcaggaaatctcaagatagtaaccactgtcatatgtgatgtggttgctatggcaaatactttttttaagcacaaaaagaataatcatataaaattgacatcaatttctccagctgcagccgaattctgaccccagcttacaaaaacattttattttaacaataattttaacgttcagaattacctagttcctcaattttggccctaattccttcaactagttgctcatggaactaaaaacctattagcaataaagaataaagtaactatcattcattctctttgtggataagaaattttaaagaaaaaggttgcttttcatctccttcatgcatccccaaaacatttacaagtaaactaaattgtgagaaatataataccgtagaaaatacgtcagtccacccacaattattcattaagtttcctaatttgcacatcttctaaacaagtaaaaagtcctcataaaaatttaaatatataaagtaatttttaaaaatactttaacaaaataatttaatttttaacttcttagcatgattatgacaaagatattcaagtttagagaataaaataacaatcataactttagtaaagtatgtgtcaacatcaaaaagatttatgaagattacctaatttgttcttctaaaaatattttaagatgtgggtggttccacctcattaatggccttcgaaatgtgtcctttaatttgctgccaagagtatagtgaatacatataaaaaccaggatgttaacacagaagctactgacatcagttttttcctgaacttcaccatactgtattttaaaacaaagaaggataaacataacatggagaaggtccacagactattcataaaagattaaaaagcttagaaaataatacctgcacaaaggttaaagagactgaaattattcagccaagaaaagtcaagtctgagaaagaacttaataagtatccaagtatttatgaagggttctttgcacagaaaatagtgaccagctgttttcaatctccaatgaagtcagaatagaaggaaacaaaaattgaagcccaaagattttagttaaataaaaggaaggagttcctgtgcgagtaatgaatattgtaatggtcactgtatctatgaaaatgctttcttccaaggcctgtacaggaaagatattttcatttttacagggaagactaatatttacatccttgtgtgtgttttgtgctaataaaagaggtatcctacaaccaaaatgcatacaccagcaggtctgagctgggttatacttcgttaaacgtcccacggaccaagagcacacagaatagtagactatactcagtgcccacagggaactccaaaccactgcagccacaccttacctggattcctcgtacttttgtaaaggaaaatgaatgatttctaattgcccagaaatatgatgggtatttgcacccagctgcaagagggacctgtagtttactgctgtcacctttattgtcatatcccgggcaacattaacctcctaagttaaagaggaatggaacagtttttcataaaagaatggtaagtgagaaagtagttcccctacacattctcctacccttgccaattatttcttggcatctcaaattccatccttagtgatttactcctttggctcaaggctgtacgattctgggagaaaatgtatttcatgagcattaaacattattaggcattttattcctgtgtatctggtctctttccaaaacagattttgggggaaaaaagggaggaaggaaaggatatgagaaccgagagaaagatattactaagcaaagaatacggcatggaagtagatgctcagaacaaaacaaattgcctcatacttcacgattttgtctaggaacaatggatgaaccagggagtagagtcagtcttctcttcttggtatctctcctcaactgacactaatatctagtatcgtttccagagtaactcctaaaaagctaaagcagaacttcatttgctttctcttactaattaagtaaaactgcatatatgtgctgtccaaaataaactctgaaattttcaaaatcaacaaatactatatgcatatacaggtaagacatttttaaaatgtatatttagtaaatattatttaacccagtatttaagaaatgataaacatttatgaaaggttaatataagtaaataatatacaacctaaacataaccggttatttctccacccattcttttttgtttttctgagatagagtcttgctctgtcgcccaggctggagtgctgttgcgggatctcagctcactgcagcctctgcctcctgggttccagcgattctcctgcctcagcctcctgggtagctgggattacaggtgcatgccaccatgcccagctaatttttgtatttttagtagagacggggtttcaccgtgttggccaggctggtctcgaactcctgaccttaggtgatccccctgccttggcttcccaaagtgctgggattacaggcgtgagccactgcgcccggcctctccacccattcttaatacaacatggtctccacctacatcgccatccagctgcctctctgttcaatgtgctccagtgtatctccagccttcttaaatactccaggtaagttctaaacacaatactccaggtgagttctggctcctgagagcagagggaagctgtttatttccttgttctaaaaagtggttatctgtcctagctgcacctcagaagcacttgtagagtttttaaattttaaaaaacgtattttaaaagcagagatgcccaagccctgctctagtcttcagaccagcatctctgaagagcgactgttacaatacatacttgtgaggctggttatttggacccaaaagcagggtttatcttgtaaatcaagcccactgctccagcctgtggtgatcttttaggatcctcgttctatcctataacatatttttattttgttccacttcatgttatttgcaattctgatggaccttcaccttatagcttcatccaagtttctatgaaaaattttgagctagccagggctggaggccgaggtcctgtatcacaaaatgagaaatcttccggtaaacaatttattatttaacattgtagtcgactgaaatttagcaaccactgccgtgtgcccctggtgagcctttgtatcatagaggctagagagctgaacaccacatttctcagaattccttgcaactagagttctgggtaagtgcactctttcgcaactggggtggtgggggcggtggggggaagcaaacagaagctatatgcctgctagtttagttatttccttcttacaagccctgtcatagaggcttgattatttacagcagcattctagcatctagtcaccagtttcacaggtactgaggagtggttgcagtaatatttagtagctttctaatccctaaatagcagtgagggttgatttcaatctgtattactgaactcagcggcgccagcggtagcctctggattgctattcctcgttgtggcagtagtagttgttccttatatgctcacttttgtggtgttgtgggagtcactcttgaagcctatgctacacagccttctcctctaggctttccattgattttcttaacttctacatctttaatatggcttggctctatgcccccacctaaatctcacgttgaattttaattcccagtgctggaggggggactggtgggagatgattggatcacgggggtagtttctaacggtttagcaccatccccctagtgctgtctcgtggctgagttctcacaggatctggttgtttaaaagtgtatagccccacccgctttgctctttctcccgttcagccatgtaggacgtgccagcttccccgtccccttccaccatgattgcaggtttcctgaggcctccctagccatgcttcctgtacagcctgcagaaccataagcaaattataccccttttctttatatattacccagtctcacatagttctttatagcaatatgagaacacattaatacaatctctgacttaaattgctttgtgtgtggaatacctggagtagattctgtttcctccaataaactctcactgatataagcacatttgagtataactgttgcactctcataacaggaccaccagctaggtcacactacatagtgtctacaagggtatcatgaaagaccttgtcaaatactttcctaatatcctaagatacaatattcaaactctgcattttctctgaccttgaagtttagcaatgctgtcaaaaaaggaaattatattattctgatacgatttcttctcagtaatctatgctgacttataacgatcctgatctttcctaaaggactcttaaatgttctagaatcctgcccaagagggacattgagctcactggccccagagtagtgatgtgattctagtgtcaaccctgtgtctatatactggtttcatcacttacttgctaggaaatcttgaacagcattcccaagtctcagtttccttagtgctaaatggtagtgaaatgctattttataggatccttgtgaggagtaaataagataacatatacaaaatcctaagcacagtgtttggcctgtagtaggagctcaattagtaacagctataacctgagaaattcacctttttctccatttccaaaaataaaataaaataaaatgtaaatgtacttttatacttccatgacactctcctcattttctcaaagagatgtcaaatttcacaaacagtggaaaacagttctctcatctcaagtcgtatcaatagatattatcaaacacactctcggtcaggagatgccaagtgcgctgagtacttctctagcatttgctcatcttgccattcaaacccctcttattcatgttgatgctactcagttcattttggagatcatcattctctatagaagcccctttgactagcttactaaaaaaaagagagatggagcaaggtcttggaggaggcagggaaaggtggaggcaagaatttgccgtgggaagaacagagttgctcgatagctcagcatctctggtcccaggaagatatgatttttatcaccgcatgggaagcagggctgacaatgcccagggcttcccggatgctccctcttatcaagttgttggaaggataaattaatagggtggacagatgaatattatcctttattgattatcaactatatttaaaacactgctaggcatgttttgaatttacctaatacacacacctgcacatatacacacaacagagagacaaatatttatcactgaaactcagacagaattaagcaacacaattactaaatgatttggcttcacatcccatgctcttcactataccacatcatttgttcagaaaacatttcatgaactcttaccaagtgctaggtattgtattaggtatcaaaaatacagtgggaaataaacaaaagcacacgctcacaataaagcatgacagtgctgtaagagtgaaagcttggggtgagatgggagcctattagaggggcacttattcctaacctggggttgatagaggaagcaacctcttaactgagcctgagtgaatgaatatgatttagcaaaagaagcataaatcccacaggaggatttaggcattgcaagtggccaaaggtaaaaaagctctgtaagagctgagaagctggaagaaggatgaagagggaatagaaaggtaagtaggaaccagagcatatactgcttcttaactggtgttgagctttagcctataagcaattggtagtcactgggagggcataagcagaagagaaatgtgctgaaatctgtatggtggggagggaatgaagattggaggcagaggatcagtttagaagcctcacaagtgagaaactatgaggacttgcactaaagaaatgcaagcagagatcatgagaagagaatagggatatttagggggcagaactgatgagatgttacttccatgaagggtgaaggaagaaacggaaattaagaatgactcaatttttcaaccttattccaaagaccacatttaaaacacctatacagcttctctaggtacttgcatgataacatttcactttttttctgtaaagtagggagcaacgtcatctactgaaactgagatgggaggcaggaagaagagatctagtgaagatctaaactagccactctgtagaatgaggaattgctgaacagagaaacacaggcctccaggaaagttgagggcccaaatgggggagaaggtcttgatctggcagccctcatctgtgcagatggaagattatctccagcagcactcaatagccagggtaaagatgcagagaagatgaacactgagactggaccatatcaaagttttccaggagaggcagaaaagacaagacattagggcagtggagtttagaatataagagagtggcagaagcaatgaaatatagcctctaagaggagtttagaacataagagagtggcagaagcaatgaaataatgaaatatagcctctaagaggagtttagaacatacgagagtggcagaagcaacgaaataatgaaatatagcctctaagctggatatagaagtgaagggagggtgtgctaataaaaagaaagcagactaggaactagggtcagggaactagagggctctcatgatagcatttcccaaaatgtgtttctcagatgcttattacacaggatgttaatcactgatacgttcctcattaaaagcttttcatggtcaaataagtgaaggaaagtttgggtaatgtaatttttaaactgtttccttcctgtactatttgtatttaataagttaataatatatactgtagttctctaataatttatctctaggataaatatgcatttcccaaataattctgattactgtatattatttatctatatttatcagagaatttcactgaatgggtatcttaaggaacacattttcagagggtctgctctgtgaaatgagaagcagggatggtagaacacttgaaaagaaagtatcttaccaaggcaggaggtttacctgaaagttctcttagcttccagagctatgtatctttaattctactataacacacacacacacacacacacacacacacacacacacacacacacagcttgactctgactctactgtaattagtattcattcatgaaaccaatattccaagagcatgtactattatgtggcagaggagatttatacagcattcttaccaggacaaacttcgtgacttatctggagaaacaacagatacacacatgaaaaataaaaacctggctggaaaatatggctcttcctcagatacccataagacatagtttccctccagggcaactagtgctaccaatctagccacagctctgtaagatcagaaagttcctccataaaaacagagctaactgagtagatctgagctgaacaaactaaaaagccccagtctttctttgctgaagctactactctcccagagtcacccatgatgaaataatctctcctaccccatcagtttgatgacatagattcttgacctggtcctaatctactccaggataataaatcctaaattgattttcttgaatgacaaccaacctgcttttacccagtgtcaagcattcagaattccaactggcacagactagtatggataaaacataatccataaggaagaagtagagatccacatgtaaataatggctagtgccagactgtgaaggatcttggtgacacagctgaagcctggacattccatggggaatgaggaggccttagggatatctgaataggaagactgggagcgggagggtaaaagtaatgccatcattgctaaaaacaggtttagaaagttattcttgggacatgcccatagggtccacgtccattttttaaaaggcagatcaaattttaaaatactttttgtcatttttctccacttcccttcaaagggtctgtgggtaattttcctttctagaggtaaggaaaataggcccataatttctagcttcatggttaaaggtataaaagagtaagtgtaaacataatttaaactgacaaggatgttaaatcaggcaactcacttgaaactccaatggaaaaagagatgaaattctaaatcttcagtacacattgtagagattttagaaaaccaaaaataatatactgctatcatcttattagggaacaaaaatgctaaagacacattagcaaatgtggctttgactgatgtgacataagctgagacctcataccaactaatttaagaagttttaaagatttagatcacgagaaaaacaaaactacaataattatatggtttcagaaaaagtaagtcttccctcaataacttcttcacatactttactactgctatactacaatatgacaatccctaggggttatactaacatcacttgattagaattttggaaacactgaagtctcacattacagaatgatgtctaacttgtaaaaacaaaaaacacagaaagttggctcatgggatttaaaatttgctgaggtccataaaacaactgcagctataaaaaccacttatctgttcaacttcaaaattggttttcactaaaatctctgtgacaaaaagtcatacctatacaatcagttataacaaaattataacatgtattgatttttgtggatgtcaaatctaaaagtcactatacaaaatgtcagaaatctgtggtataaagtatgatgtcggaaacatcatcattagtctctcttccttgaaatataatacactgcaatctaaatgaattagattctataaagactcatttttcttaactattatatatatgctgatgttcaactatatgactgcatgaaaagttgttcatatagtttcataaggagctcagtaactccctaaagacacaaaaaagcactcaatgatctaattgatctgttaagaatcataaaatttgagttaaaaattatatcagcttatggaaaattgatattacatgttgatgaaaaatgtgttaactgttttaccacagagtctttgtgatccacttgtaccccaacactagctggttctggaggccataagaccatcctctgcagtggagtgaggcacgttatggatgcagaaaacttactctagtcagatgcccagctaggaatttcaggaaatccaagatgtaggctgctttccaggaaaaaggcacagaagacccaccaatggcaggagatagaaaattcatactccacccccaggattatggcaatatagcaatctattacattttgtgcttcatgatcctctctatccaaagtacatatgcaaccatagtgggctacacagaactagggaatgtgaagaaagcagcagtactgagccacgtgacttgaagttatgggtcagacctcatggcggagtagcaaaaagaaaagggtgggcaaaaaggaaatggaagtatctgagagaaaattctggtatccattttgcagtaccagcaaatcacttgaatatttacaattttctaggttctacaatgctagaagtcatgtaattctgctgttctgccatggagaggcaatactcttcagtggaaagcagcctagtgcttgcttagactttgacactaaccacacaggactagggtaggagcatgacaggaagaaaaaggtcagttggtgctaagagaaaattcatttttgcctataactgtgaaatcacaatgacctacgatgttaactgcagtatcttaaaaaactgtttttaaaaaagagaagtgctagtctgtgaaagcattcctattgtcatcactttgtaagcaacagaggtcagagagaatgtttgatcatcattttagccactgcagcacccccagcactgtgcctcacatatgataagcagcagtaaatattcatgcaactgaatcttctgtatgagcatccctgtctcttaatccttctttctagtgcttcttattttcccaccttatttcttcccatagctcgcactgctctttgtggtttaactgataatttggacaacataaaataatagtctgttgaatttactggaagataattttaggttcacttttttaattgggaaagtaaatgttaggaacactatctttttctctctaaaatactttgcaaattaagccgtgggttagcaaccttcaacagaaaaaagttccataactctaagttgaagatgtgttgttttctgctatattaaaatacaattttaaaaaggtgacttgtgccatactcttttttactgttacataaatctaagaaacaaaattttccacagttggctataaaaagtaacacagaactagcctggttcctataaaagtatcctttcgaattagaaaactaatatttaatgtaaaaaagccacatacttttcatagttccatcttcttcttcctcatcctcactgtttatcaccatggtccccaagtcggattccaacatcgtgctattatgttcaatcatggtctgggccccttcactcatcgtgcttgtggcccgcatggtgcccacactctccacactagtcttcaccatggtgtgggaatccagctcatcttcatcctgcaagcaaaatactgcaatgagggaagacttttctatgacagctggatttcttaattcttaacaagagaatgaatatattatagttttaatacttattaaaaatactattagtactgattttaatataaatacatacatacaaatgttattttaagagtgaaaattattcaaaataacctaaagctttaggtaattacagatcaagcaacagaaactgatgaagtagaaggctgctagttgcttttaaaataaggattaagataggtaaactatcagcaaatgcataacaaagaatatggtgacaaaacaactaaatatatatgagagcacctttaagacagaacacattgacactttgtattataatgggcataatgatgtctataaccttgtaaaacagccattagctttttcttttaaattatggcaaaatatacaaatacatatatataaaattcaccattttagcaatttttaagtgtataactctgtagcactaagtatatttacaatgttgtgcaaccaccaccattatatgtttacagaactcttcattccccctttccccagccctggcaacctctattgtacttacaagaggtatctagaataggcaaattcatgagtactactattcataccatagtactaattcataattactattatacttatgaatttgcctattctagatacctcatgtaagtggaatcatacaatatattttgctgagcctaatgcattcaagattcatgcatattgtggtagaaaaatttcattcctttttaaggctgaatgatattccattgtatgaatacaccacattttgtttccctatttatctgttgatggccatttggattgttgacacctttggctactgtgaatagtgctaatgtgaacactgacctacaagtatctgtttgaatccctattttcagtttggttgggtatctacctagaagtacaattgctggatcacatggtaacttcatatttaattttttaagtgcccaaactgttttccacagtggctataccattttacactcccaccagcaatgcacaggattccaacttctccacatccttggcaacacttgttattttccatttttaaaaaataatagccatcctaatgaacatgaagtgttatcacattgtagtttgatctgcatctccctaatgactactgatgttgagcaatcttttcgcacgcttattagccatttgtatatcttctttggagaaatatccatttacccattttaaaatgggttgtttggtttttctgttgttattacaaattctggatattaattccttaccagagatataatttgcaaatattttctcccattctgtgtgctttttacttcatttatagcgtcttttgatgtaagtttttaattttgatgaagtctgatttatcaattttttgcttttgttgacaaatctcagcttttaaatgtttcacagaagaatcaagtcagtaataaaagtacaaattaaaagtgctctttagaacattcaccaaagatatactggaatagggtcataaaaataaattaacaaatcctgtttgaaagaccaactgataatcacagtgctttgggaggtcagggcagaaggccaggagtttgagaccagcctaggcaatgcagcaagaccttgcctccacaaaaaatttaaaaattagctgaacacggtggtgtgcctgtagtcctagctacttgatgggctgaggctggaagactgcctgagctcaagagtttgaggctacagtgagctatgatggtgccactgctctccagccggggtgacagagcaagaccccatttcaaaaagaaagaaaggaccaaagaatctgctatttagaaaaacttgattacgcacggaaattcatttatatttattccatttttagtagaaacatataagcaaaatctagttctggcagaggtcaaaatgcaaatctgagaacatcaatgttgagtttcagcaacttgggttgtataatataacaacagttggacagctgtttgatacctttcctcttcctaaacctacatgctaagcttgggcattaggtctcaaagtcgtttgcacttctttcatgatcctttctcttttagaagacctcttcattctcatgccttcaactatctaataagttgaggagtctcaaatcctgaaatcttcctatgtctttacttattacgtaaatacttaaagatgtctaaaatttgacagtcccaaatcagatattatttcatttatctctccagtctctcctatctgtctccatccccaacaaccaccacaaagcatggtaatcttcacttgctacataaaacttcaatgtcttcttacatttattttctctttcattccctatatatgcatcagtcaactagttctttaaataattctctcttagctccatctcttcttttccattcccactgctactgggtataatcctcactacatcataggtggtttactgcagctaatgcttcctgactgaggactctcccatctaactttctagagtcagacagacattagttcaaatcctggctcaaatcacttatgaggcataggatccttgtctccaaagattgatgattaaataaaaaggtaagcaaaatgcctgcatgctacctggaacaaggtagtttcacaccttcctcaaagtacacggcattatactaacctttcttgaatactatttctatcattctaatgaagaatctacaatggctcccagttcctgccttcattaaagctaaacatttctgcctaaatttcaatgtcttctatggaccaatcctattttcccattgttcatataacctccaatacaggcaggctggactttaactgaatctctttgccataactccatatgatgctatgttcattaaagacttcctttgtgtacgtcttattctctatccagaaggtccttcccctctatccatttaactaaatcatacctagtttcagatcaagtatctactacttccatggctaattcagtctttgttaattattctcttttctaaacttccatagaatttacaaccggcattagacacttctgtattcaatttatgatctcatattgcaagcaattgttttgcaaaatcttttataaatgtaagtaccctatggacaagaatgtcttagagtacctctgaatccactaaagtgcttcattcagtattcaaaacacagtaagggtttgtgaaagttgtcagaatcaaaatgaagtcatttctgtttaaaacaacaaaaaaacaaacaaaaaccaaccctgacaaatggagcaagggaaagccataaagagatggtcctcatgcataaatgcctgatagcgaaagctatcacaaaagactgccagaaccactatcttgcacaaaggccattgcaatcttacatgaaaaatactgcgaggacatctacccagcaactgcctatccaaccacagactggcgcacaaggataagcacttcaaaacaattaggcagttctccccatttttcctttaaaaacctttgtcttcctttaccccccgaatatgcacattgttttgtatagcacctttactcgcactgccctattctaaaataaatgttactttcttttagagagtctttgctatttaggttgacacgttcaatacatattgactttttcatggaattataaaatcaaggacctttacagttagagagaaactaattcaaaccatcattttatatctgaaaacactgaggtccacagaaaataagagacttccctaaggtcacacacctacttaaaagtaggtctgggactaagaaacaagttcttttatttcttagcccattattctactatatacatgtacctgaattatgtttaaatttttctctactcaaatgcttaagttggagatgtaagctcacaatttttaaaagcttatatcaccaccttctattcccagagtcccatataaattattccatccattctagtccaagccaccatcttctcccacttggagcatgaaaatagcctactgactgttcttattgtttccatttttgccccttttagtctcactcacataggcagattgatcccttcagaagacaaatgacatgttactctcctgctaagaactctgcatttggcctcctatcacacttagaataagatccaaaacctttatcatgtccaaatgtgatctggcctatcccatctagtaatatctgccaatcccatctcctatcacattccttcttgctcaccaagctctaaccaagctgacctcctttgctgtttcttgagcattctaaacatgttcttccttttgagcctttaaattggctgatctctcagactggaatgctcatccataaatcagtttgataatttatttaactcaggtatctatttagctgtgacctcttcggtgaagctttttctgaccaccaatctaaactaaagcctccatcattttccattcttctgtattcttcacagtctatatctggcctttacgaccactagaatgtaagtctgatgaagacaagagactgttttaacctctgaatcctcattattaaaacacctagcatacagtaggtacttgataaatatttatttaatgaataaatcaatttatattttcacttattaatcatccaacaagcatttattgtacatcaagtagtacaccagacattggagatgaataagatagtttaattccatttcagtttttagggagtttgagatctaagggaaatctactaccatgtgaacaataagttacaggacaatctattaagtgctacaagaaaagtgttgacagtaaaatgggaataccaagagtagagcctctaactctgcctttagaaagtgaagaaggtctcacagaggaggctgaacttgagtcagctcttaaaagatgagtagactatatatttaacatacaacagatacatttgggtggagtgttttacaactttttacattagaactacactcagacacattccttctcagctcagacaccccaagattgaattaggtgtcatgcctctgtattcccatagtactctgtgcttatgctgattttacagtactgtaattgtctattcacttaccttgtctaaatcccccattagactctcaaatctataagggcagtaaccacatcttgtttacagttgtattcctgatgtctggtaaaaagcaatgttcttattatgtaatttattgaatgaatgttaaatgcctcattatgaggtaatgccaaaacacagaatgaaggacaattttatgaggttctagtaacatgttcttattataaaacatagaatagctattaaagatattatactttgggacaggaaataatgccattaactacaattattcagttgatcatttatttaataatgaaaaaacacttatcaatgagttagaagcactatgctaaggtctttttaattctctttcggctgggcatgggggctcacgcctttaatctcgacactttgggaggccgaggtggttggatcacctgatggcaggatttcaagaccagcctggccaacatagtgaaactccatctctactaaaaatacaaaaaattagccaggcatggtggcacgttcctgtaatcccagctacttagaaggctgatgcaggagaatcatttgaacccgggaggcagaggttgcagtgaaccaagatggcacctgggagacagagtgagactccatcccaaagggaaaaaaaaaaaaagtctcttattaaccctcagaggtgctattattcctcttaggcaaaggaacctgaggctcaaataggtttcataatttgtccaaggtcatacaacaaataagtagagaagcaagaattctaggcaggtctaattctaaagcctaagacctaccttctaattatgtaaggcttttaaactatctacagcatttctcaagccccatttaactcatactacaggtttgcaagaacatgtttcattttccgaagtaaagagatgaagatgattttctatcagttccttttttcaaatctgctggttgaatatcttattttgtcacggttgcaaccagtttattcccaaaacactaactctattttaacacgtgtgagtcatttttctcttatccttgtgagattcaatgctgtgaccattaaacttaacaagaaacataacatctgattggtataaaatagtccttagcctccctatattctacattagagttgaatctacaaagggacaataaagcctgaacctctggattcacacaattggcttagataaaattgtaaaaacattgaattaagtttggaagggattgatcttactgcatattatttttacttacgtagtcaatttgctaaagaatgctaatctaatttacaaattgacagtaaaaaatagcaataaaaatagcatgaacactcaattcactaatgagagggtgacacacaaatagaaattaataaagtacagatggaatgataactagttaaacgaaattagaaaactcacttataatttggtgatggtgttgaaaacttttaagccacagcttttactttttaaaattcttaacttattcttgatattttagattagtattataatttcatttgatactttttatatttttataatgaaacatttatgttttttcaaaattatatttcacttacatatactctgttattcctcacaaaagaaaagcagaagaaaaacatgttgatacttcatagaaaaaggtctgcagaacagatgcttccccactgtagaaagcagccaattccagtaaggaatacaatagcattttcaatcagtggccatcatgtgccaggaatgcaaaacacagtactgatgataatccagtttatgaatcataaaatccacatggaatacaaatatttgaaaacattattaggaaatcctactccactgctaagacatgcttatgctaaaacagcctgagaaataatcagagattttgcattatctactagtagatatttgtaatatctactaccttaaagcattttctaaatactcagtaattgactgaattaaggataaaaagtatttatcacttgtgagactaatttgtcattagtgtcacaaaagacaaatactttagaatataaaattgtttctatattctcaaaatgtttagaatataaaaatagaatatttctcagttaggatacctgtttagtgagacagttagactactccttaaacaggtgtcctaaacggaaaatattctaattttatttttcttcttaaaatgacattaaacacttctttattgcacatgcaatcacataacagcatagtatcagtatcagagcagtgatcttaatggctttcattcaactggacaattctaacgagtatgcattctgctatagcatgaaaaaaatattcttcagaaaaaaacgtgtaaaatatatacttgaaacaattatacaaaaagttgcattatagtggtctaaatatttttaaaacctcttaaaggtgctaattaaacagcaaacaataaatgtaacaaacatactacaaatacatagctgagttttcaagatagtaagggctcaaaacggagctatggtaataagccaaatctaacttgaaggcttctttagaggcatgtgatgatgggggtgggggattagtggttaaataaggtttatattttaacagataaaagggaaaagggaagtatttggattctttccaaagtagaaatgaaacctccacttaaaattgggaattttgaaagtctacatcctcagcaaaaggataggcaagaaacaatttacccagtggcaaaggagatgacaagtcttacctgagctaggtaaggtaggggacagggattgggaagcctccctaaggtaggggacagggattgggaagcctccctttagaatttataaccatggtttaggccttcaattttacatcactcacacgctctaggggaacctcaaactgagaagttaaccaaatatagccccagtaaggtagcaccccaggtgcctgatagaaacaaatacaaatccatattacagggacgcatactgaaccctcaactcacaccattctcagagataaaatctagccaaacgtgaactcactatcccaaagataaatacatgagtaaacaagccactgagaatgggtagaaagaacaaacaacagaattaagatgcccttgctccttagaattaatttagtccccttagaaagctggatcttggggtaaaattagggaagaatagacagtggcattctaaactgcagaaataaccgagaacaaaagtagaaatattccagctagaatggaaagcaatgagtaagtttgattgaattagggaatgtcctacagctcatggatgctttcaacactgggagcccagcataagttgcttggcaaaggagtgataggaaccttgggaactaaaagatgatttggagaagggaaagactggagaaagactagaatcagacggttattactagaatccagatttgaggataattaattagagcctgtactaaaaagggtcatatagtaacagaaatgacaagctgaatctgaaagaaatcaccaaagaggaattaacattttctagaaagtttctaggcagtcaaatataatggatcaacaataactccaatattcagaacctaaagagatcaaactgaatctaaagagaaagttgagagagattttaatttgaataaaataggtaacaccagttatttgtaatcaaaaaatgacttactatactttgtcacttgaccatatgatcaaggaaatgaaatctaattattcattttcccatcaagtaagaaatcaacaaggcatgtccaatgcaactgcaagatgagcacaaaactggggaaaactagggtaagaatctttcacttctttcctcatgcataacggaattcgggggctggtgactgcttgatgctaacatgttaacctaggtcgataaatatattttaatcactgagttagaaaggcaaaaatcaaagggtactatcgtacatttgcttgtatgtctcgaatcatgtaagattcctactaaactaaaaacactctttcctatagcaaggtgaaactactgatgtgaccaacagagcattaccttgaaactgtacttccaactctggtaaaggatagcagttatcccattgtccttgttattaatacacaaggttgtacctgtttgttgtttctgtgttccaagtgaaattgcccacagtagatcaactggtaactctgatccaactgagctaaaaattactgagaaaacatcaaaaatagtctctttcaaatagccgcccttaagtgccacttcaatgtctgacgggctgaaaaaagtaacaaattggtattcacccattaaaaactaagatttacagtatctgaaaatctataaaaagaattaattgtcttctcactgctgtaagtaggtggtctttccctttcactacgaaatcagcttaatagcttatacagctgctgtctttgacatacctgtctttagcaaacagaaacttcatggatcctaactttttgcacattcacaggcatgttttaaagttacatcaaagctttcaggatctccaaacgtcataaaagacttattcatcagtataacaagcctaattggtgaaaaggcatgtgggcaggacttcagaggctccatgatgcaagactgtacaagtttttggcattataggagaagtttccaaacaaaagattaccttacatctcctgtgcacaatactaatatacaatagagtaaattaaaagtaaaagcaaccttaaccgtgacatttcttttttctttcacagccaaaagcatgtcaaaggattgacaaatataaagaaacttataaaatcaaatattttaaaataagaatgacacctttaaaaactgttgtgttcttacaagcagtttataaaacatccacaagagggaaccaaagacaaaagactaaaattccactatttggagatttacacaaataggtttataaaataggttattacattaactaacataccatcaatagctttcagaaataggctaatggtttcttgatacatttttaagcagtgatatatttaaaaatactgtaaccactgtcatgttgatacctttatataagcaatgtttatgttcctcaaggacaacaaatgtctttcacattcagtaacctccacttgcatataatagcatgaactcaatgaacaggtggtgattccacaaaatttatagaagtatacaaaagtaaataatgaatattcatattaatttatcaaaacttcattctaaattgcttttatatgaaaagatttatgattgtatatatcttatgttcttagaacaaatacaactaagggctaaagggtctttaaaaagatttttttcttttcttcattctttctttctctcattccttttctcttccattatgatagtatttttaagagttagcagaaattttgttgttgttctttttggtttgttggtagtaaacagaaattttaatacataaattgtatttttattgtttaaattttaacaacagaaatatcacctacataaacttagatataattttgtaaaataattttagaaaatttccaaaacatacaattcaaaagaagactacttgaaacatgctaaagtaacaatattgattttaacatacagtttacatcactgaacttcctgataaaaatgaaattctggggcagaaaaatgtcagggcaacaaaaaacaatctcccccacaacccaaatatttttcacacatttgacttaagcattgctgaagaaatacttcatgtgcaagtatacaccttattaattattaaatgcaaatacattctgtgttgatgattttgtggctggcactatccttaatgatgagtaaaagtcaggcaaaacctgtttaaaacagttttatacacgtgtttcttgatttgataagtatttaccaattaaatatttatgtaataaatgtttgctgtgtgccaggcaagtgtgttaaggtataatcttttccttgagaaatgtatagtttaatggggagttacaaaatagacaaacacagtgagataaatattctcagagctaaacgcagtattccatggtgaacacagaggagcacttgccaaactgaagcctggaggagccccatgaaaggcttcctctttccagaggaggcaatggctaggatgtcaagacaaaagcagcaacctacacttttctttaaccactttttgagcaatccaatctatgctcatggtttaactaccaactgcggaaagcactgatttcctaatttgcctgagttctcccttgggattcagaccgctgtatccaactgcctgctacacaaaatgacttaaatgacctatggacatcgcaaattaaataactgctaaagtgatctcatcttacacagaaatacgccttggagagaatactgctggagaatacttcagccacagtgtaagtgcaaagtgaaaaaacaaaggctctgactatgctatcaagaagtttagttgtaaataatttgttgttttttcccttattttttaaatggtcaaaggataactatattttgaatgaggaaaaagggcccagaagaaagggataatgtagctgactaaagaaacaagcagagaaggggccttttgagggaagtaaaaagaaaaccaagagcaataaaacaattactgttcatgcatacctctatcacagtacttgctacattgcattatgatcagttatcagtttatttgtctcactcattagattgcaatcttcttataggcaattaccatgtcttatttttcttccatatccatatttataaatgggaaaaatatataacctctgaaccagggagacaaggaaacatagtgaggatacagaaacatattaaagttaaaagaaaactgaggtctagttagtacaataagaaaaaagttataaagattggaaagaaactatctatatttgcagatgacatcattgtctgtgtagaaaatttcacagaatctacaaaaaactcctagaactaataaaaattagtgtgtgtggcaacgtcacaggatacaagggcaatacacaaaagtcaattgctttcttacataccagcaataaatgactgaaatttgaaattaaaaaaaatttcaacagaaaaaaaacccacttaggtctaacatattaaaacatgtacaggatctgtatacactgatgcaaaaaataaaagatgatctaaataaattgagaaacaccccatgttcatgaatttgaagactcaatactgttaaaatgccatttcttcctaacttgatgtatagatttcattcaatcccaataagaattccaggaagttaatttagaaatgttgacaaaatgatcctttctatggaaatgcaaaaggcctagaacagccaaggcaatactgaatcagaaaaacaaaatttggccaggagaagaggctcacacctgtaatcccagcactttaggaggctgaagtgggtggattgcttgagcccaggagtttgagaccggcctgggcaacacagcaagacaccatctctataaaaaatacaaaaattagccacatgtggcagcatgcgcctacagtcccagctacttgggaggctgatgtgagaaaatcacttgagcccaggaggtcaaggctgcagtgagccgtgattgctgtcactgtactccaacctggttaacaaagcaagatgccgtgtccaaaaaagaaaagaaaaggaaaaagaaaattggaagattcagtgtccaatcttaaaacttctataacactacagtaatcaaaacagcacagtactggcaaaagaatacacacatatatcaatgatgtatcattgaaacagaataaagagctcagaaacagacctacacaaatatagtcaacagatttttgaaaatgacacaaaggcaactcattggagaaagaacagtcttttaatcaaatggtgctagaacaaccggatatccatacggaaaaaaaaaaaaaggacccagatatagaccttacagctttctcaaaaattaactcaaaatgcttcaaagacccatataacatgcaaaaccataaaacctatagaagaaaactcaggagaaaatctatgggaccttgagtttggtagtgaatttatagacaccaaaagcatgatccatggaaaaaagctggtatcatcataataaaactaaacacttcagctgggcatggtggctcatgcctggtaatcccagtacttcaggaggctgaggcaggaggattgtagtttgaggctacagtgagctatgatcatccactgcactcagcttgtgcgaaagaatgagaccctgtctctaaaaaaacaaaaggcaaaaactaaaaactagaaatctctgctctgtgaaagacactattaaagaatgaaaaggcaaatcaaaaatgggagaaaatatttgttaaatacttactttataaaggactcgtatccaaaatacacaaactcttaaaaattcacaataagaaaacagacaacacaatttaaaaatggggaaaaatattgaacatacactttgccaaagatatataaatggcaaataagcatataaaaagatgcccgacatcttcatcactaaggaattgcaaattaaaacgagataccactaaacaccttttagaatggttaaaatgcaaaaacaaacaaacaaaaaccctgaccatacaaactactggtgcgcagcaacagaaactctcattccttggttagtaggaatataaaatgatacaactttggaaaagagtttggcagtttcttactaagctgaacataccataagatccagcaactatgatcctagatacttactcaatgtacctgaaaacttatatccatacaaaagccagcatatgaatgtatacagcagctttatttattgataactgccccaaactaataagtaactattgaagatggccttcaataagttaatggataaatgaactgtcatgtatctctgcaatgtaatactattcagtgataaaatgggctattaagccacaaaaaaaaccatggatgactgttacaaaaaacgtagtgttaaatgaaaaaagccagtctgaaaaggctacataatatatgattccaattatatgatattctggaaaagccaaaactataaatggtaaacagatcagcggttgaaagggggttgggggagagttgattatgtgaagcacaatggattttttttaagggtgatgaaactgttctgtttgacagtacagtgtatcatgtgtatcgttttgatgcctaataccatgcgtttgtcaaaactttacatcataaagagtgaacctactgaggcaggaggatccctcgagaccaggagttctagaccagcctgagcaatatagtaagactcccatctccacaaaaaatgaaaaaaaaaaaaaaaaaaaaaaaaaaaagtcaggcctggtggtgcatgcctgtagtcccagctacttgggaggttgaggcaggaggatcgcttcagcccaaaagttcaagacagtgagctatgtttgtgccactgaactgtagcttgggtgaaagagagagacccagtctcaaaagcaacaacaacaacaataacaaaaagagtgaacccaatgtatgcaaaattaaaaaaaaaaatttaggaggtcaggggatcccagggtgaaatgtagaatgtggcaaaaaaaaaaaaagtaactgtattaaaaatatattgaaacaaattcactgaaggaggtgagaagaaaaggtactaacctaagtaactttggagtaagtgaactgtgaattctgttagactaaagacaaaagaaatgatacataagcagtgtaactgataatgttgttttccatgttttccacatgggttaagaattctgaaaccactatacatgtatactggagttgagaaacttagtaaatgaatgataggagccaggtttctcaccattggagttgtaggttataaacaagcaagaggacccatctagaataataatggattagagtcagacacaacagtataaattaatgtttagtttaatacagatacagatgtatacacatacatatatatacacacacacacgtgcctacatatatagttataaatgtgtatatacataggctagtatacacacatatatctccttgcctcataagctgagagggcacagaagcaacaacatcccacagtacaaaaaagtccccctggaatccaaacttgatttcctacagttttccagtaaaaggaagtaggctccttattctagtactggaacaggaaatatacaagatgagcctagaatatcttatagtgtcagagagtaaggaagagctaaaaacaaaacaaaaccgcacaatgatggggatatgtcatagggacaaaggagtcaaaacaaaaggttcccaatggccaaagctggaacaatttaagcaaaataaataaataaataaacatagtagtattggattataatccaaaatataaactaataaccatgagtcaatattgatgcgaatgactgaataaatggggagaagagacaaatctcctgtgtagaaaaaattctaaatactccatcctcaagaaagtggagaataaccccccacttcttaaatgtgagctgtgtactgtgacttccttccaaagagtacagtatgaaaagaaagaaagaataattttactgtaaagaaacatgacatgctacctcagtcatgtgatcctggttaacatcaacagtggtaagtcatgttgacagaataatttactcttgatgtgatgagacttatatttatctctgggtcttttcaaaaaccaataagcctcgtctcatcattagaaaaaaaaatcccaattgaaggacattctacaaaatgtctaaccattattacccaaaactctcaaggtcaccaaaaacaaggacattccgagaggctgcgacatcatgaaccctttctgtgcctggcttatatcatttaacgtcctccaggtaaatacgtgcttgccacaaatgacaaaatttcattcatttttatggtatatacataccatgtgaaattagccaagcacagaaagactaaagaagctgatctcatggaagtagagagtagaaatggtggtttccagaggtaggggaggcttgtagaggctaggggtggtagggagagattggtcaataaatacaaaattacagttaggaggaataagttctggtgttctgttgcatagtacagtgactgtggtcaacaatactgtatatttcaaaatggcagaagattttgaatgttcttaccacaaagaaatgataaatgcatgaggtgatggaaatgctaaatattctgatttgatttttacacaatgtatacatgtatcaaaatatcacactttaccctgtaaatatgtataatcgttatatatcaattttttttaaaaaagagaagcctaaggagacatgatgactaaatgtaatatggtaacttgatgggtcctaaaacacaaaaagaacattaggtaaaaactaagtaaatctgaaaagaataggcactttagtttcaaatctgtattaatattggttcattatttagacaaatgtatcatacgaatataagatattaataacagggaagactgaatgtgggtggtatatggaaactctctaaactatttttctatttcttctataaacctaaaactattcaaaaataaaaagttaacttaaaaaattgagaaaatcctttgctttttaatttgagcaaatatttattatctgttttatcacaaggcccaacactacaacccataagtcagtggttctcacccaggccacacattggaatctgttaggaaggtttttaaaaaaatcctgatgcctaggccctagcctacaaaaattaaatgagaaatttcccagaataaaaatcaagcattgttttttgtttgctttttccaaaagccaccactaccacaaagagaaagctcaaatgatatagcaatttattaaatattttacatactatatcgagtatcacaaatcccaaagaatcatgtttctattagaggtaataaagcatataaactctaagtgattaatgtctacaatttttatattgacaagaactctgtattccattacttcaccaaaaactttttgcagtttcttttcagagtatttttaaaatattttacaaatttcaatatgtatatgcttttaaaaaatgcacttaagtacattctattttcaaaatagcatcatttattcaataatatattttaaactttcatatggcagagacaattcccataaatttgctttatatcatacacaacactaccgtagaatgctccttggtaacaacaaaatgttgcattttgaagctttattgcatagaaagaccaattttgttaatacatactctttaaaggtggacttgccataagcaattcaagtgtttacagtaaatatgaacaaacagatatattatttaatcaactcatgctaaagatttgggaatatcttccactaatatccagaaaacgaattcttactatgtaatacagttgacccatctcaacacctaatttacatcacatactcagaaatgccaaaagaagatctttgtcatatttaacaacacttaaactaacacaaaaactttgatattggattaaccttctacagaaatctctgtttgcaatttgtttaattttagaaatctgtacaattacctcagcacctatcaaaacatgtcaatttgtcaagatacattctcatcagacaagctttttctataataggtataaaaatcaaattcataaggcactatttccaatcatgctccatacttttcttgaataaaaaatattttaaaagatttgtttataatagttacccagggcacaggtgtatgcactaaaattttaaaaaccaacatatcttgtaatggttatcatataccatttcctttttaaaagccacattataaattgatgaaaatggcaatttaattttaggcccctaatttttccccaactgcaataagccaaactagatagaagtaaattaaatttggaaatttttctttatattgttataacccatacattttctgaaaattatgttaagaatgcaggatccacacacaatagacccaagtatcaatacttgatgtgaaatataaatctctcccttaatgtagcagcgaatttcagttctgaaattctgaaatcagagaaaaaatttgatctacattatctaaaaagttagttttatgaaatttttcaatggtccaatgctaaacttgctctgtgtcattatttgctccaccactgcttaaggaccaatccagagtctggactggaaacagctacagtaaaagctgccagagaatacaggtcctctgggctgaaaataaatcagaagcaaaagttggcaatacagatctctcaccatgctgaaaagacctttcatccatgaaataatcaaaaaggagaaaaaagaatggagaaaaatttcactgaaaacaactgggacaccaaaatatccatctaaaactttccgccatatcctaaaagaaagtcagttccccagtaccaaaactaagtaggtaatggccaaatgaatccctcaaactaaagcaaaagaaaaaaagaaaagaaccagaaagtttcatgggccaaaggtaaccaagctaagctgtgaacacaaacaagaggttgcaatgcaacaaccttgacttaacagatacacatgttaagtcaagcacagtatcaattagataacaaggggtccaagcttgtactttcgttccataacctagacaaaattattgtaaaagacacagtggttaagaaaaagaaaaatatcatttatgtctattctttttgttgtgttgttgagacagggtctagctctgcagtggcgcaaagtcgactcaatgcaaccttagcctcctgggctcaagcaatccttccacctcagcctcctgagtagctgggactacaggtgagcaccaccatgcctggctaatttttgaatttttggtagagatggggttttgccatgttgctcaggctggtcttgaactcctgagcttaagctatccacctgccttggcctctgaaagtgctaggattacaggcatgagccaccgtgcctggaccatttacttctattctaatcaactataaatttggatatgatttgctttaattgtcctgattccttgtaatgctaccttacagaagttttcccttccctgcttgtcactttgacaacttgtctaaaacaaatcagaattgaacaaactatgattttttctttgaattgttctaatttatgggcactcaaggagtttgttaatcactgaaatatacggagggttttatagatttataaagagatcatattacaaactcaatatcaaaaattataattttaggccaggcacagtggctcacacctgtaatcccagcactttgggaggccgagacgggcaaatcacttgaggtcaggagttcaagacctgtctggccaacatggtgaaactctgtcactactaagagtacaaaaattacccaggcatggtggcaggcgcctataatcccagctactcgggagactgaggcaggaaaactgcttgaacccaggaggtggaggttgcagtgagctgagatcacaccactgcactccagcctgagcagcagagtgagactgtcttagatagatgatagatagatagatagatagatagatagatagatagatagatagatagactgatttaaaaaataaaataaaaattataattttagaacagtccaagaaattacaaatggcaggagctcccatcaaaatggagattagaacacacaggtttacacctatccctctcaaaaccctctcaaaactacaataaagccacagaaaaggataaaccccaaaagacaaacagcacaggaattgaatagataacagtatatgggagatgtcaaaaatgtggaagctagaaaaatgtttggaagttagaaaacagataaatatgtaagcagctaactcagcagaccaaaaataagacttaagcttgcaaagagaaaagtcacaagaagcatgtgaattcagagtagtgaaccctaacatcttttacagcaaaatttgctggtcaactagttccactcttacacacagagctgccagaggtaattttagtgcttctctcaaatataatccccgtacatttgaagaaagcccataaagtgaaatgtcagagatcaaaacaaacacaaaagaacagacacaaggcagggagcaaaagataactcaaaataataataatgaaataataacgtagaagagaaagctatcttagacattaaatatctgatatgaaaaaatagcaagtttggaagataaacttgaggcaatctcagaagaataaaaagagaaaaagagggaaaaggaaacagaaaagataattgaaagactaacctaaaaggttcaacaaccaaataaaaggagatccagagacagagaggagagacagtgaaaattaccaagaaatagcaaacatgaaatcacatagaactgaagggtgtttccagatttaaaaagtcaaaagacactccatacgatgaatggggaaaagatgtataccaaggcacattattaggaaagttttaaataacagggacaatgcaaagatccaaaaactcccacattcaaacattcaaagaatcaggtatctgaatggcatctatcttctcatcagcattattgctgagcaaggaaaaagagcaaggtcttcaaaattataaaagaaagttattttcaatccaaaattttacacccaatcaatcaatcaatcaattaagggtaaatgtacaataaagacacggtcagatatgcaatgactgaaaaaaactgctgctgtcaggaagctactgggagatatgatacataaaaataaggaagtaaaacaagaaagacagaagacagcatcagggataaagagattacagaagaaaaaaaagaggacattccacaggttgatgttgaaaggaagtcttaggatgacagctgctcaacactcctaaagaggaattagttccgattagtaaaggacagaagactattgaagggatgaatcaataaaaaaaaaaaagtacggcattaataaattgtgtttgaacatacacagaggagctcagagatccagcagagagtttgggaatatagcatttgggaacaaactagtgattagaaaactgtaaaaacaacaacagtaacaaaaacggagacaattattggttctgaaaatcacaaaaagaaataacatgtaatgataatatgatataagtgaacagtatttacacagttataactatataagaatttgttttaattgtgattacataggaaaaattagacataacaagtaatcaattcttttacaagttttcaatttgtggtaaataattttatctgaaatatttcttattaaataaaatttactttttaccatgtaaaggaatgagaataagtaaatgttctttactggttttcctcaaaaaaaaaaaatatgtgtgtgtgtgtgtgtgtgtatgtatatttatacacattttcaaatatatgtatacaaatatacatatctatacttatatttaggaaaaccagtaaagaacaaatacatattacatattaataaaaataaaaatattaaagaatataaaaatatatattgtaaaaatataaatatataataaatatataaatatatatatgttttttctttttagacagagagagagagagataaagagagtctcactttgtcacccaggctggggtgcagtggcatgatcatggctcactgcagcctcaactgcccaggctcaaaccatcctcccacctcaggctcccaaatagctgggactacaggcatgcatcaccaagcctagctaattttgtgttttttaatttttttttttgtagagacagggtttcactatgttgcccaggctggtcttgaacacctgggctcaagcaatcagcctgtcttggcctcccaaagtgctgggattacaggcgtgagccaccgtgcctggcccaaatatatttatttttaattttaaaactagatttaatatctaccaactcttccaaacatatttgaccagttaaaatttgttttaaaatgttttttaaaaaattgaatctatatcagttcacaccagatcagtaatgttattttggtggccacaaggtagggcaaaaccagtaagggcaaccagcaaaaaaaacccgaaaactaaacaaacagaacaataacaaaaacaaaaaacctggccaaaatgttacaacagcagtagtgatggtataagtagtggcattaataaaaacaaaagctaaactttattgagcatactatgtgcaaaacattgttctaggtgtgtatatatgtaattatatcctcataacaactctatttgcagatggtaaaactgaagtagagaggttaagtaacctgcccaaagacataaagttatttgggaacagaactagaattcacatccagatagtatgatctatttttagataatgcaacctcccttttaccaagtaagtacattacaggcttctggactgacttgggctaattctcctgctgttcttttctttacctaattcaaaaggttctcaaaaggtagacttttggccagaaacagtggctcaggcctgtaatcccagcactttgagaggccaaggcgggtggatcacttgaggtcaggagttcaagaccagcctggccaacatggctaaaccttgtctctactaaaaatacaaaaattagctgggcatggtggcacacgcctgtaaccctagctacctgggaggctgaggcaggagaatcgcttgaacccaggaggcagaggttgcagtaagccggggatcacgccactgcactccagcctgggcgagagagtgagactccatctcaaagaaaaaaagaaggtagacttttgaaggtccctattgaacaggggtaaggggaaagaggggaaggcgggggaagtttctgtctaagaaatgctcacctgaaactgtatcaccacctgaggggaatgggttattcaaagcaccctggcatttctccccacacccatgctgagaattaattgctttagtgaagcatgtttaaagagaacatgacattattcagacattaaggaccgcaacctgaacagctctgagttcagaccataagaggtcaccagaaagtcctcatttcttttccaaggatagaagctctaagacatagtctaagaccaattagacttcttttctttgagtcattaataagttaatatgaagtcaaataacacctttcttcagataaaagtaaaggacctgatacatgcataaaagtgaaaagatttcattcaagcttaacatcaaaaagtatcccattttttgctcaacatttcacttaaaattcttctacatccatttaactccttgtattttacttaacattgtgatccttaagaaacgtctgagctccagtgacaagcaattcttctaaactccttatcagtcttttaaagtgctttaaaaatagcatgtcaatgctacattctatgccttatcttataaattcaattaacatcattctgctttgaaaatcatcatccaatgtaccacatgtagaatatttgctttgctgttttacttaaaaacaagtactcttttactgtataaatatttaaaaactcattcaagtacctgtacaatattcaataagccataccagcaaacttacaaattagtattttaaaaatcatcaactaagttcaagaaatacataagaatgaatactgcttgttgtgtaactaccaaattaccaaactgcatgcttacattttgaatactagagttaaactagtactaactgcacaaatcctgtatgcctgctttttatatacacaacctagattaaactttgtgttcatttagtcaaaaatgaatgtaaattttataaaaaatattttacttttatgaaaaagagtatcacttcaatgaaataaattgtcctactgaacatcaagagatgtgtagtctatgataaattagctgatttaaaactgtatatgtaattcaatttaagccaattcacaaaagaatcccaaaggaataaatgatataaactatttaagattctgagccttcaatgtggataaactttcctgagaaattacatctactaattttaaaagttgctaaaaataaatggcaatgtaggatatacatttactgtagaaagacttcagattcattctgcctatctcgttcttttaagtgcttgtgagagtgtatgtgtgtacatattgtatattttctatgcagggcaacaacagataaaataacctcaaaatggaagctactgcctgaaaaaataatctgaagaaagcatgtgaatattgctcaatgtgtgactctccaaactttttacttttttcttataatttcagtaaaaaagactataagagttttacccagaaacactaagctttgccccagagaataaatgtttattcaggaaaaaaaaatcataaaaacctgacataatttttaagtgctcataatatttcccctcaccttgaatatggacaggaccaagtaacatatacctaaaacgacttggtatcattggatttgaaactaagcagtgggcagaagctagaagcactttgaagacagttttagtaagagcctgaagagtcattaaaaaactgtcagaagcctgacagcctttaagaaagtttcaggaaggtaagggaaatattagaaagctggagaaaaggagattcttatgtggtggcagaaaatttagaaactgttgtattagtccattctcacactgctatgaaggaatacctgggtaatttataaagaaaagaggtttaattgattcacagttccacatggctggggaggcctcagaaaatttacaatcatggcagaaagcacctcttcacagggcagcaggagagagaactgctgagcaaagtggggaaagccccttataaaaccatcagatctcctgagaactcattcactatcacaagaacggggtggttgttccctgattcagttacctcccaccaggtccctcccatgacgcgtgaggaataagggaactacaattcaagaggagatgtgggtggcaacacagccaaaccatatcattctgcccctgccccctcccaaatctcatgtcctcacatttcaaaacacaatcatgcctttccaacagtcccccaaagtcttagctcattccagcattaactcaaaagtacaagtccaaagtctcatctgagacaaggcaagtcctttacagcagcactccactacttggtaccaatttactgtattagtccattctcacgctgctataaatacctgagactggttaatttataaagaaaggagacttaattgactcacagtttcacatgaagcctgaggaggcttcaggaaaattataatcacggcacaaggcaactcttcaaagggcagcaggagagagaagcgccgagcaaagagggaaaagccccttataaaaccatcagacctcatgataactcactcattatcatgagaacagcatgtgagtaactgcccccatgattcaattacctcctaccaggtccctaccatgacacatggggattatgggaactataattaaagatgaaatttgggtagggccacagccaaaccatatcaactgttggctataggaaccagaaaagtaacaggaaaagtaaaaaatgtacctaatgaactgggtggtctagcaaagcatgtaagatgttgcctggtttcttcttgctgcttataatcaaacacaaaaggagagagataagcttaagaaacgacaattaaacaaaagagggactgagacttgtcgattttgtaaatctccagcctctatagacagcaaaccatgctacagttatgagacagcttgcaagcaaacctcaaatccaggcaatagtcaggaaattatggtctaaatatcaagctgaaaaggtgactgtaaaatcctttgttcagatttctgacagatccatgcagttcctcaacagggcttctaagaagcttaaaggcattgtccctgcacaatctcatcaagaggccaaaatcagggaaacaattatctcaacaaaatgtatgagtatagattattctaatggagtaagctgcaatgagatttataggagacccacaaagtgtttttggcagaaacactaccagcattgactgcatagcacagagatgcacgaaatgaaaagagggctttggactccaaaatttctaaccacaggaagcaggctgagaaaactatctagctcaacacacaggctaccttccatgaaaaaggaagaactcagtgggcagagcaaaaaactcagagaacacagaaaggagccatgaaaaactatcctgaggtaggaatagaacttagttttaatgaagaaacttctaacatttgcttggctggattccaaaactgctatggaatagtgactcgtgcacttcctgtcttcctttttttttaaacagaactacccataatgatataattttatgcctgacccaccattgtacattggctattcggggtggtgggggtgaggtaagaaacatctcttttgtttataggtcttcagattgaaaggaactggacccaaggaacattatctctatctgaatgtaatttagaagatgacattctagattttgagctgatattgtaaagaaataatacttggggtagatgggatagtgcgtgtattttgcatgggcaaggaatgtaaataaggtgcggccagaggatagtctgagccagttttaaaacataaccataaattctttggcaattctcccctcaaaaggtggagcctcattcctattgccttgagtgcaggccagacctagtgacttgtttttttttttttaattgaggtgaacttcatatacaaaaaattaaccattttaaagtatacaaatcagtggcacttagtacattcacaatgtgcaaccatctcctctatctagtatcacagcattttcatcacctcaaaagaaaacactgtacccattaaggagttgctctccatccttccttctttcccacaccctgcacaccacaactgggccctgtcctggtctctggtaaccaacaacaatttgcctataattcaattgtaagttgtaagagttctctatacagtttgcttttttttttttcttttaaacagatggggtctcattatgttgcccaggctagtcttgaattcctgggctcgggcgatccacccgtctcagcctcccaaagtgctggtattacaggcatgagccaccgcacccagcttctatacattttggatactagacccttatcagaagcataatttgtaaatattttctctcattctacaggctgtcttttcacttcttgataatttattctcttatgcacaaaaatgtttaattttgatgaagttcagtttatcttttttgttatttctgctttagtatcattctctaagaattcactgacaaatccaaagtcatgaagaataaccctatgtttttttataagagttttaaagttttagctcttacatgtagggtgttgatccagccaatcagatcttatactaaaaggctgctgtatttgataaaacataggggtctaacttcattcttttacatgtggctatccagctatcccagtaccatttgttgaagagattgttcttttcccattaaatggtcttagcaactctgttaaaaatcagttggccatagatttatgggtttatttccagactttctattctattcccttggtctacatacctatccttatgctagtactacactgatttgatcactgcagtttcatattaagttttgaaaacagaagtgtgagtcttctaacatggttcttcttttttgatatgttttggctatttggggccccctgcaattacatatgaatttgagaactgacttttcctcttctgcaaaaaatgacctgaaatttggaaatagatctttaaaatctgtgaattgatttgaggagtactgccatcttcacaatataatgtcttctaatctctgaacacaagatgtctttctattgatttaggtcttttagcaatgttttgtacttttcactgtacaagttttttaactccacggttaaatttatattttaggtatttcattcttttggatgctattataaatggcattgtttgcttaatttcctttttacatttttcattgctggtgcctagaaatacaactgagttttgtggttgatgctgtaccctgaaactttgccaaatttatttactagctctagcagatttagatggttgacagataacaaacaggaagttgctctagctcatggggggctgaaacaaaggtatctgcaccagtccctcagggaaccaccagacaggtcaaaatgaaaactacaattttttttcagaacaaggatcttattgtccccgtcctggcaccagtgagctacaccgggaatatgggttgctggccccatagctgctgctgagctagaaaataaaggatattaggtatataagcaaaaatgtcataatgctttcttatcaaaatctggcactcccctggatgctgttaagttttctatcagattccagagttatgcaaaagttgatttgtcagttttttccagtttaacatagttgcttctgtggaggtaactgattcttagagctccttgctccaccactcacttgcttttaaaaactgggccgggcgcagtggctcatgcctgtaatcccagcactttgggaggccgaggtgggtggaacacccaaagtcaggagttcaagactagcctgaccaatatgatgaaacctggtctctactaaaaatacaaaaattagccgggtatagtggcatgagtctgcagtcccagctactcaggaggctgaggcaggagaattgcttgaacccaggagatggaggttgcagtaagccaagatcatgccactgcaatccagcctgggcaacagaacgagactcggtctcaaaaacaaaataaaataaaaataaataaatagaatgtggcagaagtgacagtatttaactcctgagactacaacataaaagacagtgagaggtcctctttgttctctctcttggaccactcactctgagagcccctgaatgagccatcctggaagtgaatcctccagcccttgtcaagccttcagatgactgcagctctgatgaacacttagattgcaatctcataagaaaccctgagaatgaatcacgtaactaagaccctcctgaaatagcaatctacaaataccatgataataaatgtgtgttgttttaaggtgctatgttttgggggtacatgatatttaaagctgagactcaaaagaaaagaacctagccactccaagagttctaagaaaaagagtgtttcaagtaccgggtatagcacatgcaaaggccctgagtaaggaaagatcttaagcatgttaaaaaaaaaattaaaaatctgaaagactagtgtgacttaagctcagcgaaggaaagaaaaatagtgaagaaagagacccccaaaggggcagaaagaaaccaaaattactataacaaagtcttaaaaagtagtaaaaactgataatatatgataaagtgcctttgaaaccacaagaaacaactacaaaaatttaacatttagaaacattaactggagagaaatctgaaactaaatgtatctatcatcacacaggaatccagggtaggaaatatgaaaccccctgagagcaagaaccaagggtctttacatctcccatatcacctactcatctttgtagaattaatgcacaatgacaaacctgaaaaaaataccttttgaagacactatttaaaattctaagtaatgaattcattggtgaaagattttaagtctagaatacaggcttcaagtatctcctcactaggtagtccatgacaacggccaaataaataactcatgtagctgcatatctaaagaacatgattataaatcagctctacaaagatgcacatttctccttgtcctgggctaccatgtgataaaaggttttataattggtaaaaagagtaaaagaatttcaaaagaattcccaactggataaccagtctctgaaattaaaactgaatttaatttagcaaaataattccatttgtatacagaaactgtaagatttttaaaatgaacttttatgggagaacatactgttacgaaatacattttcaatcagtaaaacataaaataatacatgtgttttcagattttatgactatttgaataccaagggttattctcctctatatctttatccagaaaaaaatatataacttgaaacacaaaggcaaaaaataattagcaaggtatagaagcactagacactacaaaccaggtgcagtggctcacacctgtaatcccagcattatgggaagttgaggtgggtagattacttgaggtcaggagtttgagaccagcctggccaaaatggtgaaaccccatctctattaaaaatacaaaaattagccaggcatggtagtgtgcgcctgtagtcccagatactcatgaggctgaggcaggagaatcgcttgaacccgggaggtggaggttgcagtgagccaagatcgtgccactgtactcccgcccaggtaacacagtgagactctgtttcaaaaaaaaaagtattagacactacaaaatgtggtaaataaatacaattattttatttcgttatttaaatgtagtaacatcaatataaagtaaaaggaattaatagctagtttaatatgctaggcctttttatgtcccacctgcaactcctgctatggtacgttttatctacagcatagctggtgaccagttaaaagaaaattccagaagatatgacacaaaactgtataaattcaagacaatatttatttaacaaacccagagttagtatcaactagatactaggtactgtggaagttcatcctatcaacattacattccactaatcactaattcttaagacatcagaaaaagatagcaaacatataaggcaaaccaaatatattttgagattcaatgaaaaaacatatcttacttgtatagtaaaacagtaagtgcttttaatatattttaacagaattacagacaaataactcagaagaaaaaaatcaactttttgaagataattacaaaccgaattttcttcttcctcttccaattctcgttgctgttcctcatgtcttttagctttgatctccatagcttctgtgatcaggtctcttaatattgatacaggtttggcattcttgataaaaggatgctaaaaaagtaaaattcaatggtataaattcaaaagatttttccgaattatagctaacaaatgttaaaacaacatgtaaatgttaaccaggatcacaggcttcaatgattgttttttcatctagaattaaatgtataggttaagaaaagagagtatggccactgcctagaaataaagaatttgctttggggcttgtttaaaaaaaaaacttaaagcacacatgcaaaaatgcaaccctgttaataaaactataatatccttaaagatctaattgtccaaaggaagtgtacattaggagtaaaaaagattaagttaaaaataggattacagattatattacacatagaaataaacttattttggtactgagttacgtaatttaattaatcttaataagttgacagccaaaatcagtggccaaaaggagagcaactattttgttacttctttaacatattttctattttattgtatcttaagtaatttaaccaagacaaaaatattttttcagaaaatgaatgttgcctaatttctttactatatataaaataacttgtcactttttaaaaaatatcaccctgatctagctaaaatagctaagctctctatcattctgacaaagagaaggaaaactatcagaatagacctaggttttgaatttctttttattgagaaggagggacatgagagaaagtagagtgaaaggttataattttggatagataacctaaatttggggcagcaatcagtttcagtaattttcatagttacatgtcagtagatagcatcaggtaaaagtgacctgactgagtgagtgagttatttgtttatttgtttgtttgagacaggggcttgctctgttgcccagatgcgagcacaatggtgcaatcatggctcactatagtcttgacctcctgggctcaagtgatcctcccacctcagccttcctaagtgctgggaatagaggcatgagccactgcacccagccctgagttattttaataaacttcaagagaacacaaaaatatatttaaagacaaaaaaaattgtgctgaagaagaaatagatacttgaaagagggtttaaaatggcaaacatatcatttgggacaactataagaaagaactttttcagagtacagaaatactaaaatcaattgtaaagaaccaataaattattttagaacagttatagattaatcttaccaaacaaattaagtcctattaacatatctgtggtagagactcctggtcatacaccaaaaatagagttgtggttggaccgacaattgcccaactggatcctacgtttctcaacttaacccattcaggtggttatatgcgactaagtgaatgcgggagcaaatactgtgttccacttcctggcctgggctatggagggctccttgttactaatggataagggtgagaggtcaggttctcccagagtcctgtactggtactgtgggaagtagtctcattttagctgattggcgatgaaagtcctgacccttcaccagactgcctctgaccccactccaacagggaggttgttgggttcttattcctgcctggtaggagtataagtctaggctcccacatggtcttcactggcactccccacttagggagggaatactttctacactgccttgtggagatgaatgccttagcatgacagccttctctgacaccgcctgagaaggactggacagcctcaaaaggatagaagtctaggttctccatttagcctttgctggtgaccggggtaggccatagttttcttggtggtgtttggctagagtagaacggttatcatctgaaagttttcagtcttactaggctgtccatttctccgtccttctgcttgaaagagcaggtttttatttctagtttgtgtccaatgttgtttctgggttgttggcttctccactacccagtgtgggataaatgagggaaaaagaaaccccagggaactcacagctatgtctttccttgagtcccaccatctctagcagtctattgccttctttccaccttttagagtctttttatgcttgttttatatacttacaatgtccatggttttagctgtactttaatgaggaagtatagagaaaaatatggttactcaatctgtccagcggcagaaatgccttcttcaactcactttaagcacttgttttatctgaagtgtttttgtataaatcattaattttgaacactatcagtttagaaattgataattcagaacatgaacaaaatttaagaggaaatatttcagattttaaaagaataaacttttcaagcagtctcaatttttaaaatacatcatcaagaatgtgataggttgatctgcagtaatttctgtcttctcattactttaggtggtttaagaatcctcaccctctttaatttttattttagacacatttagaaataggaaaactttactgcctattagaatctggtacattcatctttttcttgttgaaatactttataaaacccttcatataatcagccccttgcctgacataaatatatatatatattttttagtttccgttttttgccattcatgcattttttaagttatatgtattcaaatcatccatttttcttttgctttattgcaccggaatgaatatataaatattctcctatattaacccctagttctttcctatttccattttttgttttagtttttttaacatttaagaccttaatctatctggaaattactttggtgtttctgtggtgaagatctaagttaatcctcccaacaccccctaaaggcaggcagttatctcagcaccatttttactttgtttttccctcactgattagaaatgctatcttcataatatgctagtttcctttgtatattatataccatttgtgggcatttaattctgcttcattattctatctcatactggcgttacatacttttctaagcatttaacaaaaagatgtaatttgtttattaaacataaaatttgatttttctattaaatcaatcactatataattcagatgatgtttattttttgcctatatggttactcagtgactgaaaacggaatatcaaaatatcccaatttatttatttagagcaacctcttatgtctttaatttgtaacatacaatgctatattaatatatcaagtttataactatatcttcctttatattatgttctttatcaatattaagtgactccatcctcatttactgatttctgctgtcaattttgcttttttgatcatgttattcatactatctttttatattttattaaaatttcattgcctgtttttaacttttttttttaaataaaaacagacaattgaaacatttttattaggttaatttcactttttacattactacaacaataacaaaaataccaataccattgaatacaattaagaagtttacttaaatcatattcctcaaaatttggtgtgtatcatcacatgtgttagaatcatgggagcgagggcagagggttacttctaaatattcaaattctcggcctcccctagacaaactgaatcagaatttctaagaatgttgccatagaatctgcattttagcatttctttccaagtgatttttatgcaaaccaaaattaaaaatactgcattgacattttccatcccagtcttctgaagattgaaagttaacagcagggttggggtgggctggggtgggacaaggtcatgggaaatagcagcccaggaagcatcagcactgtcatcctcactgtggtttggatgaagtaccttttcaataagctcttctgtatctcttgataaacagttacatggtaatgaaacttttcaaggttatttccttgagaatacagctaaggcagcttcttgcgtctttccaagcagaatattctgatattattattaatctttatcttgtcttgttctgaaaacaatttgagctatcttatgaaattcatagtctatattagtttaagaagtagatgagaaaataagctcaggaaaataaacctatgggtaagagagagagtgtatgtgtgtgtgtgtgtgtgtgtgtgtgtgtaagagagacagagagaagaaagagagagaaggtaacttagagattaataaatacttcttttaaaaataggagttatttgtattttagtttttaattcaacctaaaccttctctctgtagggtttcacaattttaaaaaagtatgtcttttaatttaacaaaatgcaaacatgtatctctgctagtggagaaggtagtgaaaatctttttttttttaaagtttttttttcttttattattatactttaagttttagggtacatgtgcacattgtgcaggttagttacatatctatacatgtgccatgctggtgcgctgcacccactaacttgtcatctagcattaggtatatctcctaatgctatccctcccccttccccccaccccacaacagtccccagagtgtgatgttccccttcctgtgtccatgtgatctcattgttcaattcccacctatgagtgagaatatacggtgtttggttttttgttcttgcgatagtttactgagaatgatgatttccaatttcatccatgttcctacaaaggacatgaactcatcattttttatggctgcatagtattccatggcatatatgtgccacattttcttaatccagtctatcatttttggacatgtgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttagctgcataaatgtcttcttttgagaagtgtctgttcatgtccttcgcccactttttgatggggttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaaggccttgcccatgcctatgtcctgaatggtaatgcctaggttttcttctagggtttttatggttttaggtctaacgtttaagtctttaatccatcttgaattaatttttgtataaggtgtaaggaagggatccagtttcagccttctacatatgactagccaattttcccagcaccatttattaaatagggaatcctttccccattgcttgtttttctcaggtttgtcaaagatcagatagttgtagatatgcggcattatttctaagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggcctttttcacgatattgattcttcctacccatgagcatggaatgttcttccatttgtttgtatcctcttctattttcttgagcaggggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgaaactttgctgaagttgcttatcagcttaaggagattttgggctaagacaatggggttttctagatatacaatcatgtcatcagcagacagggacaatttgacttcctctttttctaattgaatacccttgatttacttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatatcccatcaatacctaatttattgagagtttttagcatgaagggtggttgaattttgtcaaaggccttttctgcatctaatgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattaggctgtgaatctgtctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctcggatggtagtttgtatttctgtgggatcggtgttgatatcccctttatcattttttattgcatctatttgattcttctctctttttttctttattagtcttgctagcggtctatcaattttgttgatcctttcaaaaaaccagctcctggattcgttaattttttgaagggttttttgtgtctctgtttccttcagttctgctctgattttagttatttcttgccttctgctagcttttgaatgtgtttgctctggcttttctagttcttttaattgtgatgttagggtgtcaattttggatctttcctgctttctcttgtgggcatttagcgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagattcttaatcctgagttctagtttgattgcattgtggtctgagagatagtttgttataatttctgttcttttacatttgctgaggagagatttacttcaaagtatgtggtcaattttggaataggagtggtgtggtgctgaaaaaaatgtatattctgttgatttgggatggagagttctgtagatgtctattagttccgcttggtgcagagctgagttcaattcctgggtatccttgttgactttctgtctcgttgatctgtctaatgttgacagtggggtgttaaagtctcccattattaatgtgtgggagtctaagtctctttgtaggtctctaaggacttgctttatgaatctgggtgctcctgtgttgggtgcatatatatttagtatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccttgtatttttagcctatgtgtgtctctgcacgtgagatgggtttcctcaatacagcacactgatgggtcttgactctttatccaatttgccagtctgtgtgttttaattggagcatttggtccatttacatttaaagttaatattgttatgtgtgaatttgatcctgtcatgatgatgttagctggttattttgctcgttagttgatgcagtttcttcctagtctcgatggtctttacactttggcatgattttgcagcggctggtgccggttgttcctttccatttttagcgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctttctcgaggagtatctttatggcgttctctgtatttcctgaatctgaacgttggcctgccttgctagattggggaagttctcctggataatatcctgcagagtgttttccaacttggttccattctccccatcactttcaggtacaccaattagacgtagatttggtcttttcacatagtcccatatttcttggaggctttgctcatttccttttattcttttttctctaaacttcccttctcgcttcatttcactcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgaacagatgggtttttggtgtggatgtcctttctgtttgttagttttccttctaacagacaggaccctcagttgcaggtctgttggagtaacctgccgtgtgaggtgtcagtgtgcccctgttggagggtgcctcccagttaggctgcccgggggtcaggggtcatgcacccacttaaggaggcagtctgccccttctcagatctccagctgcatactgggagaaccactgctctcttcaaagctgtcagacagggacatttaagtctgcagaggttactgctgtctttttgtttgtctgtgccctgcccccagaggtggagcctacagatgcaggcaggccttcttgagctgtggtgggctccacccagttcgagcttcctggctgctttgtctacttaagcaagcctgggcaatggcgggcgcccctcccccagcctagctgctgccttgcagtttgatctcagactgctgtgctagcaatcagcgagactccgtgggcataggaccctctgagccaggtgcgggatataatctcgtggtgcaccattttttaagcccgtcggaaaagtgcagtattagggtgggagtggcctgattttccaggtgccgtccgtcactcctttctttgactaggaaagggaaccccctgaccccttgcacttcccgagtgaggcaatgcctcgccctgcttcggctcgcacacggtgcacgcacccactgacctgcgcccactgtctggcactccctagtgagatgaaccgggtacctcagatggaaatgcagaaatcacctgtcttctgcggcgctcatgctgggagctgtagaccggagctgttcctattcggccatcttggctcctccgaaaatcttctcttgagaaaagtgaatggacaaataaagatttctcatttccgacaaaagaaaataaccagcattgatttgctatttctgttgttatgagtgcttccaggtggttgtctttggatctgctctgttcctgtgcacctcttcttggaatataaatttctgagcctcaatgtgccctgatgccgttcctttcttccaccgtaagagttaccgaaagctcggcgtccgtgatggggtagagggcttccgaggcgatcgggcagtgtcagtcttcagccgctaagccgagaagatctgggaaggagtcagagagccttgggccagagttccaggggctctgggagtggcggatttgaaattggtgagatgtatcttgggctggtcggtctgaggacctgaggtcctaggtggatctttctcaaggagcaaaaagcaggaggacgggggattgatctcccaagggaggccccccgatccaagtcacagcaccaaatttcatgcacgtccgtgtgaagagaccactaaacagctgtttttaacttttaacccaaattcttttaagtatgcctcatgtagaaacatgagttggattttatgtaagtttgtaagtttatctcatgtagaaagcatggagttgcatttatcttatgaactaagtgaaccatttagtacttaactaaatattatttaaaaaaattaaccacttatgttagtatataattatatgctaatgccattttatcacaattgttttacattatgtaaaacatacatgttttatcataatattctatcataaatgttttacatttgccatcttgttttttctgcattcttttttacgttgctttgcagttttaattttaccacctgctaatcttaaaatgcctttaaaaatatacagatagtccctgacttacaaaggttcaatttaggatttttcaactttacaatgctgcaaaagtgatatgcattcagtaggaaccatacttggaattctgatatttgatattttcccaggctagtaatatgtggtacaatactctcttctgatgctgagcatggaggtattaataagtcccagctcccagtgagctatgcgatcatgagggtaattaaccaatattctatagtgtactgtgttgtcagcattttttggatattgtgttttgtgttttcacattcaattgcgtctacaaaacactcaactacactaatgtatgtgttctgggcacgtttttggtaggctaggctaagctaggataggtgtattttaacacctttttgacttacaatattttaaaccttcattggggtttatcaggacctaactccattgtaagttaaggagcacttgtacttaaaaacttggcaatttgtctgataaaacttctcttctgactcaagaatactcaaataatatggtcttgctcttcatgtacccttttaactttattagccagttcctctttgttgatcaaaaccatgtctgcagcagttatgtagggaaagcatgagtacaaatgaaattggacataccgagattttgagattaagaatgttaagctctatagactaactgtagcataacactatagtgaattgacaatgaattgcataaaagcagggttgtggtaaattggacgaaccagataagtatattggcttttcttaaaaataactgcagcttagaagggtagtttatacattcccctgagaagataaagtataatgtagtttgaattttctatactttgttaaagaaatataattctactggtttctagtttctgtagtgttggtcttctctcacttctgttaatacataatcagtcactaaatccttctcattctttcatcagatttactattttctattttggcaactatttttttaaactcaggtccttaacaattcacacctgtattattacagtgcctcctcattctatttctatactttgttgcaatattatgttatcaaagacattcttttcttacattctcttgtttacatatgtaagtaaggtggctctcagacaaaattgaggcatctcatcctaggcatcagaatacccttcttgcttcactgttgtctgtatctaaactcagacaccacttctctaactggtgtttctattctggctaagcagatcttactgtgttctaaaatacatctcccatttttgtgtctttgttcatattgttcataccatttctcctccctaaaatgatctgcttcttctgtatgaggtatctgtgattaccatatccattcttctacttttacatttcttaatcatataggctgtgcatcatgaatgtaacttctacattgtattataattttttaacatttttgtctttcatttctcaaagaatataacttcagttttttgtgtgtttttggggtgtgtgtgtgacctttctactagtttgtcaaaaatgtttagagtaggacaggagtcttttctttcttattgctctacactcctctaggacactgtctttgtctttacagttgtttgaagttgtgttgtaagtacctctgttttccaacttgataaaaagggaagagatcatggaagactgctcactgacttactttatttatttatttatttatttatttatttatttatttatttattttgagacagagtctcactctgttgtccaggctggagtgcagtggtgcgatcttggctcattgtaatccctgtctcccgggttcaagtgattctcttgcctcagcctcccaaatagctgggactacagacgtgcaccaccatgtctggctaatttttgtatttttcgtatagacggggtttcactatgttggccaggctggtcttgaactcctgatctcaagtgatccacctgcctcggcctcccaaagtgctgggattacaggcgtgagccacggtgcctggccacttactgactttagaatctcggctgcccaccagcaggtataaggatcatcttcagatcaggaactccggtgctaatagactgaaactgaaccttgtcttttaacatctccagggttttaatttatctttaaaaactactaaaatttcaatttaataatctcaaaggatccttcccttctatgatttttaaaaatgtatacaataatctatctgtgtcatagaaaatcaatcactattttaaaaatccatcaggaatttctttttaaatattgtttctttgtttactggaaatgaatatggtataatctgtacacgtaagctatagatatatgtcaactaaaatttggtaatcagattgtccactgagagttaaactatgatttaaattaggggtccccaacctccagctgcagactggtacctgccttggcctgttatgaactgggctgcacagcaggaggtgagtgagcattacagcctgaactctgcctactgtcagatcagcagtggtattagattctaacaggagcacaaaccctattgtgacctgcacatgtgagggatccaagttgcatgctccttatgagaatctaactaatgcctaatgatctgaggcaggacagtttaatcctgaaacaatcccaactctgctcaccatccatggaaaaactgtcttccatgaaaccagtccctggtgccaaaaaggttggggacaactaatttaaatcataacagataagacatacaaaactccttgaagagacagaatggttcctaggcttcctgctaaataagactctaatgaggccaaagataattatcctacccccccaaaaaaaaatttaaatcagaagtttgttaggttaaatacacacatattaactttaatatgtacaagtactggatactaggagtccaaaggtagtaccctttggactactttaaaatacatatatatttcagcagggcgagatagctcacgcctataatcccaggaatttgggaggccaaagtgggcagattacttgagcccaggagttcgagactagcctgggtaacatggcgaatcctgtctctacgaaacagacaaaagttagctggatgtggtggcatgcatctgtagtcccagctactcaggaggctgaggtgggaggataggtggagcccaggaggtagaggtttcagtgagcgagatcatgccactgcactccagcgggggcaatacagtgagaccctatctcaaaaaatacatgggccgggcacggtggctcatgtctgtaatcccagcactttgggaggctgaggcaggcggatcacttgaggtcaggagtttgataccagcctgatcaacatggcgaaactctgtctctactaataatacaaaaattagccaggcatggtggcacacacctgtaatcccagctacttgggaggctaaggcacgagaatcacttgaaaccaagaggcagaggttgcagtgagccaggtgccactgcactctagcctgggtgacagagtgagataccatctcaaaaaaataaaaaataaaataaaatatatacacacacatataatatacatatataacacatacatatatatttcaaatgaatattgacaatatttcaaaataaatgttttaatcaatttttgtggaaaaataaaattttaccatcttaaccattactttttgaaaggtagtatttgcacataacccaaatcgcaaaagtctcataaacagttttcatcaaaaagcaagtctccatcccagtcctgccccatccatagttagttaccttttctggaggccagtttcttgcttatttttccagagatacttcattataagcattaagatatgtatatatgttgtgtgtacataggtgtatttttccagtaactctttttcttgtactttaaattgtttccaacttgttgacagacatttaggatctttccaatcttttacaatttcaatgttctacgaatatttttacacatgttatttcacacatggttaaatatttctgtagaataaattcctagaagtgcaactgttggatcaaagaatatatggatttttattttaaatagatattgctgtactggcatctatggagattgagtaccaagttacactttcataacaataaacattatacttaagagcctgttttccatacccctcaatacatccttttggaaaaatgggactttggaaagttacttttttttttttttccttttttctttttttgttcttttaacccaatggttcctttagagacagggaagtccctttttacaagaaccatgtttttcatccttttgtcacttaacaatagaaatcatttagcaaatatcaagttttgttaatgtgagacatacttattattagctgaaagttctaagactattctgttggggaaattaagattcacaaacacctattataaatattaaattatttctatttgcattaaattttaaggtagattttaaaatctactgacattctggatacaaagtctacttacaattattctatcaaaaaaaattgaaactctgaagctcttcatttagataatcctgtaactgatatttacaacgtgataatctcttcaaggagtccagggatcttgtacttacatattttatggtggagcaaaaagtcaaaggataaatgctgagtcaaggaacagaagaaaaaaaaaacatgagaaatagtaactatgaagacaaagattcctttctgaaaggagaatgctttggaaattttgttttaaaatgactctgggggaaatgaggggacgagaggggaggaaagaaaagaagggagcaaacaggaggggaggggaggtttacatctttagaaatcagttatgaaacacacagcaattctggccaatgtcagaaagctgaaaggtatgaagaaaatatccttcccttcgaggcacaagcactgacctgtaaaagttgtgttgcagtagctctctgctcaggattcttcaccaaacactttttaacaaaatcggtgaaatcatcggaccaaagttctggctttctgaatgttggtggtggatttgtgggaatcataaaaatagcctagtacaaatgaaatatccaaaagacagtaagaatcacactagcacaatcaaataaacaaatctctttatctgtctttttatcagactctaaatttgaaaaacaaatttaagctgttctaggatttctagtaacactgaaattcaggaagccagtccatctgctactaatgtaatcatttcccattaaatttcctctatttgaattgtagctcattgagcacatcattctttattttacctattacttttttttatcagtctctaaagaagactatatttctgacccactaaggactttccctaaacatatatattcccaaattttgctactacatgccagatttacttcttgtttcagttttatataagcattgctgcttaaaatgggtagtaggagtccaatttgcttttgcaatccagaatatttaagtaaaattactgctataatttgaaataatacttgacagagccaagacttttctctttttaaatatgagtcaaaatttcaaatgaaaaatttcaaaggtaatatactactttaatttattactaatgattgagtacttataatttagtggtaatgataatacattcagaaacctcaaaaatcaaaagccataaaaagagtccatctcatctctcgcctcctagatagtcaccctggcctgtttttgcttttaatctgagtatgtttatgacccaagaagtagattaaaaaaacaaaaacaaaaacctgaagacattctaaatatgaaatacaagtcagttagggggttaatgtagatgtcccaacatgagtaataaaatgttcaaactagaatagtatctacaggaatgaaatggaagaaatgaagcatgagatacttcaaaggaggaaccaagagtacatgctaataatattgttttggagaggtgaaaaaaggaagcatgaaaaattactccagaattcaagaaataagaaataggtaccttaaattgcaaggcactcaggtattttaataattgcctatatcattcttttgaatgccctcagaatatgcagccatttaatataatgcattatcattggtttcttacttggaaagtgatcaaatggactttctgtggacacagcagcaaagactcaatatccaagtctgttgattataggttaagagtcaatctttttaccagtatatgcatcttctttcaaaaaacgtaaattctttaatagattagaatattttatatacctcacgtcatgttatacatattacatctatgatagtctttcaaaagcagtgtagccagtattacaaaacaataaacatctttcaatcaaacaaatatttataaagcatttctgtgtgttcagaacaatgctataatttagaggtatcaaaacaaagggccacaggccaaatagtgccagtggacctacttcgttcagacaaaatcaatctcacattgccacaagatgaatctgctgtaattagactaatttaaactaggacatatgttcttccttttgcgtgagctctatctagcctggctcaattatctactttatgtgatggtccctttaaatatcagaccttataaacccggctattacagtttttaaaataggatacatatctcagacccccagagctcacagtcaacttgtgcagaaaaaaaaaaaaacacatatgaaacgaatagcaaacaactgagtgccagacaatgaaattctgcctgcaaataacctaattaatctcagacagctccacagttgaggcagaacctaataaggctttaaaaaatgagtaaaatggggttaaaagcagctgctggaaaaggcacacaaaaccacctgctacttccaactagagaataaaaataaatttgaactctcatctctgtgaaacagttcaaaggacttacataagcccctatatagactgacctcaaactgcaggtaaattatactagattgtctagataaatattgttcatctgcacttctgttgtaaactggtggataacacaatgatttatgtccttgaagccaatgctctcctttgaactttgaggcaatgagttgcagtcttatcttgagataatcttaacatataaggctcaccttagcagtagctattagaaacccaaggataaaaagcttaactctaactcttatttacccagtactctcataaagtgaacctaaaatgtcacattctaccctcaaatatgcattgaacaagcatgaacaccgagcatacagtccaaacaaataagtcttagcgtatgatctacaccaaaatgtctccaggaaaaccactatgccatttatttccattttttaaggttagctcatcaataatagattttcttgacagccttactgtactaatttaactaatttaacctaataatgaaccacagaggatcctcttaagaatctctaggttttatatgagttgattaggtattaggccccttctatagaaagttttggcaatcagtggctcactttagactaacaattcattcccttgccaccaaccaaatcacagggacacacattacagccatataatttatcttatctctaacaccattttgattgaagaatgttagtaaaataaatgacatgattatccttgtgtttgtttctacacaatgtgttgcttaactacataccaaacctctgattatgtttctaaaagaactactctgatcacaagcagtttaataacgcaagaaatctaggtgcttcaaaacaactaattatcttcatgcctgaaatgtcatgccttagactgcaagagtacccaggagatgtggaaagggctgaaaatgagaatcaacaatgactgaactttataatctcagtggaatgagtcaacacatgtctgactctacagcagctgagtctgtgaatgtatagaagtgatgggcatgccagaataacaaagaaattcatgctattatttaagaacctcagatatatgagcaaaaggttatcttcacaacaaataaatgagataaaggatgagaaaacactataaaactataaagaagtaaacaaatatagctgtttcctgatagcaaacataatacacaggtaacaagctaaataaaattttaaaataatttctggaaaggaaataaagtaattacactaatttataaaagacagtacaaataaaagcaaacagtacaatgtgatgaggccaatactggacatgagtcagaaaaactggcttgagttctaaatcactacctgactgtgtggctttagtatcattttgttttttttttccaagtaaggaggttgaactggatgtttatcaggtcccgtactgggtataaaaagaccctggcactctttaccacgtattaaaaaaccctggcactctaactgcctagcaattgaagggtaaaattatactaaacaagtattaaattgctagttaggaaagggatggagaagaggaaaaagagggaaggacaggaaaaggccttttagatgttaatataaaaatgtgaatctaggccaggtgcagtgactcatgcctgtaatcccaacactttgaggggctgaggcaggtggatcacctgaggccaggagttcgagaccagcctggccaatatggtgaaaccctgtctctcccaaaaaacaaaaattagccaggcatggtggcaggcacttgtaatcccagctactagggtggctgaggcagaattgcttgaacctgggagatggaggttacaacgagccaagatcacgccattgcactacagcctgggcaacaagagggaaactccatctaaaaaagaaaaaaaatgtgaatctaaatttttatcaccattccctcaaaagcaaatatgaaatatacagaaattttgaagagaatagtaaatctaaagtgaaactttctcctataataaagtttccacagtaagcacagagttaaagtattgggaacatgaactcacaattcactccagttccagtagcaatcattaatctggccaagaaaggccaatgtgccagcctggaaaccaaattaagggagagggtgcagctggtattctggaagtacaaagcaaataagagaaccagctctagatggcactgggtacataacagcaccattattagtaactatctgacctatttaactactctatgcctctgttcccatatcttaatatgggaatgttagggctgttctgaattttaaatagattaatacatgtaaaacacttagaatagtgcctggcacaattgtaaatgctcaataatgtgagctattattaacctaattttacgactgaggctcacaagagtaagctagcttattcaagatcacacagctagtaaagtgaatgtcaaaattagaacaagtttgattccttagcatatgctacctcacattaccactgcttccatcagatttctgctgcacataattttattttaagataaaggctctgttatatacattcagtctctagaaaaaagtggaaaagtatttgtaacaaagaagattatagttttactgtctctaacggtggaaaactgaagaaaaaaaaagtcaaacaattgagggtgctaagtaaactatatatgaataacataaagtaacatattgccataaaaactgacaaatgtgtgaattacaaaaccacaaagaaaagttcttaaaaagcaaaaatgagggagtaaaacagtaaagactgctttcacataaaaatgactagtatgcagcaataaaaactaaaagatggtatagaatcttaaaaatttaaactgtcaattcatagcagcaattatgtacaagattgtataagtgtctttaaaatttatttttactatgatggtttttaaatttttttttacttttaaaaattatacttgcagctaggcatagtggctcatgcctgtagtccctgagctgagaggctgaggaaggtggattgcttgagcccaggagctcaagacaagcctaggcaacacaatgagatcctgactctatttaaatatatatacatatatttaaaagtatttaaaaattatactcgcaattgcaaaagcttcatttgataccaccccttaagctgtcacctattccagtctgccccacaaccacctcttactcatgcactatttaaatcccaatacaatcaattgtaaatcttaaccatctttcaagactgaaatataatatccctttaatacaatccaacaatatcataaaacatggctgtagagaaaagcaaaagtgaacaaaagccaacacttaaagaactttatcacaaatttcactctctcagatagaagtcctatgatcagttcaactgacttttgtaagcacataaatgtatccatacctgcaatatattaacttcttcaagaaatttagagtctaatggaatataaaaatgtatatcagatcattttaataaaatagtgtaagtgctcaaatacatgtgagcaataggtattacaaaggatgacttagcccaaataggtatgtgagctaaatgggtatgggaagatgagatttcagctgagtcataaagaatgagtgagtcagtgaagcacagaaaggagaccagcatcttctcagttgtgaagtttgaaacctcatggagctgtgagagaaactgacttatttcagatgtagggcagggaaattacgaggtgagccaaaggcatcttgttgcccataaagaaagaaatcactcaaatactaactggatcacatcagaagttcagcacttgtagaacttagtatcagccataaaagagtctgatttaactgatctggggtgacgacaaggcacaatattttcttacatctcccaagcaattccaatatgtgagtaacatggagaaccactattctaaaatataaaatacaagacaagtgctatcactgtttaatatctcaacttcagaactttccatattttaatattgtactctgattagttataaactcattctaaatgccctggataacatgaaaactacctgaaggcaagacagtgtcttctattgtctgaatgtttgtgtctcttgcaaaattcttatgttcaaagcaaatcaccaacgtgatggtattagaaggtggggcctttgggaggcgattaggtcataagggctccacctttgtgaatggaattaatgccctcataaacaagtccccacagaaccatctaatcccttctgccaaataaggacacatagaaggtgccttctatgaggaacaagccctaactagacaccaaatctgctagcacctagatcttgaacttccaagcctccagaactgtgagcaatacatatcttttgtacataaattacccagtctaaggtattttgttatagcaacccaaacagactatacaatcacttaagttttatatgtcaactgcattaggcatagtacttctccatagtaaaacctaaatttatactgagagtgttgatataaagacatccagttaagtatggtaactgaacatactgatttacttcaactccttccccaaaatcctgctaaagtacagtaagaattttaaaaaggcttaacctccaaagagagaagggcaatagaaaataagagacagcaataaaattttggaaatagaaagtagatgaaagagtcataactgactcaaaagatctgagaaatcagtaagaagcacatcaattccctccaaataactaaaaaaaaaaaaaaagcctaagaacttggaagtaccaaatatatctaaagatagtggacacctgtaacaaggagcacacctggtaccaagatcttggcttctaaaatgccaatccccagtaaaagaaacctatgctccttgaggaaatgactaatttcaaaggtcaaaataggaaaatcacaaggttagctctgggtatcttgctaggccagaaggtaaggaaacactcaaagattaatggtattatgtcaaaaggacatataaataaccaaatttaggataatttgagcatcaaaataataatagtaataatgactataactgattataacaaattgaaaacaattagtctacagtgttttttttttttatttttgagatggagtctcgctgtcacccatccaggctggagtgcagtgacatgatctaggctcactgcaacttctacctcccaggttcaagcgattctcatgcctcagcctcccaagtagctgggattacaggtgcccgccaccatgcctggctatttttcacatttttagtagagacaaggtttcaccatactggccaggctaatctcaaactcctgacctcaaatgatctgcccaccttggcctcccaaagtgctgggattacaggtgtgagccaccgcacctggcctatgacaatatttttcaaagagtttaagaaaagctgttctttatagaaaaattctaaaaatacacagtaactgaaatacagtatcaacatattgcaccctcaatgtaatttaatgatcaattcaggcaaggaacaccaatggatacttgagtttggatatctgtcccctccaaatctcatgttgaaatgtggtcctcaatgctggaagcggggcctgggaaggaagggaagaaggaaaggaaggaagaaggaaaggaagaagggaagggaaggagggaaagatgatgtagagagatagaatgaataatgcccccaccccgcaagatgtctacgttctaatccccggacttgtgaatatgttactttacatggcaaaaaggattttgaagataagattaagttaaaagtcttgaggtggacagattatcctaaattatctaggcaggccaaatgtaatcagaagggtcctaaaaagtggaagagggagccaggagagtcagagggagatgtgagtttggaataatggtctgctttgaagcagtcttcaaataatgctgctttgaagataaaggaagagggccatgagccaaagaatgtgggcagcctttagaagcttgaaaaagcaaggaaacaaattctctctgagatactccaggataaaaaagcttccctgccaccacttcagatgtagcctagtgagatatgtgttagacactgtattttggaaagctccaaaataatctcctttgactccatgtcccacatccagggcacactgataaaaggcgtgggctcccaaagccttcagccactccatccctatggccctgcagggttcagcccctgaggctgctctcatgggctggcattgggtgcctatgggttttccaagtgcatagtgccagctattggtagctctatctggaggggtctggaggatggtggccctcttctcacagctccaccaggcagtactccagtgaagactctaaccccatatttccctcttgcattgccctagtagaggttctcatgaaagctacagccctacagcagacttctgcctggacattcaggcttttccatatctcctctaaaatctaggctggggttcccaagtctcaactgttgccttccttttagttatgaaaatggctgcagctggcttttgcaccctcaaataagtttttcttttctaccacatggctgggctacaaaattttcaacttttatgttctgcttcccctttaaatacaagtttgagttttacatcatttctttgctcatgcatatgggcacaggttgttagaagcagccaggtcacctcttgaacactttactgcttagaaatttcttctgccagataccctaaatcatcagtctcaagttcaaagatccacagatccccagggcaggggtaaaatgccactaggttctttgttaatgcataacaaaagtgacatttgctccagttcccagtaagttcctcatctccatccgagacctcatcagcatggatttcattgtccatatcactatcaacattttggtcacaatttaacaagtctctaagaagttccaaactttccctcattttcctgtcttcttatgagccctccatactcttccagcctctgcctgttacccactttcaaagctgcttccacattttcaggtatctttatagcaatgccctactccttggcactgattttctgtattggtctattctcacatttcaataaagaaatatctgagactgggtaatttataaagaaaagaagtttaactggctcatggttctgcaggctgtataggaagcatagcagcttctgtttcagggagacctcaggaaacttacaatcatggtggaaggtgaaggggaagcaagcacaccttttttttttttttttttttgaggcagagtttcactcttgtcacccaagctggagtgcagcggcatgatctcggctcactgcaacatccgcctgcccatttatggtgataacaacttcttcctctcttacttcctccctctctgtcttcgccctgcccccagctatccgtctatactagttttctatttctgctgtagtaagttatcacaaatgtagtggttcatacaacacaagtttattatcttacagctctttaggttagaagtacaatatggcttggctctgtgtccccgcttaaatctcctgtcaaattgtaatccccaatgttagcggtggggcctgatgggaggtgattggaccatgggggtggagttgtcatgaatggtttattatcatccccttggtgctgttctcatgatagtgagttatcataagatgtggttgttaaaagtgtgtagcaccttccccctttctctcttcctcctgctctagccatgaaagatatgtttgtggccgggtgcggtagctcatgcctgtaatcccagcgctttgagaggctgaggcagtcggatcacctgaggtcaggagtttgagaccagcttggccaacatggcaaaaccccatctctgctaaaaatacaaaaattagccaggtgtggtggtgggtgcctgtaatcccagctacttgggaggctgaggcaagagaactgcttgaagaagctgttatctccataaatgggcagtatcaggctagtatgatactgctgtagtgccatcagtatgtggtctccaccttccaatttacttcatggtttaagatgggtggttgaacattaccacacactgactccagaactcaaaaaaaaggggaagggaatggcaatatagagtattaatcagatctctttacccaggctccctggaagtccaacacaacatttctcttttgcagtgttctgaacacttttgaagctcttttccaagaggctgcaaaagcccatggaatttccagagatataaatgtctttgttatgctaaggagttgacacatgccaactgaagcccctagatagcttcaggatacaggatggtcagcagaaagaataagcatgtaattagcaggttagtatatttagctgcctgacctctggtgagtggatactaaagactgagctcaaacaaatggccaaaggtttaatcaatcattactacttaatgaaaccccagtaaaaactctgtacatctaggcttagcagagcctcctggttggcaaacacattcacatgtcctgattctacaaaaggaagtcacacaggctctgtgttccctctcagacaatcatatgggtctcttcatttgactggtcctcctgattagcatcctttataataaacctgtcattctaagtatagttctttcctgaattctgccagtcattctagcaagttatcaaacctgaggggatcaaaggaactgctgaatgtataaccatttagtcagaagtatgggtaacctagggacaaattaagtgtagctggtatctgaagagtggtcatgttggggatcatgcccttgaacttgtggggtctgagctaactctggatggttagcagtagaacagaaccacagtacactcaatttgtgttgaaatagaatactgtaattcaggtggtattcaaatgtattttcactgtttttcaaacatagcaaaatagtgaaattgataagcaactgatataagaagcactttttagacaaaggtgaaaaatactgtttctctaacagcttttctctacagttgtggttctcgaggtgttcatgaactccttcactgggccctttcagggatctaccaagtcaaatctttttttcataaaaacactaagccattcttttcctttttctctcaattgacatttgcactacaggtacaaaagcaatgacagataaaattgctggctccctagcaccaatgaagacagtggaacaaaactgtaatcattgtattcttcattgtcatgcattcacaatttttttgaatctgtgaattcacaaaaaagacacttttgattaagaaaatccttgatttaaaaaatactctttttagcaaatctttttagcatctttttagcattttgtagtgaaatgagaaatacgcataaactatacctgctacataatgaagtacaatggttgtctcaaggaaaattatctgtgattaaattgcatgttgaactacagcttttttcatgaatcatctttttcatttgaaagaaaaactgagagataaactttgattattcagatttggatactcaacagacattttctcaaaaatgaatcaactgaacctatgacatcatggaaacacagatggtttttgataacaattataaaatttaagctttcagttgaaaagtcaaattttcaaaagcttctatctgccaccatgaacttaacagtttcctagtatttagaaacttttctgatttttccaaatgacaaatacatgacattacccgttcacatatgaataaagatctattccaagtacaagatagagaaatagattttaatgtaacaaaatagaaaaactcactactatggtttcagattctaatactggaattaatctttagaaaattatcactgttgaattttggtgtagtatgaaaggaagaatatcataattaccagaaaacaaatgattagaatattgctccatcttaatcacatatcatatatgtgttaggccagatatttttcatacatttccattgaaataatgtgttacaacactcacaaataaaaaaaaaaattcaaccatcttctattaagctatccactcattatttttatgaaaatagtaattgattcatataaacaaaagctcttgggtcctcaattctttaaagtgaaaaggactgctcaggccaaaaagcctgaaaaccactattctatagtgaatgcaaaccagggaaactaacaggaatattttcttctgtttgatgcatgttcaccagcaacagtaccacaaacttgtttcattttatattatgtccttctaatttgtttacttttttacatatttgaaattttaacacagataaaatttggtatatagtttattttttctaagtaactgtattttaatatgcctgaaaaaataatgaagagacatggttcacaagacatcaaaagagcatccagaaaaatgaaattggtaatgtgtctccattctgtccaagaggatgccctggaccactaaaaaatatacctggtccttgcaatagataaattcaagtggtagacacggatgagcatagcttgatgcagtagtcaataagatcatccaactaatcaccttattctagtaaccattttcacctgacagccttctggtcaaaatttggattcccatgtaaaactgacttcagaagagaatatggtgatgaacatctgattacttgagggttaaatatctatttttaaagtaataaattggaattttgatttgtatatcagtgaacttggttaagtccatcctatgagacagttctatatttattacattggcagatcggtcttcgaataataaatgctgctctgtgatcttgtctgggtagccaactgatcttccttagaaaatacacaaccacaacccttccgcaagcattatgctcatactacatcactgattacctaaattcacaccctgacaaagaagagggctctgccaataacaaagcatattaagttatatatttcagaataacggaataagagtgaaactttactaagaatagtgaataaaataatattttaaatgttaaataagttttgagataaggccttttaatgtttaattttagaataattctaggcattttaacagcataataactcctcaaaaaaagaagtgtatggtttggatgtcactttaagccatgaaatttttatctcagctatttaaataaagtatctcatctgaaatatggtacaatgtatactttacactgcattagctataacaataaataatggatcataaacatttacatataaaaagaacaaaatgaaaggtaagactatgcggaaaaaatactagaacaaccactagaagtttacaaaaaataagaagacagtacaaaaacatcaataaaatagattgaaaaataaagctgatgaactaattgccttgaatgtatcagaaaacttaagggaagacaaaatattagaaatcagtggccaggcatggtggttccgcctgtaatcccagcactttgggaggctgacgcgggtggatcacgaggtcaggagatcgagaccatcctggctaacacagtgaaaccccgtctctactaaaaatacaaaaaattaactgggcgtggtggcgggcacctgtagtcccagctactcaggaggctgaggcaggagaatggcatgaatctgggaggtggagcttgcagtgagccgagatcagagatcgcaccaccgcactccagcctgggtgacacagtgagactccgtctcaaaaaaaaaaaaaaagaaataattgacatatatcagataaactaattgcatgtattatcaaaacaatttcagaagcatgataaaattaagaatctggaagaaaactttcatagtaacttatcttagtaataaaacagaaaatgaatcagagcttcaaaagcaagaaagaagaaccaatacccccatccaaaggaactatctggaatgtaccaaaatgtttcaaaacagaaaaaaaaaaaccatatgattacaaaatgagaaaaaaggaaataatgaacaaaagattcatgtaatgtaacttagtataatttgaccataagattagggaaataaattaatactagtcattagcagtttttgtatcatctggtaaaagagttccaaggacaagaagttcaacaccatgaagtactattagaagatcagaatattatatgcaatactgcctagcttcattttaccaaagtgcaacaataattcaattcaatccaaagtaaatcaatagcatccattgattttctttctattctattcccacctctgactcctaaaacagtgcggcacacacgtcttagctctatcccagtgcccccaccaccatatgccacccttgcaatagctgtgtcttgtccatcactagcctggtgcagtctgtcctaatgaggaaaagcagggaagatgcccgcataggctcaggaccatttaaatggggaatcctgggatcctgggtctgcagagcatgatctaggagggaaaactatgggctctagcacagagatgtagcatggcccatgcagggcataatctttgggcaaaggctccagttaccgggcctagtgcctataattgacatactatcctcaaaattatcatttagcataaaatcatcctgattcgagttaaaatattatgtcactttacaaccaaagtgcaaagactaagttgttatagaatctgtgaaagttaatcaagtaatcaaaacatagtaaaatataaaaatgctcattataaagaacacatcattcaaaatccagtcatatctaatagagactacaaaacttaagcagatgtttacacaaaggcctataaactcaaactgatacaaagaactgggttaaagctaaacaagcagaggtcagcacagagctcctgtgattgaatcacaataaaacaatacactagtcctaagatagcaagaatatgatgcaataagtgaggctctggtcccaaaacagtataatgcccagtacaaatcaatttcacaaaaatctataatagaagtcaatgtaaattaggattaagaaaatcaaaattaacaacaaaaaatatatgaagaacaaaaaagaaacaactgaaaatatgaaaagtttataattaaaaaaagacacacagacatatatacatacatcaaagtctacaatcagaaaaaaacaatagatctcagaaatttagtgtgaaatttaagagtaaatagtaagttttagaaagaaaagaaatctgtcaacacagcccctcattttcgtgcctagggaaaataaggcttaatctacagccttggccaaatatgattgccagataaataaacccttagattctaccataagttaattaaaatgataaaaaaaaattcatatattagtttctaactccaaatttctttaagaaaaccttatgattcacaagcaaccaaccaattccaaactctatgccagtggttcttaacactggctacatattagaatcacctgggaagcattctaaaattgcttattccctgaactcaacccaaagaatctggtgttgtctaggcctaggttggttggtttttaaaaaaatgtcctatatgagtgtaaggtgtatcaagggtcaaagatcactgcatgaatcaaacagtatggatccaaattcccactacatttagcacaagtttggggaataaaaacttaccatttttagagacagagttcataaatagaatgggagaaactaggaaaactaattcaggggccaactctaggcaacaacaatcaaactgttccccttgctaaataaataaatacatatatagtatataaaatatatataaatatacatataatagacatttatataaatatatatgtgtatgtatgtcactatattttatatttcatctaaaattccataaattagaaagtcattgctgtttaaaaactatgtgtaacttctgcttctaggaagatagagtagatgtacattttcctatttctctcgttaagtacaaccaaaaaccatggacattatgaataaacaagcatacgaagatccagactgggcacagtggctcatgcctataatcccagccacttgggaagccgagtggggaggactgcttgaaaccaggaattcaagaccagttcaagaccactgtttctaaacatatatatatatatacacacacacacatatgaattctatatatacatatatatcaattctatatatatatcaacccatatatatagagagattctaatatatatatatatatatgaaagatggagagaaggcagaacagctagggatcttggaacccaaggaacataactgatgacttccctggatcttctttgtcccttatatattccacacttggggccagataagccaacaaccagaaaaagctaacaggtacaaacaaaaaagctccgacaaaaccctgcccaaaagatgaagagaagaacaccatggaaagaagaaaactttaggcaaatttcactctatgtcagccaaacaccacagaaaaaactgtagtcccactctaaccatgtcagaaaggcttagtggacagcctaaagttctatcctcatgagactataacaaggtcccacaatactcctgacatggtgagaaaagaacaagtagggagccaagaatttcacccctctggaaagtaaaaggacagccccccctagcagtgtcagtagacagcaagtagaacctgtacttcctctccaaactggcagcaatgaggtgatcctcccactacccactgaggaggactagaaaaaagttaaattaagactttcactaaccagtggaaattaggtaagcaccaatacaatagagactacacacggagagctagaatcaccactctgactcagcaataatgaggagccactcctgctacttgagtagggcaacagagactgaaaggggaatctggacttcaacaaactctacctggcagtgatgagctcccttcccctcttaaagtaatgtcataaacattcacctaaaacagaaggtttaaataagatccagtctcagaatataatggggaaataggtcctgttttcaaccaaaaattactcatcagaccaagagtcaaaaaaatcacaaactgaccaaaaaaacaaaaaagataaaagtcaacaccaaaaaaagacatgtcagaagtatctgacaaatattttaagagtctttaaaaaaatgcttcaatgaacaatcatgaaaataactgaaacaatgtaaaaatagaaagcctcagctttaccagtaccttgtgataatttatgtacatatagaataatactaaaataaaccaccaaaaagttttgcatagaaatatcctcataaacactatagataaatcaaaagaaaactcttaaaaaaaatcaagtaacccacaggaagtaaaaaaaaagaaaacagaaattaaaaaaatgcaaaactttagccataacatattaataattacattaaatgtaaatcgcctaaatatgccaattaaaaggcaaaaactgaaaaggtagattttaaaatgcaactcaattatatgtagtatataagaaactaacttataatataaaaatacaggcatgttgaaagaaaaatgatggaagaaatataacatgcaaacaataatcaaaccaaagcagaagtggctatattaataacagataaaggagacttcagcaaagaaaattaccagagacagagagggacattacatagtgatgagacataattcaccaagaaaatataacaagcactaatgtatatgtaccaaccaacaagctataaaatatatgaagcaaaaactaaaacttgaaaggagaaatagataaattcaccattatcagtagaaatgtcaatatcctctaacaacaagagataaaacaaatagacagaaaatcagcaaggatacagaagaaatcaacaacaccatcaacaaaatttatagaataccccacctcaacaacagcagagtacttattactttcaagtaatcatggaccatataccaagagagaacatatactgaggcataaaacatacatcaacaaattttaaagaactgaacagagtagagtctccaagcacaatggaatcacattagaaatcaataacagagacataataggaaaatcaagcacttgaaaactaaagaacacgctttcaaataatctatgtgtcaaagaagatgtctcgatcgggggaggagccaagatggccgaataggaacagctccggtctacagctcccagcgagagcgatgcagaagatgggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgatggatgcacctggaaaatcgggtcactctcacccgaatactgcgcttttcagaccggcttaaaaaacggcgcaccacgagactatatcccacacctggcttggagggtcctacacccacagaatctcgctgattgctagcacaaagcagtctgagatcaaactgcaaggcggcagctaggctgggggaggggagcccgccattgcccgggcttgcttaggtaaacaaagcagccaggaagctccaactgggtggagcccaccagagttcaaggaggcctgcctgcctctgtaagctccacgtctaggggcagggcacagacaaacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccctagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaatggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctaattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgaaagattttgtgaccaccaggcctgccctaaaagagctcctgaaggaagcgctaaacatggaaaggaacaaccagtaccagccgctgcaaaatcatgccaaaatgtaaagaccatcgagactaggaagaaactgcatcaactaacgagcaaaataaccagctaacatcatcatgacaggatcaaattcacacataacaatattaactttaaatgtaaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatactaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaatttaactcatctccgcaccaagcggacctaatagacatctacagaactctccatcccaaatcaacagaatatacgtttttttcagcaccacaccacacctattccaaaattgaccacatagttggaagtaaagctctcctcagcaaatgtaaaagaacagaaattataacaaactatctctcagaccacagtgcaatcaaactagaattcaagattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaacaaagaaaaaaagagaggaaaatcaaatcgacacaataaaaaatgataaaggggatatcaccaccgatcccacagaaatacaaactaccatcagagaatactacaaacacctctatgcaaataaactagaaaatctagaagaaatggatacattccttgacacatacactctcccaagactaaaccaggaagaagttgaatctctgaatagaccaataacaggagctgaaattgtggcaataatcaatagtttaccaacgaaaaagagtccaggaccagatggattcacagccgaattctaccagaggtacaaggaggaactagtaccattccttctgaaactattccaatcaatagaaaaagagggaatcctccctaactcattttaggaggccagcatcattctgataccaaagccgggcagagacacaaccaaaaagaagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacagaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagatagggatgccctctctcactgctgctattcaacatagtgttggaagttctggccagggcaatcaggcaggagaaggaaataaagggtattcaattaggaaaagaggaagtcaaactgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaatagaagaggatacaaacaaatggaagaacattccatgctcatgggtaggaagaatcaatatcgtgaaaaaggccatactgcccaaggtaatttacagattcaatgccatccccatcaagctaccaatgactttcttcacagaattggaaaaaactactttaaagttcatacggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggagtaaagatttaaacgttagtcctaaaaccataaaaaccctagaagaaaacctaggcattaccattcaggacataggcgtggggaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtgaggggaggggggaggggtagcattgggagatatacctaatgctagatgacgagttagtgggtgcagcacaccagcatggcacatgtatacatatgtaactaacctgcacaatgtgcacatgtaccctaaaacttaaagtataataaaaaaaataaataaataaataaataaataaataaaaaggtcaacatcaaaaaaaaaaagaagatgtctcaagggaaattaaaaaaaatacactaaaccgaataaaaatgaaaatacaacaaatcctgttaaaatttgtaggacacatgctgctacttgaagagcctagacaaagaagaacaaaaataaatgcaagacaagaagaaagaaaataataaagagtagaaatcaatacaatttaaaatatgaaaaaagttaaaaatatcaatgtaacaaacagctattttaaaaaacacacacacaagaaattgacaaacctcttccaaaatgacaaaaaagacaaaaagagtagtaaagtttctaaatatatttttgttttttaagcaactgtaaatggtattgcatttttaacttcaatgtccatgaattcattgttaatgtacacagaaaaacaactgattttttttttttttttttttttgagacggagtctcgctctgtcgcccaggctggagtgcagtggcgggatctcggctcactgcaagctccgcttcccgggttcacgccattctcctgcctcagcctcccaagtagctgggactacaggcgcccgccactacgcccagctaattttttgtatttttagtagagaccgttagtatttttgtattcaccgttttagccgggatggtctcgatctcctgacctcgtgatccgcccgcctcggcctcccaaagtgctgggattacaggcatgagccaccgcgcccggccaacaactgatttttatatcttgcatcttgaaaccttgttgcgcttactcattaattctatgagtttattcattggtattttctatgtagaaaatcatatcatctacaaaaggagatggtttcatttctacctttccaatctgtatgccttttcctttcacttcttgcctttttgagctggcaagaactcccagtactgtgctgaatgagtagtgagagtgaacatcgttcctgttcccaacattaggggaaaacattcagtcttttaccattaattatgatgttagctgaaaggtttttataggtattcttcatcaaattgaagaagttatctttattcctattattctgagatcattcaataccgtaaatgggtgctgaattgcatcaaatttttttttctacattatgtgacttttcttctttagtctgttaatatggtgcattacattgattcagctgaatggtactctccccacccaacaacccagctgtctgtatgttcttaaggtggaagctcagagtgttgttttttttaacactatgaccctgaataaagcaacatatctatatagctagtcccagaatcactggtaattgcttacataagaagctccgtatggccagatgatacagattgtggacacatgagaaaaaccttcttgttgcaagtaaaatatatctgtggctgagaaaaaaagaccgtcaaatgaaaaattctacatacaaaaaaaaaaatcagacattgggcacggtggctaacgcctgtaatcccagtactttgggaggctgaggcaggcagatcacttgaggtcaggagttcaagaccagcttggccaacatggtaaaaccctgtctctactaaaaaaaaaaaaaaaaaaaaaaaattagctgagtgtggtggtgcatgcctgtgttcccagctattcgtgaggcaggagaatctcttgaacccaggaggcagatgttgcagtgagctgagattgcgccactgcactccagcctgggtgacagtatgagactccatctccaaaaaaaaaaaaattggatttttttggtttactttccctgattctattaatcactgaatacaataaaccaaatactaaataggattagttatgactcataaataaacataaggatgtatattacattgccattcattcattgtatgtaaatttcctacagctagactataatatacagcttcccaaagcaatctaaaagtaacaaactttaatgatatagcacaactgaagtttggtatagtaagtgcaaataagtattgcaatgacaattcatcatggtaaactcaagggtctgtaaaaaatcaaattatcgaggaccgagttcaagaagaactatattaatacatagatttctgtaacttggcagagaattccctacaattgctacatttaaagtaatcaacacatttctatatctcagaagaagacggaaattatgtgttcgcctatcctaatgtattaaacttttattacaatagttttagtatatttttagcttaacattaaggtagaaacattctatcaaactaagaaatagaaattgctctgaaattgcaaaaacctgtactatttcccattttaaaatcagaaggattacttctacagcatttaattgttacatcttacaataataaattacatgggactaatatgcataatagaacacaacggtagtagtaataatgattgagcagtagtatatttacataccgataaaagaaaacccatgtagaagaaactgaagaaaataaacgctagagtgaacaaatgatgagtaatgctccaaaatacaagaaaaagaaagaatgggatacagaatagaggttgagagattggacttgagcagagaaggaaccctcttcctccacatggaacatattgtgagggagggaagaataagatgagaaggaggagaaaaagaaacgaagaaaaaataaagggaaggaagaaaggaagaaagagagggggaaaaaagacataaaggaaggaaggaaaagtatagatattgactgttacggactgaattgtgtcctgtccccccaccaccaccactaccaaattttatgtcaaagccctaatgctccatgttactgtatttgcagattgggcctttaaagaggtattaaggttaaatgaggtcataaaggtggggctctaatccaatatgacttgtgtccttataagaagaagaagagacattaggaatgtgtacattcaaaaccaaaggccagggctgggcacagtagcttatgcctgtaatcccagcactttgggaggccaaggcaggcagatcactggagcccaggagtttgagaacagcctgggcaacgtagcgacagcccgtctctacaaaatatacaacaattagccaggcatggtggtgtgcacctgtagtcccagctactcaggaggctgaggtggaaggatcatttgagctcaggaggtcgcggctgcagtgagctgtgatcacaccatgacattccagactgggagacagagcaagaccctgcctcaaacaaaaacaaaaacccaaaggccatgtgagaacacacagagaaggcagccatctgcaagccagagggagacctcagaagaaaccagacctgccaacaccttgatcttggaagtccagactccagaactgtaagaaaataaactgttgttgtttaaatcacccagtctttagcattttgttatagcagcaggaacagactaatacattaagttagacggagggacagaaacagtgaactgctaatagtctccagtttttctttggaccagaaagcaagtctgacaaaaccaaggagagatggggtaaagaaattttgcaacagacccagaagagaatgaggtggtaggcgtaggggaacatgtgaaaggattgccaactgtccatttcagattagaaatcaatcttttgggggcatcagtcttcacagttacataattgcagttaagcagcctggttacgaggaacacagcaaaatgggaaaggtaaaaacctttgaggttttttaagtctgagtgataacctagctctatcagtgtagctgtgtcttgggttgttatctagagttataataatgatagttacatagagtgtgccaataataatatctactccttttagagttgttttagagttatgtaaaactttatcatagagttggtcagatagtagacaataaataatagctactatacttattactatgggattagtgtagtattggtacattgttaggaagatacagcaaaaaagagaaggaaaaaaaggaattaaaagaaagtggttcagccgggtgcggtagttcatgactgtaatcccagcactttgggagaccaaggcgggtgggatcacttgaggtcaggagttcgagactagcctgggcaacatggtgaaaccccatctctactaaaaatacaaaaaatgagccgggtatggtggcagatacctgtaatcccagctactcgggaagctgaggcaggagaatcacttgaacctgggaggtggaggttgcagtgagttgagatcgtgccactgcactcaagcctgggcaaaaagagtggaactctgtctcaaaaaagaaaaaaaaaagaaagtggttcaagtgacagagtagagtcttggctagatagaggagtaaagtgaatgcctgaggatactgacaagctggaaaacaggaggaaaaataagttaaatggcctgaggatgaagtccagttgaattttaaacccaagaaaatgagaaagatcgaaagattggtaattaaaataaaatcctccagagaagactgctgagtgtgaatcagcagctacttcttatatgtaacaccacagagaaacataacaaaaaaagaaagccagctaaatggtcgtggccttgtcattagctagcagtgtatcttgaaagaaggcgcttaaactgtgagccttactgctatttgaggattactgacaaattacctctggtttctcctttattccacttccactgtaccctctctccgacaacacacacatacacacatacacactcatcattatagtaaagatcaagaaaggcagtaaacaagagcaaagatctggaaagaaggcacattttcaaaactgacatttgtcttgtgcatcctcccacttcccttttccctctcccagtcccacctctacaagcccaaaaaccccagctctcactgctggctctgctcccagaaaaagcccaaagtgccatgtttctctttgacctttcttccctccctcccacctattaaaacttccactgagtctatctcagtttaacaagggaaaaggcaaactgattatgccttttcataatgatgccaggatgaacagtaactcatctgtgcttaaacctcccaagtgtgtttggcttaaaaattgaaacgaatctatttggcaaaatttcaggcagaatggaaaggggataatttggggcaaggagattttctttcttccctgttttaaagttgtgaggaagaaaaagaagtgtttgtcgtaactgacaacagacaaccaccacagaaaaaacatccacagcagctcagaatgctagactgctacacttaagggtactttttaggtgtacaggcctgcataggatgctgaagtggggggcttatgatagcaaacatgaggaagcaatctaccctactataaccctgaaaaaagtggttcagaaccatctaccacgtcatggtaatgactctcttttctcttccctttattacagaggctgcccctcaccctgccccccagatgctcccctgataaaaggaggtggggaaaaaggaggcagccataaaggcagcagcaggagtgaactctccatcttagttatttcctgttagaagtggggaaagaatctgcagcatagaagccttaacagaagcctgagtataaagcaagaaaatagctgtagatagaatcacatgaaaaagtgactatacaggaaaaggtgccattcaatgagaaaagggggaaaagtatcactgaagaaaagaaacactctcttcccaaaaaaggtagaaatacaatcaaatgtttcagagcagggatcagaaaacttcggcccacatgccaaatctaaccagtctcctgttttggtaaataaagttttatgggaacacagccacactcattcatttatgtgctgtctatatggctactttcacattataatggaagagctgaatgactgcagcagagaccatataacttgtaaagactaaaatatttactatctggccctttacagaaaaaaggccctgctttaggaggtcaggggtaagaaggggactgagatgaggccatcggatttgataataagtgatctctggcaaatatgaagaaataatttaaaagaagtttaaaagaaactaaatgtattctaataaagtagagacaatgaggataaggtattctttcaaacagcctctaggaacaaaggaagactacatgcaagtctgcatggggaaataagaaattttcttgatctcaccaatcttcctcctcttggagtcactctctttaatcaccaaccaaacagcttcccaaactagaaactgcagaattttggtaagtgattctagctccacactgctttctgtatcctcagttccaggtgcaatgcttagtatacaaaagataatgtttgttgagtaaaacaatttaagagtacagaatgtagagagaaaagattgagaagagagaaaaaaattctgtccccacttcatacctggaaaaacattccatgccacctctaatggctatgtggcttggactcaagtcttaagagtcatcataggccaggcgcagtggctcatgcttgtaatctcaacactttgggaggccaagcccagcagatcacttgaactcaggggttcaagaccagcctggccaacatggtaaaaccccgtctctactaaaaatataaaaattagccgggcacagcagtacatgcctataatcccagcactttgggagactgagacaggtgtatcacttgaggtcaggagttcaagatcagcctggccaacatggtgaaaccctgtctctactaaaaacataaaaattagccaagcgtggtggcatgtgcctgtaatcccagctacttgggaggctgagacaggaaaatcgcttgaacccaggaggcagaggttgcagtgagccgagatcgtgccactgcactaaaaaaagaaaaaagaaaaaaaaaaaaaaaaaggtctggttatttaaaagagcctgagactcctcccctttcttttgctcctgctatcaccatgtgacatactcatgcccccactgcctcaggaagtaaaagcttcctgaagcctcaccagaagccaagcagatgctggcatcatgcttgtatgacctgtagaactgtaggccaattaaacctcttttatttataaattacccagcttcaggtatttatttatagcaatgcaaaaacaagctaacacacacacagcaaagcctaagatttacatctatgtttactaccaaaaattttatagatttagctgttaaatttaggtctttggtgcattttgaattaacatttttacagggtatgaggttggagtctaatttcatttttgtacatgtgggtatctaattgtgccagcacactatgttgttttaacatcaaatgagaaaatatataagataatttgatactacaaatatttgtggttgttaaaattcaggtactaagcaaacagctcagtagaatactacaacaaacatgtaacctaattctcctgtctctagtttctcctttaatatctgttttatatctgtgtaaaacacagtccagtaatgcaacaactctacataaaactaaagatacctactgctgacagaattagaatttctggaaattctgagacagaacttgcccctgatttttccagtttatacaagctatccacaatccttcgctcatggcctccttcctctcttttcaattttccaggctcatctcttaccattgttcccaaccacttggtctggctacacaatgttactagacacatctgatgtgaagtactcttgaaagactctgtagattactcatgctagacttttggctttccttaacctgggggttccctgaagcagaaagaattttatttatccctatattcaagagtccaggagagtgcccaacacaaagcaggtgtttcataaacacttgctaagttaaaggaatacacaggcaggcatggtggctcacacctgtaatcccagcactttggaaggcagaggtgggaggatcacttgaggccaagagttagaaactagcctgggcaaaatagcgcaaccctatctctacaaaagtaaaattttaaaaatcagccagtcctagtggtatgtgcctatgttcccagctactcaggaggctgaggcagaagaacagcttgaggccaggagttcaagacagcagtgagctatgatcacaccactgcactctatcccaggcaatagaggaatatcctgtctccactcccctccacactccaaaaaaaaaaaaaaaaaaaaaaaggaatgtgcctataaatggaagacagtgacgaaggtaaaggaataaagtagacgaaggcaacaggtttggaaaacattaaatcatcttgtttggcaggaaaaattgtctatatagggggatgttgagagaagcctggaaacctggatgggacagcaagagtaaaggccaagtgaggaatttgtacagtgatagttttttagggtaacttgatggatttttagacacagattataccaattctcttttcccccaataagagatttgtgactttggctaaattatttgactcagaaaagactcaagtacttcatacacaaaattagactaatctctttagtatgataggctcagctggtaggcccatcaccctagacacagaagaaaaaaataatcatgctataataaggaagcttgacagtcatttacgagagtttaccaacttttgagcagtgaaatctactttccaaataaactcatacatggaaccctagtacagaaaccttttttaaacccacaataattgaaaggggcatgaaaaaaactggagaccccacacacccaccttccttcctctcacaaacattggttcatataatcaagtggacttcaaatcaaatatggggaaccctaaacactactttagaacatggtcaaaagtttactaatctagagggatccaggtaaagtcatacaaccaagattcccctttgtggctactgattcgaaaataaatgctagggaggaaacaaagataaaaactaaagatggaaaggaaggtcctactgtaattttcctgaccagaccaatggagggcataaactaggatggtagtattaaaaagacagaagccaagcaaatataacatacagaaactgttttcactttgttttccgtattcttgatgggaaccatgctgacccaggagagactgcccctcccaaggctagctacttcttagacagcaaactacccctccttgagtgcttttcgcatgcaaaccactcaatctaaaactacctcccatccatccccagtattcagctctcacagaactcttatattctgggactattagaatagtcccctgttctaataatcacgccagggccaggtatcaaacaacttgggggctgctcttatatgtgactatgccgacattattaaaaccagccaattctaagcctccttaccctgcctcgcctgttccttctcactaaaatcatgataaaggctctcccccatgatttccctagctatttctgcctcctaaacaaccctggtgcttccctatgagcactatgtggcgtggcatatatgccaccctgtctgatgtgccatgccctctccacttagaaactgtatcaatcttttcaatggcagttgtctcctgacgtgttagtttcaccatatttgaataataatataaaccacattttaaaaatagttcaggaccaagcaccaaacaaacagcacgtacttagagaataaaatgtgaagtattaagaatcagtattaaggctgggcatggtgggtcatgcctgtaatcccagcactttgggaggctaaggcgagaggactgcttgagcccacgtgttcgagaccagcctgggcaacacaatgagaccccatctccacaaaaaaattttaaaaattagcaggggtggtggcacacgcctgaagttgcagctacttgggaggccaaggtgggagaatcacttgagcctgggaggtcagggctactgtgaaccctaatggcaccagtgtactccagcctgggtgacagagaggaacagaagaagaaggagaaggagaaggagaaggagaaggaggagaaggaggagaaggagaagaaggaggagaaggaggagaaggaggagaaggaggagaagaaggagaagaaggataaggagaaggagaagaacaagaagaagaagaggaagaggaagaggaagaagaggaagaggaagaagaagaagaagaaagaaagaaacagtataaagatgagattttctagttatgagagatgccaaagcagaatgttttaagagataaacctgacatatagtaaacatttctttttttttattaaaacacattaactataaatatgtttaacatcatttcttatcttcatcattcaagatatctgagccaaaaacctaggccaaaaatcctgactctcatttacattccacatttagataatcagaaaatacaaatatccagaatctggccacatctcaacaactttacctttactaccctggttcaggccgccattatctcttacctggactactgaagaagtaacctcctcactattcacctggcttccattcttgtcctgctacaatcccttctcaatgaagaacgagccgtttaaatcacacatcagaccataccattcctctgctcaaaaccctgcaatggtttcctgtttcactcagggtaaaagctaaaggtcctgccgtggtttatgaaggctctaagtgatctggttccctgccatccctctgatctcatctcctacttctttcaccatcttatccagctccagccacttaaacctccttactgtttctaaaacatcaaacacagtcacacatcagtttactctgactagaacgttctttccccagaaatctgcattgctcatttacttagctccttcacatctctactataagtcaccttattagacaggcctttcttgaccatcctacatataatatcacaaacatatctgtcattctgtatccctcttatcctgctttttcttcatagctgttatcagtacctgatatgctatagttttcgtttttttgtgtgtttttttcccgagacagtgtctcactctgtctcccaggctagagggcagtggcacgacctcggctcactgcaacctccgcctcctgggttcaagcaattctcctgcctcagcctccaaagtagctgggactacaggcatacgccactatgcccacctactttttgtatttttaatagaaaatgcgtttcactatgttggtcaggctggtcttgaactcctgactttgggtgatccacccgcctcagcctcccaaagtgctgggattacaggcgtgggccactgtgcccagctttttgtgtgtaatttactgtctttccccactacaaataggtacctaagagattggaactttgtttcattcactgttatgtatgagtgcctaaaacagtgtctgagcaggcactcaataaatatgaaataaattaatataccaaagcctttctgagggatttacacttgtactgctcaaaaatccataaacctcgcaaagagacaaaactggatcactagtggtaatatataaaaatgtaaaaataaaaatgtagtcttctaagaaagatagaaggcttgacagtaaatgattaactaccaaaagaataaagtataaatgagagattggcgaccatgtgaactcacctcaagagaataatagatacctacaaatgaacatgtgaaaaactttataataaaactatataattaagcacagagaataagactatcttgccaagatttgctaacttggcaaacatccatattaaactcagcttccccaattccagatacaaatgaaattgtgaatttggcaattcactggagagaaagactgcattacaatctaggttcacattaaagttacctcattcttctcaacttagatctgacgcagaggaaaatttttaacagattctattggacatatgccatactatagtcagtaaagttcaacattaacattttagatgttaacctaaatgatttgttttcctaaaactaaactgcactaaaaaaatatgcattatgagtataaaatgaattattttaaataatattttgtcaaagaaaaagcaatttataacaccagtccttccctcgtattttgatttcattcatgtagtgcctcacccacagctgaacacatggtagcactcaagctgttcactgataagagagagaatattctttccttcaaggtttattaaatatagatatgtccacctcaaccttcccagttattaaaaaatgcaaatgaaaattatgtaccccaaatttgtatataaatgtattaatcatttatttaataattagtatgtcataaagcgtagtattagatactgaagacacaaaataaaaattacacatgctgctatcaataacttcataatgtggtagagaagtcatataaactataacagaagatgataacttgtatggtcttggggcacacaagatgcaaaggaagcccagaagaaaagttcccaagatagaatgtgtagaaaaaagatgggagaaaatgcaggcataaagtaacacttagaagaaggcagaggtaaacctaacactacctacaaatgatagtatggctaaaggaaaggaaatatcacatgaataaagatgtatgcagagcccaaggtcttacatgacacccttaaaaatttggctattaatggggaggatcttaagtaagacagtaatatgagttgtgtttcatttaagatgatcaatctagcagcatcatgaagtttactttagagaggagattgagactgcagattattaaatcagttggtactgatccagaagaaggtagaacgatggcggtggcgttggctttgccagctcaggactgagtgcaagtaacagagaatcagccagattctccagaggctcttcaggttctcctctgtctttcagtcagcagtctcagtccatttgcggaggaacattggtgttacagcagtggcgtttaataaggaacttgatcctgtacagaaactctttatgtacaaggttagagaatacaaatctaagtgacagacatctggaggatctgttgatactgatccagagtaccagcaagagccagagaagaagctttttaagctcaagcaagtgtatggtaaagcagacatgaatacattccctaacttcaaatttgaagatcccaaacttgaagtcatcaaaaaaccccaggcctgaagaaataaagtaaaattaacctggtaagttgtcaagggttagctgtacaactagctagaagtttcagaataaacatacattcacaactgtcaaatgttcttttaatctcgattccaaataaattagttggtgatgtggagtattaaaaaaatctggaaggaaaaataaagatgtggacgaaaagaaggggatattacttgagagatattaagaaagttacagagatgggaactggtgaataatgaaaacttgaatcagcacagtggcagtggagctggacaggaaggagggaaggaaacatcaacaggacctggtgactgattaaaggcagaagattgggccaggcacagtggcctgtaatgccagcactttgggaggccaaggcaggcggatcacttgagtccaggagtttgagaacagcctgggcaacatggtgaaaccctgtctctaaaagaaaaaatatatatatatacaaaaattaaccaggggtggtggtgcatgcctgtagtcccagctactcgggaggctgaggtgggaggatcacttgaacccaggaagcggaggttccagtgagcggagatcgtgccactgcactctagtctgggtgacagagtgagaccctgtctcaaaataaaataaaaaataaaggcggaagattggacagagggaggatactcttggttaatggcaccaccatctaaccagttgtttcaaatacatagttggttcaaatataaagggagaaacaagcctgatgaaaaaacagtgaaaacaacttggagatattggatttgaattatctcaaaatagtaaagaaaattatataagcagattactagaaatatgtctagaattcaagacagagataaaagctggaggaaagccagggaatggagacagcagtgttctctactgctgtcttaaccctttctttcagagccacatataaaagcagttcactggcacctctgcttcctgggtccaagtgattctcccacctcagcctcccaagtagctgggactacaggcatgcgtttttatactattttgagagaattcaaatgcaatatccccaggttattttcactgttttttcattctcccaaaggaaaactgtttgtctcctaaatcaaggagcacgtgagcctgtaaagttccatagcagagaggaaataagtgatgggtaggagaaaaaaaaacaagaagaaagaggcatacccttctataatactacagccagaaaagggtaaaatgaggccccaaagttcaggcatatgtatatggccatttaactaggactttttaagcaataagcatgctgtgcttaggctgtctcagcactattgttaaatgctttaattatgtaacttttgatacattcatgttatcatatgttgtaattattgttgttactattacattttctctatatagcacttattatgtatggggcaatgtactaagtagctttacaaaaattatttcttttaatcctcaccaaaaccctatgaggaagtatttctccattttatatatgagaaaactgagggatagaaaggttaaataacttgccctcaaatactcagcaaataaaggacagagttgaaaatggaacccaggcagtctagctccaaagtccatgatcttaatcatcaagttatactacctcttttcaggtggataaagaatacttttggttactaacttaatctgaagacaactattttctagtaggaaatatttctaattttacaatacatgtaggagaaaattgagtttactgatcagaaacttgctagactacattattaagtaaaaaaacacacagaattaaaatattatttaaaacatctgtacatttttaatctgtataaacatgtatatataacaatagttctcatctatataaatatgtacatataataattgttcttaaattttactatgcatcagaatttcttggtgggcttgttaaatgcagattgctgaacccctacttcaaaccccaatctttcccctattacttacgaaataaagtacaacttcttttcagcatggcttacctttggccatgaggcatcgtctaaccatctttcaataagtttttagtacattacctatttttttatgctttccctaatacaacccttcctaataaagccatacattccttctatgattccaaagcacctctaaaatagtaaaaaacagaacaatgataataatatcaattaactctgtggggcattcccaaggaaacatgaattacctcattcaatcctcataacaactcctcaggataaagattataattattctcactgtacatatgggaaaaaagtgagacatggagaggttaaattgggcatggtaatacaatcagcaagtagaaaagctaggattctaccactgcaattatactatataagcaattactagattgttcagtacttggatactatttagatactagatttttctaagtactaatgtaaataatttccttattcatttttacacttatttaactgacatttactgactgcctatcatatgccaggcattgtgttaggcacgaaagactatcatgttaaaatacaagggaagacccagtacctgctctcttgagacatggaatccagtggaaaaaccaaacattaaattaaaaatcagagaaatatttcaagaaatatgtgttaaagacaaaaagtacaaggcactccaagattataataggaagatctaagctgtttatagttattgtactggcagtgtcctattacaagagtataagttacacagaatttgcatttcaggatgccaaataattccatttcaaaatgacgctttcaaaatcaaattaattaattataagaccaaagtcatatagttaaaatttaaaacatattatttaaaatgaaatttaaatatgtcagctctttatttttccccttagcaaatggagctattacgcatctgacacagaatgtaataaatataaactatccaaaactaataaaatagcatttgaaaatgtccttgcaatattggtcatgataaaggtaaaataatatgccaagttcctgacaatcctagtagtgcataaagtacttccattttggacaatgctaactttcttatgattgaattagatccatgacttaatatacatcatttgtaagattttttttttttttttttacaaaaagcagacttctttcataataaatttcaaaatgaaaaccaatgtttttttacagaggaaaaatgcctaaaagtccaaatactgatcttacaaagagacatgaaaggtaaaatcaagtatgaaccaggcctggattcccacatcttcagtttctatttatcaaacagaaaaatctttccaactttctcctttcctgtataagaccaaaactatgcaatattctgtttgtattacaattacactaattcaatgcaggtcacttgctttttactgagtccagatgacattcagtaaactaaacatgggccaattagtttaaaaaaaagaggaagaaaagaaaaaaggaagaaacgagtgagttctgattgcctttgggtaggtcatacagtggctacagagcatcacagcctgaacttcattttggctaacaccaaccatacggctaacattaaggactagcattttttattcctttcagatttctcacatttggaaattccaatttaaataattttctggtgaaagtgaggacagcactcctgcataatatcagttttcccctaattcaactccaatgtcttattttggagctactaaaatggaatctgcacaatgtctaaaaaagtataataatcctttttaaccaatttttttatgtattacagttttaaatgagcaaatgaaactgataatttagctgacacaaacccacacaaaaaaagatggtctaaagctatgaagtttcaacatcaatgtttgtaatctcaaatcaacctgaaccaccatacaattaggtatatgacaaactaagtaatagaaatattcataactaaaagcaatattatttttaaatatcttattaggtgttggcacccaacattttcttataatctatcatgtaaagaaatctgttttactattccttttaaactctctactcatgctactttaggtgtgtttctagaaataaatactaaactctctgctaattttttttggctaagaaattttttgaaagttataatgtaactaagttaaaatgtacatataatcataatttgatatcaagactgctttcatacaaaaaacctacattaattaattccttaagtaaatttacactttatcaattgttggtattttaaaaagtactcaaaagaaactcttcattcaccattattacaaaaatggaagtctccaaatatgtaaactagcttgatttttaaatttgttacttatttagcctaatttttttaaacttgcctaaatttaactgaagaatattatgttcctgcaagtgttcatgaatacaaagatacagtaatgaagatggaaattatttactctaacaattctgactgcatgactgttaaatcacttacatacggccaaatgatctacaaggaagcagggaggtcctgaaattgtgtactcatatccattttcaactactgcacaggtgacacaaccaatcaaggcattactgaaacagaatgggaatagaaaggacttagtgaataaaagtgacttctttagacaaaaatgtagaggttagcttgtgaccaaggtggaagaaacagcagcaccattcctcccattgcttgttcatattaagagaaaactgagaccactaagaggcaaaggacagaggacagcaacaccagcaaagagacaggcagcagtggggtcagagcatgagaacagtattaagagttaaacatagagcacagagggggtggtttaaaatgtcagttttactcaattatttataggacagttcttggaaataatgttacaatgaaatgttggttatataaaaatcttatttaatgtagtaattactatttagacaagggcaaatatagtaaatattaagtaaaaattaacaataattaaaatgggcttatggtctgaaatagacatattatgggaaaggattactgttctaacaactacgcataaagctgtgaaaaggcaatagttatactagtctgtagaaacagtactctaaaagttacaataaggagatacacttttttttttttttttttgagcaaggtcttattctgtcacccacactggaacacagtggcatgatcacagctcactgcagtctcaacctcctgggctcaaccgatcctctcacctcaggttcctgagtagctgggactacaggcgcatgccaccacacccagctaattgtttttgtatgttttgtagagacagggttttgtcatgttgcccaggctggtatgaaattcctgggctcaagcaatccacccacctcagcctcccaaagtgctgggattataggcatgaggcaccatgcctggtccaatatggatattaatcctcctgaaatagatgggattttaaaatgcaatactcagtttcaatgttgaaatgtgctcttctttcactgaaaatgacatgacactgtgaaagctttcttctaacacaggaatttttagaccttcacacaagttttcataatgtttaatactttcaataagcttcatgactattaatgctttggggaaaacttactttttgtttctttatttgcttttcaaaaccaaaggcatatagtaataattcattatgcttttacaatcaggtttcatctgatgtcaatgttacctttcatatctttttaagtgtttttccatgttaacgtgaaggtgtgtttcttaacttcacatagcaagaaacaaagacacgcctttgttcaatttaaatattttggttcctggccaggcgcggtggctcacgcctgtaatcccagcactttggaaggcttaggcagatggatcacctgaggtcaggagttcaagactagcctggccaacatggtgaaaccccatctttactaaaaatacaaaaattagttgggagtggtggtgtatgcctgcaatcccagctgcttgagaggctgttatttgttatatgttattccatattccctattctattctattctattctactcattcagagacaggatctcaccccatcacccaggctggagtgcagtggcgcgatcacggctcactgcagtcttgacctcctggactcaagtgattctcccacctcagtctcccaagtagctgggactacaggcacaagccactatgccaggctaatttttgtactgtagacacggggtttcaccatgttgtccaggctggtctagaactcctgagctcaagtgatctgcctgccttggcctcccaaagtgctgggaatacaggcttgagcaactgtgcctgacctccatattcattttattcaaaagaattttatacacaaaattgtggcaaaacttcaaggaagaatatattcttttgtagttctgtaatctagtggaaaaatgtgatataaaaaaacataaaagttaatgatatactagtgaagggttcctaatattcaattaactttgattttattctcaatctattttatactaccattcttcttatgaaaatatcttcaacactttcattgtaccaataaacaacaatacaataattaacaatttgcatttattattaaagtattaaatttaaaactccaaagcacctacttgaaaggaacattccaatataatttaattattcttggtcatttgctcatgtttccttaaatataaatacagtatacctaacaaataataagcataattataaatattatcacattttacaattttttattctaataaagaaaacatatgctcaaataatggaatttaactataaaatctaatttttagctcattgaaaaaacataaaaaaggatgatcaaactatttaccagtcttaaatatttaagagtataatatgtttatactactatatttatatgttataaatacagactatatattaacacatttataactatagtaatatgtatttatatagtataaaaatatactactatatataatactggctttttaaatacatttcctaatttcctttatttactactttaactttgtagtttataatttacaaatttcccagcactatatcttccccacaagaagatttccctttctagtggctactaacatacaatgtttaaggattaattaatgatagattggttaatgaatctgcaaaatatttagctcttttatttccatttttctctcctgctaattgacttttgaccatgttagtgtttattaagctcaagatccaaattagctaaattcttgccctcccaaacaggaggcagtctaaagcaaaggtgttggttgactgcaagttctggtggaatttacctattaatcagttctacaccattttgtcaaatctgaaccaatatagtgccaaaagaacattcttaaatattaagacttttatctttggcatacaggattcattcatccaacaaatacatactgagtaactactatgggccaagcactgttctagtgcttaacatatattagtgaacaaaagaaataagaaattcctgccctcatgttgccaatttaccaaccctgtgctgtgctccacactaaaaatacaaaattgaagatactaccccttacttaaagaagatttaatctaatcaaaggcaagaaaaatgtcctcaatgcaacttatcatataatgctaaaatatgcatatgtaaatggtagcagaagcatatataaagtgccatgaagagtagaggggaagaagcctctgtgcagatgttactgagtacaacatcacaaggagtataattctctctgcctataacaatcaaacacaggcattccaacctgagaacagatatgcccaatacagctttatatctaactctatgttgtctttcttagaggtaaatcaaggtgctgctttacagaccttcataattaatgtccccttagcatcttcaagagttaatggaaaaggagggaaaattctaatcactacatgttgacactttttagtagccaagaaaagttctcaaagaatgacaatttaaaaaattaacttgtatacactttctaggttaaccgtgggcctcaataatccctaccattccaatacacaaatgtcacaagttctcattcatatgtgagagctcaaaccagtggatctcatgacatatggagtacacttgccatcaccagaggccaggaaggggagcggggagggaggagtgaaatggagggaaaagggaaataaatgtatttattggcactgagctgtacacttaacaatggtaaagatggttaatttttaaaatattttcaataataatattaataattatccttaccatccttatctcttattcacatgaagacattagttaccatttattaagtgcctccagcaggagaggcactgtgtacaccctttatataacattatttctaaggcttaaacctttagaagattagtatttttattacccagtttttcacatgtgaagactgagagtgggagagattgtataatttgcccaaggttgtacaccatttggcctggaatgtaaaagaaatccatacgaacacaaagtcaaggatcttttcactctacctgatagctgcccactcccataaagaatctaatattgagggatattaattcctcttctatgattatttttaaccatcctatatgtagataaatatgtaaactgatctaaaacagtttacatccttgttgaaaacaggatcacatatgattacctagcctgctaacccagacaggcagatggatggacaggcagatggaagaatgaacaaaatctcaagtataatgacatccaaactgtttaaatctactgcacagtgttcttataaatcttcaatggcaagtccatttgactgacactatttctaaaagaacaattaggctaggcacagtggcccatgtctgtaatctcagcattttgggagggcaaggcagaaagatcacttgagcccaggagtttgggaccagcttgagcaacatagtgagaccctcacctctacaaaaatatttaaaaattagctgggtgtggtggcacacacacctgtcgtctcagctactccagaggctgaggtggaaggatcacttgagcctgggagatcaaggctgcagtgagacatgattgctctccactgccctccagcctgggcgacagagagctcaaaaaataaaatacaataaatgaaagcacaattaaacaaaaaataaacttaccttgagatctttgtaacacctttattatccctattattacctcatcttctattaatgtccttctggctcactccagccacactggcctctggttaagaatcaaagagccaagcatgttcccatctcacacagactttgtactgtctgttccctccaatcaaggcagtcttaccccagatggctcactcccttgtgtgcttcagtctttagcttagatatctccttcttaacaaggcatccttgactaccatttaaaagtacaatcagaccttcatactccctaatcaccatccaatgatatattttatgtatgtgttatatttattatgtctaacccaaccagaatataaacacaatgaaggcaggaatttttgttttactcaaggctatatatcctgcccatagaaaagtggctgatgcacaacaaatatttgttgaatgaataaatgaactttgtgaccaggcacagtggctcatgtgtataatctcagcactctgggaggccaaaggaaggatagcttgtgcctagaagtttgagaccagcctgggcaacatactgagacttcacctctacaaaaaacttaaaaattagctgggtgtgatggcatgcacctgtagtcccagctactcaggtcaatgtgggctgaagtgggaaaatctcctgagctcagatatttgaggctgtagttactatgatcacaccactgcactccagcataggcaacagacaaagaccccaactcaacaataataataacaaccacaataataataatactaaatgaacttcattatttggaacctaaagaggaattgtataagttcaatttcatcactgataaataattcaattaaagacttcttttaaagccaagttttatattatttagcactactgaacttccccttcttataaaatgtttgcctccttactctggccaaaaatcttcttttcattgctctttagaagtttaacatgatgaaaatcagtgtttgactttaaaagtcaaagtatgaatgaaaccgaacttgtatagacacatcttttagctctcatttcaataaactgttattaaatccataatcttttgagagagcaactcacagattaaaaattaaaattaatattttatctgatgctttacggcatccattgtattgaatgcatttgtttaatatttctaagtctttagaaaagcttctgagaaaattgatttccttatgttgtttacagtctgtgaccaaatatttttaggacattcacatgaataaagggtcccaaatgcaacagaaattataatcacatcataacttaagctttaaattattcatgtcttttatgtttaacaaaaaaactattatccaaaactatttattatattaaaatatttttactcaacaatctttttctcctaaggtcaatgaaggcatatgactcctccccaattatataactttttattattttaattaaattaactgataccagcatgttttaatatcatccctacacatttagaagaagtaaataacctagagatcaaaatacacagtaaacccatacaaacagcagtttttcattgccatctctctatatataaacattgaatgcaattctatgaaagtatggctccacgtattcagatgaggaatatgtctgtttacatgtgtctctttcccggtccacattacagggggacctgtgtgtgcctccgtggttaagatttactgcatgttcacattaaagtctcatttccaacatttaaacatgcagccacaaagaccaattagaacagttattagtacaacccttggtgtaccaaagatttgggagttcataaagttgaaattgattgtttatggacaattacaggtaccaaaatgatttaaaacatttcaatttttgctctgctgaacgagactcatttaaacagcagaactagaagcagagacttaaatatcaacttgtaatcaaaaatcaccagtaatgtcttagcagcgtgttcatcctcctactcagtagagtccttaaacatacagggactccaatattagcttcaaaacattttcagaatgtctagcaaaaatatgtcaaacctggatctctgacttaaaggaacacacaaggcctaagaaataattgctgtctcaaatactgtggagttaataaggttttaaagtatataaagttgctataggctaaacggcacattttatattagacaccctttcttgctaaacactgtattatatattaaactgtagcaaaagtgaatgaatctatgaggaaaatcaaaatgaaattttcaagtactcacataatgacatacctctaaactgtgaggtactttatgacagagtgtgtgattcattcatcttttaattcctagtgcttgaatacaaagttgatattcagtaaacactgattgaatagaaaaatgagtaaatacaacttgaagaataactatgtaatgagatttctgattttacaaaacactttcactacttttctaattatatatatatacatatatagatatagatacagatatagatagatatagatacagatatagatatcgagtagagacagggttttgccatgttgctggtctagaattcctgagctcaagcaatccacccacctcgaactcccaaagtgttgggattacaggcgtgagctatcatgcccagtcgtgcttcaccacttttcaatgtcaacttcaagaaaatgaaaattgcacctttctgaacaaactttaagtctaccctaaactgctaagaatcaacactaagagcagatgacataatgtgtgggaaaataaaaagtcagccagccagctggacatcagtctcttctctgactgctatgactaaactcttcaaggttataacttttcaaatgctaccactgtaatgaactatttcattgctagtgttacctcctttccttggtcttcccctttctagacaagaattcctgttattatctcattcccttcttgactgcactttacacactggtttcaatttgtacttgacctagttcccagaaaacacccagttttccttttctcacttagtatcttaatatttgtaatattaataacccacttatctattcaattgtttaattgtattttatctattatctattcaattgtttatttctatttaattgtagtaactctattcagagctagcctatgcaaaagagaagacagcagtcttcagatgtgacttacttagtacagaaagatcccaaccctaatatatacaaacacatacacatgcaaacacacacacctgctataaaccaaaattagagatacatttctttgtgttaaactcctgcttcttgaggttcttattctccctctgtccctctcaattgttctgtcactctttacctcctgcttttttctgttttacagtaattctctccagctaacttcactcttctttcttctacatacaacatccaatgtgtccaaaaaaattctgtgggtttttgtttcaaaatatatccaaaacctgattaggtcttaccacctccactgttaccaacctaacacatgccacgatcatctctcacttggattactgcagaggcctcccaactggcctctttccttctatctttgcccaccccgcccccacaatctgttctcaacaaaacctaagtaatcctttaaaaatgtaaatcagatcttatcactctgctgctcaaggcctgccaggggtctgtctacaaggcactactgatctcacctacctccatcacctcccttacttcctgtctttctctgacattatctcctacttctttgtccctagatcactctgctcccttctgcctctccaaacacaaaagggctttccattgaccattccatctgcccaaaatgatctccccaggtatatgtgtggtttactcccacaatacctgcaagcctctactcaaatatcaccttcccaaggaggctctgaacaccatatttaaaatcacaaatttgtccaccaaaactccctgtatccttcttagtgtacactctagttttctttaatcatttccaaaacacttatggctttctcatattctatataaattacttattatatattgttttatatctattgcctccttctaggatgtaatctctgatatatcccaaatgcctagaaaggtatctggcagagtagacaccgaataaaaatttgaatacatgaaaatatactagactatcttaaaatacaataaatatatagtatgttctttttgtttgttttttgagacagggtctcattctgttactcaggctggactgcagtggcacgatctcggctcactgcaacctcagcctctcagggtccacaggcaggtgccaccacgcccagataatttctgtatttctttgtagagacacagtatgccatgtttccaaggctggtgttgaattccttgatacaagcaatcctcccacctaggcctcctgagtagctgggattgtaggcatgagccattgcacccagccttgatgtcattatctaatgtctcctccttaataaattgttaataacccttaataaattgtggctaacataccttttacaatacaactctagaccattaatgtgtcccataaatcctgtgtgcatcaggaggtatcttttttgcctcaatgccttttattaatgcactgtcagtattctacttgggctttattcaaatacaagcctataaaactactgaatctttttccatccctcctactttcccattcttgatttttcccctacctttctctacaactccaggtgaccagcaatgacaacctaatatgtatcactccataccttcttctccatccttaaataaccacgtacaaacatatgtagagatttaaaattctattttgtttctttgggaatgaagttgtccccatatatgctccttcacatcttatttttctcatctcatagcaaacagtggaatataactacattaattggtatacacagaactccattctttttaatggccgcatgttacaaggccaaaatgtatcaaatgtattcaacttttcccaccttgtttccagttttttaccactaataaaaatactgcaaaaagatccttgctttgaaaaatgcatatatccttacatatttatgcttttatttttatgagataaattctaggggtaaaactgccaaaactgctttccaagaaaagaagtaaatgtcacatttctaccacaaatgccttttgctctaatttgccaccaatattgagtggagccataacatttttaattttggatatatgatgatatctcagccaggcacagtggctcaagcctgtaatccctgtacttcgggaagccaaggcagatgaatcacttgagatcaggagttcaagccagtctggccaatatggtgaaaccccatctctactaaaaatacaaaaataagccggctgtggtggcacccacctgtagtcccagctactcgggaggctgaggcaggagaatcacttgaacctggaggcggaagttgcagtgagccaagattgtgccacagcactccagcctgggtgacagagcaagactccgtctcaaaaaaaaaaaaaaaattagcccgggcatggtggcgggcacctgtaatcccagctacttgggaggctgaggaaggaaaatcacttgaagccaggaggcagatgttgcagtgagccaagattgtgcactgcactccagcctgggcaacaagagcaagactctgtctcaaaaaaaaaaaaaaaaactcaatgttactttaatctgcatatcctaaagtactattaatcatcttcctatgtgtcattagtctattgggatttgcatttctgtcaactattcatctctctccctgttttttatactggattgtcttttgacactaatttgtagttttttttaatatcgtagatatcaaccatttatctgtaatttgaagtataaatatttttcccaacctaccgcttatctattgagtttgctgccaatgagatcccacatataagttacaaaaaaaatcattatatgattagatttatttttctttcatagctcctgcatttcctatgttggttagaaacttctcccaagtttctaattcatgcatatagtccagaattcatattcttccatgtaagtctctagtatacttagaatttatttaggtattgtaagagaccaaagattcaattttctttcagatgaacagataattccaaatgcatgattatcattttcccattgagctcaaattttcacatttatcatattaaattcccaacagactattgtaattacagtagctttagaatttattttaatatctggtaaagctattcatttctcacttttttctccataattttcttagtcaacaagtatgaacattatgttacccaattccaatgtaaaccataaaggaattttaactagaactgcaattaacttttaaacaatttttggtaaaagattattatgatatagtttttgcatggcaacacaatattataagaattgggaacatatttttaaagccagcatgctctttccttcatttcaattccagtgtaatgtctttcaattagatttttacgaatttcttcctacagaagtgtacttcttttgttaactttattcctaaggattttctagtttttgaaactacttttaattgattactttttccaatttttctttaataacattattatcagcactgagaaaggctaccaatttctgtgtattttatatacaactattcaccaaattatgttattaagtctgataatattttactggtaccttttggatatcataagcatacaatcatatcagcaaaataaaatgtatttttcctcttcttttctaatgttcatacagattatttcattttttacctcattcaacatgctagaacaaaactaaataacgataatgataataatgataatagaggacatacttgttattagaaataacattagcattccactgtttaaaatgtttacttttgaagaatggcccggagggcagccaagatgaccgaataggaacaactctggtctacagctctcagcgtgagcgacacagaagatgggtgatttctacatttccatctgaggtaccgggttcacctcactagggagtgccagacagtgggcgcaggacagggggtgcagcgcaccatgcgcgagccaaagcagggagaggtattgcctcactcgggaagcgcaaggggtcagggagtccctttcctagtcaaagaaaggggtgacagagggcacctggaaaagcgggtcactcccaccctaatactgtgcttttccgacgggcttaaaaaacagcgcaccaggagattatatcccgcccatggctcggagggtcctacgcccacggagtctcgctgattgctaggacagcagtctgagatcaaactgcaaggtggcagcgaggctgggggaggggcgcctgccattgcccaggcttgcttaggtaaacaaagcagccaggaagctccaactgggtagcacccaccacagctcaaggaggcctgcctgcctctgtaggctgcacctctggaggaagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctggccctggagccgcctaactgggaggcacccccaagtaggggcagactgacacctcacacggccgggtactcctctgagacaaaacttccagaggaacgatcagacagcagcattcgcggtcacgaaaatctgctgttctgcagccaccgctgctggtacccaggcaaaccgagtctggagtggacctctagcaaactccaacacacctgcagctgagggtcctgtctgtaggaaggaaaactaacaaacagaaaggacatccacaccaaaaacccatctctacatcaccatcatcaaagaccaaaagtagataaaaccacaaagatgggggaaaacagagcagaaaaactggaaactctaaaaagcagagtgcctatcctcctccaaaggaatgcagctcctcaccagcaacggaacaaagctggacggagaatgactttgacgagttgagagaagaaggcttcagacgatcaaactactctgagctacaggaggaaattcaaaccaaaggcaaagaagttgaaaactttcaaaaaaatttagacgaatgtataactagaataaccaatatagagaagtgcttaaaggagctgatggagctgaaagccaaggctcgagaactacgtgaagaatgcagaagcctcaggagctgatgtgatcaactggaagaaagggtatcagtgatggaagatgaaatgaagcgagaagggaagtttagagaaaaaagaatgaaaagaaatgaacaaagcctccaagaaatatgggactatgtgaaaagaccagatctacgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaagttacccacaaagggaagcccctcagaccaacagcggatctctcggcaaaactctacaagccagaagacagtgggggccaatattcaagattattaaagaaaagaattttcaaaccagaatttcatatccagccaaactaagcttcataagtgaaggagaaataaaatcctttacagaaaagcaaatgctgagagattttgtcaccaccaggcctgccctaaaagagctcctgaaggaagcactaaacatggaaaggaacaaccggtaccagccactacaaaatcatgccgaattgtaaagaccaccaatgctaggaagaaactgcatcaactaacgagcaaaataaccagctaacatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagattaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacactccactgtcaacattagacagatcaaccagacagaaagttaataagcatacccaggaactgaactcagctctgcaccaagcggaactaatagacatctacagaactctccaccccaaatcaacagaatatacatttctttcagcaccacaccacacctattccaaaactgaccacatagctggaagtaaagctctcctcagcaaatgtaaaagaacacaaattataacaaactgtctctcagaccacagtgcaatcaaactagaactcaggattaagacactcactcaaaaccgctcaactacatggaaactgaacaacctgctcctgaatgactactgggtacataacgaaatgaaggcagaaataaagacgtgctttgaaaccaatgagaacaaagacacaacataccagattctttgggacacattcaaagcagtgtgtagagggaaatttatagcactaaatacccaaaagagaaagcaggaaagatccaaaattgacaccctaatatcacaattaaaagaactagaaaagcaagagcaaacacattcaaaagctagcagaagggaagaaataactaaaatcagagcagaactgaaggaaatagagacacaaaaaacccttcaaaaaattaatgaattcaggagctggttttttgaaaggatcaacaaaattgatagaccactagcaagactaataaagaagaaaagagagaagaatcaaatagaagcaataaaaaatgataaaggggatatcacgaccgatcccacagaaatacaaactaccatcagagaatactataaacacctctgtgcaaataaactagaaaatctagaagaaatggataaattcctcgacacatacaccctcccaagactaaaccaggaagaagttgaatctctgaatagaacaataacaggctctgaaattgaggcaataattaatagcttaccaaccaaaaaaactccaggaccagaaggattcacagcctaattctaccagaggtacaaggaggaactggtaccattccttctgaaactattccaatcaatagaaaaagagggaatcctccctaactcattttatgaggccagcatcatcctgataccaaagcctgacagagacacaaccaaaaaagagaattttagaccaatatccttgatgaacattgatgcaaaaatcctcaataaaatactgacaaaccgcatccagcagcacatcaaaaagcttatccaccatgatcaagttggattcatccctgggatgcaaggctggttcgatatacagaaatcaataaatgtaatccagcacagaaacagaaccaaagacaaaaaccacatgattatctcaatagatgcagaaaaggcctttgacaaaattcaacaatccttcatgctaaaaactctcaataagttaggtattgatgggacgtatgtcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatcaagggtattcaattaggaaaagaggaaggcaaattgtccctgtttgcagatgacatgattggatatctagaaaaccccattgtgttagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaaattaaaagggacgtgaaggacctcttcaaggagaactacaaaccactgctcaatgaaataaaagaggatacaaacaaatgcaagaacattccatgctcatgggtaggaagaatcaatatcgtgaaaatggccatactgcccaaggtagtttatagattcaatgccatccccatcaagctaccagtgactttcttcacagaattggaaaaaagtactttaaagttcatatggaaaaaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggatcccctatttaataaacggtgctgggaaaactggctagcgacatgtagaaagctgaaactggatcccttccttacaccttatacaaaaattaattcaagatggattaaagacttacatgttagacctaaaaccagaaaaaccctagaagaaaacctaggcattaccattcaggacataggcatgggcaaggacttcatgtctaaaatgccaaaagcaatggcaacgaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagacaccatctcacaccagttagaatggcgatcattaaaaagtcaggaaacaacaggtgctggagaggatgtggagaaataggaacacttttgcactgttggtgggaatgtaaatgagttcaaccattgtggaagtcagtgtggcgattcctcagggatctagaactagaaataccattgacccagctatcccattactgggtatatacccaaaggactataaatcatgttgctataaagacacatgcacacgtatgtttattgtggcactattcacaatagcaaagacttggaaccaacctaaatgtccaacaatgatagactggattaagaaaatgtggcacatatacaccatggaatgatatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtgggaggtggggggagggatagcattaggagatatacctaatgctaaatgacgagttaatgggtgcagcacaccagcatggcacgtgtatacatatgtaactaacctgcacattgtgcacatgtaccctaaaacttaaagtataataaaaaaaaaagtttccttttttatatactttatatttatgtactcaagaaaggctgttgaattttattcaattttttcagcatccattatcatcatctaattttccttcttcaatttgatacaccctacttgatattctttaatttatgcagaattattttcagttaaaggctattaattagtgcgtcctttttatttcaaaaattcttatttagtatgcttccagtcactctatcattatccattgggatttggtaatatatatagaaagatttattgtttataactgtttcttcttcataatctttcaaggcctcaattctgattcatttgctgtttggttatagttagttcaagtattttcctcaaatgaagcaaatgagagttatattctgtcaatctctgaatatctaaacatatctttactctgaaaggtggatgaaatactggttgagtcactcattcatttattatttaataagaattactctacgtaatacagatggatacaaaatgacaaaaaactccctgcctttaaagaatacatatattccagcagacaaagacagacaataagcacataaatgaatcaattaattaaatataaaatggttagaagagctaagaaaaaataaggcaaggaaaggaaaatcttctataatatatacataacagtcaagaccgacctctgattttgacaataatggccattcacccatatatagtgctttctaagtgccaggtactgtggtaagtactggacacacatcaaatcattcaatcacaaacaacccttcgagatagttactatgaaaataaaaatgctataactggtgaaactgaggcacaaacaagttgatttaccaaaggtaaaacagcaaataagtagtagaaccaagctgtccagctcttaaccattatgttttcttgcttctctgataatatgccatttcagtagataatgaaaggaaatgagggcaggagagagacccatagggttatatggaagaatagaattcctagcgaaaagaaaagccaccacaaatcttataaacgccatgaaaaatagatataaatacattaaaatatttgtattataatcttagactcaaccttaaaatatgtggctgaaacaattcctcacatgtatagagaaatgtttaggttatattaccttatcactcaagaattgatcagataaagtactcaggattaaaatgcaaaaaagcaaaaaaaagagtattaagagtatcttaatgtgatttcttaaaatttatttctaaaactaaatgctagaattatataaagtgaagaaacacagacacattctcaataaaaatggaaataaaactagaataacagtctacctaccacccctatgtaccaatactgtaatggatcctttacacacaatttctcatttagtccttacaataagcctgtgattccaataaatctattgtgtccatttaatatataaagaaagtaaaatttaggagaatcagtatattgccctaaagtcacataataggaaaagtgggaagaaataaaatacaaatttgtaaaacatcactgtataccttaaacatataaaatctttatatgtcagtatatctcaataaagctgctgaacatatgaatttgtatgatggcatgagcacagactattagatccaagaaaatcaattgtctatggtaaataagttcagcaaaattataggatatatggtaaatccaaaaaagtaattccctattgaagctggactgtgcggtagagaaaaaaaatgagctttggagcaaaatatgcttgattcaggtcaggcagagaaggctatggagttaactgaagagggagtgctgctgagattagtacctgcagggtcatgcttgcaataaccctagtggatgcaccagtgacaaagttgctcagcaacaacagcaaactaaagcaaacatatctgttcctagttctgagagatcaaaaggcaaccaacccaaactatgtaagaagttaagaaccttactccctttcagccctcattctcttctcttctcaatactactacttttacctcctgttaactacctcatttttctttctttccttgctctttgactctttcttgctgacgcttcccttctaggtctcttttttcctttcaatcaccccctattgaactgctttcttccctctcaccaccagtttggtttcaagaggattcttaaataacttcattacctccaaatacattttgatctcaaaggtcatagctcttcttccaatattagtaatttaagaattactaatgagacaaatccacaggttaacatgaaacaattccacatgtcacagagttaaaaaatgggtcaaacacactgacctgtttatgttaaaatattatatggctttagaaaaaaattatgccctaaatacaacatgcgctgcattaacaactgcattaacaacattttagtcctttagatatgcaaatacttattgtgttacaattgcctacagtattcagtacagtaacatgctgtaaaggtttgtaatctaggagcaataggctataccatataccctaggtgtacagacagctatattatctaggtttgtataagttcactctatgatattcttcacagatttctcagaatgtatttccatcattaagcaatgcatgactgtattaaaaattctttcatacaatttttcattatttttgcaaaattcaaggagtaatatatcacttatttaacaaatgttaacaggatatttcagaagattggtgtcaaaaagaaactcagttattgctttaatgtctctcagcaccaaatttcttttccatttggacttaataacaccttacatatacaaatgattcacaaaagacaagtcctctacagtttactatcatgagactcagaaaccagtatcacacaatgcttttaattcttatcatattactaaaattttatcagaaacagatgtcagcaatacaattttgatggaattacttaactttttttttttttactttcataacaaattaagcattgctcagttgaaaagttataatgtcacaagccttgaggcagcattaggtgctataatttgaaccgatgcagtgtagagtttgcatgctagtagaaaagaatttattagctacattgttgataattatttaactagcaaactccaagttttcttaaaaacacttccaatcaattaaatatctaagaaaactaataaaataactcaaagttttctagatgtataattaacatagcaatacataagttagcaatatagctgcaaaacaggtggaaaatataaccattaaaatgacttccatcctttcggtaggaagtagcttaaaaaaacaaataaaaataaaaacaaaaacaaaaaataaaatgacttccaaagaacaaaccaggcaaatggtttatgtccctaaataagctgaagcctagagataaagaaatttagtgggtaaaaaggaaagataatctatactaaaaacaaaaccaaaaaatgaacgaagacgatgaatggataaacaaaacgtggtataaacatataattgaatattatttagccttaaaaaggaagaaaatcacatgctaaatacagatgaagcttaaggacattatgctaagtgaaataagcccattgcaaaaagaaaaatactctatgattacacttacaggaagtatctaaagtagttaaattatcatagagacagaaagtagaatggtagttaccaagggctggagggaggaagcaatggggagtggttacttaatgggtaagagttgcagttgtgctagatgaaaaaatcctgcagatctgctgtacaacaatctgaatacatttaacgctactgaactgtgcactgaaaaacagttaagatggtaaatttttttaaccacaattaaaaataagagctttttaaaagaatgtaaagtaaaaatggaagatctgtgcacaatttttcttacgggcaaagaaatggtacatcttacaggtaaaacatgtatgttatgtgttacaactttagggaagccaaaggttttaatatctgatgccccatgaatgtgatatagcagctctctccatatcaattctgacaaacactatcaactttatttcttaaaactgtcccttagccatattcattcacccctctcccaccaatgttgtaggattccaagccaagactttctgctttgaagccctttaccaatgcaatcagtacccaacatacaactttccatccagtatttgtcagtcaagatatcacattaggttttcccttccctcttctcttcactttcccatcatcactgtagaagcctctgctacctgggacttcctctccctcctcaaaaatgaagaagaaattaagacattcccagataaacaaaaactgagagaattcactgctagcagacctgccctgcaaaaaacaaaaaggaagttcttcaggtagaaatgaaaggacactagatactaacttaaatccacacaatgaaatcaagagtacagcaaaggtaactacagaggtaaatgtaaaagacagtataaatgtatttttttcttttctttgtaactctttagagcactcctaccataagtataaattacaatttttaaaatgtcacgctacaattcaataggtaaatactgaacctgttttaagaagtacgttttatatttcacttctagaatagagataactaaaggaaatacagcctctttgaaaataaggaaatgcttcaaaacaaatctgtggtagatgaactatccctcacatgtcataggcatatagtactcttataacttgattatttagctcaatgaagttttaaaatactaaccacatcttattttacctcttttatatctctgggacctgtccctttttctctatcaccgcagctaataccttaatccagggtatcatcatttctcccctggattattggcagcctcctaatgggtattcctaatattagtcctgctccactttaatctgtttcctatactgatgccattagtgacataacaacaacaacaaaaatcagatcccaccattctgctcaaaattttcaagtggcctcccataatcttcggggaggaaaaatttaaattcccaaataatatacaggtcaggacatgaccactacctctgtctccagtattagaatcaccacatacataaataatctacacccacattctctgctacagcccttaagagttatttaggatcccagaataccacacatctacttttatacatgcttaccttctctgattagaaaaaccttactttgtctacccccatctctacttctttagtcttcaggactcagtgcctatacctaccacccaccctaactcccaataatgctgagttatatcatctcatagattctagtcacaattaccacagtacttaccaaaatgtactataaacacctgcttgctatgtatttatcccacagactgtaagcttcttaagcataaagattgtttccttactcctattttttgtccctagtatacgcaaaaaatgtctgccatggagtaagtgtttaatcaatgtttgaaaaaaatgaatgaaaggatgaagcaggttgtacattgagagacccatggagaagctgttcaatttttactatctataacaaagacaaacatcaaaattaataatctgataaaactgaaataccaaaattaatctttactttgtaatcagtaaaaataagtaaatcgatatactaatgtaattcttaatttttgtagttcattcttcaaaatattttattcaagcaagtgggatccagcaaaaaaatggagaccctccccaaaacttttacaaccagaaaatgagcttctttcaaattctgatgtggaattcccaagtaatcttgcagcaaattaaacaatatgatctatgatccatatgtaggccttgactattaaacttattttgtcttattaacagtattggagggatttttttaacaccatggattaaaaagtgaaaatgagttttttaaaagtaaagcttaaataacactctatctactgttttgcaaatgtgttatgaaggctttgaaaccacaaaatttccaacagacctaaaaatgtataatgtgctatatgtcaagctgtatttctttttttttttttaaactttaagttttagggtacatgtgcacaacgtgcaggtttgttacatatgtatacatgtgccacattgttgtgctgcacccattaactcgtcatttaacattaggtatatctcctaatgctatccctcacccctcccccaaccccacaacaggccccggtgtgtgatgttccccttcctgttaattcaagatggattaaagacttaaatgttagacctaaaaccataaaaaccctagaagaaaacctaggcaataccattcaggacataggcatgggcaaggacttcacgtctaaaacaccaaaagcaatggcaacaaaagccaaaattgataaatgggatctaattaaattaaagagcttctgcacagcaaaagaaactaccaccagagtgaagaggcaacctacagaacgggaaaaatttttgcaatctactcatctgacaaagggctaatatccagaatctacaatgaactcaaattcacaagaaaaaaacaaccccaacaaaaagtgggtgaaggatatgaacagacacttctcaaaagaagacatctatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacagtgttggtgggactgaaaactaattcaaccactgtggaagtcagtgtggtgattcctcagggatctagaactagaaataccatttgacccagccatcccattgctgggtatatacccaaaagattataaatcatgctgctataaagacacatgcacacgtatgtttactgcagcactattcacaatagcaaagacttggaaccaacccaaatgtctaaaaatgatagagtggattaagaaaatgtggcacatatacaccatggaatactatgcagccataaaaaatgatgagttcatgtcctttgtagggacatggatgaagctggaaaccatcattctcagcaaactattgcaagaagaaaaaagcaaccaccacattttctcactcataggtgggaactgaacaatgagaacacaagttgtatttctaaggtaggagaaaggttacatagtctttaatactttctcctttacaacaaacttttccttatatataaaatacagcaaaaatagtaccttttgttcaaaggattgttgagaagactagaattcacgtaccacacttttgcctcatgcacaataaaaactttttacatgtttaggtgttattattactataattattatgacatatccaagtcccaaaaagttatcagcagtatactctgcaaaggaaaagaaaacacaccactcagataagtctatattcattaatgaatatatctacataccaaacctgcccccatttctttctactgattcccatctaattgaagaaagattttagtagtattctgctgtggattgactcttaaatcacttcactaataaagtcctatgaaaatttaaccaccaccaaaaaaaaggggatcagcacttaatcgcaatcctggattgcaatatgagtgatcagatgctaccccggtctgggtcttcatttcttcatctgtccaatggcaatcacagttcctatcggatctcatagggttaactatctgtgagaatttaaagattataatttatgtagaattgtttgctaagcttgaaaatacttcataaatacagactaataatactattgctgtacaatgccaaataataaatattctacgttttaagcagattgtctttgcttccttcagaaccaggtcttgactctttagcccaacttcgtttggtttggatatataaaacgacatcttataaggtgttcccttcaagggtactttatattactatgcataagaaatgctttccatattaactgaaaaggagatgaactaataagttcaccgaaagcataaatgactaagaggagagagaatgatctctggctttgagaattctcttagaagtactgcctataatcccagctacttgggaggctgaggcaggagaattgcttgaacccgggaggcggaggttgcagtgagccaagatcacaccattgcactccagcctgggcaacaagagcaaaactccgtctcaattaaaaaaaaaaaaagtatctaggtatagtaagtagtttaactaaaaacagtcttagaaacatggatcccaattcctaccctaaattccactaggacacaacattcttataattgtatgtactgttctttcttgccaaggtactcagcactaagaaggcaaattcccagaaagaatgaaaagtgtaagaatgtatgtgcactaactttaacttcctactgtgtgtcaaacactatctttacctactttctcatttaactctcaaaacaaacttgaaaggtattacatcttttttacagatgattacgttacgtaattcacagagatcgtattagagagaacaaaatgctgaaactaaaggtctgactacaaaggcagttctttctatttcaccacactattgatcctatgaagcagaagtcaaaattttaaaatgtcatcagagggttgtatccccattgaagtagctggttacataaaccaccaaggtttctttttgtttgtttgttttttgagatggggtcttgccctgctgcctaggctggagtgcagtggcacaatcatgactcactgtagcctcagtcttcccaggctcaagcaatcctcccacatcagcctccggagcagctgggactacaggtatgtgcaactgcgcccacctaattttattttttgtagagacaaggtctcactatgttgcccaaactggtctcaaactcctagactcaaggaatcctcctacctcagcctcccaaagtgctgtgattacaggcatgagccacaaccacacccagtacccatcctgattttttttttttttgagaccgagtcttgctctgtcgcccaggctggagtgcagtagcgcgatctcggctcactgcaagctccgcctcctgggttcacgccattctcctgcctcagcctccagagtagctgggactacatgtgcccgccaccacgcccggctaattttttgtatttttagtagagacagggtttcaccatgttagccaggatggtctcgatctcctgacctcgtgatccacctgcctcagcctgccaaagtgctgggattacaggcgtgagccaccgcacctggccccatcctgatttttaaggaaacttcaacacgagttcttccagtcccttttaaatgatggacactgtcaagaagtaaatttcacctaataactggtttatccagaaagaaaactgactcctcattcaaatggcattatattaaaccagaataatctccttaccttgacacaatggtttttgtaaatgtaaaaaaaaaaaaaaatcacacagaggtattctgattcatccaaggacattttctatattagcctagtaacatatagaataaagtaatatacaagaaaacttaggggtagacaggtatatattcagccacatgcttctcaataagaaaaatgatttatctactgtaagaaaaagtaaccttatagtaaaaaacagcagcagaatattacttgtaatagatgttaaatatttagtgtctctgttagttctatatacagttatacctaatcatgttaagtgtagagatttagcctcataaatatttctataacagaatataacctatatttcttaatacacaaggcaaatgtaaataaaacaaagatttgctggtctaaatacccaattctttaaaagtaaaccaaaattttcccatataaattttcctttggagaacacaggaataaatcccatctgatgaaggaaattatcaaaagaatacacattgatctaacatgtctggctcagtttgcctattataaacaattctggtctctggacatgaaaaactaataattttcagccacttgttttattacatctaagtctcaattattcacaactaaaaaagatagaataatgacattttacaatgtcccaaacacatgaatcaatcatacagcaggtggaaaaaatgctagaaaagataacatttgtgtcagctttacctctctctcacaggagtctcaacagtgtaaaccttaattcgtatatcttgactgcccagagccttccagagaaaaggatcatattgtctttttaaaaaatctcaattgtcaataactgaaggaaagcaagcatagctttccaaaacaactgagtccagatattttttccattgttgctgtcaattacttttctaatttctaattataattctaataaaaacttcagcataactaagaaagacaaactaaaactactcaggaattttcatgcaaaacttccaattatgtgtcctaaactcttttactccaacatgagttcacaaactctgacagatgttttataaccctgtttaaatatttagtcagtaaaaggataaaatttttaaaaaacagaatgatttcattcttttcaaaaaccagggtggtctatgggcaattttggtactagcagtgttgccgggggaacaaaatgaaaacaggtgtcatcaaattcaaattaaagatttacttctattttaaaccaccttaaacaatgtttccataaactttctaactgatactactataaatttgacaatattttataacaagaaaaggattataaattgtctgtagaccatcaaattttaactgtaacaaattttgactgattggcaacacttccttttaaaaaacttttttcattaaatatgcagcatcattttaaaaattgaatgtataaaaggcaagtcaaaataagaaaagagagcaagtatagactctgatagtcttttctgaaagattttactttgttttgagcctatgctgttttaaaaataaaaaacgaagtacaaaacaaatgttaaattcacaacatataaggaaaaagtgatacaattagtaacatgacaatcataacttttcctcataaacttaattgaactacaatcttcaatgttaaaaaaatccattaatttttgtgtcttattttggtaatgaaaagagtataaatacttggtttctaccattaaatagcacttatttttactcttaaaagagatgatgaagcaagtgactcaccatataaaagttaatcaatgcttaaaaatacattagagtattagacactttctcagttgtttaatacagtttcagtgacaaaatacacttacttttgttaaaagctttaattaagaaatgaacatataagaaatttttaaataggtaatattgcagattggttatgttcttcttaataaaactgtttaagattctttcagaatggattaaatacttacccagtgaggattctagatacaggtaagatgaggtgtacattcttcagtattattaatttaaacagaattaatttctctttgtattagttttgacaggtgaaaacttcttaaacttttaggggcatttaatcttgcactgaggagagtccttttatcttgactgtgaataatcaaattccattgtcatttcaaatctttcagacagttcaaagttttatttttagcagtgcttcagggaggcacaagttggttcactagtgtggaatcataacttacagtcagctccaccagttggattatttccaatatttattagtttcatcaactagttttcaaaaaagcttaaagtttcagtattaatagataaatgtctttgaaactaatatttctagcttaaagtttccattaaattgtatttataaaaataatacaaaatcttttttcagattactacatgtattttaatagtaaaagaaaaatatacagcattatataatgttgaacaatataaaacttcctttacagttagtttaaaataatctcacttgcatataattataaaattactatactcatctattgcttactttgaaagtgattaatcaaagtcagagaaagccaaccatcaactgaagtgtgttacaaatttccttctcagaggcacatcaaaaaaagatgagtcaattctactttaattaaaaccttgtttaagaatatgaaataagtgttttctgtataattccaattatatttcaattgtgttcagctttcaaactgcctctgctacttgattacacgtgccaaattaatcttgtcttttttttttttttttttttgagatggagtcttgctctcgctctgttgcccaggttggagtgcaatggtgtaatctcagctcactgcaacctccgtctcctggctccaagcaattctcctgcctcagcctcctgagtagctgggattacaggcacgcaccaccacacctggctaatttttgtattcttactagagatgtggtttcatcatattgatcaggctggtctcgaactcctgacatcatgatccacccacctcggcctcccaaagtgctgggattacaggcgtgagccactgcgcccggcccattaatcttatcttttaaatcatatcaacagttctaaaaaaagacttggattttttattgttctagtgggtattgttctagaagcaagactcctctaattgatcataacaccaagcctaccccttagctgacagttcagatgtgtgtttttggttggttcaaatacaggaagacaccctttgtatacatttgactaattagtcaaagaataagaaggcaggggaaagaaatttatctaaaatattttttgactaatacatagcagtcttccaaaaattcaaagtggaatttttagagaaactacatgttctaacatgttctcttagggtgcttcatacagatcgtcaaggaagtatcccaaaaaaaatcaatgaacacccggaatacagggtcttcaacagaatcaagcaacatgttacacaactgagggtaacaaagtatcagtccctacaacacttgtgtcaaacaaatctgtttctcctttcaccttacttacctcctttctcctaccctgttctatgtatggcctagcccttcgaagatacccaaacacaggaaagattaaagatccctttcaaacgatagaagatctctttcacacgatagatgataaaatgaagagatgttcagaaggctgtagctgctagcattcttccaccataagcttctccacctatatctgtagtagataactgtacttttagataacttttcaacccttttgaagggtttcaggttaacaaatatttgaaaattagtactcacaacactgtatataaaaatgaatagaggccaggtgcagtagctcatgcctgtaaatcccagcactttgggaggccaaggcaagtggattgcttgagtccaagagttcgagaccagcctgggcaacatggtgaaaccccatctctacaaaaaatagaaatattagctaggcgtggtggtgtgtgcctatagtaccagctactccagaggctgaggcgagcaggtgcccaggctcgaggggttgcagtgaaccgtgatcgcaccactgctctccagcctgggttacagagtggggcctcatctcaaaaaaagaaaaaaaatgaaagaagtatggactcaggaaagaagtactgacacatgataagcaataatctagatgcaaataaaaatcattagatttaatataacatctttaggctcaaatggaagctcactaaatattaagtcaatcaacactgatagaggcaggaagcagaaaaatcctagtcagacagggtgaaaccccaccttcaagtcaaaaacagcctgaaacccatgacccagagagagaacttctatttctgtttgcctgctctttcccaactggttctttctgaataatgctttttaaccaatcaaatgttgccttttccaatactacctgtggcccatgggcccccccgatcctgtgcccataaaaaccccagatccagccacactgagggagatgacccaacttcgagtgagagaccaccttcctgtcccctctctagactgagagctgcttcatcactcaataaaattctctgtcctcatcacccttcaattgtcagtgagacctcattcttcttggacatgggacaagaactcgggacccactgaatgtgggggctgagtgtgcagttgtggcagctgtgggatccacactggagtgcaagccagatgcggcctggcaggctgagtaaatggggcacctgctcctgcgagcccagcaaaggggccaagaaaaatcctgcatcaacactatttaaatgttaaaggaaaagtcaatataagtaacatgtataacacactaaaaatatattaatgataaggcaaaatgaaattagagaatgtataataaagctctgtgggataagaaccttctcttataacattctgtcaatggctgaacttccagaaacattacctatgaaattaaggacagcctttgtaaatagaagggctaactccttacatggagacttaccacccagaactattgtctgaatccatctgagggggaaaaaacccatttccatggtaaggaacaaagcagagacaaagttcattacagctacatacaaatggaaatgccataaattacataaaagctcatacaacaaagaaactagcaacttggttatttgtatacatagaaagacagcaggaaataaaatattttatattatatgaaaacaaaatgcttaagaactcactgacacagttatttgacaaatatgctgaggtttttgtatataaattttttagtttggggtttttttttgttttttgtttttttgggacagggtctctcgctctgtcacccaggctagagtgcagtggtgtaatcatggctcactgcagcctcgacctcctgagctcaaaagttcttcccacctcagcttccagagtagctgggaccataggcacataccaccacacttggctactttttaaaaaatcttttgtagataacagtgatatggtttggttctgtatccccacccaaatcttaccttgaattgtaataatcctcaggtatcaagggtgggaccaggtggagataactgaatcacaggggcagtttccccctgctgttctcatgatagtaagtgagtcctcatgagatgtgatggttttataaagggcttccccctttgcttgccactcattctctctcctgccaccctgtgaagaggtgccttccaccatgattataagtttcctcaggccttctcagccatgtggaactgtgcatcaattaaacctcttttctttacaaattactcagtctcgggtatttcttcatagcaccatgagaatgaactaacacagacagggtctctcaaacttgcccaggctggtcttgaactcctgggctcaagtgatcccccaacctcagcctcccaaatatgtagacccagcactttggaaggctgagacatggtgggcggtgggtgtggggggttagggggttagggggtgtgattggtgggggtgttgtgccaaggggcttgaggtctcaaagagctacgatcccgccactgcactccagcctgggcaacagagagaaaccttgtatgggaaagaaagaatttttgttttgttttgttttacagctttgggaaagatcttttctatagaatcatatatctgatattacaataaaattatgactcaaaaatttgttttacataaaatctctcatctacatgtcctcaagctaattacttaaacaacatcaccatctcttccacaggcactagcacatttagaaaagaaagaggtttgggttttgtttttttcctgtactcaaagttcagctaagtaaagaaacaattatttcccaaaggtttcaaagcaattgcctcagtaaatcaaaagaatgctttcctattagcaaagccatataatttaagagtaaagggttaagatgatttaattttctcaaagaaaaaagtgaaaagttaggtggctatacagttaatgaccagaattctggaaaactgccaaattcaggcacattctaaccatcaagttattactatttagtggaggtcgggggcagtcactaagaactttttatgcaggtttaaattttacatacagagaagccatataattattgtgaaatacttcaagggattcaagaagaagctatgacagtttgctgtgtttctttaaaaaaaaatgcacatttactgactttgagtggtatttagttccaaaaatatcaaaaatatcagaaagataatgtctatatttaatatttggtattacatattttggttatggcttctaaactttctcatagcccaggcactcagctattcaacctaaatttttccagttgcctcaatgttatataattcccttttcaattttgttcagtcatacttaggatctactttatacaaggatgaataaaacactattttacatctaggtcataagaccaggatataaagtccagtgtctgggttctaatcctggttctaccaattactagttctttattctctctataccttactttgatcatctgtaagctgtagatatagtactaacacccacaaaatagggtttgatgtgagaatcaaataagttagtatacaaaaaatactcagaacacaaccatataaaggaataaaatgcgtgctacaacataaatgaacctcaaaaacattaagctaagtgaaagaagccagacacaaaagtcacatattgcatgattccatttagataaaatatataaatccataaagacagaatgcaaactggtggttgccaggatcggaggggtggggaggggcaggtgggatggtggagaatggggataaaatgcttaacaagtaccgggttgtattttggagtgaaagaaatgttttagaactagataagagttctgaaggccactgaactgttcactttagaatggttaattatatgttatatgaaattcatctcaataatttcaaattttaaaaaaagaaataaaaaacaatttattaacaccatccaaaaaaatacttagaacaatagcagtgatacaaaatgagttcagtaaatgtacactgtaataattatcaatgccacataaactggtaaatatgtagaatactatgctacattccaaagattaaaataaatatacataggtttggagtttatgttttcttttaagtactcattttaacaatttatttctcctaaattcagcatgaaattatgtaattcatctacaaggaactctcgcttcctccaaaagagacactcagagagaaaatacatatgaaaaatggaaactaaaaatttattttgtacatttactgctatatgtcatccaagttatgttattttaacatacagtgcttatgtgttaaactatctgggaaataaagagatgacatgcatgaagaaaatatacacaaaaggacaaccaaagaattattttgtaaatttaaccccacaaattataaatattatattgttacattcagttgtttaaacaatatataaaataccactaaaagactcatacacatatttataaactcaatgaaatgttcaatttgtgatgaatcagaaaaaaatgagaaaacatcttcataatgggatacaaaaatggaatttagaactggatcagcctggggaaagcaaattttaaaaagacaaaatcatagggctagatttgtggatatgagaaatcaatgaattcatttttgaggcaaaaaaaggtcaaagtaaaaaagcattctatatatcaaacttaacacatttatactatagtttaaagaatatgtcaacaaatgaagagatcacagttcccaaataattatagcagccaaaaggtcaagtctaaaaacccttcacttcaaataaaaagctactaggagagactatgaggtactttctactaatatctcagaagaaaactcatgaaatattcaaaagcaagagaataattcgtatcttccgtttctttgcctcacatatttgttttactattagaagaaggctgtttttttgttttctttgtcatgactaatgtttatcttataaatttctattaaatgtgttaccaaaagttcctgtcgggaatggtaactacatttcacatacacatttataaacaacaaaagagaaaactgtcattaattttaatatggaattaaattattagaataaactttcaaacatatgttgaccagtcaaagaattgtggcatgatgcatgtagccttcactgtttcaaaagcacagagtttaggtcaagctccttaaaacagccaaatgttttaacaagtaaagaaaaatatacataaagtgcttcatgaataaaagtagttcaaatgaacaaggcttgtggaaaataaagcactgtacagattttatatcaaacatgccaagaatgttaataacactacactacactatatatgagaaagaactctccaactacaagaattgttatattaaaaatatacatgttatctttttctgttaacatctttaaacaaataagtcagctagcttcctgaaatgatgtaaatgtgattcaacctaaagatgtgattttcttgcacgtcatgagttccataaatctttgaatacaaatattatgcattttatatgccatcttatctgtatgtctataaaaaaaatggctgagctatggaaaaacagtatggtggttcctcaaaaaagtaagcatgaaattatcatatgatccagcaattccacttctgggtatatacctaaaagaattaaaagcagggactcgggctgggcgtggtggctcatgcctgtaatctcagcactttgggaggccgaggtgggtggatcacgaggtcaggagatcgagaccatcctggccaacacggtgaaaccccctctctactaaaaataacaaaaaactagccagacgtggtggcgggcagcctgtagtcccagctactcgggaggctgaggcaggagaatggtgtgaacccgggaggcggagcttgcagtgagccgatattgcaccactgcattccagcttgggtgacagagcgagactctgtctcaaaaaagaaaaaaaaaagcagggactcaaacagaatatttgtgtgtccacattcatagcacgattcacaagagccaaaaggtggaaacaatcgaagtttccatcaatagatgcacagataaacaaaatgatgtgtacgcataaatgaaatactattcagccataaaaaggatatgaaattctgacagttactacaagatgaatgaaccttgaatacattgtgctatatgaaagcagccagacagaaaaggacaaatatttcttgattccacttacatgaggtacccagaatagtcagatttatagaaacagaaaatacaatagttctaacttgaagctagaggagaaagtagtaggaagtaactgttttaacaggcatggagtttcagtttgggatgatgaaaagttctagagatgaatagtggtgatgttgcagagtaatacgaaagtatttaatgccacttaaaaacagttaaatggggcggggcgcggtggctcacgcctgtagtcccagcaccttgggatcacccgaggtcaggagttagagaccatccagcccaatcaacatggtgaaacccagtctctactacatatacaaaaattagccaggagtggtggcacatgactgtaatcccagctacctgggaggctgaggcaggagaatcgcttgaacctgagaggcagaggttgcagtgagctaagatcatgccattgcactccagcctggggaacaagagtgaaactctatctttaaaaaaaaaaaaaaagttaaacggtaaattttgttaagtgtattttgccacaataaaaaagtaaaaaaaaataagttctgtgtatggatggtagtgacggctgtacaacagtgtaaatgtgtatataacatctctgaattgtacacttaaaaatgttaaaatggtgaatttatgcttatttccacaatatttttaaaagctggttaaggtctttcagtaattagcttcactctaaattatttttaaggcagatcagaatatagttgctcagaggcttctaaatactttgtaagcaactgaaccaccactacagctaaccagcacccctaaaccaattattgcctagcaaagtattactgcctttcaacccactggccctgcctaagtctggcaaccatataaaatgcttgatactgcttctgcattaataagcagtgagctcttcaaatgtaacacttgatgtccagggcaggagcaggttatagacatagtatgcttaaatctactttccccatggttgatgactagacttaaatcctcagtcacattccctgctacctgactggggccttgtttcattatctgtcgcccttggccctactccttacatctttaatcctctcctctgggtcctacatctcattctaaaatcagactaagtctcctcatgccattaaaatcttccctggactctcaaaccttcaaatctcaccgcacccccaccccccgcccccaccgccacccaacttactcctcttcttggctaccgaacttcatttctggatcccccaggaattgacttcagcctgctacttgactgaattacactcctgaaagttaaccatgacctccaatctgataacctattattcatactacccaaactaaaggcaaaaaagaagaaagaagaagaaagacaaaggaggaagaggaaggaagaaggaagaaggaaggagaaggagacggagatggagatggagacagagaagaggacaaacatttgtaaaaggtcatcaatcacaacctccttaaaactattttctcccttggctgaaactctcctaattcttctcttactctctggtctcttttatctccttccaccaaatctccaaatatgggtacttgtcattctgccttcaccctttttcttccctctcctaggaatttttcagaacttttcttctcaaaacttcgcaaaacatttgaaaatgttttttacattttatatgaataccatcagcacaagaggttgcagaaggagtcaggtagttggagaacaattctgcctaccccagtaactaagaagctggcaacagaagtatgcttccctactgcacatgtatatatcagtgtccaaggttaagaaaaccacatttgtattttttggcaggtacaatacattttaaatgaaaaaaacatttagaatgttttcttttcaaaatgattgtactgatagaaggaagtatctaacaatctgttcattattaattgcatgttttctgatatggttaattatttaggcttgatgtaatcactcagctggttaagactgcttactgatacaaagttaaagataggatgtacaaatgcaattaaatatcagtttcttaaggttaaaaaaaataataatttcctccaatagagagttcttaacattctatgtggaaataaaatttgtagaaaagaaacagaaaaatgaaatccatagagaattgatatgctacaccttaaattaaaacttatcatcagaatacttaaattcttaaaaagtataatttatgatatttaataaataatttatgagtatgaaaaattaaaaccatggacttttttaaactttaggattaatgactagtaatggcttctttgcataagttgcttcctttcgccttaaacaaagaaaccatacattttaaagttttatcataaaaacagaatgtatatgaaattatttcactttagcaatttttaaagtattttaaggctcaaaaacttaaggatatgggaaagtgatcaagatgtagtgatagaggaaaaaaagaaagttataaaacaatgtaatctcatgattccaattttggttaaaaaccagtatgtactaatgggcacagtagatacacaaagtacacagaagcccatatatcaaaatgttaatggtaaatcttgaggtagtacaagtatttttattttcttccttatactttgttttcttcctttatacctttattcctttctatagcaaacatgcatcacatttacagttgagttttgtggaagaataaactctatatttcattccatttctgccttcctgcttatattttgatagactaggaaaggaccatctttcaaagctgtgcagagtaactctttagcattgtcagtgctctcatatacctaatccatcagcaaatcctgttaatccacttacaaaatataacagaattcaactactcactattttcactgcttcttcaagagaagtcaccgtcatctctcggtttatgcaaaagtctcctaactagtctatgtaattccacccttaccacctttctggctctaatgtcactcctctacttagaaattctgtgacttctcatctcattcagaataaaagtctaagcactgattgtgaccttctaggctctatgatctggaccaggaatcaccatgcacactcccacttcagcaccacagaacttgcagtaagttggctctgcctagatattctacatccagataccctcattttcttcagctttttattccagtatcatcttctcaatgaggccttcactggcaatccaacacaacacatcaaccactccaccctacccttgaaatttcctatcttgtttccctgttttattttttctactctagcacttatgactatctaagacacatgatgtatttatttatttttgatattatctccctccctcagtagaatataaactcaataaagagaaatttttacctttgtttttcctgctgctgcatccctagtacctagaatagtcccaagcacatggtaggtactcaatatatatctactgaataaatggataaatgcattccagtgaatccacaagcttaaacccacagcttctcagttacagtaatagttggctcaatgaatgtcatgaaatgatagcaacacatttattcatattctgagaatcaatgactttctaagtgactttgcatagggcaagagagctgaagaacagctatagtaaacaataatgtagacatattttctcaagcctaaaagggagcatctaggatcttagcttcaaaatttatgaataaaattatgacttgatttggtataacaaaggtaaggtaccctgagatcatattgctgttattgttggtactaaaaagtaagcaaaactgtctaaaatcatattgttactcttctaacttttccattagaatattcaataccagtctgtgaaactggatatataactttccttatgcaaacaaaaaactagctgaatatcatactactatgcacctgagtatctgttatctgaaagatctttggatcttttataaacatcaatcaatgctgtgcagacagagctaagagggaaaggcaattagatactgtgaaaaaatggaggcaatcagaagaaatacagtccatggtggcagtgacagagctaagcaggaggtatggataatctgggtaagtgccatggaaaaataaatatcatgattgaacttgaggcaaatggaaacagttcaaattggcttcatacactactctgtggaacatatgatgtccatatgtccattaccaacaaactgaaacatggaaaataacaaaagccgatgctatgatggctataagaacacacccaatgccagtctctaccacaccgcagcagcataacttactacagctgccaggtaagttggctaagaagtcagaagcaataagaaaaaaaggagaaagaactaactataaactgttctctttccctacagaagacaaagttgggatctatactagaaagtagaatgtagcaacgataaaggctgaaagtaaagcacaattttttctctgtagacagtttctaaaagtataaactactttggaattaaagaaggcaacattttatccaaaactacaaacgatttaagatccagagaactaaataaaataacagaggaataagatggaataacttccaaataaaaaattataaatatgacctttcaagttttgaaatacataatagagtataaaaagaaactgaacaaaagatgtggtgggaatccattatgttttacatcagttttaattagtctaccaaattttccttctatagtttctaaccccacctttcttttttttttttttttttggtgttgttgttgttttgagatggagtctcactctgtcacccagggtggagtgcagtggcatgatctcggctcactgcaacctccgccttctgggttcaagcaactctcctgcctcagcctcccaagtagctgggactacaggcgcgtgccaccacacacggctaatttttgtatttttagtggagacagggtttcaccatgttggtcaggctggtctcgaactcctgaccttgtgatccaaccacctcgacctcccaaagtgctgggattacaggcgtgagccactgcacccggcctctaacctccacctttctatactctctaacccccaaagcgattcatcttcaagatacaataagagttgacataaaagaagtagagcttaacttaggcaagtatcatgaaggaccaatttacacagcaaagccaaaactgtaaaaaaaaataaaaatataaattttttaataatgtttaagtgttaaagcctatctggtggtcctgaccttttcaaccaatcaaaaccaggccagtcagatgaactgtataaaaataatatgtacaactactacatatccataatacttaaaatgaatgtttaagaaaataatctcagcacttattcagaaatatactagtgtcactcaaactatacagtaatgaaattcagcagctaaaaatatataactattttacagtaaatatcaatgtcattcctgtttcaacctgacttcccattctacccctaaactcccaaacttgaaaccaactacaatttcttgagtagctggagtgtggtttaggaaaggaagctatgcttgtttgtatggaatctgccatttcctccctgccaaaacacttgtttaaaaagtcatgtaatatttctattaaattgtaaatgcagtcgacaaggaaatggcctactagcagtgtattacctttgtggcagtgccaacgggcctacagcaaaatagtgcacatgataatttcaacatgcattcccaagtaacaaaattgtgctttacataaataccacagaacctgagcaagatccagaaaaagcaatgaaaatctgcccaagctttcatgcttgcctatatcaattgtatgtcataagtaaagcaaaatagaaaagcatctacatatgttcaagaagcttgtgaagttagatcatataaccctgggaaaactattgcagcttaaatctgtgtatttcttgttaaccactgtaacaactcactaataaaaatgaagaaaaaccatggatatcaaatgaaccaaaatgtactaactacatacaagtccttaaagatcatgatgcaacttattaacaggaacatattttcagtgtaagccacaattgttatgttaaattacttctttctttgatatcattcatttgattacagaatgtaagagattcacgagcattccaattaaaatggtgaccttcagtttataagtcacttaccgaaatgcttacaaagtcaccgctaatcatttatttcttaccttgcattgcatagcacaactacatttaattatgcaaattaaatgatcccagatgtaataaagatggttctattcatgtgaaagttatacttaaaaccaagttaacaaaattaaataattaatctgtaattaatatagtcttctaggacagctgaattctattctacagcaatttaactaaaatgcatatttattttataagtcaggtatgacttgtctttctttttaaaaatatcaatcgacacataatttcaaaatttaaacctgatagagacaccatttcctccaaaaatgtaaatttttaagtgttatacacatgaaattagagtaaatacctgccctcagtatacctccttccaccttcctaccctatgcacacctagctatttatgtctcctaaaataaatgctagcttaaatctctggcacaaatagttactattactggcttagaataaaataaaacttactatgaccaacagagtaagtccacacaattgcttttaagatatatatcttcaataatgcttaatggttgtctgttaaaacagttttcatccccaattagcaaaccaaagctactatatcctgaggccaaaattaagggtgcccactactgatttttctgatctctaataaggaacaggaactaaagtgccaaaaaataaataaataatataaattatatcaatttaaaatttaaatgttaaataaataaattgtgctaagtaaaagtttgaaaggcaagctgtgagggatgacagctctttcaagttggatttgattagcatttaattactttcactttttaatttatttcattgattcttatgctaagttgtaagtacaacacttattattttaagaaagaaaaatctgagcttaccagatttcagtattaacaccacagaagtatctttgagataggaaaggaaataagcacatattcaacaaaaatatttattggatattcttatgttagaatctgctagattcatttagacacacaaagatgaaacatacttgaatttaaaacttagatttagtagggaaatacgacaactatatcaaaataactatgataatacacagtaagtttaaaagtgccataagaaaattatagataaggtgatatgagaattcaaagaaagaaaagattttttaaatcagtgggatgaggaacttctaacaataattagacttatctaaaactaagctttccagaagtagaaagattacgggaggaagacatcataatctacatttggttccaggttgaaatgcagaactgtaatatgctatgataaagaaaatagtaaacaaaacactaccctaaatacacaatgtaacaagatacactcttgagggtcactgatattaagaaccacagttctcagttattttcgatcaaggaatccttgtttcaaggagttattattttcatttgatggaaaactatgaactatcttaccagaaaaatacatatctgcacaaacatcaatatttaagtgcaatttcataagatgtgctgactgaattctctgccccagaaacagctcattctaccctcttgtgaatcatggtttccattactgggctagtatgcagtataggggaaaatgaagaagtaaaaaataactgtttttcatcattagaaaagataaaatgtatcacagtcctaataggctcattattttcatattgcttccagtagaggctgcagaagacatctcagcagccataagcaagaacttaaaagttttcagcaatctcccctggctagcaataaactgtcaataagcaggttcaggcacagaaacagtaattcctttgggtactgtgtaacgtcccaatacctcccatcctactgaatgtcctacaacaaaatcaggtgatgaaaaacaactgctcgatccttccacagctcaaagttccttaagtaacaatagtaaatattaaacgggcatcctctgtaagaacctgaactaatttatagtctcaatatgttacttcaaaagcaacttcataaagctagttcatatttctacagtacttagtattttacatgtattgttcatatacactatcccttttgatcttcaaaaagaactctgtgaagtagatggatgagggtccattataactaattcagagataacaaaattgattcaagcctcacaagtctcaaacatcaggtcacaccattattacgtagcaacaatagaagcattcggactttgttagaatttggatttccaacacctggttcagtaattattgctctatagattcaagttgcaaatcattactgggtcataaaatcaatgtaatggatttggaccacacattttttaacgaaaagatgaaacagaatagaatactgtgatagaacagaagtcagagtgaatcacaaataaggaaaataagtatggtttcatgtatattttgtttcacttatgtgtgtgtgtgtgtctgtacacatgtgcataatggatcacactgtgaaaatatttctaccatggaccacaattttaaaagtctgaaatgtaaatgtcatctttcaatcattaataaatcaatttaactcatctcctttaaattctcccacacaaatacagagaaatattgcatttgtcagtatcccacattaaaatcctaaaaagatgaaatgtagtataattctttctcagtaagtattactctaagcaatacttaatggaaacacgtctccaaaactataattcatatttatataatttgtatgtcagtaggaaaatgataattatttcctcaatattaccaaactaatcatgtgtacagagcacttggcaataccaacagcaaggttagaatacagacgaagagtaggaatgcctctttcctgtgtaagtatcaggggtgaccccagcaggcttaatctagagaagttgagacctgtttattctcttcacttgttcatgtcttaaagaataataactctgacaagacaaaaatatgttgaaactgtcactgtaataaaccttaatccccagtttagggtctaggatgccttataccaccaccacccttcaatgtgtatcaggaccacaaagcagagaactcttaactttcaaatggagtaaaaatccatgtcttggaagcagtactgaaattccctgatgatcccatttctcccactcctctggatccttggatgatgtgaaagtacggttaatagaatcaaggtatcacctaaaataggcaaaaaaatagggaagagaaaggaaaggaaaccaaaggtagagaggggggtgaggggagagtattcacctacacaccctgtcaggaaacaaaaaaatgaaaagacaacagtaggaagaaaagaaaaaaaggaagataagggcaggttcaagggagaaatgcaagtaaagtatgtaatgacaaaataataaaatttttatctacaaccatatgatcttatgtaatttgagataatatatacatataactgaataaacgttttacagtgtatagcttcctattctaatcaacaaaactcttatctaccctttcctattaaataaaacagaaatctaaatgattctaacattaaaatgctagttatcactgaactataaattccaaaagaacagtgaacatgtctgctgtgcttactactacttcctaacagctcaagtggtacctgataagtgtgcaccaagtatctacagaaggaaataaaggaaagggaaagggagtaaaagaatacagaaggcactctagatgacatttaatttctctgacacaaaacaaccaatttgggagagaagagatactgtccaactggtcccaaagccaaatttattgcctttatgttagaatatgcatttcttgcattaacaatattaaatcaaaaataatttaatattaatgattaaatttagtattgacgaaaacatgggactgtcccatcatgagaagatacacatttacatggcagaaaatttcaagagtgtcattctcgttgctaaaagattcattaaaaattatttgtactccaaaaggtcccactagctcccaagcaattactcctaaccagaatgaaatgtatgaaataacagatacagaattcagaatatggatggcaaagaaactcaacaagatccaagagaaagttgaaatccaacacaaaggaaacagaaaaataatctaagatttgaaagacggcacagttattttaaggaagaaccaaacagaacctctggaactgaaaaatttactagaggaatctcaaaatacagttggaagccttaacaacagactaaaccaagcaaaagaaagaatttcagagattgaagatcagttcttcaaatcaacccagtcagataaaaataaaaataatttttaaaaatgaaaaaagccttcaagaaatatgagattatataaaatgaccaaatatgtgacttactggcattcctgagagagaagagaaagtgagcaacttggaaaacatatttgaagatagatataattcagaaaaaattccacaatcttgctagagggatcaacatgcagatacaagaaatccagataactcctacaagatactacacaaaatgactattcccagggtacacagtcatcagaccatccaaggtcacccaaaagaaaaaaccttaaaggcagctagagaaaagtgtcatatgacctgtaaagcagcagtctccaaactttttggcgcaaggaaccggtttcgtggacgacaagttttccatagatagggttggagggggtggtttagggatgaaactgttccacctcagttcatcaggcattagttagagtctcatgaggactacacaacctagatcccttgcacgtgcagttcacaaaagggttcacgctcctaagagaatccaatgtcagtgctgatctgacaggaggcggagcttaggctgtaattcttgatcgcccaccgcccacctccagctgtgtgacccggttcctaacagttcatggaccggtaccagtctgtggcccaggagttgggggacccctgttctaaagggaaacccatcagactaacagtagacttctcagcacaaatcctacaaaccagacaagattaggggccaattttgagcattcttaaaagaaatgccagccaagaatttcatatcttgccaaactaagcttcataaatgaaggaaaaataatgtatttcccagacaagcaattactaagcaaattcatcactgccagaccagccctacaagagatgcttaagggaggtctaaacatggaaacaaaagaatgacatttactaacacaaaagcacacgtaaagcacataacccacagactctataaagcaactatacaatcgagactacaaagcaactagctaacaaccctgtgatgggaacaaaacctcacatatcaatattaaccttgaatataaagggcctaaatggcccacttaaaagacatagagtggcaaactggaaaaaacaaacaaaatccctctttctcttatctgcaaaagaaccatctcacaagtaacaacacccatagactcatagtaaatgaatggagaaagatcagttaaacagaaaacaaagaaaagcagaggtcttatattagataaaatagactttaaacaaacgactgtaaaaaaggacaaaaaagagcattatataatttttaaagggttcagttatacaagaagacttaactatccttaaatatatacacactcaacactggagcacccagatttatgaaaacaattacttttagacctaagaaaagatgttgacagccacacaataacagtgggagacttcaacaacccactgacagcattagactgattatcaaggcagaaaactaacaaagaaattctggacttaaatttaatgcttgaccaactgaacctgatagacatctacagaatactctaccaaacaaccacagaatatacattcttctcatatgtacatagaacatactcaaagactgaccacctgctcagtcataaaggaagtctcaataaattcaaaaaaatcaaaatcataccaagcatcttttcagaccacaatggaataaaaatagaaaccaacaccaagaggaactctcaaaaccacataaatacatgaaaactaaacaacgtgctcctgaatgacttttgggtaaacaatgaaattaaggcataaataaaaaagttctttgaaaaaaatgaaaacagagacacaacataccaaaacctctgggatacggcaaaagcagtgttaagaggaaagtttagaatgctaaatgcctacatcaagaaaatggatctcaaattaacaatctaacctcacacctaaaggaacaagaaaaaactaaacccaaagctaggagaagaaaataaataagtaaagtcagagtagaactaaatgaaattgagaacaaaaaaccatacaaaagatcaatgaaacaaaaaattggttttttgaaaggatgaatgaaactgacagactgctagctagattaaaaaaggaaagagagaagatccaaataggcacaatcagaaataacaaaggtgacatcacaacgaagcccacagaaatacagcagatgttcagaggctactatgaacatttcagtacatacaaagtagaaaatctagaggaaattgattaattcctgaaaacacaaaacctccaagattgaactaggaagaaacagaaatcctgaacagaccaacaagtaacaagattcaatcagaaattacacacctaccaatgaacaaaatcccccaaagagagagattcacagctgaattctaccagtcctaataaaactattacaaaaaatcgaagaggagggcctcctccctaactcattccacaaaaccagtatcatcctgatatcaaaatctggcaaagacataacaaaaaaagaaaattacaggccaatatccctaatgaacataagacccaaaattcctccacaaaatattagcacactgagctaggtggaatggctcacatctataatcccagcacttggggaggctgaggcagaaggatcactggagctcaggagtttgacaccagcctgggacatatattgagatcccatctctccaaaaaaaattttttaattagccaggtacagtggcacatgcttatagtcctagctactcaggaggctgagatgggaagatcacctgagcctgtgaggtcaaggctgcagtgagccatgactgcaccactgcaccccagcctggatgacaaagtaagcctgtctcaagaaaaaaaaatttatatatatgagcaaaccaaatccagcagcacatcaaaaaattaattcaccaccatcaagtgggctttattcctaggatgcaaggatgattcaacatatgcaagtcagtaaatgtgatttaccacataaggagaattaaaaacaaaaaccatataatcatctcaatagacacagaaaaggcttttgacaaaatcctatactccttcattataaaaatccacaacaaacttgacatcaaaggaacataccttaacataataagaggtatctattacaaactcacggccaacatcatactgaatgggcaaaagccagatgcattcccttaagaactggaccaagacaaagatgtccactcttaccattcctatccattatgtcactggaagccctagccagagcaataaggcaagagaaagaagtaaaagacatataaataggaaaaaaagaagtcaaattatctctcttcactgacaatataattgtatactagaaaatcctaaagattctgtcaagactcctaggcctgataaatgatttcagcaaagtctcaggatataaagtcaatgtacaaaaatcagtagcacttctatacgctaataatgttcaagctgagagccaagtcaagaatgcaatgccatttacaattcctaccaaaaaaaaaaaaaaaacaacctaggaatacacctaaccaaggaggtgaaggatctccacaaggagaactacaaaagactactaaaagatagcagagacgacacaaacaaatagaagagcattccacgttcccaggttggaagaatcaatattgttaaaatggtcatactgcccaaagcaatctacagattcaatgctattcctatcaaactaccatcatcatttttcacagaattagaaaaaaactattccaaaatttatatggaaccaaaaaggagcctaaatagccaaggcaattctaagcaaaaagaacaaagccagagacatcaatttacctgacttcaaactatactacatggtactgtaaccaaaacagcaaggtactggtacaaaaatagacacacagaccaatggaacagaatagaggcataaaaaaataatgggatcatgtcctttgcaggaatgtggatgcagctggaggccatagtcctaagcaaactaacacagaaacagaaaaccaaacactgcatgttcttacttataagtgggggctgactactgggttcacacagacataaagatggaaacaacagacgctaggaactctaaaaggaaggaaggagtggagaggacaagggctgaaaaacttcctatcggatactatgttcactatctgggtgacaggatcagcagaagcccaaacctcagtaccatgcaatatacccttgtaacaaacctgcacatgtaccctaaaataaaaatggaaacttaaataatacaaactgtgaaaaaatatttttaaaaaataatttccaaagaatatgaaatgctgatttacaattattaaatatttacacaacttcttcagaacacacctattgcataatgcaaagtacatatatatgatttaataaaaataatcctctacttggtagacaactaagtcatttgcatagaaacagtgaaaagcattctgattgaaagatctctcaatatagtgattacaaagaagacatacaaagggactcagactgtgtattataattggggtggagaaagtgatatggggacaactggaaagacaataaacaggcagtaaaaagttaaaggagtaggacaccttcaccagcatagaaacaacaagcaggtcagtactagagagaggttaaacaaaaagcccaatttaaaaatgggcaaagcagcaccgggcgcagtggctcaaaacctgtaatcccaacactttgggaagccaaggtgggtgaatcaaaaggtcaagagatcgagaccatcctggcaaacatggtgaaaccccgtctctactaaaaatacaaaaattagctgggcgtggtggcgcgcatctgtaatcccagctactcgggaggctgaggcaggagaatcgcttgaacctgggaggtggaggttgcagtgagccgagatcatgccactacactctagcctgggtgacagagcaaaactccgcctcaaaaaaaaaaaaaaaatgggcaaatgaattgaatagacagttcccaaaagatatacataatggataatggacaataagcatatgaaaagatgttcaatatcactagtcatcagagaaatgcagatcaaaatcacaatgagatgccacttcactcccattactatggccattagcaaagaaaaacaacagaaaataacaagtgctagcaggaacgtgaagaaactggaactcttgtacattggtggtaggaatgtaaaatggtacagctgctgtggaaaacagtatggaggttcctcaaaaaataaaacactcttgaattgatgattgtggatccagttcatggtagcattattcacaaaagccaaaaggaggaagaaacccaagtacccatcaacaaatgaatgaataaacaaaatatgctatatacatacaaagaaatattattcaggctttaaaaggaagcaaattctgacacattctatgacttgtataaattattgaaaacattaggctacataaaacacacacacacacaaaagaacaaatattgtttgattctacttatatgaaatatttagaacagtcaaactcatagagacaggaagtagaatactggttgcgaggggttggagcaagaggatatggagaattattgtttaatgggtacagggtttcagtttgagataattaaaaaatttctagaaatagtggtaatgattgcacaataatgtaaatgtactttatggcaatgaattgtatagagtactttaaaatggttaaaatgataaattttatgttatatattactcattaatcctaattataatcttaaattatgtaattatacttatactatataaatgttaatcttaaattatacataattattaatcttaaattttctttctctatttgaaagaagagaacatattatggggagtgtagtgagttgaaaaatggccatcctcagaagatatgtccacatcctaatctctgaaacctctaaatgttacacaatttgggggggaaaaatacaatttatgcagatataattaagttaagaatcttgaaagcagaagatcatcctggatcatctgagtgggccctaaatccaatgacaagtgcccttataagagaaaggcagagagaaatttgaggtagatagacaaaaaagaagacacagggctgggtgcagtggctcacacctgtaatcccagcactttgggaggccaaggcagacagactgcttaagctcaggagttcgagaccagactgggcaacatggtgaaccccatctccacaaaaaaaatataagatttagccagccatggtagcttgtgcctgtagtcccagctacttgcggggctgaggcgggaggattgcttgagcccaggaattcgaggctgcaatgagccatgttcacgccactccagcctgggtgacaaagcaagaccctgtgaaagaagaaagaagatgatgatgatgacacagacactcagaggaaaatgcaatatggagatgtaggcagagattagagtaagacaactacaatctaaggaaaacaggattgcaggcagccaccaagagctggaaaaagtgaaaaatagattatcctgtagagccccttgagggagtacagtcctgccaacactttgatttcagacttctggtttcccaggctaaatgaagatactcctctatgccattcaccactgtgttaaatccttgcaaggaatcttccaacaggtggtgtcagacaaacacaggtgcacatacactaagacatccaaggtatctacaaatacctacacagcagggactgggagatggaaggtgtgttaagtgtgttgggtgtggtattactcaagtctcaccactacagagaatcagttttccagaatttctcaagcaaattttattattaattgagcaggaaaggaggacatggatgcttttctcttttttggtgttgggtttttttaaatattaaaaaacggttaactaagtgttcactcttcacatgtggacataaccacattttttgtctctttttttaaaatcctttctttgtgaaaaaagtagtgccatgggatttccaatgggagagagctactgtgttttactttttgatatgcactataaagaatgatcttctaacccatgtctgtttttacgctgcctatactaaagcatttgttgcatctatttaaatgctatgtttctccaaaaagggaggtggaagccagttggaaaatatggtgggttaaggaaaagactcttcaggaaaggatagcattatttttgaaaacatcattcatcaaaaatgactccttatgtttgaaaatatctgcagggctcctttatttgtaagtaggtagtgtaaggacacagagatagagacctttttttaggctaaaataattctttttttttcatactttaagttttagggtacatgtgcacaatgtgcaggttagttacatatgtatacatgtgccatgcgggtgtgctgcacccattaactcgtcatttagcattaagtatatctcctaatgctatccctccccactccccgcaccccagaacagtccccagagtgtgatgttccccttcctttgtccatatgttctcattgttcaattcccatctatgagtgagaacatgtggtgtttggtttcttgttcttgcgatagtttactgagaatcatgatttccaacttcatccatgtccctacaaagaacatgaactcatcattttttatggctgcatatcattccatggtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatatacccagtaatgggatggctgggtcaaatggtatttctagtcctagatccctgaagaatcgccacactgacttccacaatggttgaactagtttacagtcccatcaacagtgcaaaagtgttcctatttctccacatcctctccagcacctgttgtttcctgactttttaatgattgccattctaactggtgtgagatggtgtctcattgtggttttggtttgcatttctctgatggccagtgatggtgagcattttttcatgtgttctttggttgcataaatgtcttctctgagaagtgtctgttcatgtccttcgcccactttttgatggggttgtttttttcttgtaaatttgtttgagttcattgtagattctggatattagccctttgtcagatgagtagattgcaaaaatttcctcccattgtgtaggctgcctgttcactctgatggtagtttcttctgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatggttttaggtctaacgtttaagtctttaatccatcttgaattaatttttgtataagttgtaaggaagggatacagtttcagctttctacatatggctagccagttttcccagcaccatttattaaatagggaatcctttccccattgcttgtttttctcaggtttctcaaagatcagatagttgtagatatgaagcattatttctgagggctctgctctgttccattgatctatatctctgttttggtaccagtaccatgctgttttggtaccagtaccatgctgttttggttactgtagccttgtagtttgaagtcaggtagtgtgatgcctccagctttgttcttttgggttaggattgactcggcaatgcgggctctttttgggttccatatgaactttaaaatagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcccaggtattttattctctttgaagcaattgtgaatgggagttcactcatgatttggctgtctgttattggtgtataagaatgcttgtgatttttgcacattgattttgtatcctgagactttgctgaagttgtttatcagctaagggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttatggagagtttttagcatgaagcattgttgaattttgtcaaaggccttttctgcatctattgagataatcatgtggtttttgtctttcgttctgtttacatgctggattacatttattgatttgcatatattgaaccagtcttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgtcaggctttggtatcaggatgacgctggcctcataaaatgagttagggaggattccctctttttctattgattggaatagtttcagaaggaatggtaccaattcctccttgtacctctggtagaattcggctgtgaatccatctggtcctggactctttttggttggtaagctattgactattgccacaatttcagagcctgctattggtctattcagagattcaacttcttcctggtttaatcttgggagggtgtatgtgtcgaggaatttatccatttcttctagattttctagtttatttgcatagaggtgtttgtagtattctctgatggtagtttgtatttctgtgggattggtggtgatttcacctttatcattttttattgtgtctatttgattcttctctcttttcttctttattagtcttgctagcggtctatcaattttgttgatcctttcagaaaaccagctcctggattcattaattttttgaagggttttttgtgtctctatttccttcagttctactctgattttagttacttcttgccttctgctagcttttgaatgtgtttgctcttgcttttctagttcttttaactgtgatgttagggtgtcaattttggatctttcctgctttctcttgtgggcatttaatgctataaatttcactctacacactgctttgaatgtgtcccagagattcttgtatattgtgtctttgctatcattggtttcaaagaacatccttatttctgccttcattttgttatgtacccagtagtcattcaggagcaggttgttcagtttccatgtagttgagtggttttgagtgagtttcttaatcctgagttctagtttgattgcactgtagtttgagagacagtttgttataatttctgttcttttacatttgctgaggagagctttacttcctgttccaaaatgtggtcaattttggaacaggtgtggtgcggtgctgaaaagaatgtatattctgttgatttggggtggagagttctgtagatgtctattaggtctgcttggtgcacagctgagttcaattcctggatatccttgctaactttctgtctggttgatctgtctaatgttgacagtggggtgttaaagtctcccattattattgtgtgggagtctaagtctctatgtaggtcactcaggacttgctttatgaatctgggtgctcctgtattgggtgcatatatatttaagacagttagctcttcttgttgaattgatcccttcaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattttgatgttagctggttattttgctcgttagttgatacagtttcttcctagcctcgatggtctttacaatttggcatgattttgcagtggctggtaccggttgttcctttccatgtttagtgcttccttcaggagctcttttagggcaggcctggtggtgacaaaatcactcagcatttgcttatctgcaaagtattttatttctccttcacttatgaagcttagtttggctggatatgaaattctgggttgaaaattcttttctttaagaatgttgaatattggcccccactgtcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacacagtgagatgaagatctggtcttttcacatagtcccatatttcttggaggctttgttcatttctttttgttctttttctctaaacttcccttctcgcttcatttcattcatttcgtcttccatcactgataccctttcttccagttgatcgcatcggctcctgaggcttctgcattcttcacgtagttctcgagccttggctttcagctccatcagctcctttaagcacttctctgtattggttattctagttatacattcttctaaatttttttcaaagttttcaacttctttgcctttggtttgaatttcctcctgtagcttggagtagtttgatcgtctgaagccttcttctctcaactcgtcaaagtcattctccgtccagctttgttccattgctggtgaggagctgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtgtgttggagtttgctagaggtccactccagactcggtttgcctgggtaccagcagcggtggctgcagaacagcggattttcatgaaccgcgaatgctgctgtctgatcgttcctctggaagttttgtctcagaggagtacccggccgtgtgaggtgtcagtctgcccctacttgggggtgcctcccagttaggctgctccggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcctccagaggtgaagcctacagaggcaggcaggcctccttgagctgtggtgggctctacccagttggagcttcccggctgctttgtttacctaagcaagcttgggtaatggcgggcgcccctcccccagcctcgctgccgccttgcagtttgatctcagactgctgtcctagcaatcagcgagactccgtgggcgtaggaccctctgatccaagtgcgggatataatctcctggtgagccgttttttaagcccctcggaaaagcgcagtattagggtgggagcgacccgattttccaggtgccgtctgtcacccctttctttgactaggaaagggaactccctgaccctttgcacttcccgagtgaggcaatgcctcgccctgcttcggctcgcgcacggtgcactgcatccactgtcctgcgcccactgtctggcactccctagtgagatgaacccagtacctcagatggaaatgcagaaatcacccgtcttctgcgtcgctcacgctgggagctgtagaccagagctgttcctattcggccatcttggctgcttccccaataaaatcaataattcttaatttactcttaaacagagattgtcatgctttatgtgagttaaatttccagaaagttgacaagtgcctccaattatctccttaaatcacatttgacataaatcttccaaaatacactatttatttacacatctttttttaaagttataaacattcagtattgcattgcatagaagtaaaaattcttggtttgatttctattttctttcctttgcctgattcaagaaatcatcaggtacttctcctgctgtccacagagtgatccatacagttctttccttacccctttccctatgctgaacaacaggtaagcaaacacaaagggtttttacaggttacgcctgtactcccaactactcaggaggctgaggcaggataattgcttgacccagggaggcgaagattgcagtgagcctagatggcgccactgcactccagcctgggtgacacagcgagaatccatcaaggaaaaaaatacaaaaatttgctgggtgtagtggtgtgcacctgtagttccaggtattcgagaggctgaggtgggaggattgcttgagcctgggaggttgagggctgcagtgagctgtgattgtgccactgcactccttcctgcctgggtgacacagtgagaccctgtcacatggatggaaggaagggagggagggagggagggaaaagaaaggaaaggaaaaaagtaaagagaaaagaaaagaaagagggaaggaaggacggaaggaaggaaatgatactatttattcatctcctgatttaaaatatatacatatatatacatacttcctaaggctgagtgcactggcttacgcctataatcccagtactttgggagaccgaggcaggtggatcacttgaggtcaggagttcaagatcagtctggccaacatggtgaaaccccgtcactactaaaaatacaaaaaattagcttggcatggtggtgcgcacttgtaatcccagctacttgggagactgagctgagacaggagaatcgcttgaaaccgggaggcagaggttgcagcaagccaagactgccaccgtactccagcccagacaacagagcgagactttgtctcaaaaaaaaatatatatatatatatatctatacacacacatatatatacacacacacactcacacacacacactctctctctctcacactcacttcctaaaggcctgagaaaaagagaagactgatctcctcaaaagtatgtggttaactgaattcaaaactaaatttttttaactattctatttatctaactgatcaaaattaatttggtggtttcatatttaactttataaaataaactgagttttaatttaaaaaaatttgtttcacttaacattctgattagacttactcccatttgccactactcactaattttaatctcatagctgaatataaatttataagcacttttatccctctcctgtttaaaagctttatatgtttcaatgtgtacatcatcatttccctttactaaacagataatcattactgtctaccacagtgaagattcggtttacatatactacaagtttctttggggggaagaaaaagttgtatggaaactaacaaatttggttaactccttgccatcaaacaaatccagtgtttttaatagttcttcttattagaaaatttctccttgaacatctatattccaaatattccttattctgcccaggaatgataaaagaaataatcaatctctgacaaactgataaactaaagcatataaaacaaatgacctcagacttaacacctttgaaagacccattctcaaataactgcaaatttccaatttaaccactttcattttctaatttagtgccatctttaagttcttcgtatccctcagactatgacaccctaaatatatgtcctacaaaaaccttaatcagtgaaaaacagtattaatttgtggccacttaaggagaagcaactccattctaaattatccaagctcaaggcatctctttttgcccctaatttttgctggcctaagcaatactactttacaaacaggcctggtacctaaacacggtaaaaggctgagaaaatgactgggaaaccaaatcccagttcactcagtctacaaggcagcaccactgttctggagtgttcctaattatatacagctagtgggcaggcatagtggaaagggctagaactctgtgaggatgaatgcaaggcatttcagaaagactggctagaatcctcactccaattaggcaataccaccagtggctgggcaccccactatagatggaggctggggaaactcacccaccacatcctaactttgtctctaactttgttctagatagccatgtatatgtagtaaattgtatcatttacttatattaaaataactatcaggttttttgcctgttatcagctgtggggtcttcatgtcaatcacatctttgtctcattgtggcaactttgtagattattgattacctcattagcctatatgtctaccaaaacatggctggaaaacaaaactttaaaaattgaaatcttacctaggttaccatatttcctgctactctggaaaacttagagggttcagattttaaatcagtaattataatattgtgattacatggttttaaaatgtcttatttttgttagccgctcctccacttgcactgagttgggatattaacacagaggatatttctttggtgtctaggcaaaaacacagaacaaactgagttcatatctcagttctgccactgacaagttatgtcatcttaaataacataatcttatccatttcatccaatccacccaatggaggataaaatatttatttcacaaaattactacagtacaaaaaaaaatgttggtaaaaaacttcaatatttcactcacttaccatagtgtcatatcctaccagctttctcatatcttaactaccactttatctcctctctaacctcctgagattctgatttaatctgtttagggtagggctccccacatgacggctatgcagcaagcatggagaacactacctattctttgatcaccccatttccttacactctctcttttctttccagactgtgccctgttagtaaccccttgaactgtctctcagcagcatccttaaattccctatagccccatccttctaagacactcattcattaaaacccaaaccctccatatcaaggccataatgcattctactgcacagcagagcacactaccataggaaggcccacaaaccaggattaattacactatactttcccaattaccaattttagctgggccctcaacaatttttctctcttggacagctctttctttcattgccctcactataccccccacaaaactactgtaaaccttgatgaaacagtaaagtttattaattctattaaatttctacacttgaatatgtatttttaatattctacattgacaaaatggaaaatatgcataaagcacttccccacatatcaaagaacaacaataatctgaaaaaaagcagttgtgtgactgagctgcaagctaaataaactacaaggctcttttcaaagaacatcatttttacttgaagaataactaacagaaaactaaggttacacagacttgggtatttgacagacattttctcaaaaaggaaccaagtgaacctgtcatttcaaggaaaacaaaaggcagtacttgttaccagtgataaaactatctgttacatgatctcaacagcttccaatacttgcagttcaatactctactttgtaagacagctcacaaacacaagaaaagttaaataatgatattatttaaataggaaataaactatattatgtttggaaatgcacgaggcaacacttgattaactgtccaaagaactggactgtgaagaaattgcctatatacaaaatatgaggaaaaagagaaatttacttgggcgatagctgtcaagaatggctctacacaggcataaaatccaagttgggacttgaaaaactggtaggatttagatttaaaaaaaaaaaaacagtgagcaaggcatcctaggaagtttgcaatacaggtatatttttttctaaaagaaatattattttcaggtatatttttaataatgtataatgtattcattcaaactctcaggtaatattagaagatccttaaaggaagaggccacatattacaattctctgctatctgagcacaggatcaaatttaacatgttgaactatttggttggaaaaataagatttacacagggaagaagcagaatagtaataatggaagtcctaagttaaatcccagctcttgtacttacctaggttgccttgggtaatttagtaaacctcactgattcaaactcaaatacacctactttgaggatcaccctacaaacatcctaactaaaagaaccacagataactaatgatcagagatgaaataagactttgtgttcctgtttttatgctgaccttgttgtttttcaagttattttcaaacaattgatgcatttttatctttcatttaccaaaaggaatttatatacaccaggaagatgatacatattgtatacaattacattactcaaagaactctaggctgggcacactgctgtaatcccagcactttgggaagctgaggtgggcggatcgcttgagcccagaagttggagaccagcctgggcaacatggcgacaccttgtctctacaaaaaattagttgggcatggtggtgcatacctatagtcccagctactctgcaggctgaggtgggaggatcacctgagcccaggaggtcgaggctcgagtgagccatgatcgcactactacaatccaggctgggtgacagagtgagaccttatctcaaaagaaaaaaaaaaaaaactctctttaaaatgtttcaatacagcagacagatttttaaatattttctgtataatacactgttacctatattatcgaaatttaacccacaatggcattataatatcagatgtaattccaatttattcttcttcagatattctaaaatatctgaatttttatgcattcttcctctttctatctatttacttcacattcctccagccaccatgatattatcttctcttttctacaaatacacacatacatacactcctcccctcattcctacatccttattgagataactacagccactagagggcaataagtatacaaagatcagtgtacctatttatgatgatgaacttatctatatgattcacatagtaataaacctaaaaagtatatcatcacaaaccctgaaacacaggcaattagacttgaatatgcaaaatatatatttcaaactcaaaaattatcctgcagagttcacagaagcatataatgatgttcaaaaaaggaattccattttctcagcatgcattcattaaaaaaaattagccgaattcctttatatgtgcatagtaatattagaaattaggattgcttaataccatcctcagaccaaagaagagaaaaggcagaaaaaaaaaaacacacagtaaggtataaatcacagagtgggtaaaaaagtgagaaatgattacttccaactctttcactaccacaatcaagaaaacaataaactgaagagcaaagaggatttaccaaccctttcttctattgaaaagcaagcaaaaattttacaagtatatttttgggggaggagaacagtgatggtagagatatacaaagccttcagttcttttctcacaattaagaatgcagaaggaagagaagttaacagttactaatctttaagaggtaattttaccatttttaaaaagaatacatttaaatgaacttatttagtttatatttacttacattgacattacaaaacggcaacacttatataaggctaacattttcagcaaaccataattttcttaccctcattggatgtatatcagcataaggaggttttccttcagccatttctatagaagtaatgccaagggaccagatgtcggccacacagttatagcctatttcttgaatcacctcaggagccatccaaaatggagttcctattacagtattgcgttttgccattgtatcctgcaataatgttacatagccataaatgctactacaaaagcacaaaggaaatctgtatgccaaacatacttttaaaaaatgttaaaacctccaatgccacagattatatcagaaattgactattttgctaaaatttcaactagttatgacatacttaggaattccgaattctgaaaataaccaagagtccacaggtaacttatccacactaccatcattaaacacagtcattaaagatagtgctacaatgataaaagctacagaaatgagctacgtagcttcccttttagaacatttaagcattttgattataagatatattttcacattcaatcaccctaaattataaattaaataatactcaaatttggctcaattatggttccttctccacaaaaattaaaaaactacacatttctttccattccccctcaaaaagtaattgaagtttagttataatcaaatctgaacaaattagccaagtgtttagaaaaccattaaagttaacttactgttaactgaccagccactccaaaatctgccaattttgcatgtccttctgtattgaggagaatatttccagcttttatatctctgtgtatttttctcataaagtgcaaatattctagtcctttcaatgtagatttaagaatggttgcaatttcatcttctattaactggaaagaaatatttttaaaaccataattaaaatgccacgttagataaaatcttacgaaagagcactagtaacaagtatgtctttccgtgtgtgtgtgtgtgtttttttttaagagaccccactctgttgcccaggctacagtgcagtggtgtgatgatagctcactgcagcctaaaattcctgggctcaaggcatgctcccacctcagcttcccgagtagctagaactacaggcacatgccaacccaataggctaacttatttttatttttgtagagatggggatctcgctatgttgcccgggctggtcttgaactctttgcttcaaacaattctccttcctcagcttcccaaagtgttgggattataggtgtgagccaccatgcctagccacaagtacttctttctaatgaccgctaaacctccaggaaaatgctaaaggggtaaataatcgagaacctcttcttcccacaataagctttcttattacacattttactaatgaaaggatgatcaaatttctctctttaagattatcagtatcagcagggcgtggtggctcacacctgtaatcccagcactttgggaggctgaggcgagcagatcacttgaggtcaggagttcaaaaccagcctggcccacatggtgaaacctcgtctctactaaaaatacaaaaattagccaggcgtgatggcgtgcacttgtaatcccagctactcaggaggctgaggcaggagagtcacttgaacctgggaggcagaggttgcagtgagctgagatcacatcactgcatgccagcctgggcgacacagcgagactccatctcaaaaaaaaaaaaaaattatcagtatcattcctaaagcaaacaacatatctcaagaatcagcctgatataaggaatcataatagtgatttcccacatcttctaatactgggagggcactatcacagctaatatctgttctgaaaaagtaaattcagatacttcccctgagatatttcagattcttgatgaaaatgaaaccaacagctttacataaaggaaagtaaatgagggagggaggcttgcaatgaatcttctgcgagaagctcctacaccaatgccactcctaacccttccaagttctggacttctgacctaatattgagaactcagaagaaaaaacgtcagagaaagattaggaaaatggaaacacaagcaaagactatcagaggagggaaaaaggggagagtagagaaggccgaggaagagacggatgggaaagaaagaaaatcttcttaacagttgtagcagtagagccactgctatctgtaccaggcaatgtgctaagagttatgcatgcattctctcatttattcttaaaacaaccttgtaaggtagtgtgatattatgaaatcacaggaaatatttggtctttgtaggttcttggcacaaaatctcctaagaccctgtgaattgactgagtgagtgagaagttgaatcaagatattttatctttgttttctcaccctctcacaagagtgagaggggctgtcttttgtcattcataataagctcctttcaaccataccagaatttatactgatcaggtgactcttggtgggagcctagatagcttcaggatgggagctggttgccgaaaaaaccaaccaagtgattagatgtttggaaatttctgcctgacccctgacttacgggagggctgcaaggagagagggggtagagatttagttaagcacaaatgtccaaagacttaatcaatcatgcctatgtaacagaatcaaccataaaaattctaaatgattagggactgctctcaagcttatattctatctataagcaacgggataatttgatagaaaataggataacacaggaaaatgtctgtgaaaattgctatgaggacaacaatagagagctactgatagagaacgactgagaagctactttagattgacattcaagaaggcccaaaagacattttactgaagtctaaatgatataatggggccaaccatgtgaatggctatctgggaacatacactccacaaaaaggaaaaaaaaagattaaaatatcttgattcaacttctcaaattttctaaaacactgaagaaaagagaacacttccacactcattttaagaggcattattctgatatcaaagccagacaaagttaccacaaaacaactaagaccaatatcccttatgaacattgatacaaaaatcctcaacaaaatatagcacactcacttcaacaggattgtaacaggttatacactatgaccaactggaatgtattcctggaatgcaaggttgattcaacatacaaaatcgaacaatgcaatacaccaccttaacagaatggagaagaaaccacatgatcatttcaaatgaaaacagaaaaagcatttgattaaatttaacttcttttcataaaacacacaactaatatgaatagaaggaaactatctcaccatagtaaaagccatatacaaaaaacccaaagtaaatgtcatactcaaagcagtaagactgaaagcttttccacaaagatcaggaacaatgaaaggatgctattaggttggtgcaaaagtaatcgcagtttttgccattttttttttaaagtaatggcaaaaaccgaaattacttttgcaccagcctaatacttctgttacatatagtactggaggttctagacagagcaattagggaagaaaaacaaataaaggcatccaaactggaaaaaaagaagtaaaattatctctgttcacagatgatatgatcatatatgtagaaaattctaaagattccacaaaaaaaacctattagaactaataaatagggatggagacaagacggctgaataggaacagctccagtctaaagctcccagcgtgagcattgcagaagacacatgatttctgcatttccaactgaggtaccagattcatctcactggggagtatcggaaagtgggtgcaagacagtgggtacagtgcactgagcatgagctgaagcagggcggggcatcacctcacctgggaagtgcaaggggtcagggaattccctttcctagtcaaagaaaggggtgacagatggcacctggaaaatcaggtcactcccaccctaatactgtgcttttccaatggtcttagcaaacggcacaccaggagattatatcccgcgcctggcttggagggtcctacacccatggagcctcgctcactgctagcacaacagtgtgagatcaaactgcaatgcggcagcgaggctgggggaggggcgcctgccattgcccaggcttgagtaggtaaacaaagcagccaggaagctcaaactgggtgcagcccaccacagctcaaggaggctggcctacctctgtagactccacctctgggggcagggcatagccaaacaaggcagcagaaacgtctgcagacttaaatgtccctgtctgacatctttgaagagagtagtggttctcccagcacacagctggagatctgagaacagacagactgcctcctcaagtgggtcactgacccccaagtagcctaactgggaggcagccccaagtaggggcagactgacacctcacacagcccggtactcctctgagacaaaacttccagaggaacgatcaggcagcaacatttgctgttcaccaatatccactgttctgcagcctccattgctcatacccaggcaaacagagtctggagtggacctccagcaaactccaacagacctgcagctgagggtcctgacagaaggaaaactaacaaacagaaaggacatccacaccaaaaccccatctgtacatcaccatcatcaaagaccaaaggtagataaaaccacaaagatgcagaaaaaacagagcagaaaaactggaaactctaaaaataagagtgcctctcctcctccaaaggaacacagctcctcaccagcaatggaacaaagctagacagagagtgactttgacaagctgagagaagaaggcttctgatgatcgaactactccgagctaaaggagaagtacgaacccaggcaaagaagttaaaaaccttgaaaaaaaaattagacaaatggctaactagaataaccaatgcagagaagtccttaaaggacctgatggagctgaaaaccaaggcacgagaactacgtgacaaatgcacaagcctcagtagccgattcaatcaactggaagaaagggtatcagtgatggaagatcaaatgaatgaaatgaagtgagaagagaagtttagagaaaaaagaataaaaagaaatgaacaaagcctccaagaaatatgggactaggtgaaaagaccaaatctatgtctgattggtgtacctgaaagtgatggggagaatgaaaccaagttggaaaacactccgcaggatatcatccaggagaacttcctcaacctaccaaggcaggctaccattgaaattcaggaaatacagagaacgccacaaagatactcctcaagaagagcaactccaagacacataattgtcagattcaccaaagttgaaatgaaggaaaaaatgttaacagtagccagagagaaaggtcgggttacccacaaagggaagcccatcagactgacagctgatctctcggcagaaactctacaagccagaagacaggggggccaatagtcaagattcttaaagaaaagaattttcaacccagaatttcatatccagccaaactaagcttcataagtgaaggagaaataaaatactttacagacaagcaaaggctgagagattttgtcaccaccaggcctgccctaaaagagctcttgaaggaagcaataaacatggaaaggaacaaccagtaccagccactgcaaaaacatgccaaattgtaagaccatgaatgctaggaagaaactgtatcaactaacgagcaaaataaccagctaacatcataatgacaggatcaaattcacacataacaatattaaccttaaacgtaaatggactaaatgctccaattaaaagacacagactggcaaaattggatacagagtcaagacccatcagtgtgctgtattcaggaaacccatctcacgagcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatcctaaatatatatgcacccaatacaggagcacccagattcataaagcaagtcctgactgacctacaaagagacttagactcccacacaataataatgggagactttaacaccccactgtcaacattagacagatcaacaagacagaaagttaacaaggatatccaggaattgaactcagctgtgcaccaagcggacctaatagacatctacagaactctccaccccaaatcaacagaatatacattcttttcagcaccacaccacacctattacaaaattgaccacatagttggaagtaaagcactcctcagcaaatgtaaaagaacagaaattataacaaactgtctctcagactacagtgcaatcaaactagaactcaggattaagaaactcactcaaaaccgctcaactacatggaaactgaacaacctgctcctaaatgactactgggtacataacgaaatgaaggcagaaataaagatgttctttgaaaccaacaagaacaaagacacaacataccagaatctccgggacacattcaaagcagtgtgtagagggaaatttatagcactaaatacccaaaagagaaagcaggaaagatctaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaattaatgaatctaggaactggttttttgaaaagagcaacaaaatagaccgctagcaagactaatagaaaagagagaagaatcaaatagaagcaataaaaaaatgataaaggtgatatcaccaccgatcccatagaaatacagactaccatcagagaatactataaacacctctacgcaaataaactagaaaatctagaagaaatggataaattccttgacacatacaccctcccaagactaaaccaggaagaagttgaatctctgaatagaacaataacaggctctgaaattgaggcaataattaatagcttaccaaccaaaaaaactccaggaccaaaaggattcacagctgaattctaccagaggtacaaggaggagctggtatcattccttctgaaactattccaatcaatagaaaaagagggaatcctccctaactcattttatgaggccagcatcatcctgataccaaagcctggcagagacacaacaaaaaaaaaagagaattttagaccaatatccctgatgaacatcgatgcaaaaatcctcaataaaatactgacaaaccgaatccagcagcacatcaaaaagcttatccaccatgatcaagttggattcatccctgggatgcaaggctggttcaacatacgcaaatgaataaacataatccagcatataaacagaaccaaagacaaaaaccacatgattatctcaatagatgcagaaaaggcctttgacaaaattcaacaacctacatgctacaaactctcaataaattaggtattgatgggatgtatctcaaaataataggagctatctatgacaaacccacagccagtatcatactgaatgggcaaaaactggaagcattccctttgaaaactggcacaagacagggatgccctctctcaccgctcctattcaacatagtgttgaaagttctggtcagggcaattaggcaggagaaggaaattaagggtattcaattaggaaaagaggaagtcaaattgcccctgtctgcagatgacatgattggatatctagaaaaccccatattgtctcagcccaaaatctccttaagccaacaggcaacttcagcaaagtctcaggatacaaagtcaatgtgcaaaaatcataagcatttttatacaccaataacagacaaacagagagacaaatcatgagtgaactaccattcacaattgcttcaaagagaataaaatgcctaggaatccaacttacaagggacatgaaggacctctttaaggagaactataaaccactgctcaatgaaataaaagaggatacaaacaaatgcaagaacattccatgctcatgggtaggaagaatcaatatcgtgaaaatggccatactgtccaaggtaatttatagattcaatgccatccccatcaagctaccaatgactttcttcacagaattggaaaaaactattttaaagttcatatggaacccaaaaagagcccgcactgccaagtcaatcctaagccaaaggaacaaagctggaggcatcacactacctgacttcaaatacactacaaggctatagtaaccaaaacagcatggtactggtaccaaaacagagaaacagaccaatggaacagaacagagccctcagaaataatgccgcatatctacaactacctgatctttgacaaacctgacaaaaacaacaaatggggaaaggattccctatttaataaatggtgctgggaaaactggccagccatatgaagaaagctgaaactggatcccttccttacaccttatacaaaaattaattcaagatggattaaagacttacatgttagacctaaaaccagaaaaaccctagaagaaaacctaggcaataccattcaggacataggcatgggtaaggacttcatgtctaaaacaccaaaagcaatggcaacgaaagccaaaattgacaaatgggatctaattaaactaaagagcttctgcacagcagaagaaactaccatcagagtgaacaggcaacctacagaatgggagaaaatttttgcaatctactcatctgacaaagggctaatatccagaatctacaatgaactcaaacaaatttacaagaaaaaaaaaacaaccccatcaaaaagtgggcaaaggatatgaacagacacttctcaaaagaagacacttatgcagccaaaagacccatgaaaacatgctcatcatcactgaccatcagagaaatgcaaatcaaaaccacaatgagataccatctcacaccagttagaatggcaatcattaaaaagtcaggaaacaacaagcgctggagaggatgtggagaaataggaacacttttacactgttgatgggactgtaaactagttcaaccattgtggaagtcggtgtggcgattcctcagggatctagaactagaaataccatttgacccagccatcccattactgggtatatacccaaaggattataaaacatactgctataaagacacatgcacacgtatgtttactgtggcactattcacaatagcaaagacttggaaccaacccaaatgtccaacaatgatagactggattaagaaaatgtggcgcatatacaccatggaatactatgcagccataaaaaatgatgagttcatgttctttgtagggacatggatgaagctggaaaccatcattctcagcaaactattgcaaggacaaaaaaaaacaaacaccgcatgttctcactcataggtggaaattgaacaatgagaacacatggacacaggaaggggaacatcacacaccggggcctgttgtggggtgtggggagtggggagcgatagcattaggagatatacttgacattaaatgatgagttaatgggtgcagtacactaacatggcacatgtatacatatgtaactaacctgcatgttgtgcacatgtaccctaaaacttaaagtataataaaaaaagaactaataaataaattcaacaaagtagcagtatacaaaatcaacccaagaaaatcagatatatttttatacattaccaatgagcaatctgaaaaggaaactacaaaaaaaattctatttacaatagaaatagaatttctttattttaaagaataaaatacttaggaattaatttcaccaaggaggtgaaatatctgtacaatgaaaactacaaaacactgctgaaaaaaaattttaggacattaataaataaaaacctatcatatcttcatagataagaaaatttaatgtttttaagatgcccatgctacccaaagcaacctacagattcaatgtaatccctatcaaaatcccaatgatgtttattgcagaaatagaaaaacttatcctaaaatttgtatgaaatctcaaggggccccaaaacaacactgaaaatagaagaacaaagctaaaattctcatagttcctgatttcaaaacttattacaaagctatagtaatcaaaacaatgtgatattggcataaacacagacagatagatgggaggaacagagtagaaaacccagaaataacccttgtatatataatcaaattattttcaacaagagtgtcaagaacattcaataggaaatgaacagtattttcaagaaacagtgctggcacaactggatatccgtgtgctaaagaataagtagaatccttacctagcaccatatacaaaaattaattgaaaatgaatcaaagacctaaacataagacctaaaactataccactcttgggaaaaaataaaacagggcaaaaacctcatgataccagatttggtaatgatttctcagatacgaccaaaaaggcacagagaacacaagaataaaacagacaaattggacttcatgaaaattaaaaaaaaaaacctgtgcatcccaagacaatatcaacagagtaaaaagacaacccacagaatgggagaaaacatttaaaaattacgtatctgataagacattaatatacagaatatatagagaactcctaaaacttaacaataaaaaaatcaaattcaaaaatgggtaaaggactcgtatggacatttctccaaaggtatacaaatggccaagaggcacgtggaaagatcctcaacatcaccaatcataagacaaatataaatcaaaaacataatgagataccacttcacacccattatgacggctattatcaaaagacagaaaagaacaaatgttggcaaagaagtagagaaattggaaactttgtgtatagctaatgggaatgtaaaatggtacagcctctgtggaaaatagtatgaagattcctttaaaagttaaacataaaattaccttttgacccagcaattccacttttgggtaaatactcaaaagaattaaatgcagggtctcaaagaggtgtttttgaacaagtttcacctcacgatgaacgtacacccatgttcatagtagcattattcacaatggctaaaaagtggaagcaacccaaatgtcattcgacagacaaatgaataagtaaaatgtggtagaaacatacaatggaattttattcagccttaaaagggaaggcaattctgcaatatgctacaacatggctgaaccttgagtacattatgctaaatgaagtaagtcggtcacaaaaaaaggcaactaatgtatgatcctgcttatatgaaatactcagagttaccaaaatcacacatctagatagacagtagaacagtggttgccaggggccgaggtagcacacaatggacagttagtgcttaatgggtacagagtttcagtcttacaagatgaaaagagttagggggatggataatggggatgcttacacaactttataaatgtatttaatgccactgaactgcacacttaaaaatggctaagatggcaaattttgtttatgtgtatcttggcacaataaaaataaaactgagggggggaaatgccttgattcaagaaaaagctcaccatatttgagttgaataaagaaggctgaagtttaatgcaccagaagactagctctagatgagatctgagagacaggcaaggaccagatcatgtaaggctttcctggccataggtaagcagtctggattatctgaaaattccggtacttccaggaatttattctctccttcagactagatggtctgacttgacagcgcagagaaagcaagcaccatactctaaagctgcaccatccaacagagtaaccactaaccacacatggctcctaaacatttgaaacgtgggtattctaatttcagttatgctataaatgtaaaatatacaccaaagatcaaggcttagtacaaaaagaatgcaagctattttgttaaaaattcacatactgattacccactaaatatttacatattatgttatgatattaatatattaatgttgaacatataaaatgttaatgtttaatatagtaagtattaaatatggtatttcatattatataatattgttatttattaatatgtgtgatacattatgaaagttaatttcactttttttaatgtggctactcaaaaatttaaaattacatgtggcttgtgtttcttttggacagtactgcactagaaagggtccacaagaatgttttgtgaacactttgttcactgatgtatccacaatgcttggaactatgcctggcgtacagatagcacttgataaataatgaatgaatgggtacagacttgtcgatacaaaaagaaaggagacaccttcatctgatgttcccaatctttctaagttagtggtgtgcagccaaatgtgggggagtgggaggtaggagtgtgtttagggccaccataatggaccactacagacggtgggcaaggtggtggtgctgtcatgtgcacctagcttttctcgtctgtcctcatcctccactctttgtataaagactaaaaagcttggggtgttaataaaggcagcatcagcccataaaattgtgtcttatttagttacttcagtacagacctttttagttacctagacttcaatttttatctcttaacattctatttccaaccaataagtcactaattttctattaactctgatttgttatctctgctcctgtaccctatatatcactgctctactaaagaatgttcagaattaaataaactgactgtacttcagggtcttaggatctgtctgattttaatgctataaagccactggacaaatccacagcaagtctaaaggaggattttccagggatattatactaattcatgaactgtctggctttgctcaatgacttgaaagggtcattccaactctatgattctatgttatcaaagtatcttcatgtagaggcaatcttcactaaataaaattctcactcatttgggcatcaatctatgtgttcatttagtaaatatattcttgactggctctaccacagcgctgatactcttcaaggtgctggatatacacggacagggaaactgataatcccagtcctaatgagcagacaagaatatctgagggcataacctgaatttggctctgaactgttaaaggtggagagtgcagatctgaagtttatacagcctctctttcattatgcttccctttggtaacaaatccctcccactacttcagagagtcaatgtcttcccattcgcttcatatcctccttaatcaaaaaatgatgcaatatccagtcattcatacaagtacatgaatagagcttaatttaaatttattttaacaacccaatttagtattaaggcttataagcagtatctgtactttaagacttttaaattcaattatgaaatgaaaggttcctatccctcaataaaatcactttaaacaacaataaacaggtggagaaatattttctagaacgtaaaggcatactgttgtcttaaatttttatatttatttacagtttataaaaagtattttatgtgatttctctacttaagtaagtaagcagaaacacttattattattccttttaacagacgaggaaacgaattcagagaaattaaatggactaccgaatgtcatacaactactaagtagcaaacctcacatttcttcaacaatcaatattacttccatcccaccactgccagatgtcacaaacataaatatatgaattagtctaatataagaaaaactggggccaggcacggtggctcacgcctgtaatcccagcactttggaaggccgaggcaggtggatcacaaggtcaggagatcgagaccatcctggctaacacagtgaaaccccgtctctaccaaaagtacaaaaaaattagccaggtgtggtggcaggcaccagtagtcccggctgctcgggaggctgaggcaggagaatggcatgaacccgggaggtggagcttgtagtgagcatagatcacaccactgcactccagcctgggtgacagagcgagactccgtctcaaaaaaaaaaaaaaaaaaagaaaaactgggggttttgagacttgttctaagtgtgatattcaaaatatctgacagtcattaaagcaaatgtctaattagaacagttgccaaccacaataccaaccaatcaaaacagctaccagtggtaaacaacagtaagaacagataccagccataaataggcagtaaaaaaaaatcatccctgaatatcagacagagtacctgccccagctcagcattcaaatttaaattattttcaatggtatgccagccaaacaaaacaaatatacctgttaatgaattgtagaagtaagcacactcacctggccaataatttttttgattcctttcaccctgagtacattaatgggtggctttatgagcattttattgaaaacagatgcttaattctgctaaaacaaatatataaatcaaagatttaaacattttaaaaatacttagaagaaaaccaaagtaagtttcaaatcactaagcaggaaagatagtttctaatcaaaaaaagcaaagaaagaattatgagaacttattagttttgtctacacaaaaacttaaaatacataagcttagaatacatacaaggttctacataaccttagaaaactcagaaaaatagccagttatggtggcacaggcctatagtctcagctacccagcagactgaggtgggaggatcacatgagcccaggagttcgttcaagtccaggctgggcaacatagtgaggcctcgtctctaaaaaaaactaaataaatttttaaaaagaaaaaaatagtcatagcaagatattaatatatataattatttatttagaacatagagctcatataaaaccttcagaaaaacaataaaatctcaataaataaacaggcctaagaaatgaatataaaattcacaaaactaaaaaaaagagctaattaacatacatggaaactactaaactgctctaattatcaaagaaaggcaaattaaaacaataaagtaccaaatataaaattaccccaggggttacaatattgctgtgaataacagcacatatataaccagaatgtaaaccagagtgtaaaagtgacataagaattcagaagtattttccaagaagcactaggaaacattgatccactgaaaaattatttattgagcacctactctagatttaatttttttttaaatctctaacctaacctcatggggctccaatctagcaggaaatacagacttagagactcataaatgatcataaaaagctctttcaaagtgaaacataaccaaaaaggagtgcaattaattaggaacagatagaggaagtggcattaaaatcaagctttaaataaaaaaagtagctcactatccagagaaaggaaagactactaatagagtaactcaaataatgaactaaagaatagaaatataacaattataaaatggcactcagaaaccaagtaaggcccagttttcttccttccactacaataagaaaaatgacaaaaagcgatagtccaaatttcagccttgtaccaaaacggagacaaatcttagcaaatttggaagataaatgtttacttggtctcttttaaatatcaatggtgccaaatgaactttggacaagagaaatatctgtatcaaggtttaaggtactctacaagtattgtgtgtcactaatggaaaaggaggagagtggaaggaaataagaacgtatacttagtggacaccatacagcaggttctgatctagatgtttatatcatgctcatttcatgtcatttggacatatgttaacctttttgttattaaaaaataaagaagttgacagtcattttcctagatagatggagttttgttttcaaataatctctagctgttttaacaaatttcattcacatataagcacagccaattaccaaaagtagctagatttttatttggcaacaaagagaactacttctttccattgtgacataaaatttaaagcagtacctttctcatatctgtaagacttttcatgaggctggataggtccatacccaactatttcaaaatggtcagatttatactgaaaacaccaagagggagaaaacacatgagagaggatctgcttcatatagaagaaggtaatgtaagaattcagctccaagatggaaaagcgttagatccattctcaaatcacagctagcacttccttcagtggtatctgttaagaatcccttaaaacaaacaaaaaaaaaattgtggacaccattgattggaatacaaaatattttatcaacagaatacttcatttgtggatttaattaggttatcctcaatacattacagatttcatttcatttaggtcactatacaaatggtgcgatgtcatttttaaatcctctgaatcacattttatagtctgttttgctgtatttttttaaagaagggtggtagagagataataaaccatgaatgaaatactcagcaatcagggataaaagtaagacatttatagctgagctaatacgttaaaagatggaagtctacatctggtttcaattggtatgaattcactggcaaatttaagaagaatttcattgtacgaaaacaaaaagatggttttgataggctttagtcctctggttacttttgtttctttagtcacatgattagtataataatatgatacatttaatatgtcactgtgtatatggttttgataaaaatacacccaccaacttgtctcaagggcacatgcacaaatggttttaaaatacatatactgccttaatgtttttagatcagtaaaaatgaattcaagtgaggttttaagttcacacaaaattaagaattttaattttctaataagtctttcgcaatgttagctaaacaccttttggacataattacttatgcatataaaatgacgcattaattctacatttaatacctattagatagtaaggatacaaaaaattagacatacgccccccttttcaaatgccataaatagataagtacaggtacttcatttaagttttactttcataggcacttgcataaggtcttaaaaattgatcgaaactcaccaatgtaatccttacacagtcttttaaggcctggatcaaactttgcctctttcaagaaatcaccctatattcctcgagtcaggattaatctatccagtgttaacaatggtgataacaataacagcttgcatttattgagttcttactagtcagccactccacaggtttcatttcatttaacacccaaacagaactgtagaaggtaggcactaacaaggatttactgaaagtctgttacatgatcactgtcttcatgacactcagaattttgtgggaagggaataggaacaattaattacaatactaagcgatgcctgcaacaacaggattagcaataggagcactccaggacagcagttcttaaagctgattatgcataagaaccagtactcttaaaatccaaaccatctaatacaacatttaaggccttgaatgatacaattcctgccagcctcgaccatctaccttaccattctaccactcaggaagggcttcacagagatgacttttgagctgactctaaaagagtgaacaaagtttatcaggtgaccaaagagggaaagatacataaggcatgtgcaaaggcactgagcataaaaatacataaagtgcattaccaatgaatagttctttgtgtttgaacatagtgtgtatggtaaaatagtgcaaaatgggaagtcagattagggccaaactgttttacacacccacatatttttaagtggaaagatgacatgatcatatctgaacttttaggaagaaaactctgacagcaggctctcagacaaagactaaaaggaggaaaacagaagtggagaatttaataataaaataattcgtaaaaataacagtagtagtagtaggagtaatagtaacaggtctataaccttgcttagaatcctaagagagacttgtgtggtagaattaatagtgaacaccttaagcaaaattattcagaagacgaagaagagtcagaccatgcagagaagccaaaaggtgccaaaagcaaaatccatctttcctaatttacgtaggtcttaaagactatctagagtcttttcccacaactgaaagtgccttagcactaaagaatcatatattgcttagttagcatcctctcagttctcccaaaaaattgttataaaaaatgaacatgtcctttgactcagtaattccatttcattaatacatccaatgaccacaacacaaatatgccaatacctatgtacaaaagttccctgcagctttgagtgtagcaataaaacattaaaaagttagaagtcactttcatccaggagactgaaaaaaatacattctgttacacacacataagacctatatgtactggtatgggaaggtatctaaaatatatcagaagttgaaaatgaaaaacggtaaggtataaaacatcacatatggtattaatcccttgtgtaaaacaagatatacatacatatgtggtgaaagaatccacaagaaattaactgacacaacctcaaggaagtaaaattgaagggtagatgtgaagacattaacttcctcttttgtacccttttgtattatttgaaatttttacaatgtgctcgtgttatgtttttctctataatttatataattaaaaggaatgaagcagttaaaagtacactctagttaaaagtacagataattatgcaacgcaattttagaagatctccatataatactgttaaaattagaaatttgccatccaaggaactaactttccatttcctggaatattaacttatatatatttcttgatttcctaagattaaacaaaagtaagataagacacaatgatcttttcatatgttttttctaatgctgaagaatatccactatttcaacaaacatcatacaattcttaaatcacttgtgatttaaaactaaataccactttttaaagtttttaccttaacagtaaaaagtggcaatttacatttgtatagaactttacaggttacagagtcctctgacacttaccatgtttttttcccacaagaaaacactgatgtaggtaaagcaagtaatatgatattagatcaatttcaggattaggaaactgaagctgagaggagttacacaatgtacccagggtcacagagctaataagtaacaacccaagcactgaagcttggtcttcctgctccacatccaaagggctttccactaaaccacatcactccaaataaccactgttacagcgtgctatggggtcaggcttctgacagggaagaagggctcactacagatctggcaatgacaggcagtctgcctgcagaggaatgtacaatacaaaaataaagtgtatgaaggtgggcctgactgacgaaagggaagtagaactgggagaaatgccaagaagaataacaaaggtgaaaactgggcaacttaccaataagggaagccaaggaaatacctttgtaaacttaatttacttagttaaggtagaagggatagtctatgtaggggactatatattataatgtggaaaaatcataaagtgtttataattcaatcaaaagatttagaaaagatgtaatgaagcgtgatgtgtatgctgtatttaatcagagattacaatgtggcagcacatgactgccatgaaaattttaatggtctaatcccacaatgcatatcctgttaatgttgtggcttagaactttaagaggcaagtgtgaagtacactcagaactcatactcactccatgggacacccgaaataaggagcaaaaagtatcactttctacacaaaagaactcattctcctaagattctagtacagcactgatcattagtacccactcagagtcagaaaatccttgtaagaacgggccagggacaccagaaataacaccaggatcaagccatcctggactaaagagaaccatgggtctttccactgagtactttccaggaaaatcctttagcaaacatttactgctgacctagcaggaacaggctccttgagaaacatcaaccttactgtcccttactgtgacagaaggaaaaaagagatgggacccaaaagctttgactcaatgtcaccagatgtatcttccacagtttaagattcattttgtgagctattttagagtttttaaattattgtcctttattcctggtgtgttttgaagtttagtaaatatatagaaacatctattattttttgccagtctagcactcatttgctcttctcctgctaaacatattctgatttccctctaggaaatcactacttctccattctcagaccatgtatttctggtagtcaagtctaccctagctccagattgaacatatgacctaggtctaagtcaattactaaatcacattgtaatggccacaatgatttgctcagagaagggcacatgacccacgcagaggcacaagattatcactcttttctgctggatttcaactagaaagatataacccagggaactgctggcagacatcttgtaactgagggaagagcttgtgtgagtgaggccaagaaagaggtatcagaacaaaaacatgaattcaagtaattcctctcaccctgaatcaagccatgcacaaactaactttgcaatgagcaagggttatgtgaacaaataaattccctctttggcttgagctggcttaggctgggttttctgtaacttataaccaaaagttgaaactgattcagtaaacttgaagtaaataccaaacaggagaagttcttggaaaagaggtttgtgtaaagcacaaaccactgactaactccagaaatgctagaggttattccagatgtataacagctttagatgtctgatctattttctactttctggcccatcaaaaaaagggatacaataattggcggaaagaaaagtagaataaacatattttttaaaaggaacatgcacagtcatttttttaaagtctcctgctgccttcattttcctactagcacctcccctagctagtttgtcattgtattcatttgcatttgatttctcattttacggaactctcagatgtttcagtttccattcatttttatggcataatcaactcacacaatagttaccaaaaccctttacagaaaaatcaatggtttcgagaaacttggtgaatatgtagcaatttctgaaatacttaaatctcaaaagtaatacttaagcttacatgtaagattttatctgatcattcatcaagcttcatattccaacttcttaacaaccaaaatttctccctgccccctcctcctctcctaggataaagaatacacacattaaattggggctcccaggtatcctggatgaggaaaatactctgggaaaaacagcacagctgttcagttaactcccttctaccctcacaaatctatttcattccacccccctaaagaagagacttgaaaatataaaatatccaaggttataaacaataaaaaaagttatggaatttgtccagaaaaacacaaatcttctgttcaacacaaagtacatacattaggaaaaataactagaatattttaaccattattcgagagggcagagagaggttgtctttcatgaaatctggattgcacatgtctggcaaggaaaaaaaagattaataatctatcacaaagccccacaactagtgattcaaaatgaaagctttcactacttacaccatatgtaaatatatatatatacaagctgcttataatcccttgatctgcagagaaagagaactgatactctactgtgaaaatggtcagtgggtacacattttaaaatcctttcccacatgaaaagattcctgaaaaagagatcagaagacaacagaaaagcactcaatatatatggagttgtaaatccagtatgaaccagtatctattacacaaaggaggaacatgcaacaaagtgattaggaaagtcaaacatgaattaatctaataacacaaaggtaaatataaaccccaaagagcactttattgaacagaaatccacacatatcaaaaagatgtctactattaacaatgacatatcaagcttttaaactccaaattaatcttaataatcaataatgcaaacttgatatgcccttaccaagaaaaaaaagtttgaagaagcacttaacatcaaggcagaacatatacatatttttaaaatataacaaaccaaatgtttaccataaaggctattacatgcaaggtattgattctaagggcacttggataaaatatgctagtatattttgaatagccactgcttgactcttttatttatttggttatttggttatttatgtatttatatgtttattgaggtggagtctcactctgtcacccatgctggagtgcagtggcgagatctaggctcactgcaacctctgcctcctgggttcaagtgattctcatgcctcagtctcccggcagctaggattacaggcgcatgccaacacaccaggccaatttttgtatttttagtagagacggggtttctctatgtcagccaggttggtctcaaactcctgagcccaagtgatctccccgcctcagcctcccaaagtgctgggattacaggtgtgagccacctcgcccagccaccaccgtttgattctattaaagaaactaacactgtacctaaaaatgtgaggtctatgttatggaatgtatactttcttcattaacaacaataattcaaagtaccaaagtaccaatggtgaatactaagattctatccttggttctatagttctctgcattcttctacccaaatacatctggtagatgatcatgtccaaaatgcaaagacacttttatctacctaagtgagatgataggataaggatgacaatgtcaaaagcaaatatatatagggccacttatgtgccaggtgttattctttaaatacatgtaatctttataacaactcatatcttgtcccatatatcagatgaagaaattaagtcacagagaagtttaaaaacttgcccaagttcagagaggtagtatgtagcagagccaggattcaaatcctggcagtctggctccacatttcatgttctcagctcaattctagtcttcagctataattccaatcctttctttccatatcactacttaacctccatatgtttccatttctcatctggaaaatgggtcattaatagttcttacctcatagagttctccaatcctcatgaggattaaatgccataatatacataatgtatttagaaaagtacctggcacataaaagtaatacatatttctgttgttattttatctaccaaatgtctgtcactggagttgagaaccattgttctaaaactgtaacagtgagaatttaccaagcagaatagtcttaatgtgcccttacactggtaactaaagaaaactggactttctcaattattttcaatataaaacaagtccaccaccagccttcaagaaaatatacaaatcatttaagagttgctatcttcagtctggaatttcttctccattattttgtgttccctcacacccacccaatattacagaaatagatctcatcctgataaaggtatatagtgaaaatgtctcttatatatcaaactgaatgtttatacaacttttaagacataaaggccaggtgtggtggctcatatctgtaatcccagcactttgcgaggccgaggtgggtggatcacctgaggtcaggagttcaagaccagcctggccacatggtgaaaccccatctctactaaaaatagaaaattagccaggcatagtggtgcatgcctgtaatcccagctacccgggaggctgaggcacgagaactgcttgaacatgggaagcagaggttgcagtgggccaagatagtgccactgcactccagcctgaacaacagggcaagactccgtctcaaaaaaaaaaaaaaaaaaaaaaacacctgtgtggtattttaatgtaattctcatctatacagctggatgctgggtactcttgaatcagaatactactcccagagtttggcttcacgaaagagctacaaagtgtgaagactgagggaactacaaccatcctttaacccagggactaacgctgatcgacatttaaatatgcttctattaatagttttctgttgtgacaacactcttgcacaggccccactatacaattgtgccaagatttctcaaaagtacagaaggaggaggaaaaccactggatagagcctagagtacatacatattcaacgacaggagattatcaaattactctttgaagtagttgtactaatttaaattcctaagagtatgatagcatatagagtatatataaggcacaagtgagtacaataaatttggaagcatttctatggagaaggtcataaccaagagcagacaaagaagtgatctaccaagtaaaccccagaaggactccaagcttagaaccatagggtagggagagcaagagggaaagggagttcactttttcacggaagctgtaaagaagaaaatggaacaagagttggctccttgaccccagtctgcccctgctcccatgtacatgcagattacatgaattctggcatttatccccagatcaaaaaaaaggggaaagggttcctctctaaagaaattcagggggccgggcgcagtggctcacgcctgcaatcctagcactttgggaggccgaggtgggaggatcacgaggtcaggagatcaagaccatcctggctaacatgatgaaactccgtctctactaaaaacaataccaaaaaattagccaggcgtggtggcagtagcctgtagtcccagctactcgggaggctgaggcaggagaatggtgtgaacccgggaggcagagcttgcagtaagccgagatggcgccactgcactccagcctgggcgacagagtgagactccgtctcaaaaaaaaaaaaaaaaaaaattcaataaaaacctgttgtaggccctttcccttaaaagctagctcccaacccattcaccctaatattatgcctgtcagtcaaaaggcattgtcccagtgcttacggtgagacctgagcagccttccagtcccaagggcaagaccagaataaataaaacaaggaaatccataaccctagaagaaacagaaatgattcaggaaacagacaatagcatttatttaaaaaacgtattattcttaaagcaatttcaaaagcttttctatccatgtcagcatcaatatgttatgaaaaaggaataatcaaaagagttcttgtaattaaaatataactgctaaaataaaaagttcagttagaaaagtcagaaaataaagcaaaataaagcaccccgcctcctccaaaaggcaaaaagacaaaaagagacggataatctaagaggaaaaacaaattcaggagattcaacctttcaataaagaaaatagaaattttccaaagctgaagacagacaattgtttatatattaaaaggaactactgaatgctgagcataactaataaaatggactcacatctaggcacattcttgtgaaatatcagaaacgtcaagataaaaagaaaactccagaaatttccagagggggaaaaaacctacaaataagtaagactctgacagccattagcaacactagatgttagaagataaatggaggaaagtctcaaagctctgagagaaaattattttcactgtaaaattctacgtaggctatcaaccaagcataaaagcaaaataaagacattttcagatatgcaaaggctcaaataataattgaccccttattcttgtatcatgaagaagacagtttaggaagaatacaaaacaaaggtaaaaaccaagaaaacaggaaatatcctttttttaatggtggcactaacccaagagtcaagtgaaaagaaattctaaggatacggctataaaacagacctcaaagcaataagtccacattagaacaagaaatcaggaagctccaaagaaatctcaaagaagaatcacatacatttcaggaaataaatacactgagtaagaagctcaaagatattaccaaagggataaaagatgcatacattgcttttttcaaaataacaaaaaaagaaaaaactcccagaaacagaaaattatataacaacatgatcctaacatagagccatcaacctaaaatgtggcaatgattttgagtaattaattgtgagaaaagtaaatccatttagaccacatgctgggaacattcttctttgggtaacctaggggtacaacactggatatttagagacagaaataaaatttgagcatatcattgtttcctcttccaagatgttctttgccctctcttctctgacttactcatttattcattcactctctcaatatttactgagcacccatcctaggagctaaagataaaacagtgaacgaaaaaagaaaaacacctgcccttttgaagcttatattcaataactcctattctttcaagaatctgctaaagcaggagtccccaacccctgggtactggtccatggcccgttgggaactgggccacatagcagcaggtgagtggcgggtgggcaagcattactgcctgagctccacctcctcctgtcagatcagcagcagcattagattctcataggagaataaaccctattgtgaactgcacatgcaaggaatctaggttatgcactccttatgagaatctaatacctgatgatctgaagtggaacagtttcatcctgaaactatcacccccatccgtagaaaaattgtcttccatgaaaccagtccctggtgccaaaaaggtcgaggaccactgtgctaacggattctctcaccaatgaaactttttctaaattgttaggctatgtgcatctccttttttcctcctaaagaactctaactctttgcaaaacagaatttggctttttacatacctattacctcatctagtgtgtgaagaatgcaagacagcaacatttattagttatttgtacttctagtgaacagcactgggcctaaatcaataaatgtgttttgaacctttccattcaaccaaaatgtaaataaaactgctgtattcatccactctcacactgctataaagaactacctgagactgggtaatttagaagaaaagagatttgattgactcacagttccacaggctgtacaggaggcatggctggggaggccatggagactcacaatcatgacggaagggcaaaggggaagcaaacaccgaattctcatggcacagcgggagagaggatgaagggggaagtgctacacactctcatgagaactcactatcacaagaacagccgggggaaatctgcacccatgatccaatcacctccaatccacctccatgatccaatcacctcccaccaggtccctccccgaacactggggattacaattcaacatgagatttgggtgggaacgtagagctaaaccatatcaactgacaagtaaaatgtaaagcactaggcaaatgttacttattacttaacagatgaggacactgaagtccttgtcagttgaatgatttgctacagaccacaagactagtctgtagaagaaccaaaactaaaacccatattgctgaaagcctgggttcatgccgtttctcctatactaggttgaatgaaaacaagtagtcaaatcaaaaaatgggcctaaatgggaaagaataaccttaggcattttcttagaatgtttttaagtatacaataaacatccaaaatatagactctatttcttccatatgtcaagacatagctttacaattatgtaaagatcatttggaaagcctctaatcaaaaatctaacctatcttttaagagcttcaatttcacagagttatgcatttctactctgcagtatatgtttgaaatgcataaatgtttcgagatgtttaacggcatttaatataatataaattggtttttaaaaaatttcttcatgggaaaccttcaaaacttactaccacaaatatactaaagtttttattcttttaaaacttgaaaacacttgactcctcaaaaaaaaaaagctcatattaccttacacaaacaacaacaaaaagctttttcatgagtcacagaaggcctatggttaaaattatcaagatacacatttttaaaattaagcaaaaaattaaacagacacatatataacttttgtaaaaatcagggaactaatgaaacattctggtatttcacacatgccaaggttactagtaagcatactttttatggcttgtctttggtatatgaccatatttgttcagcaatccacattattaataccgaatagtagccatgcaaattataacttatccacaaaaatataacactgaataaagaggtagggtaattttatattcacaggacaagaagccaaaaaattggctgtttcagctcaacatttatcaaaggcttgtaggtgccaaaagctattctaggcacttggaatatttcaagattaatatattaaaactcctgggcaactgcaactactcttctcccaaacactaaaagctgactaattaaatgtaactcccatatataggataccatgactgggttatctacaaagaagtttcatcaaacttaaaagatagtttaaaatactgtgaaaaaatcagttactgaatgtgaatgatacgaggacttgagctgtgtttgtgagtctgatcacaaaaatcagaaatttaagtcacatatactattttatagagccccaaatacttaaaaaccaaaaggactcaatgaatactaatcttacagtgatttttactcataatgtaaccagaagagtcagagaaacttttatcacccattagaatacaggagttttacctttttcctaattctagtaccactaccattaattaccacaattcgttaccagctcaagtgccaactctgtgatctggcccatgttgagtaagaatcagcacttaaatagacaaaatctctaccctttacaactcagactcagttacaatcactggaatatgtctaattaacccacaacttaattctatgccttcatcttttcctacatgtttcccaaaggaaaagtatagatcagattttgaaggtccttctttaatatctatgctgacaatcagataatttgttttatgacttttaaaatatgtgaagtactcatataactattagcaaactgtcaagcaataaaacataaaaaaaaggccaacagaaacaacaaacagcaaagaacaggcacaaaaagaacatgaaacagccaatacaaatatgaaaagatagcctacctaatagtcaaaataaacatcatcatcacagtaaaaatagcatttattgtgctttctttatgtaagagtgaatatgcaataaacacccaattaattaatcaatgaattactaaatagacaacaaactacctgagaaaataagcaaattttcaaataagaggtaacattttcagctgggccttcatggatgcaaatacactaggcaaagactgggggtagggataacactaaaagaagtgcagaggatgaggcaagggcatacatataatcaccaaaatatgaagccagttcttattctaggagccagttctcattgtaacactgaactggaaagtacctgataaaacagtgacaaggtatgaaactgtacaggaagaaaggaggtaatacataaactctgtttatacatcaggctaaaaaatttgaacttaaatgttttatttaaaagacatgtaacttaattggacttgctctttcctgtgccttttattttcaattttcaaggaaatatttgttcaaaaatagacaatagtcaataattcagaatcaagaacgctttacccctaataagatttctttcaaagacaagcacaattccacacacaaaataaatatgttacttaggtggttctccaagacttactactcttaaaacaaattaaaaatttagaatctattgtcaactccctaaatcatcacataattttgtttcttctctataataaatgaagctcactatatataaatatgtacaaatagaatatgcaaattatacatagacaatatccagaaagtttctaataatgtaatctaaactgtccattactctgagaaagcttactattaatgtggttaatatatgtagtatatacataatcaaatgaattataaagttaaggtctcacatcagaacaggattatgctgtcacaacaacatccatctgggtccacttgagcaccaatccaaccttgttctcaacctatattttatagtttttattaacaatttaaagataagcacaaaacaatttcagtaatcatgtttttatatctttttttagatttataaaggttaaagctgtcaataaagttttacatccacagatcatacatgaattcatttaagtgaatataataataagaaaagtcaattcaagggctctacctgacatacccaaatgaacaagagtaaaaagagatgcaagcaaatgagtaaaccagtatctgagatactcactccaaggaaaaggccccaaacataaagcatgagtttcaaggacaagataaaactcctaaaaagagattaagagaaataaatggggtactaggcaagaataatacaaaatgtcacacaggattattaactggattacaaaaaaggtacatgaatagaaaataaataagcaaatgactaattagtaaaatcaaggaacagggtcagaggagtaacaacggtaaaaactgctatggtgaataacaaaaatatatgagatacagcattcttagatactagcattagccgactagaaaatataacagcaacaaaagatcattcacattagcagtaaaaatgacaaagctcctagaagcaaatcaaatttaaaacgtatataattttctttttcttttttttttagatggagtttcactctttcgcctaggctagactgcagtggcgcaatctcagctcattgcaacctctgccccgcaggttcaagagattctcctgcctcagcctccagagtagctgggattataggcacctgccagcacacccagctaatttttttgtatttttagtagagacagagttttgccgtgttggccaggctggtctcaaactcctgacctcaggtgatccacctgccttggcctccagaagtgccaggattacaggcgtgagccaccgcacccggccgaatgattttcaagaggatttaaaaatgcatttaaatacaaaaaagaagaactgaacacaaagatattctatgatcatgcattggaaaatattagttaacacaaattatgagttaaatgtaattccaatcacaaacccagcaagactttttgtggagcttgacaacttattctaaaacttatgtgaggccagacacggtggctcatgcctctaatctcaacactttagatgaccgggtggatcaccccacgtcaggagttccagaccagcctggccaacgtggcgaaaccctatctctactaaaaatataaaaattagctgggtgtgatagtgggtgcttataatcccagctactagggaggatgaggcacaagaatcacttgaatctgggaggcggaagttgcagtgagccaagatcacgccattgcactccagcctggggaacaagaacgaaactccgactcaaaataaaataaaaaataaaataaataaataaataaaacttataagagagatcaaggaaaacaaagacaagggaattgcatcccaaacatcaagcacgccaccatataattaagaacatatttctggatccgggagccaagatggctgaataggaacagctctggtctacagctcccagcgtgagcgacgcagaagacgggtgatttctgcatttccatctgaggtaccaggttcatctcactagagagtgccagacagtgggcgcaggacagtgggtgcagcgcaccgtgtgcgagcctaagcagggcgaggcattgcctcactcgggaagcgcaaggggttcagggagttccctttcctagtcaaagaaaggggtgacagagggcacctggaaaatcgggtcactcccacccgaatactgcgcttttccgacgcgcttaaaaaacggttcaccaggagattatatcccacacctggctcggagggtcctacgcccaaggagtctcactgattgctagcacagcagtctgagatcaaactgcaaggcagcggcgaggctgggggaggggcgcccgccattgcccaagcttgcttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctgaccctggagcagcctaactgggaggcacccccaagtaggggcagactgacacctcacacggccgggtactcctctgagacaaaacttccagaggaacgatcagacagcagcattcgcggttcatgaaaatccgctgttctgcagccaccgctgctggtacccaggcaaacagagtctgtagtggacctctagcaaactccaacacacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacaatcaaactactccaagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagacgaaataaatgaaatgaagcgagaagggaagtttagagaaaaagaacaaaaagaaatgaacaaagcctccaagaaatatgggactatgtgaaaagaccagatcttcgtctcactggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttaaaatgaaggaaaaaatgttaagggcagccagagagaaaggtcgggttacccacaaagggaagcccatcagactaacagctgatctctcagcagaaactctacaagccagaagacagtgggggccaatattcaagattattaaagaaaagaatttttaaaccagaatttcatatccagccaaactaagcttcataagtgaaggagaaataaaatacttaacagacaagcaaaggctgagagattttgtcaccaccaggcgtgccctaaaagagctcctgaaggaagcaataaacatggaaaggaacaaccggtaccagccactgcaaaatcatgccaaattgtaaagaccatcgaggctaggaagaaacggtatcaactaatgagcaaaataaccagctaacatcataatgacaggatcaaattcacatataacaatattaactttaaatgtaaatggactaaatgctccaattaaaagatacagactggcaaattggataaagagtcaagacccatcagtgtgctgtattcaggaaacccatctcacaagcagagacacacaaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtagagggatcaattcaacaagaagagctaactatcctaaacatatatgcacccaatacaggagcacccagattcataaagcaagtcctgactgacctacatagagacttagactcccacacaataataatgggagactttaacaccccactgtcaacattagacagatcaaccagacagaaagttaacaaggatatccaggaattgaactcagctgtgtaccaagtggacctaatagacatctacagaactctccaccccaaatcaacagaatatacatttttttcagcaccacaccacacctgttccaaaattgaccacatagttggaagtaaagctctcctcagcaaatgtaaaagatcagaaattataacaaactgtctctcagaccacagtacaatcaaactagaactcaggattaagacactcactcaaaaccactcaactacatggaaactgaacaacctgctcctgaatgactactgggtacataatgaaacgaaggcagaaataaagatggtctttaaaaccaatgagaacaaagacacaacataccagaatcgctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcgaaccagaactgaaggaaatagagacacaaaagactaatgaatccaggagctggttttttgaaaggatcatcaaaattgatagactgctagcaagactaatgaagaaaagagagaagaatcaaatagaagcaataaaaaatgataaaggggatatcacgaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaacaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaattctcccaaactcattttatgaggccagcatcatcctgataccaaagccgggcagaaacacaaccaaaaaagagaattttagaccaatatccttgatgaacgttgatgcaaaaatgctcaataaaatactggcaaaacgaatccagcagcacatcaaaaagcttatccaccatgaccaagtgggattcatccctgggatgcaaggctggttcaacatacgcaaatcaataaacgtaatccatcacgtaaacagaaccaacgacaaaaaccatatgattatctcaatagatgcagaaaaggcctttgacaaaattcaacaacgcttcatgctaaaaactctcaataaattatgtatcgatgggacatatctcaaaataataagagctatctatgacaaacccacagccaatatcatactgaatgggcaaaaactggaagcattccctttgaaaactggcacaagacagggatgccctctcaccactcctattcaacacagtgttggaagttctggccagggcaattaggcaggagaaggaaatcaagggtattcaattaggaaaagaggaaggcaaattgtccctgtttgcagatgacatgattggatatctagaaaaccccattgtcttagcccaaaatctccttaagctgataagcaacttcagcaaagtctcaggatacaaaatcaatgtacaaaaatcacaagcattcttatacaccaataacagacaaacagagagccaaatcatgagtgaattcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtattttatagattcaatgccatccccatcaagctaccaatgactttcttcacagaattggacaaaagtactttaaagttcatatggaaaaaaaaaaaaaagagcccgcatcgccaagtcaatcctaagccaaaagaacaaagctggaggcatcatactacctgacttcaaactatactacaaggctacagtaaccaaaacagcatggtactggtaccaaaacagagatatagatcaatggaacagaacagagccctcagaaataatgcttcatatctacaactatctgatctttgacaaacctgagaaaaacaagcaatggggaaaggattccctatttaataaatggtgctgggaaaactggctagcgacatgtagaaagctgaaactggatcccttccttacactttatacaaaaattaattcaagatggattaaagacttaaacgttagacctaaaaccataacaaccctagaagaaaacctaggcattaccattcaggacataggcatgggcaaggacttcatgtctaaaacaccaaaagcaatggcaacaaaagccaaaattgacaaatgggatctaattaaactaaagaacttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaagtgggcgaaggacatgaacagacacttctcaaaagaagacatttatgcagccaaaaaacacatgagaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgggaatgtaaactagttcaaccattgtggaaggcagtgtggcgattcctcagggatctagaactagaaataccatttgacccagccatctcattactgggtatatacccaaaggactataaatcatgctgctataaagacacatgcacacgtatctttattgcagcactattcacagtagcaaagacttggaaccaacccaaatgtccaacaatgatagactggattaagaaaatgtggcacatatataccatggaatactatgcagccacaaaaaataatgagttcatgtcctttgtagggacatggatgaaattggaaatcatcattctcagtaaagtatcacaagaaccaaaaaaccaaacgctgcatattctcactcataggtgggaactgaacaatgagaacacatggacacaggaaggggaacatcgcactctggggactgttgtggggtggggggtggggggagggatagcattaggagatatacctaatgctaaatgacgagttaatgggtacagcacaccagcatggcacatgtatacatatgtaactaacctgcacattgtgcacatgtaccctaaaacttaaagtataataataattaaaaaaaacatatttctgttgcagaagcaggcaaataaatctctgctagaacagacagaccaaatatagagacaaatatatacataactttagtaggacaggcttataagccagttaaaaagggatagaaaattgtgttaggacaattagatttccacacagaaaaaaaaaaaagtgctgtatacccctatctcctatcatatacagaaataaactccagctagattaaagatgtaggtaaaaagccagcctattgcaagataagagtgacaccatttcaaagcaaaaccaccataatgacaggagtttggctccagcagcaaggtctttaaacaatgcctgtagcatagacaacccctcataaagatgtttatctaacctctccagtggtcatgagtagcaacaaagtctgaggtgtaaccagctgcatatgttttaccaaaaaagcttgctatataaaggatattttcgggagggtggatgtgggaatacaccacctcttggccacccaaaacattatttctgtttgttagtctgtaataaatgtttttttataagaaactggatttgtcagtgtctttcttcagctctcagctcccttagcctttgggggtagctttgcatatgtttgctcatagcagaacagaactgctaataacaaaacttgtactatttgaaagagttccacttctggtagtgataaactagataattcagaccactctcctgcttaaagaactaaaatgtctggagaaaatacatttaaaagtctatgttaaggctaatgaagacacacgagcagtgtattttgtctgaaaacaaaatattaaaaaaagaaaaaagaagaggtaagcctagcaataagggctgcttttccccaagaggcatctatcaattatggaacagaggccaagaggctaataagcagagcagaccttttgactgacttacaagatgagaaggtcaaagactggaaatcaaaacctaccgagaaactgagaagccctataatgccaaaggaccatatcctagatgtaaaggaggatcaaccctcaaaagtacagtcatgtgtcacctgacaacatggatacattctgaaagacatcattaggcaacttcatcattgtgtgaacatcacagagtgtgtttacacaaacctagatggtatagcctattgctcctaggctacaaacctgtgtagcatgttaccgtacagaatgctgtaggcagcagcaacacaatggtaagtattcgtgtatctaaacacatctaaacatagaaaaagtacagtaaaaatacgatactataatcttatgggaccacaattctacatgcagtccatcattgatagaaacatcattatgtagcacataactgtactgaagcccagattcaaattatctctaaccccaattgaattaagtgatccaggattgctagttctagccaccagatagaaacaaaaaccttaagtaaaatacgtcaacattcagaagttcaaataacctctatcacgttttacgcaatgtctagcactctatcaaagatcacaaggcacagacaaaaacaataaaaaacaagagaaacaatataaaatagaaagagacccacaggagattaacatttaaaagattagcagacagaattagactataattaatatgttctaggatatgagcctaggcagcgaagtgagaccctatctcttcaaaaaatcaaaaaaattagccaggcatggtaccacacgactgtggttccagctactcaggaggctgaagtgggaagatcacttgagcccaggaggccggggctatagtgagccatgatcacaccactgcactacagcctgagtgacagagcaagaccctgtctcaaaaataaaaataaaaaataaaaataaattatgttcttggatataaaatacaagatttctggataatatctttaaaaggctaaaaggaatcactaacctagaattctttacccagcaaatatactgttcagaagtgaagtgagggtcagacatggtggctcacatcagtaatcccagcactatgggaagccaaggcaggagaattgcttgagaccaggagttgaagaccagcctgggcaatatagccagaccccatctctacaaaataaaattgttttaattagccaggcatgatggcatgctcctgaagtcctagttactcaggaggctaaggctggaggatcgcttgagcccaggaattcaaggttgcagtgaactgtgatcacaccactgcattctagcctgggcaaaagagcgagaacctgtctcagaaaaaggaaaaaagaaaacatgaagtaaaataacaacattttcaccaaaaaaaaaaaaaaaaaagacattatcatcatacccaccacacataaggaaatactaacagatattcttcagacaactgagaaacacagaaagaaataaagaacaataaaaagcataaatatatgagtaaatataaacatttgcaatacaaaataagaataacaatataaaataacaagaattccatgtgctatttaaaatgtatacagaatttaaagaaacaaagcagatcacaaaaaaaacaacagaccatacaagctcttaaaaacaaattgccatattcttaggaaaagattgtttcatgaccatgaaaacaattactagagtgagttttacacctgtttaatcaaagacgactgttagactcgtcaaatttttgaaagccagtcagtcagtaatagtcatgcttctgaaattcagacaatcaagagttaacactctagtgaacaaaggcctacaacatccagatattttttaaataggatgttacgtatctttatattattaaccttaacaataatggtactctttttggataataaataaatgaagaaaaatgtccttgcactagaaaagaaagatacaaatattcttgagacttaataggagctgtcatcaaggcaacactcagaaacaatatacctacagctcctgatcaatctcttgtgcagctctgggttccttttcatatatggaaattagactcttaccatgccatcccagaacccagggtacctgttgtgtgagcgtaacaactatgttattccaagtgtacaactccccaacatgctcagtggactgtgtcttataacaaagaatatgaatggataaaatctttcctttgataactgacaaagagttttctgaagataatgatctgatccatacctatctttaagaactatagtatgtcttcacagttgtaattattggcaacaagcattaaacttcttggatcaaatacttcatatctactcaaaattgtaacattaacacttaaaactaagaaaatagagatgtttaaaattttccatttcacacactacttcatattcctacctgataactttaaataccaaatgcactgagtttagccctgaaatgagtttaaaacaattctctaactgggatataattactttccactgaagcatttttctgccactcaagaatcatctgatttacataaatgctagttaagcaccatagaaattctaaaatatatcattagcagaatgtcacagatcacttaatctactctgtcaaaacagggattatttcaacttctgtttcacttcccttaaaagaaatcctatttactttcttttctctaacagggaaaaaaaattagtaaaataaacttacagtgtacttcccaaatcaaactttaaaatgattctggttaactacaaattgactgaagtattttttctgaatgtattttactgaaacatggctgacaacatataataatgttactgctacagaattacaaattatttcactgattactcttcctattcaagaaaaaaaggtcactttggtccatacaaattgtccaaataaactagatgtattactagcttaaagtaaacaattttgtaaatagcacttctagttagagttaaaacataaccataaaaagcttttattaaacaatacatttcactaagctaaatttatagaaatatatatatttctatcactttcacacatcctgacaatatttgggaaaataaatacaaaaatgtttttttttaattcagaagtatataatttcttcaaatattccagccataaattataatacataaaatttaagatacgtaaataccatgaatattataaactttaaataaaattctagccataatttatgaaactcacattattaaacaacacacacacacgctgattccaaatgaagaagagaagtaccatggtagtttctctgtgacacaccaaaaattatcctaataaataaattaaacaatcatgtaattcctaaatttgttacagaaagatatgtggctggttctcacacctcctactagatatctttacaccacttaaaaccttttcttttttcatgctattattttctgtgtaacaaaataccaactagtcagattctaaaatatcaatctttagaaatgatattagcaaaacaattttaaaatacttactgtcttgtttcgtaatctaattatgtctgagacagagccagcgccacagtactccataacaatccagaggtctgtattcttaaaataactgccatagtactttacaacatatgggctaaaggaaaatacataaacaattaaatttagttaattcccaaagaaatttttttcttaatcccaatacaaagtattttcaacatttcatactgttccaataagttaaataagtaaatttctattgcacatcaaattctcaatatctggagttcaccaactatgcataattaggctttacttcatggacgaaatttaacaggattacaaaccagaagaggcccaaatgttttgagtgattctgaagaaaataagacttcattttggcaaagaacttactacttaacatgaggaacaaatgaaaatttttccctttaactaaagcattttaaatatgtcttctaaaggattttgcattcagtcaaatattaatcaactcgaaaataatctatatttccatgaggccaaaaagttattttaaattttctttcattctggcttttgaaaattctagagaaaaaaaattataaatttttctgcttaaatttatagaattaaaatattagcaatttaatttctaaactgaggtcttacgtcttccagagcagaataaactatgtttatagccaagctgtcttcaggaagatttagaaagggacaaatgaccatcagcaataatgtatattatggataaactacatatagtgatgtatgagaaatctaacctatctcaaagaggcagaatatcatattcaaaaaatgcatagagatagaaaatacaagacagcagaaactaaataggacacaactttaatgctacaagagctcaaatgaggaaataacattggaatcatccaaagagaactttgtggaagggagtgggatttgaatgagattttgaaagaaaagtttaaactccaaaatgtagatggagaagagggataagaaaattctagaaaagagaaagaccatgaataaaggtacacaaatagaaagggaaaaaccaagtatggcatgtaagaggacaacttgttcaaataaatacttctatctagtaatagctacaatcaaaaacagtagccattttgctgggcacaaatgtaagataaatatgacagaaaaacaaataagcaaaaaaaaaaaaaattgaaagtacaataaaagaacacgtagagactctatcaattgtggaggttaagagaagactgtcagggaagacttctcagtacagcctttaaaattttagctatgctctaacactgaggcagtaataaacagcctaccatccaaaaaaaaaaaccacccaggaccagatggacttagggccaaattctagcagatgtacaaagaagagctggtaccatccctgctgaaactatttcaaaaaattgaggagaaggaaatgctccctaactcatcctatgaagccagcatcattctgataccaaaacctggcagagatacaacaaaaaaagaaaactttaggccaatatccttgatgaacattgatgcaaaagtcgtcaacaaaacattagcaaaccaaatccagtggcacataaaaaacctaactcaccacagtcaagtaggctttctctttgggatgcaagattggttcaacatatacaaatcaataaatgtgattcatcatataaacagaactaaagacaaaaaccacatgattatctcaatagatacagaaaaggctttcgataaaatcagacatccattcatgttaaaaactctcaacaaactaggtattgaaggaacatacctcaaaataataagagccatatatgaaaaacccacagccaacaatcatactgaatgggcataagctggaagcattccccttgaaaagcggcattaagacaaggatggactctctcaccattcctgtttaacatagtattggaagtcctggcaagggcaatcaggcaagagaaagaaataaaggtcatccaaataggaagagaggaagtcaaactacccctgtttgcagatgacatgatcctgtatctagaaaaccccatagcctcagcccaaaagcttctcaggctgataagcaacttcagcaaagtctcaggatacaaaagcaatgtgcaaaaatccctagcattcctatataccaacaacagtcaagccgagagccaaatcgggaactaactcccattcacaactgccacaaaaagaataaactacataggaagacagcaaactagggaggtgaaagatctccacaaagagaactacaaaacactgctcaaagaaatcagagatgacataaagaaatgggaaaacattccatgctcagggatagaaataatcaatatcattaaaatgaggctgggcactgtggctcacgcctgtaaacccagcactttgagaggatcacttgaggtcaggagtttcagatcagcctggccaacacggtgaaacccccatctctactacaaatacaaaattagctgggcatggtggcgcatgcctgtaatcccagttacttaggagggtgaggcaggaaaatcacttgaactcaggaggcggaggttgcagtgagctgagattgtgtcactgcactccagcctgggcaacagagcaagactccatctcaaaaaaataataataaaaaataaaaaaataatatataaacacacacacacaaacacacatcattaaaatggccatactgcccaaagtaatttatagattcaatgctattcttactaaaactactatttgagattcggcacagaactagaaaaaactattttgaaattcatatggaaccaaaaaagagcccgaatagccaaggcaatcctaagcaaaaagaacaaagctggtggcatcacactacccgacttcaaaatacactacagggctacagtaaccaaaacagcatggttatgatacaaaaaaagacatacagacaaatgaaacagaataaagaactcagaaataagaccacacaactacaactatatgatctttgacaaacctgacaataacaggcaatggaaaggaaaaaggattccccattcaataaatggtgctgggataaccagctagccatatgcggaagattgaaactggacccctcccttattatcatgttcaaaaatttaactcaagatggattaaaggcctaaatgtaaaacccaaaaatataaaaaccctggaagacaacctaggcaataccatccaggacataggcaaagatttcacgacaaagacacccaaagcaatcacaacaaaagcaaaaattggcaaatgggatctagtaaaatcaaagagcttctgtacagcaaaagaaactatcaagagagtaaatagataacttacaaaatgaaagaacatttttgaacaaactatgcatccaataaaggtctaatatccagcagctataaggaacttaaacagatctacaagaaaaaaaaaacaaacaaccccattaaaaaatgggcaaaggacatgaacagatacttttcaaaagaagacctacatgtggccagcaagaatatgaaaaaaagttcaacatcactgatcattacagaaatgcaaatcaaaaccacaatgagataccatgttacaccagtcagaatgactattattaaaaagtcaaaaaaaaaaaaacagatgctggcaaggttgtgaagaaaaaggaatgcttatatactgttggtgggagtgtaaattagttcaaccattgtggaagatagtgtggcaattcctcaaagacctagagacctagagacagaaataccattcaacctagcaatctcattactggatatatacccaaaggaatataaattgttctattataaagacacatgcatgcttatgttctttgtaactagcactcttcataatagcaaagacatggcatcaacctaaatgcccatcaatgatagactggataatgaaaatgtggtacatatacacaatggaatactatgcagccacaaaaaagaacaaagtcatgtcctttgcagagacatggatggagctggaggctattgtccttagcaaactaacacaggaacagaaaaccaaatactgcatgttctcacttataactgggagctaaatgatgaggacacatggacacacagagtgaacaacacacactggggcctatcagaaggtggaaggtggaaggagggagaggatcaggaaaaataactaatgggtactaggcttaatacctgggtgataaaataatctgcacaacaaacccccatgacacaagtttacccatgtaacaaacctgcacatgtacctctgaacttaaaataaaagttaaaaataaataaataaataaataataaaaacatcagtcatctaaaaaacaaaagtttaaaattttcccattataattaaattttatattaaaaacaaaggcaataaatacaaaaaaaaataactatgtcttgaagtcaaaggtagaacagagtggttggagctgaagggcctgaattcaaacctgttttatccccactgctactccgttacctcttgcacagacttgctccccactggtctccttgtcttagttttctcccctgttctagtctatgctacatacagttgacaaggtaccttactttaaaacaaaagtaaaacaagctgatcatactgctctcctagttaaacaaaaatactctaacagctctccattacccaaaggaaaagctcttaactgcttcatatcgcatacaagttatttcagagtctaccttgttacccgtatctctgattactctccatctcataccttaaatttccagacacactcagctttgctaggtcttgggaattgaaagtatgtatttggagttcataaatgttcactgaaccatttaagaaaagtgcttgtttacaaacaaatgaaactaaatacagacttagaactgcaacatatgagaaacaaaaaaaaaaattctttacatgtactcctttaaggtatggcgcctatgtggaaacttttatagggagtagcgttcctacacctggctgtgcatgagagccacctgtgacccaagcccacactcctttgaggttctgattcagtaggtttttaaaagctctaccggtgactctgacatagacccagagttaagcttcactctaccagtgaatagactgtatatccttcaggggaaaaaaaaaaaactctctctctctctctttttttttctgaagcagaatctcattctgccacctaggctggagtgcagtggcaccatgtcggctcacagcaatgtctgcctcctgggttcgagtgattctcgtgcctcaacctcccaagtagctgggattacaggcctgtgtcaccacgcccagctaatttttgtagttttggtagagatggggttttgccatgttgaccaggcttgtcttgaactcctggcctcatgtgttctgcctgcctcagcttccaaaagtgctgagactataggtgtgaaccaccatgcccgccaaaaaaaaattctttaaatatgaatgttctcattcaaaattttgaaaagtgttaagtaacaatgaattgacgattatgttcactgaaaagcatacaaaaaaatgtacatttttcttgccatacacactaatcagcaatgctaagggtagaagtgacaactcatgaaaattaggaattctaacctgggcagccacctgaaaacacagccctatctctccataagagtaagtcaagagaaaactttggcaaaacgtaaaattctcttcaaaaaaataattcatggcccatctaacacccacgtaagtagatggatccaagtccaacacctctataacataaaacatggcctcactaactttaacccagcaaagtatttaagcaactagaactaaacagccacatgcattcactgaccctctactcgggccaggcatttcaccagatgttcagtatgcactagtgaaacacacattcacaatttggaccctcataccgaatacactagcatgaatatacaggaattaaggaagtaaactcacaaataaatatgattactaaccatggcaagaaaagaagaaagggtgctataagataaactggctgtgactttattttgtattcaccatttctgcaaataaaattgctcctagttcatatgaaggaatggaatgcattcatattccatggtagcctctgagacttggaaggcactggagtatgtgaaaaacctttgaaagcagataagtgagctttaacaataaaatgtcctttctccactgaactgctgtgaattacaaaatccacagattggaaaagaaagaaatgcttaaactccagagttcatatgtatacagtggccatcctctgacactttctaagtcagcaccttttatactgtaaagcacttattacatcctgcaaggactttgtcattgacttttatctgcctcccccagaagaacagaagctccataaagataggtaccaatctgtctcgctttccattttatcctcagtagctctcttctcctatatacaaactaaagaagcaggccgggcacggtggctcatgcctgtaatcccagcactttgggaggccgaggcaggcgaatcatgaggtcaagagatcgagaccatcctggccaacatggtgaaaccctgtctctactaaaaatacaaaaaaaattagctgggcgtggtggcaggggcctataatcccagctactcaggaggctggggcaggagaatcgcttgaacccgggaggcagaggttgcagagagacgagatcgtgccactgcactcctgcctggcagaagagtgaggctccgcctcaaaaaaaaaaagaaaaattaaaattaaaaaataaagaaagaaagaaaagaaccaacgaataaataaatcacacaaaaaactaagacaggacctaatttaggactctccaagggaataatatttaagctaagatgcaaaacttaacgagaagttagccagataactaagcactaagaactgccctgcaaaggccctgaaagacagaacaaatcacggtcaaagaactgaaagattagcgggcccaggataaagtgagtaaaggatacagtagaacataatggagttgcatatgtaggcagaagcctgaccatgaagggcctcaaaaccaaggtaaagagactgggctttatttgaaatacagaaaaaaaaatcagtgaagaattttaagcagacgaataacatgatgtaaagtttctgtggttgctgaatgaaagctagattgtagggaagcaaatgtgaatacagagagaccaattaaaaagtaatgttagtccatgcagagattatagtaagcatatctttttattttctgtattcttgatgctttggtatctgggaccttgctaaaactgaagcgactgcccctctcagggtaagctaattcctagagacagcaaactaactcccatggaaggatgtctttcatatgcacaccaacctatctaaagcccaaacctccaaccacctctatggttacactctagggtcaacttttcacctgcccaaattgccccagggccaggtaccagacaaccagagaaagccctatgccccagaacccactcaaaatactcaaagtagccaatcctaaacctgtttaccctatctcacctgtcccttcccagggaaaccacacaaacattcttgtccacttcttcccccctctttctctgcctcctaactgactctggtacttccccgtggagcccctgtgacacagcacgcctccttctcttgtgagctgtatatataacaatatatcttttccatagcaatagtctcttgatctgttggcctcatgatatgtgagtaataataaagcatactttttttttttgagacagagtctcgctctgtcgcccaggctagagtgcattggcgcgatctcggctcactgcaacctctgcctcccgggttcaagcgattcgcctgcctcagcctcctgagtagctgggattacaggcacccgccaccatgcccggctaatttttgtatttagtagagatggggtttcaccaggtcaggagttcgagaccagcctgaccaacatggtgaaaccctgtctctactaaagatataaaaaattagccgggcctggtggcatgcacctgtaatcccagctactcaggaggctgaggcaggagaatctcttgaacccgggaggcagaggttgcagtgagccgaggtcgcgccattgcattccagcctgggcaacagggcgagactccatctcaaagaaaaaaaaaaaaaaaaaagcctaccaataggctcagacagttcaagacctgagacttctaaactcaagtctatttccattaacacagatatgcattcaaattcacatttatttatctttttttttaagtaattcaaacaacaaatattcactgaacaagcctactagcagaagctagggagaaaaatggaaaaacattagactagtgacaaagaagaaagggcagtccaggcaatggggaacccctgaagaaatttatataaggaaataatacaatcaaactagcatttaaacattatcctgagcaggattgtcaaggatcaaacatgatgttgttcattctagccagcaagttaactaactacaattatttagatgttctaacatctgtttttaaaccagcatgttgattattaaaggttagggaagaaggggagagagtttcactcaaaacactgtaacactctagtgttatatacaggcaaatctataagatattgcaggtttgattccagaccacctggataaagcaaatatcacaatacagtgagtcacacaaatttttgttttccagaaagaaaccttggatcaggcagattcatagctgaattttgctaaacgtataaagatgagctggtaccaatcctactgaaactattgcaagaaagctgaggaagagagactcctccctaactcattctacgaggccagcatcattctgataccaaaatgtggcagagacaaaatgaaaaagaaaacttcagaccaatatctctgatggacataaatgcaaaaattctcaataaaagacctgcagaccaaatgcagcagtacatcaaaaaactaatccaccacgatcaagtaggctttattgctgggatgtaaggttggttcaatatacacaaatgaataaatgtgatttgccacataaacagaggagattttgcaaaattcttgagggtcctaagatttttggaatgggcaatgaacactggcttcaacttaaagtcatgagaggcatcagcccctaacaagagagtcagcctgtcctttgaagctaagcagtgacttctctctagctaggaaagtcctagatggcatctccttccagtagaaggctgtttcgtctacattgaaaatctgttgcttaatgtagccaccttcatcaattatctcagctacatcttctggataacttgctgcagcttctatttcagcacttgctgcttcatcttgcacttttatgttatggagacagcttctttgtttaagcctcatgaaccaacctctgctagcttcaaacttttgttgcttcctcacgtctctcaaccttcatagaattgaagacagtaagggcattgctcgagattaggctttggcttaagagaatgctgtggctggtttgaacttctatccagaccactcaaactgtctccatatcagcaatgaggctcttccactttcttaccactcatgtgctcactggagtagcacttctaatttccttcaacaacctgtcctttgcattcaagcttggctagctgtttggcacaagaaccctagctttcagcttatttcggctttcaacctgtcttcctcactaagctaaatcatttctagcttttttatttaaagtgagagttgtgtgactctccctttcacttgaacccttacggaccattgtagaattactaattggcctaatttcaatattgtgtctcaaggaataggaaagcctgaggaaaggaagggagatggggcccacggcctagcagtgggacagtcagaacacacacgacatttatcaatttagttcaccatcttacaaaggtgcagttcgtggcacctcaaaacaattacaacagtaacatcaaagatcactgatcacagatcaccataacagatataataataatgaaaacgtctgaaatatgggaaggattaccaaaacatgacatagagacatgaagcaagcacaaactattggaaaaatggtgctgacggacttgatttgctcagtacagttgccacaaaccttcaattaaaaaaaaaaaatgcagcatctgcaaagtgaagaagtacaacagagtaaggtatacctgtatataaattttaagcaatgcagaaagttttaattcagccatatgcctaagaattttgactaagccagtatatggacttgcaggttgtatcagaacccagcaattctatacacagtcatccctcaatatccatggcgaactggttccaggaaccccacagataccaaaatccatgaatgcacaagttccttatattaaatggcacagtatttgcatataactacatacatcctccagtatactttaaatcatgtctagattacttattacacctaatacaatgtaaatgctatccaaataattgttatactgcattggtttttttttttattgtttttttctattgctttttttctcccaatatttccaacatgcagttagctgaatctgtggatgcagaacaagcaggatacagagggctaactgtagttttgttacattttttatttttattttttaagagacagggtatcactctgtcacccacgctagagtgcagtggcacaatcatagctcactgtagcttcaaactcttgggctcaagtgatccttccacctcagcttcccaagtaaccgcaactataaacatgcacacacccggactaattttttttattttttgtacagacagggtctcactacgttatccaggctgctctcaaattcctggcttcaagtgaccctcctgctttggcctcccaaagcactggaattacaggcgtgagccactgtgcctggctagttttgtctcttttaaagaggagtaagcagctatgtctttgaaaatttcactgggtggaagaaccaggaaaacacaaaggaaattacagactacaccaggaagcagaggtgaaatatgatgccttaataactagcatgccaatcatgagccacattctatgcctttctcttatgcatcttctctccatttcatcctcctgtctcattaattttttccttcccctatttaacgccttcaatccaataaaatgacgtatcttgttctcgttttcttttttttgagggggtggggggcttctgggcttcctctcatctcatacctaatgatcacatcctttccatttccatcttcactttacagctccctacactctttatcctaatggtcctcctctagtatcacaactcaaaatagaaagagtattaaaaaaaaatgagaaaaaccaaaggggaaaaatggaaaaaggactacatactcctatctaattgtaccttacttaaacactatgcatgatacaaattatacggactgaatcattacgtttaagcttcttataaaaatccaaatgttctattcataacacccaaaatatggaatcaatctaagtgtccatcaacaacatcatataattaaataaagaaaatggaatactatttgaaaatactgcttgaaaggtgactttttctttttttttttttttgagacagggtctggctctatcacccaggctggagtgcagtggcatgatctcaggtcattgtaacctctgcttcctgggctcaagcaatcctcccaacctcagcctcccaagtagctgggactacaggcacgtgccaccatgcctggtgaatttttgtattttttttagagagagagttttgccatgttgttcaggctggtcttgaactcctgagttcaagcaatctgcccacctcggcctcccaaagtgcaaggattataggcatgagccaccacatacaatcaaaaggtgactttttaaatagtaacttgaatttcattctaattgaagaaaaccatatatagctaaaggtatactttttaaaagtcttcctaatatgagcatgtgataattaaaatactaaagaaatggctatttttaattacatcattttcatcaacatcttactataatcttagtagtgttctataacttagtatggtaatacagtgtttttacaaaggcaatgtggatattctattaaaactgagctgtttccagcataaatctcaatcacacagcaatttatttcttggcccacccaaaactgaatatacaaattgccaaagttcaaattgctgatacaaattgccaaagttcatcaataatcctccaacatggtgattttgaaacttttgattttttatttatttatttatttatttatttgcctcagaaacagtgttcaaatggaatcttatctagaaacatgaggaaatagaacaggtaagaatgtagaatactctggtagaagccaaggggtgctcagtgacaccctgaacaggccagctgaaaatgctctatttcaccataagagttatctcttctctttgcccagcaaatctaactcatcaatcaggactcagctgaggtatgacctccctgggaaaactttccctgaacctccaaacatgaggtgttagatatctcttccaacccacatacttccccatatctatcccatcacagctgttaccacactgtgtactgaaacagcctacccattcgtctgtttcttccagctgagtgaaagtctctctaaagcctcaaacccattcttttttgtttcttttttttgttttgttttgtttttgagatggagtctcactctgtcacccagactggagtgcaatggcacagtcttggctcactgcaacctctacctctcgggttcaagtgattctcctgcctcagcctccccagtagctgggattacaggtgcctgccaccacgctcagctaatttttgtatttttagtagagacggggtttcaccatgtttgccaggctggtctcaaacttctgaccttgtgatccacccgcctcagcctcccaaagtgctgggattacaggcgtgagccatggcacccggccgagacccattctttgttgtatctcttgtgagagcacatcaggcctacacttaggagtaggtggtactcaatacatactagttgaacaggtaaaaaggggataagtgtgtgccctgattcataacaacatatttatctttgtttagatatgaaaagttccttctctgcatataagcaccaggagggtagggactatgtcagttgtgattaccttgtgtacatattacctgccacatagtattgctaaccagctgttgcctctactcctaggaatgccttgagagtgcttcactttgaactgttggaatctttttacaggcattgctttcttcaacactggccctgaagtagggtaaatgtgggttcttattgcatctcagtcactaactagcagtgtgattttgggcaattcatgtaaaagctctaggtctcattttctgtatctgcaaaattgtttttaaatatgctttagcactagaagacttttcctcaaataaaaatttcaaaagagtcccatatataaaaaagataaaagcaataatgaggttctcattctactcaattcttcagtgaagaaaatgcccctagaagtaccttcttagagcagggtatgatttgaaaacactaaactagctgacccacagaagttgaatctagcactaatattctatgatttatccatttaataaatactcattaaatgtatactctgtacctggtactgaactaggcactgcacattcagcaataaacaaagcagatgggctccctgagatatttatgctaacatgtagtattcagcccattattaaatattcacttaaaatgaacaaaaaaagattaaaacaccacctctggtccttttatagagtatagaaaacaagacaatttaccaaattcacaaatagctgaatgtattaagaaaatagttaaatttcagaaatgcatatctcattttccctatcaaaatttcagtgtattatttgggaatttttcaattcatactgttttcttccaatcatttttatgctaatttcttaataacacatttacattaatactagttattggtagctaaaatctaagtttctccctgtcatttcctaattgtttttctttttcttttttttttctttttgagacagagtctcactctgtcacccaggctggagttcagtggtacaatctcagctcactgcaccttccgccttccaggttaaagtgattctcctgcctcagcctcccaagtagttagaattacagtcacctgccaccacgtccagctaatttttatatctatttagtagaaatggagttttgccatgttggccaggctggtgttgaactcctgacctcagatgatccacccacctccgcctcccaaagtgctgagattacaggcgtgagccaccatgcccggccctaatttattttttactagtcctatcttttagcattttaggatcttttaaccaactaattttttgatccttcgcaacttcatacttacaatatgaatttgacagtaaaatcttaaaaggcagaaaccatttttcatcaatatttgcctcagcatttatttcattcaacaaatatttgagaagtacctactatgtgcaaggcattctgctataaagtggtacaaaagttctagaattctataacatttccttctcattgtattctttacttttctttccctttaaaagcttaaagtgcataacaagaataagtacctgatttccctggggttccctcaatctgtaatgctcttccttgtactcctcatacataccacaccctttcattcattcatcaaaaagtatactgctaggcgctgaacaggtgctaataaagaaaaatatatggttcctttccttaaggaatgaagagaagaataaagatagtgatgacatttcagaaggaaaatctacaagactcagtatcatctgaagtatcataaaaaggaataaagatgattctcagccttgctaaaagactaagtagatgatgatgcctttgatacacaggaatttgaaaggcttgtctggaatgtttaaaactggttttagaatgttaaatgtgtaattccctctggatagtctagttgagttgcccaaacagaaattattaaatagaagtactcattagtatctgagtaaccattatgtggcaggatccaaggacactgagtaaaatacaatccccgaactcaaggaacttaagacttagatgatagagaatacaagtaaacaggcacttaaaagagaaactcaggtaagagactggaggtgtaagcactagatggaacatgaaggaccttgtatgccactcttaggagactggatttctcgaggcaatggggaaccatgggttttaaacagggaatgcttgattacatttgcattttggaaagaacgctctagcttcaaggaagataatgggttggaggaggcaaacaaagtgaacaaataagatgctgttgcagaaatctgaacaagatttgagggaagagatatgtaatagtaatatttgagaccctgactttcctagacaacactcaaagtacaatgctaatccttgaactatttttaaccataataacaaaataatactcgcatcaggcaagtataaagcatacctggtggccgagcactatgctatctcatctcttattctatatcaaattgtgggaaccacagttgaggaatgtatctttttttttcctataaccacttgaatttcacatgctatgggaaatatgtaacataatttaaatatacagcatattctaaagaaaagcaaaattgaacagatccaagcagcaaagttcctctaggattatgcaatcacttcattagccaaaaagcttacaatctatagatcctatgtattgttaggagtgaaagctttccataaatctctaattacagggccctgaattgataaggggagacaatgtgcccagactaccctgtgtcaccagctctaagtcacacgagacaatttttacaaataagactgaagttgaaggtttctgggaaagccccttccctgcttcttcttttcttcctcctgcctggaatgtagacataaagctggggctgtagcagccctgttgtagccatgagataataagcatgaggacaaagcacatgctaacgatgagagagtacaagaaaagaagactgagacatggctgttcctttgttgctgctgtactagcagactttttgttaagggagaataataaatccctctgtggttaagtaactttaggctaaacatagtcataatttatatactctgaatcccttatagaataaagcctaggctacttcacattgcataagatgcttctcaccatcagctccatttaactatccaacctcatttcattctgttctctgtcccatactttccattccaataattctaaatcttgtcagatgagcacaccccaatgagttgtttttacctttctacctgtcatccccttgactctcccttatcactccatttcttcacccaattaactcttcgtcagcattccagatttcctggctccactggctgaggaagatgccctgccttcttcttttcacattaccccatgcaccagtcactacaatgagtgtgctatattacagctatttatttatatatttgtcttcccaactacactactgacccctcaaaaagaaaaaagtatcttagttcttttggcattcttagatcctggcacagtaccgggtcaactggggatgctcagtgaatgttgaatgaattagatttacataaaacatgacttcttaattagtaaaagtgattacataatacagactgttaaatgacccctttaacatcaaaaactcattctcatccataaatttgtcctaaaaaagtccaggctatagtgcagtgctgcaatcatagctaactgtggccctgaactcctgggctcaaacaatcctcccgcctcagcttcccaagtagctagaactacaagtccaagctaccacctggataattttttcttttttggtagagaaagggtctcactatgttgctcagactggccttgaactcctgggctcctttaccctcgatgctctggcctctctaagggttgagattacaggcgtgatctaccacatccagcctcatttctgcttttaagcagaaaagctgcaaagagctgtaagtcctaaagacacttgacaaagccatcctcatctgccttaaaggattaatctcacttccaatgggaagtcagaaatgaaaactaggccaggcatggtagctcacgcctgtaatcccagcactttgggaggccaaggcgggtggatcacctgaggtcaggagttcgagatcagcctgaccaacatggagaaacccatctctactaaaaatacaaaattagccaggcatggtggcacatgactgtaatcccagatactcagggggctgaggcaggagaatcgcttgaacccagaaagcggaggttgtggtgagccgagatggcgccattgcactccagcctgggcaacaacggcaaaaccctgtctcaaaaaaaagaaaagaaaaagaaatgaaaactaaacagatgatcaaagaataaattttgttatattttattagcaaaactcgtcaaaacaagggtaagcaaagaaataaaatctcttcatacctgtcacattgctgcattatggaaatttctttgattatttcctgaagatctgattcaacaggtacttgtttaattgcgacaacttgaccggattccttgtgtattgctttaaatacacttccataagacctaaaagaaaccaagacattatttttttcctatcaaacatcgtaactataagattaaaagtctactatgagttttctgtggatagtcttttctagtttaaaacactatttaaatgattaaaaaatcaaagtaaacaagtaacaattttaaaaggtaatgaattatatcttagctttattgcttcaactacagacttaaaatagtcaagttaacatataatgagtagctatttttcttatgaatgaaagaaacagacttgcgtttggtcaactcaaacaaatgcagcattaagaagatataaatggaaattaaaagaatgaaatgtagattaaaaatagccaaagcctcaaattaggagaaaaggctgatctcaaggaaaatgacccccagaatatcaaaaagtcacacttctgttcagagtaccttaacagttaaaaccctcagctggggaccatattaacatcaaagttagagaagcaaggaatctgcagccatctgcttctacctgatttacagatccaaggtctctttttaaaaagttcctttcattaccttttcctcaagagaaaaactacaaactcacaggtaaataaaatgaggaacagggtctaatagtcacttgcccaaaacctgtctctgctacaactcctgaaactttgccaactgaatattcacgtgttttaaaaagcaaaaacaaagaaggaagaagccatttgtaccttagtatgaacttaaaaacgaggttaaacactactatgtactgagttcttactataaaccaggtcctatgctaggtgttttacatgcattatgaaattcaaccctcacaatcataaggaaaaacactattatcgtcattaaaagatgagaaacagaccagtagggccagaattcaaacacattcccaccccaaaaatcaggtttttctcaccatatttttctacagaagagaaacaagagcaagccaatggaaaacatcgaatgtttcctaatattagaaatctatgcagaagcccttccaaatttataatcttttaaaataagtgaaaaagagacaaataagtgataacgcggctacttcaataaaatacattttatcctctcctctgtttctttgggctctctgaagtcatttaatttggtttggtacccaaagtcacattgggctgggtgtgggggaatgtatgtgtgtgtatctccccttgaaagccatatgtgtgtatgtgtgtatattccctcaaaagctaacatagaattcagtgctagatcatctactgtcaattaggcaacaccatcactcctttctaaggactcctcagcactacgaaagagaagctgcaatccccacttcccagaatccccttccctgaatggttcctcattaaaagtctgccagtgagaaaaacacgtatgtgtgaatgacgaaaggagaaaccatttttctccagatacagttgtagcagatggactgacagatatgaagtgcacagcagcttcctgctgagcttccaacagccaccactgctgcagactgaggtagttggtgggagtttctcaagactgcaggattccagcagattcccagagagcttttgagaaacacccacttcagtgcttcaggctgagatcttcaatgctgacttcgaccttcaacctttggcaacagttttcatgaactttgcatccctggcccctccacaattcatttgagctcctaacttcattactaaattcttcatatctatagagtacatacagtagcttatcttttccttgatagcaatatagtttttggtagaagaagtgtttccaagggaaagaatcttaaagatgagaatcttgaattagttctttcttagatgttgatatggtttggctatgtcccacccgaatctcatcttgtagctcccataattcccacctgttgtggtagggactcagtgggagatgactgaatcatgggggcaggtctttcccatgctgttctcatgatagtgaatgggtctcacaagatctgatggttttaaaaatgggagtttgtctgcacaagctctctctttgcccgctgccatccatgtacgatgtgacctgatcttccttgccttccaccatgattgtgaggcctccctacccacgtggaactataagtcaattaaacctctttctttcgtaaattgcccagtcccaggtatgtctttaccaacagtgtgaaaacagactaatacagatgtgtagacagtaatgacttcaatacaagtaacaaatagtatactgatggtctatggcattcagtggcaaacagttatttaaattatcacccttagttgcctggagtctaagcaaagctttaaaagaccaagtagctgtatcaatacaatgtatggtgaaaataaagtataaggactatagaatgggctgctgcctctgcctgcactggaaaagttatagaacaaacacagcaagctaaaggcttaaatgtccagctcaagactgagagaaccagaaaacttctgaatttcttaattcttacagaaacagggttgagatttctgaaaaacaaactctaggtatagtcttactggaagttgaattacatttcaagttgaattcacatcagcaccaggtctgttatgttaaagttaaggtatctaacaataaagagaagtacctagagaactggtattaggacatttagatagattctcattaatctgagtaccttgaatccccaaatcctatcaagcctcccttgataccaaaagcaactctgccctcctgtctgagaaaattaaccttacaatgcctgaagactctatctacctcctgaggcagtcacttttcagcagcatgcagtggtcctccagaccactccaccaccacttattgcttccagacccaaagttatactcaactcccatagacaccagggagacaagtataaaatttaacccaagcagctactattcacactaaaaaagttgcaagattttgccaatttttatcagaaccctaaagaatatgtgtgagaacaaattctaagatttccagagaggaagaaatgtactgatatggatgcaagaccagaaattccagactcagcatgttagctcaaacagttgggggtgtccctaacagttgctcagccagttaactgaaacctggactcaaaagtggcccatattaagtgagatgctaagtgagcctcagtacacaccaaaggaagcatatcaaaggctcaaggaaatgggatactagaatggatatatattataagtgccatgctcacatactccctaactatgttgacaaaaagggtccagaggataccagcatcgaccaaagctctattagtgcaggggaaagatgacaaatatgccaacagtgaaactggctccttgagtttaatagataacaggatcccagcacaagagaagtggcaacagctattcacctgagacaaagtgggaacagttaccataatgagtaacaaagcaaggctgaattacagttttcttttattgtacatttaggtcttgatattaaagttacactagcttcatttaaaaaaaaactataattaactgtcctttaaacactgtataaaacagtgtttaatacagtggaacctttctggaggggaggaggtgaaatacacacaacataaaattcactgttttaaagtgtatgattcaatggcatttagtgcattcacaatgctgtacaaccattatctgtatgtagttccaaaatatatagaatctgctttctgtctctacagatttatctattctagatacttcatataaatgaaatcatacaatatgtgaccttttatatctggcttcttccttcacttagcataatattttgtaggtccaactacactgtaaaatgtaccagtacttcactactttttatggctaaaaggtcactgtacagacatatcacgttttgtttattcacctgggatagcagatggacatttgagttgtttccacattttggctattgtaaataatatgctatgagttggtacctttataattaacagttatttaatcatttctctatcactggctatatcttccttcttattccaaatcttctgtattttctattttctttagtcaacattgtaagaggtttaattattttactgatctcttcaaaagcttttatatatacaaacatatacgtatctttttttttttgagacagagtcatgctgtgtcacccaggccagagtgcaatggcacaatctcggctcactgcaacctccgcctcctgggttcaagcaattctcctgtctcagccttccaagtagctgggattacaggcacatgccaccacgcccggctaatttttgtatttttagtagagatggctactctactaaatgacaatatggtttcaccatattggtcaagctggtctcgaactcctgacctcaagtgatccacccacctcggcctcccaaaatgctgggattacagcgtgtaagccactgcacctggcccatatttatcatttctaattttttttctatctcattaatttcagctttttctttaattcaatcttcagtttcttttggtatgtttcataatttttctaagttctttaagtaagcactaagtttattttttgcctttctttgttagtctaatgaaagaatttagaactaaaacttttaattagttttgctatattccatagatactggcacaatgtgttctccttttcattgttttataatttataatatcctcttcaatcaatgggttacttcagattatgtttcctaatttctagttggtgtggattttgtcatattataattacttatttctaatttagtgagtataatcagtgatatggtttgcatatttgtcttctccaaatctcattttgaaatgtaatccctaatgttggagatggaacctgttaggagacgtttgggtcacaggggcagtttcctcatggcttggtgctgtccttgagatggtgagttttcacaggatgtgcttatttaaagcggtgtggcaggccgggtgcagtggctcgtgcctgtcatcccaacactttgggaggccgaggtgggaagatcacctgaggtcaggagttcaagaccagcctggccaacattgtgaaacctcatctctactaaaaatatgaaaattagctgggcgtggtggcaggcacctgtaatcccagctactcgggaggttgaggcaacagaatcccttgaacccgggagaaggatgcagtgagccacgatcacgccattgcactccaggctggatgacgagagtgaaactctgtctcaaaaaaattttaaaataaaaaaaaataaaactgcgtggcacctcccctgccctatcttgctcctgctctcaccatgtgagacatctgctccccctttgccttcttccatgactataaccttcctgaagccctcaccagaagcggatgccggcaccgtgctttttgcagtgtctgcagaaccgtgagccaattaaatttttctttataaattacccagcctaaggtatttttcttataacaacacaagaacagcttaatacaatcagaaaatgtgacctgtaaaaatctcttattttttagaatttgtaacttttcttttatcaatggtcctttgaacatacaccagaaaagcaggtctgcaagaatatatatgcatagttatatagacatacaggtactttatatatttttactttatatatatttacatttctataaaatcaagtgtattcatcataatgtttaatccctctatgtcctttctcttttttctattatatctgtccaattctaaaagagatacattgaaatctcccatgcaattatacttttattagatgcctctgacatcactaatagcttttctgtcataaatttagctgccatgttgtctgacatgttttgttataaattgtccttgatattgctacctaatatatctctttatttagttgaaaccttttaaactttaatgtatctaatataaatattgctactattactttctgtttttttatttgtatgtttatctataatatttttataagaaatatccttataggctatgcacagtggcccacacctataatcctaacaatttgggaggccaaggaaggaggatcacttgaggccaggagttgaagaccagcctgggtaacatagcaagatcccatctctattaataataaataaatagccttatatttccattatttgttttacttgcatctcctataaacagaatataggtagatttcgcatgttcatttactctaacagtttgtcttttaatgggaaaattaacatttactgaaaagtacacttgattttattccttccatcatgttcagcttatttttattttttatttatttatttatttatttatttattttttgagacggagcttcgcttgtgttgtccaggctagagtgcaatggcgtgatctcagctcaccacaaccttcaccttccgggttcaagcgattctcctgcctcagcttcccgaatagctgggattacaggcacccgctaccacgcccagctaatttagtatttttagtagacatggggtttctccatgttggtcaagctggtcttgaacttccgacctcaagtgatccacccacctcagcctcccaaagtgctggaattacaggcgtgagccaccgcgaccggcctagcttattattttaccttttcattttctctatttccttgtccttgttcttgctgatctataagcttcttttaattctgttttgtacctttattattttggaaattctcctatactttgccattccattaaatgctccctacctttctctctgctcaaaccggcacgtttctctactgttattttgaaatcatgtcaactattcttctgcctatataaactgtttccctcactaagatattcttgtcatatcaagacaaagactacttaccttttccaaaataaaatgagcctcaagatctaaaaggatggccttatggtcacttgcctaacaaagtcaaaaccttcaaacgtattaataagaatgccgtaagggatgaactaacaaaactcttaaacatcatttcacagcacatttcttgcttttcccttatatatatatatggcctactttctctgaaaaaacactattaccagatttagcacaaactaatctttaaaattcagtatcacctgccaagtttaattactattaaatactattcaattcatacgaatatactctagttgaaagattaacatcatataatattttttaaattgttctgaaattatttacatgctttcatactttttgtacttacccttctccaagcttctctaatacatcaaaaacttcttcaggctgcttagtcaaactgtcttcactcagcttttttagtttactgatttaaaaaagaaagaagaaagaaaatattttctttaaagaccttttacaaaatttttaatttttaaaattttaccaagtttttaattttattttaatatattcagaagactcaaacaatataaaaacatacatagtaaacattctcctttcaagccctgttcctcatgtgcccagcaacacctccaaaaataatcacttttattagttttttgtgaaacctttatataaatatgaatacatattcttaattcctcccctttgaatatataagaagcatatacacacccttctgtataaatattgtcatgttgtctactgttttctcttgacaaaactatgttagagatctttccatacaggttaatcatccataatccaaaaatctgaaatccaaaatgctccaagatctgaaattttttgagcaccaacatgatacccacaatggaaaatgccacacctgacctcatgtaatgagtcacagtcaaactgtaagcacataacacaatttaaggaaaaaagatcctccccagcccccttcagctctgacatatcttttccatgcatgcacagattctcccacccaagcacatccaaagaagggtaataaaatggcacaggtacacgccagacgcaccaatgataggttccccacgatgccccacacggagccaagactgtgcattactcactgtgggtttttttgcttattctctgctttgttggataaagacaatgttgaaaatctgagtaagtgacagaaaaagaggaagcatttatgcttatctctagccaaaaagtcaagctgctggataaactggaaagcagtatgggaaatgtcttacaaaagagcatggtgttggaatgaccaccatatacaacctgaagaaacagaaggataaattgttgaagttctatgctgaagtgtcaatgaacagaagttaatgaaaaatttttcttaattgcagaaaaccaaatgaagatctcaaatgtgtactgaaagagtaaatctgtcagcacggcagagaaaacatactacttaatggtatggtgctcatgaaacaagcaaagatatatcatgatgaactgaaaattgaagggaactatgaatattcaacaggctgattgcagaaatttaagaaaagacacattaatttttcaaagatttgtggtgaataaagcaactgctgatcatgaagaagcagaaaaattcattgacaagtctgccaaggccatcactgatgaaaatctgacaccagaacaagtctataatgctgatgaaacatcacagtttagtgttagttccccagaaagactctgactacagcccctacaggataagaatgccatggacagagtaactgtcctgggaggtgctaatgcagaaggcacactaagtgtaaacctgctgtgtgggaaagattgggttcattattagactaacaaaaaggcatgggtcactagggacatcttttctgattggtttcacaaacattttgtagcagtggttcaggtttgctgcagggaagctggactggatgatggctacaagattttgttattccttgacaactgttctgctcatcctccagctgaaaaatctcattaaatataatgtttattccatgtacttttccccaaatgtgacttcattaattcagcaagtgagcagggtatcctcagatcaataaagaataaaaataaaaacactttcttgaacagcctacttgcagcagtgaacagaaatatgagcgtggaaggttttcaaaagcagttcagcatttagaatgctgtatatgctattgtcgatgactggaacacagtatctaaagacacagttgtgcatacctggcacaatctctagcttgcaactatgttcagtaacgatgatgaacaaggcaatgactttgaaggattctgtatgtcaagataaaaaaaaaaaaaaataggccaggagcggtggctcacgcctgtaatcccagcactttggaaggccgaggcggtggatcacgaggtcaggagaccgagaccatcctggctaacacggtgaaaccccgtctctactaaaaatacgaaaaataagccaggcatggtggcgggtacctgtagtcccagctacttgcgaggctgaggcaggagaatggcgtgaacccaggaggcggagcttgccgtgagccgagatcgcgccgctgcactccagcctgggcgacagagcaagactccgtctcaaaaaaaaaaaattaattaaaaattttaaaaataaataaataaaaataaaaaggtgtttgacttccttacatatacaaaaaaataccttcagagtctgtcagtaagttggaagaaatggatatcaaataagtttttaacattgataatgagtctccagttgctcattcattgaccaatggtaaaatagcagaaatgggctgggcacggtggctcacgcctgtattccagcactttgggaggccgaggtaggcgtatcctttgagctcaggagttcgagaccagcccgggcaaacggcggaaccctgtctctattaaaaaatacaaaacgtttggtgggcatgatggcacatgcctgtggtcccagctacttgggagactgagcctgggagatggaggttgcagtgagccgagatcacgccactgcactccagcctgggtggcagagttagaccctatctcaaaaaaagaaaaaagaaatagcagaaatggttctgaatcaaggttatggtagtagtaatgacaatgaagatgatgttaacattgcagaaaaagtgccggaagacaacatggtgtgatgggcttattttaggactagagtgcattcttaacagaataggaaatcacgtcactttataacatcaaagagagacttctaagacaaaagccactgttaatgaggcagacgattctcgaggaaacattttaaaaagccatccaagcaatggggaaaggattccctatttaataaatggtgctgggaaaactggctagccatatgtagaaagctgaaactggatcccttccttacaccttatacaaaaattaattcaagatggattaaagatttacatgttagacctaaaaccagaaaaaccctagaagaaaacctaggcaataccattcaggacataggcatgggtaaggacttcatgtctaaaacactaaaagcaatggcaacgaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacgatgaactcaaacaaatttacaagaaaaaaacaaacaaccccatcaaaaagtgggcaaaggatatgaacacacacttctcaaaagaagacatttatgcagccaaaagacacatgaaaacatgctcatcatcactgaccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccgtttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctgagcaaactatcacaaggacaaaaaaccaaacaccgcatgttctcactcataggtgggaattgaacgatgagaacacatggacacaggaaggggaacatcgcacaccggggacggttgtggggtgggtggagcgggcagggatagcattaggagatatacctaatgctaaatgacgagttaatgggtgcagcacaccaacatggcacatgtatacatatgtaacaaacctgcacattgtgcacatgtaccctaaaacttaaagtataataataataaaataaaataaaataaaataaaaaagccatccagcagaatgtttccttatccctagcagacctatttcctggcccctcagctgcttctgatgtttcttctcaactaaaaaaaaaaccacacagtgtataatagtaacctttcaatcaaaaatcagcatcataggtgaaaactaaaagcctgccgttgtttgttgttcctgttgtttaaaagctgatagaggtattctggtaatgccactgtgctgcttcattaccctgaacatattttttttccactgtattaatgttatgccatattttttgcagttaagtacttatgcatgagcaagtataagaaaatgattgcttatcagtagcatgtaaattcagagtcagaaatgaaggtgatgccaaacaactccacagactgtccacatgggtggctgagatagtgacacctttcctttctgatggttcaatgtatgcaaactttgtttcatgcagaaaattacttaaaatattgtataacattacctacaggctatgtgtataaggtagatacaaaaatttcatgtttggccttgggtcccagccccaaaatatctcattatgtatatgcaaatactccaaaaaacaaaacaaaacaaaattcagaaatctgaaacatttatggtcccaagcatctcagataagggattctcaacctgaataaagcatcaatgttcttttttacagctgcatcctattcaattacagagatatagcatatcttacttgcccagtcttttgcttatggacatccaggttctcttttgatatgataaacaatgctgcactgagtaaccttatatataagtcaatgaatgaatgaatgaatgaatgaatgaatgaatatatataaacttatatataagtcaatgaatgaataagtcatgtgctagtatatatgtggaataaattcccagaaatgaaactgagaatacagacacattcacacacacataaatataaaagtagatatgctgacaaataagtatataatcatgtaataatataattttaataatgtagtataacataagatcactattgtcataactatatggtaattattaaaattattgattacattatggtatattttacctattataattatatgttatataaatatatatacatatacactgatttcagcaagttgtcctccatagagtttgtactaatttattctccaacaagtaatatatgagagcccttctttcccacagttccatcaatagggtatttaatgaaattatttggattttagccaatctgtgatgaaaacttattagctcagtgtagacttaacttgtattattatgagtgaagttgaccatcttttcatatgattaagaagctaaatcacctacttgttctttgctcatttttccactgggttttcggtccttttcttatgtgtatacaaaggaaactagcccttttttcgagattataaacattttcatttggattttgacttcacttataagcttttagttttgcagtctatttgattttttgccatataaaaaatgtcattattttatttttgcaaatgagtggatggtaatgccatttactaaggtaagaaacacaggggaaaaaaaaaacagtctggaggggaacaagatgggctcaattctagtcatctaaaagtagatttccggtaagcaactggatttacaaatctcaggagagatttgaactagaaatataatttttggtgtcatcagcacattgcttaaagctttcagaagagacaaaatcatcaagaaaatgtctaagaaaaaataagagtcaaacacaaaacacatatcaaggaaacaccaatatttaagaaatgaggtcatgaagcacaagaaggtaatatttggctacatcaaaagctaccaaaagtgcaagcagcttgaaagtttaagtatccattgtagaacttccacttctagccaccaggtttatgacaggaagcagaattatctgtcagctgcaaatagctacaaaactcaacaaaatgtaagaaactattttcagatgctggctatcaggcattccagaactggatatactgaggtccccaagagaaggagaagaaataagatgagccctgccatcgcccaggctttagatctagagactatgtcagactgtagcacaggaaaagaagaactcaaagagaaccaagtaattttgctgagttgaagaaatagagcttagagtttggtgaggaatcaaggcaaatggaaattccattacagagtatcgggagaagggagctatgcagggaaaaggttcagcaatctatctagaggtttccatgaaatgccaatctgtgcatgcttacaaaacactcctcaaagcccagcaaaaccagtttcttaaggcgaaaaaaaatgaccagggaggaataaaaagcaaaattcccagacaaggcaatttatcacaaaatatcacaaggcagggaatctttcccactatccagagttgaaagaactccacgaatacaaaggtcattcagaaaagaactcagaacagcattattttagaaaggagattatattaccaaaagataaaggatattccagattctccctagaggagcttaaaaactaacctcaaaagcatcaagccaaaccacaagacaacttgcttaactgcctaccagaacgagtctgtaacttcttaagcaaagcaaaattcaacattcacaaatgtaaaattaacaatgtcaaaaaaataaaaaaaaaaattattaaacctatgagtaatcaggaactataactcataaagagaaaaattagccaataaaacagacccagaaacgaggtggtgaaattgataaaaatcttaagaaaacctcttatgaatatactttcacatactcacagatgttaaaggaaatggaaggtagggggaaagataaatggaaatttaagagataaaaaataaaatatttgctttcgttgctgcagcagacgctgtgagtattttcaatgcttcagaagaggcttgcctctagtgtcctccgctgtggcaaaaagaagatctggctggacaccaatgagaccaatgaaattggccatgccaactcctgtcagcagatccagaagctgatcaaagatgggctgattatccataagcctgcgactgtccgttcctgggctcactgccaaaaaagcaccttggcctgccagaagggcaggtacatggtcataggtaaacaaaaagggtacagccaatactcaaatgccagagaaggtaacctgggtgaggagaataggaattctgcatcagctgctcaaagatactgtgaatctaaaaagactgatcgccacatgtatcacagcctgtacctgaaggtaaaggggagtgtgttcaaaaacaggtggattctcatggaacacatccacctgctgaaggcacacagacccacaagatgctcctggctgaccaggcagaggcctgctggtctaagaccaaggaagcatgcaagtaccatgaagagcgcctccaggccaagaaggaagagagcatcaagactttgtccaaggaggaagagacgaggaaataaagctccccttctcttgtctgtacatagtggtcttggtgattatacagatcaatcattaaaataaaacaagcctttatctgctaaaaaaaaaaaaaaatctgaaatataaattttgttgaataagattaaaaggagattagacagtgcagcacaaaagatgaaatcatttgaaaaggaaaaagtgttatttaaataaaggaagaaacaaaaagcctgagtcccacatgaaaaagaaacaaatgggatgggaagtaaggaaagaaaagtaaggaaaggaaggagggaaataaggagaaacattttccaaattttatgtaaaccataaacccacacagatgcatcaaattcaacaaatttgaaaagataaaacacacaaagagagaaagaaggagagggagagagagagagagagagagaaccaaaatatattatgatcaaattgctgaacatcagtgagaaagaatactaaaagtagtcacaggaaagacatataggcatatctcagagatactgcaggttcagttccataccgcaacaataaagcaaataccacaataaagcaaataacacaaaaatgtttgttttcccaggatatataaatgtttacactatactgtagtctattatgtgtacaatagcattatgtctgaaaaaacaacgtacataccttaatataaaaataatgtttgaggtgaaggatacccactatgccctgatgattgttatgcattatatgcctgtatcaaaatatctcatgtacccaatatatacacctactatgtacccataaaaattaaaaataaaaaagattttaaacactttattgctaaaaatgccaatgatcatctgagcctacaacgagtcaaaatctttttgctggtggagaatcttgcctctatgttgatagcttctgcctgatcagggtggtggttgcaaaaggttgggttagctgtggaaatttcttaaaataagacaacaatgaagtttgccacatcaattaattcttccttcccaaaagatttctctatagcatgtgatgctgtttgatgcatcttactcacaagtagaactttcaaaattggaatcaatcctctcaaaccctgccactgctttctcaattaagattatggaatattctaaatccttttttatttccaagatggcagattagaggcttttagtgggcctcattcacttggaaatagcaagatagtgtacaaaggccaactctgagagctttaattcacaaaggaaaacaggaatccactggaatcgtgacagacacctcagatccaaggaagacacacaaacacaaacagcccctattatggcatccaattgataaaagtgagggaagcccaagtatgcaagacagtcagaaagcctccctctgtgactcacttttccactggagatctgagcaacccaggtcaagaaagagcactttgtttcttctaagccctggatctaacttggggacaagctgatttggagatgctgtgagggacagacactcggaaaagctactggcatttcccagacccaggatggagagcaggacactattttaaatgtgggtgcatgcaagtcaaccattctttggcaacccagtagcatggccacataggcttctggctctggagcaggacagaggtcttcacagccacactgtagttagtgcctcagcagtaggtgctgggattgtgctctcctccactgcaggtcaaggatgagagaagagctgctacagctattgtttctcctggacaaccagacttcaagccagatccagcttagcaacctggaactggtctgcatgtgccatgattggttgccacagcctgttcccctgtggtgcagcagggccctctctgctctactccctggcaaaaatccaggcatttggagcaactgtttgcctggacaagcaggctgaaccacctcacccttcatggatatagatcatggcacagtggaggcctctctgctccacatgcaggcagatctagagctattcagagcaccccctcacctgcaaccgcagtctgagttgccttacccttcctgtgtgtgcatagattgtggtacagtggggccctctccactccacatggagacagatacccaggcatctaatgcacctgctcacatggactagcagattgagttgccccacttttcctgtgcagagattctgtgcaggggggccctctctgctccatgcccaggcaaatctccaggcattcagagcatctgctcacctgaatcagcagcctgacttgcctcacccttcctgtgcagagatcctagtgtagggaggccctctctgcttcacactcagacagatctcccaggcattcagagcacccactcacctggatcagcagcctgaactgctccatccttctatacatagattatggtgcagcaaggcccttccactccattgcccaagaagatctccagatattcaaagtacctatttgcccaaattggcatattgggccatgccactcttcctatgaagagatctgggtacaggcaggccctccctgcttcatgcccaggcataactccaggcattcagagcacctgcttgcctggttcagcagcctacatcaccccaaccctcctccgcagaaatcttagtggtggtggggtggcagggggaccctttccacttcatatccaggcagatgtccagccatctggagcacctactcttcaggattaggagtttaagctgccacccatccctgtgcagagaacttagggccaaggaggtctcccagcttcatacccaggtacacctctgggtgcttggtgactacccactggattctccctatgcgctgacacttgtgcttgccactggagggtctggcggtgagcctgcccagtccagccctgcatatctttccctctgccccctcagggctgagcaggaaactcagactactgtacactccacaaatcagcccactgcctgaggcaacggagagctgctcccagtaaacaaggatcaaatatatacccagtcacactggcaacacctggctcttacccataagcttataggccaaactacacagcccaatataaaacctgccaactgaagtgcataggactataaaaacaaagccaaaagactctacacagcattatttccactcacaacccctaaggagtaggggaaagggaaagaagaaaaaaacaacattgtaagacaagaaagaaaaaatcctaccagtacgaaaataattacacaaattagcagtgccagtgtctccagatgggaagaaaccagtacaagaatactggcaccatgaaaaaatctgaatgtagtgccaccacagaaggatcacactagctctccagcaatggtccccaaccaacaaggacactcagaaatgacaaagaactcaaagcatgggttgcaaggaagctcagagatccaagacaagattgaaaatcaatactaaaaaacttcaaaggaaatccaggaaataagaggtaaagatttttaaaagaaatcaatcagagcttctggaaatgaaaaaggtttacttaagaaatttcaaaatataactgaaagctttatcaatagactggaccaagcaaaagaaagaatttcaggccaggcatggtggctcatgcctataatcccaacacttgaggaggctgacgtaggaagaccatttgagccaagtagcttgagaccatcctggaaaacataaagagaccgtgtctttccaaagaaatttaaaaattagctgggcatgatggtttgcacctatcgttctagctacttgggaggctggggtgaaaggatcacctgagcctgggagttcaaggctgcagtgagccatgatcacatcactgcaaaacagatgaacaaaaggaaaaaagaagaaaggaatgaaagctgatcttttgaactaacccagtcaacaaaaatagaggaaaatgaacttttaaaattgaacaaagtctttaagaaatacaggattatgtaaagcgatcaaacctataaattattagcattcatgatacagaaagagaaaaagcaaacaacctggaaaatatatttgaggaactaactcaaaaaaatttccctaatcttgctagagtagtagacatccagatacaacaaatccagacaacaactgtgagataatatacaaatccagacaacacttgtgagataacatacaaaatgaacatcaccaaggcatatactcaccaggccgtccaaggtcaatgtggtgcggtggctcacgcctgtaatcccagcactttgagaggccaagacgggcagatcaagaggtcaggagatcgagaccttcctggccaacatggtgaaaccccgtctctactaaaaatacaaaaattagcttggtgtggtggtgcatgcctgtagtcccagctactcgggaggctgaggcagaagaatcacttgaacccaggagctggaggttgcagtgagctgaggtcgcaccactgcactccaatctggcaacagagcgagactccacctcaaaaaaaaaaaaaaaaaaaaaaaaaaacaagaactgaaggaagagatatttaatgaaatagatagcataaataaaaaaacttcaggaaacaatggacacatttacagaaatgcaaaatgctctggagagtctcagcaatagaatcaaacaagcagaagaacgaacttgagagctcaaagacaaggtttttgaattaacccaatccaacaaagacaaaggaaaaagaataagaaaatatggacaaagcctccaagaagtctgggattatgttaaacgaccaaacctaagaataatcagcattcctgagaaagaagataaatctaaaagtctggaaaatatatttgggggaataattgaggaaaacttcccagccttgatagagacccagacatccaaatacaagaagctcaaagaacacctggggaattcatcacaaaaagatcatcgcctagacacactgtcatcaaattatctaaagttaagacaaagaaaagagtcttaagagccatgaggaaaaagcaccaggtaacctttaaaggaaaacctatcagattagcagcagatttctcagcaaaaactttacaagctagaagggattgcagccctgtcttcagcctcctcaaacaaaacaattatcagccaagaattttgcacccagcgaaactaagctacataaatgtcggaaagatacagtctttttcagacaaacaaatgctgagagaatttgccactaccaagccagcattacaaaaactgctaaaaggagctctaaatcttgaaacaaagccagaaaacacatcaaaacagaacccctttaaagcataaatctcacaggacctacaaaacaaaaatacaatttaaaaaacaaaacaaaacaagaaaaccaaggtatacaggcaacaaatcgcataatgaatggaatgatacctcacatctcaataccaacgttgaatgtaaatagcctaaacattccacttaaaagatacagaactggccgggcatggtggctcacgggggtaatctcaatactgggaggccgaggcaggcagatcacaaggccaggagttcgagaccagcctggacaacatggtgaaaccctgtttctactaaaaatacaaaaattagccgggcgtggtggtgcgcgcctgtaatcccagctactcaggaggctgagacaggagaactgcttgaacccaggaggcggaagttgcagtgagccctgattataccactgcactccagcctgggtgatggagtaagactccatctcagaaaaaacaaacaaacaaacaaacaaaaaaaaaaatacatatataattgcagaacggataagaattcaccaaccatctgctgccttcaagaaacacacctaacacataaggactcacataaacttaagctaaaggggtggaaaaagacattccatgcaaatggacaccaaaagcgagtaggaatagctattcttataccagacaaaacaaactttaaagcaacagccattaaaaaagacaaagagagtcataaaaggccttgtccaacaggaaaatatcacaatcctaaatatatatgcacctaacactggagctcccaaatttataaaacaattactaatagacttaagaaatgagacagcaactataatagtgggggacatcaacactccactgacagcactagacaggtcatcaacacagaaagtcaacaaagaaacaatggatttaaactataccctggaacaaatggacttaacagattatacagaacattctactcaacaactgcagaatatacattctattcaacagcacatggaactttctccaagatagaccatatgagaggccacaaaacgagcctcaataaatttaagaaaactgaaataatatcaagtactctctcagaccacagtggaataaaatggaaaatcaactctaaaaggaaacttcaaaatcatgcaaatacatggaaattaaataacctgcttttaaatgatcattgggtcaaaaatgaaatcaagatggaaatttaaaaattcttcgaactgaacaacaatagtgacccaacctatcaaaacctctgggatacagcaaggcagtgcttagaggaaagtttataaccctaaatgcctacatcaaaaagtctgaaagagcacagacaatctaaggccacacctcaaggacctagagaaccaagaacaaaccaaacccaaacccagtataagaaaggaaataaccaagatcagagcagaaataaattaaattgaaacaaaaaaaatacaaaagataaatgaaacaaaaagctggttctttgaaaagataaaataaaattaatagaacattaacaagattaccaagaaaagaagaaagaaaatccaaataagctcaattagaaccgaaaagggagatattacaactgataccaaggaaatacaaaagatcattcaaggctactatgaacccctttatgtgcataaactagaaaacctagaggagatagataaattcctggaaagataaaaccttcctggcttaaatcaggaagaattagataccctgaacagatcgacagcaagcagcaagattgaaatgataatttaaaaattacaaacaaggcacctgggaggccgaggcaggtggatcacctgagatcaggagttcaagaccagcctgcccaacatggtgaaaccctgtctctacttaaaatagaaaaaagtagctgggcgtggtggtaagcagctgtagtcccagctactcgggaggctgaggcaggagaattgcttgaacccgggaggcagaggttgcaatgaggcgaaatcgcgccattgcactccagactgggggacaagaaggagacttcatctcaaaaaaaaaaaaaaaaaaagtccaggactagagagattcacagcagaagcagaagtctaccagacattcaaagaagaattggtgccaatcctactgaaactataccacaagacagaaaaagaaggaaccctcccgaaatcattctatgaagccagtatcaccctaataccaaaaccaggaaaggatgtaaccaaaaaagaaaactacagaccaatatccctgattaacatataagttaaaatccttaacaaaatactagctaaccaaatccgacaacatatcaaaaagataatccaccatgatcaagtgggtttcataccagggatgcagtgatggtttaacatacacaatgtgatgatacaccacgtaaacagaatcgaacacgaaaatcacatgatcgtctcaacagatgcagaaaagcattcaacaaactccaacatccctctatgattaaaactcagcaaaatcagcatacaagggacatacctcaatgtaataaaagacatctatgacaaacccacagccaatgtaatactgaataggaaaaagctgaaagcactccctctgagaactggaacaagacaaggatgcccactctcaccactcctcttcaacatagtactggaagtcctagacagaccacttagacaagagaaagaaataaagggcatctaagccgggtgtggtggctcacgcctgtaaccccagcactttgggaggctgaggcaggtggatcacgaggtcaggagttcgagatcagcctggccaacatagtgaaaccccgtctctactaaaaatacaaaaacttagttgggcatggtggcaggcgcctgtaatcccagctacttgggaggctgaggcaggagaatcacttgaaccccagaggcagaggttgcagtgagctgagatcgcgccattgcactccagcctgggggacagggtgagactccgtctcaaaaaaaaaaaaaaggcattcaaatcggttaagaggaagtcaagctgttgctgtttgctgatgatatgattgtttacctagaaaaccctaaagactcccacagaaagctcctagaactgataaaagaattcagcaaagtttccagatacaacattaatgtacacaatcagtatctcttctatacaccaacagcgaccaagctgagaatcaaatcaagaacttaactcctcttacaatagctgcaaaaataaataaaatacttaggaatacacctaaccaaggaggtaaaagacctctacaatgaaaactacaaaacactgctgaaagaaatcatagatgacacaaacaaatggaaacacatcccatgctcattgatgggtagaatcaatattgtgataatgaccatactgccaaaagcaatctacaaattcaatgcaattcccatcaaaataccaccatcattcttcacagaattagaaaaaacaatcctaaaactcatatggaaccaaaaaagagcccacatagccaaagcaagactaagcaaaaagaacaaatctggaggcatcgcattacctgatttcaaactatactctaaggccacagtcaccaaaacagcatggtactggtataaaaataggcacatggaccaatggaacagaaagaacccagaaataagcccaaatacttacagccaactgatattcgacaaagcaaacaaaaacaaagtggggaaaggtcaccctattcaacaaatggtgctaggacaactgacaagccacatgtaggagaatgaaactggatcctcatctctcaccttataaaaaatcagctcaagatggatcagggacttaaatctaagacctgaaactataaaaattctggaagataacattggaaaaactcttctagacattggcttagtcaatgatttcatgaccaagaacccaaaagcaaatgcaataaaaacaaagataaatagctgggacttaaactaaagagcttttgcacgacaaaagaacggtcagcagagtaaacagacaacccatagagtgggagaaaatcttcacaatctatacatctgacaaaggactaatatccagaatctaaaacaaacacaaacaaattaagaaaaaacaaacaatcccatcaaaaagtgggctaaggacatgaatagacaattctcaaaagaagatatacgaatggccaacaaacataggaaaaaatgctcaacatcactaatagatcaagaaatgcaaatcaaaaccaaaatgcgattccaccttacttctgcaacaatggccataatcaaaaaataattgatgttgtcggggatggagtgaacagggaacacttctgcactgctagtgggaatgtaactagtacaaccactatggaaaacagtgtggagattccttaaagaactaaaagtagggctgggagcagtggctcacgcctgtgatcccgacactttgggaggccgaggtgggcagatcacctgaggttgggagttcgagaccaggctgaccaacatggagaaaccccgcccctactaaaaaaaaatacaaaattagctgggcatggtggcgcatgcctgtaatcccagctacttggaagactgaggcaggagaaatcactttaacccaggaagtggatgttgcggtgagctgagattgcaccattgcactccagcctgggcaacaacagtaaaactccgtctcaaagaaaaaaaagaactaaaagtaaaactaccatttgctccagcaatcccactcctgggtatctacccagaggaaaagaagtcattataagaaaaagacacttgcacgcaagtttatagcagcacagttcgcaattgcaaaaatgtggaaccaacctaaatgcccatcaatcaacaactggataaagagactgtatgtgtgtgtgtgtgtgtgtgtgtgtgtgtattacatatgtgtgtacatatatgtgtatgtgtgtgtgtatgtatatatatgatggaatactactcagccataaaaaggaatgaattaatggcattcacagcaacctagaggagattggagactattattctaagtgaagtaactctggaatagaaaaccaaacatcatatgttctcactgatatgtgggagctaagctatgaggacgcaaaggcataagaatgacacaatggactttggagactcagggggaaagggtgggaagcggataagggataaaagacgacaaattgggtacagtgtatactgctcaggtgatgggtgcaacaaaatctcacaaatcaccactgaagaacttactcctgtaaccaaacaccacctgttccccaataacttatggaaattaaaaaaaaattttaataaaaaaatggagaaaccccatctctacaaaaaatacaaaaaattagccagatgtggcggcacaagcctgcagccccagctactcaggaagctgagatgggagaatcacctgaatctgggaggttggagccgaaattgtaccactgcactccagtctgggcaatcagagtgagacagtctcaaaacaaacaagcaaacaaatacttctagacctaggaaaagacttaaacaaccatacataataatgggagacttcaacagcccactgactaatgcattagcctgaccactgaggcagaaaactaacaaagaaattctggacttaaattcaacacatgatgaattggacctaacagacatctgcagactacttcatccatcaaccactgaagatacactgttctcgtctgcacatggaagatactacgagatcaaccacatgctcggccataaaacatgtctcaattaattcaaaaaaaaaacaaaatcataccaaccatactctcagaccacagtgtaataaaaataaaaatcaataccatgaagatctctcagaaccacataattacatggaaattaaacaacttactcctgaatgacttttgggtaaacaattaaattaaagcagaaatcaaaaagttctttgaaataaatgaaaacagagtatcaaaatctctgggaagcagcaaaaaagtataaacaggaaagtttacaacactaaacacctacctcaaaaaatcagaaaaatctcaaatcaacaatctattatatctagaggaactagaaacaaaagaacaaactaaccataaagacagcagaagaaataaaagcaaagaactaaatcaaattaagaccaaaaatacaaaggatcgatgaaacaaaaagttggttttctaagaggaaaaacaagaccgacagactgcaagctagattaacaaaagaaaaaagagagagaagatccaaataagcacaatcaaaatgacaaaggtgacaagcaaccaatgccacaaaaatacaaaagttccttagggacaattatgaacactcctatttacgcaaactagaaaacctagagaaaatggataaattcttggaaacccacaatctcccaagattgaatcaggaagaaatagaaaccctgagcagacatcagtattgaattctgaaattgaatcaataattaaaaacttatcaaccaaaaaaatccctggaccacatggatttacagccgaattctatcagatgtacaaagaagggctggtatcaatccttctgaaactattccaaaaatcaaggaggaactcactgcaactcattcgaaggatgcatcaccctgatacgaaaacctggcaaagacacaaagaaaaaagaaaactacaaaccaatatccctgatgaacataagacacaaaaatcctcagtaaaataactagtaaaccaaggctcggcacagtggctcacgcctgtaatcccagcactttgggagcctaaggcaggtgggtcacctgaggttgggagttcgagaccagcctgaccaacatggagaaaccccggctctactaaaaaacccaagttagccaggcgtggtggtgcatgcctgtaatcccagctactccagaggcttgaggcaggagaatggcttgaacccgggaggcaggggttgctgtgagacgagatcgcgccattgcactccagcctgcgcaacaagagccagacaagagcaaaactccgtcgcaaaaaaaaaaaaaaaaaaaaaaaaatatatatatatatatatatatatatacatactagtacaccaaatccagcagcacatcaaaaacttaattcactgtggtcaagtaagtttcattcctgggatgcaaggttggttcaacatatgcaaatcaataaatgtgatccaccacataaacagaatttaaaataaaagtcatatgaccatcccaacagacatggaaaaagctttcaataaaatccaacatcccttcatgataaaaaaaaaaaaaaaaaacctcttgaacaaactagacatcaaaggaacatacctcaaaacagtaagagccatctatgacaactccacagccaacatcatactgaataagcaaaaaatggaagcattccccttgagaactggaataagacaaggatgcccactcttagcacccctattgaacacagtactggaagtccttgccagaacaataaggcaaaagaaagaaataaaaggcatccaaatagaaaaaggagaaggcaaacaatatctcttcacggaaaatatggttctatacctagaaaacctgaaaggctccaccaaaggctcctggaactgataaactacttgagtaacgtttcaggatacaaaatgaacaaaaaccagtagcatttctatacaccagtaacgttccagctgagagccaagtcaagaacacgatcccatttacaatggccacaaaatacaatacaatacaatacaatacaatacaatacaatacaatacaatacaatacaatacaatacaatacctaggaatacatctaaccaaggggatgaaggatctctacaaggagaactataaaacactgctgaaagaaatcagagatgacacaaacaaatggaaaaacatttcatgttcatgaagtggaaaaatcaatatcattaaaaataaaaaacatttcatgttcatgaagtggaaaaatcaacatcattaaaatggccacacagcccaaaggaatacacagattcaacactattcctatcaagctaccaacatcattttggacaaaactagaaaaaaactattctaaaattcatatggaaccaaaaaagggcctgaacagccaaggcaactgtaagtaaaaaggacaaagtcagagatatcacattacccaacttcaaactatactataaggctactttaaccaaaaaatcatggtactggtaccaaaacagacacatagaccaatggaactgaaaagagaacccagaaataaagctgcacacctacagccatctgatcttcaacaaaattgacaaaagcaatagggaaaggactccttaattcaataaatggtgctgggatagctgactagccatacgcaaaagaatgaaactggacccctaactcaagatagattaaagatttaaacagaagacctcaaactgtaggaatcccagaagaaaaaagaggaaacaccattctggacatcagccttgggaaagaatttatgactaaaagcaattgcaaccaaaaaactgacaagtgggacctaattaacctaaagagctgcttttgtgcagcaaaagaaactctcaacagagtaaacagacaatctacagaataggagaaaatatttgcaaactatgcagccgtcaaaggtctaatatctagaatctgtaagaaacttaaatcaaaaagtaaaaagcaaataatcccattttaaaaatcggcaaaagacatgaacaaactttcatcaaaagaagacatacaagtagccaaacatatgaaaaaatgctcaacatgactaatcataagagaaatgcaaatcaaaaccacaataatataccatttgtaccagtcagaatgacaattattaaaaagtcaggcctcggatttctggactgatagtgagcactggcttcaacttaaagtcaccaacctcaccagtccctaacaagaaagtcagcctgtactttgaagttttgaagccagccactgacatcttttccctagctatgacagtcctagatgacaccatcttccagtagaaagctgtttcatctacattgaaactctgttgtttacagcagctacactcatcgattaccttaactagatcttctgataacttattgcagcttctatatcagcatttgctgctagtgggtggtttcttggcccacctgaagggcagacagcttttgcttctacttgcccatcagaaacatgattttttgcctggagtcagaatgaaaaatattcctatccttcccccatcagcagatggcttttccttctctctctctcccttaggacaagtatatcatgtgcaaggattggaagacaatatttttaaactcaatcctccccagtttgagcttagatcaaggcaataagaatcaaaatcccagaagcctttctggtatgtcattacacatcactttgaaaggtgcatgccaaaactgagagaaagtaagataactgactgcaaaggaacacaacacaactttttgaggtggtagaaatgttctaaatcttgatttgggtgagttacaggattatacacactttgtcaaaactcatcaaactgcacacttagagaacatgaactttattatataaaaatattaatgatcctatcttttaaaacttcagccagtttttctagtagaaattgacaagctggcaatcttagagtttgtgtattttcttcaatgctgctcagaactctgacagtagaatttgtccagagttagcattttccaggcagatgccacagaacaacaatgatataagggagttaaagatattagcaaaagaatggttgatgaaatagaccgagcagagaaagaaattttaaaagagggaggggaactaatgagcagggagaggaataaagtagaaacattttgtgaacgattaaagagcatattcctatagaaagagaagcaatcttttttaaaaattgacaattgtgccttagaaatcaaagagacttcaccttcatggctaagctcaagatgaagccatccacatgatacagcaatagaggcagcactatactaacaaatctcattaatattaaaccaaacaagtaatctaatggctacattattctccaggagtaaaaagtttgcttcaaggcagctcataatctggctcactttaaacaaataagtcaaagatcccccaaatgaatccagtaaacacgagaattttctatatttctatatttctatgtcaatataaaatacacatacaacacaattttctattttcctgacttggcaaacacaatataatgtacagagtttcatctgtctttgacatattgtgaattttaacacctcagaatatcatcataaaggtaatgtttttaatcaaaggcccccaaaaacgttattcttgactgagtggctttagagcatgtactcttctagttgcttgggaattttgtggagaacaagttacccacaaagtacctctcctggaagttaaaacagaggatttcttatatgcttaggcagacatactctagaatcatctttttaaaataagcaactagcaaatgcaatctggttttcctattgctatgttttggatatgtcccctccaaaattcaggtgctgaatctaaacggtcaatgtcatgtattaaaaggtggggtactttcagaagtttgaggttatagtgagctatgatcatgccaccacactccaacctaggcaacagagcaagaccctttaaaaaaaatcaggcctttaagaggtaattaggtcatgagggctcctcacctcgtgaatgggattaagaccctaatgaaagagatttcacccctgtcctttcacaatgtgaaaacacagcattcctcaccaccagaggatatagcaacaagacactatcttggaggcagagagcagcccttattggacaaccaaacctgctggcagcttgatcttggacttcccagtctttagaaccatgagtaaataaatttctcttctttataaattacccagtctatggcattttgttacagcagcacaaacagacttaagacatctatcatttgactatctcattaagtttaggcaagagcataatctcctattatactggcaatggaaatatactgaatcaaagataaaagcaatcatttttaaacattagtattacatgcagtgcaaaaacccaaagtgacggcagtcttacattgccaaagccatcaaaaggggaaggagagggaagaacagcagcataagctgctggcagaggcagggaaagacaagcagaaaggaaagagagaaagagacaaagtcagagagacacaggggaagagacagagagaaaaagagggagtcacagagaaagagagagacaacaaagaagtcaaaaagaaagggagatagaattagtaaagaaaaaagcagtgtaccctattcctttaaaagccagggtaaggttctgtctacccagccaaggtatattcttcttatgtggaatgtctacctatatctgcctccccactaactggaccggcacctgcaccttagtctttccaagttccaacattaacattgccccaggaaatcagaccctatcagtacccctcaaagctcaagtccatcagcacagagccatacaactaatacccctacttaatagggttaggaatggctactgctacaggaaccggaagagccagtttatctacttcattatcctactaccacacactctcaaaggatttttcagacagttttcaagaaataatgaaatctatccttactctacaatcccaaatagactctttagcagcagtgactctccaaaactgccgaggcctagacctcctcactgctgagaaaggaggactctgcaccttcctaggggaagagtgttgtttttacactaatcagccagggatagtacaagatgccacccagcgtttacaggaaaaggcttctgaaatcagacgcctttcaaattcttataccaacctctggagttgggcaacatggcttctcccctttctaggtcccgtggcagccatcttgccgctactcgcctttggaccctatatttttaacctccttgttttgtttcctctagaattgaggccaccaagctacagatggtcttacaaatggaacctcaaatgagttcaactaacaacttctaccgaggacccctggaccgacctgctggcactttcaatggcctagagagctcccctctggaggacactacaactgcagggccccttcaaagcccctatccagcaggaagtagttagagcggtcatcggccaaattcccaacagcagttggggtgtcctgtttagaggggggattgagaggtaacaacgtgctagcagccctcactcactctcagcacctcctcggcctcggtgtccactctggccacgcttgaggagcccttcagcctgccgctgcactgtgggagcccctctctgggctggccaaggccggagccggctccctctgcttgcgggaaggtgtggagggagaagcgtgggcaggaaccaggactgcgcgcagcactcatgggccagcacgagttccgggtgggtgtgggcttgatgggccccgcactcagagtggccagctgatgccgccagccctgggcagtgaagggcttagcacccgggccagcagctgcggaaggggcaccgggtaccccagcactgccggccctcccgcgctgagctcgaattcttgccaggcctcagccacctccccacagggcagggctcaggacctgcagccccccatgccagagccccccccaccaaggtgggctcccgtgcagccggagcctccccaacaggcgctggcccctgctccacggcgtccggtcccataaaccgcccaagggctgaggagtgcaggcgcacagtgcgggactggcaggcagctccacccgtggccctggcatgggattcactaggcgaagccagctgggttcctgtgttgggtggggacttggagaacttttatatctagccaaaggattgtatatgcaccaatcagcactctgtgtctagctcaaggtttgtaaacacaccaaccagcactctgtgtctagctagaggattgtaaatacaccaattagcactctgtctagctcagggattgtaaacgcaccaatcagcaccctatcaaaacagaccaatcagctctctataaaatggaccaatcagttctctgtgaaatgggccaatcagcaggatgtgggtggggtcagataagggaataaaagcaagctgcccaagccagcagtggtaacccgctcggtccccttccacactgtggaagctttgttctttcgctctttgcaataaatgttattgctgctcactctttgggtctgcactgcctttatgagctgtaacactcacctcgaaggtctgcagcttcactcctgaggccagcgagaccatgaacccaccgggaggaatgaacaactccagacacactgctttaagagctgtaacagtcaccgcaacggtctgtagcttcactcctgaagccagcaagaccacgaacccaccagaaggaagaaactccaaacgtgtccgaacatcagagggaacaaactccggacacaccatctttaagaactgtaacactcaccacaagggtccacagcttcattcttaagtcagtgagaccaagaacccaccaattccagacacattaggatatgccttttttttttcagtgacatccaaattctctagcacttcaaaacagtaagcttgttgtatctcatttttgttgtttcctgttcaatgtaagaatttccagccagaaacagtggctcatacctgcaattccagcactttggaaggtcgaggtgaaatgactgcttgaggccaggaattcaaaactagcctgggcaatgtagcaagatcctgtctctacaaaacattttaaaattagccaggcatagtaatgggtgcctgtagtcctagctattgaggaggctgaggcaggagaatcccttgagcccaggagtatgaggttatagtgagctatgactgtgccactgcactccagcctggactacagagcaagaccctgtctcttaaaaaaataaaaaaggaaaaaataattctgtcaaaatttttcctagctctcaatacaaagttttctaaatcttgaggggaggtgaagattctgtatagaatagtctccattttctccaaattcttcctaattttttataatttcaagaataagttacatttcaaattataccacagataatgctaatatggtgataaattatttaatattcttatcatttagagatgcatgctacaagttaagaacatatctaagattaacttcaaaataataaaggatgcagtatatataggggaatatattatgtaagattggccaaggaattaataattgttgaaactgggtgatgaatacatataggttcactttctcaactttgctaaactatgtttaaagttctccctaataaaaagatttttaaagagtaaacaataggtattaaatctaattaaattgttcttagaaataattagacacaaaaaacagtattaattgtaaattatttataacaaaatttagaaggaaattaaatgtccaaacataaaatattaattagttatagaacactcattccatgagataccaagtagccactaaaaatcatgttgcagaaaactcattgatataaaaagaattcacaatatacttctaagagaaaaaaaggcaggttacaaaataatatgtacagaattgaaccattttttaaatgtgagcatctgtgtgtgtatgtgcgtgtttgcatatgtgtgtatttctgccaaatactgacagactttgtttcattcactgctttatccccagcacaaaaaactgtacctggaacataataagaacaatacatacttgttgcaggtaaaggttttagaattccagacaacagggtttcccttggggtatgattctctctacgcttttgtttcatacggtttctcaaataaacattcagttttttctgttattgggggaaaacctttaaaattgtatctcacataacaaaattaaaatttatttgcctgattcaataattacttcatgaaatgcattcaataaaatcatcttatacactgaaaaaagaaaggcctcttctatactttgaatgaataaactggccacggcaatcagaaatagtaaaaacaggccaggcatggtggctcacgcctgtaatcccagcactttgggaggccaaagcaggcagatcacgaggtcaggagatggagaccagcatcctagctaacatggtgaaaccccgtctctactaaaaatacaaaaaattagccgggcatggtaggggacgcctgtagtcccagctactcgggaggctaaggtaggagaatgacatgaacccaggaggcggagcttgcagtgagccaagatcgcgccactgcactccagcctgggcaacagagtgagactctgtttcaaaaaaaaaaaaaaagaaaaaaaaagaaaagaaatagtaaaaacaataacctgttaatcagtcttatccctgtgagtgaattctgctgctgagcaataacataaccttactatctttaggaaactaatacttctaaaatgaatctttaaaacgggtacaaaaaattataaaatcagttttaaaaaattagtccattatattcattcaatacacacttactgaatttgtagacaataagttacctgctagggtaatccaaagaaaattaagttgtagcccttgataaccaagaggctcccaatctagtgggaaagatagatgaataaaagctaaatgaaacataataataaaggtagctgacatttattaggttctttttttggcattgtgctgacacttaacaagcattttctttcttttttttttgagacagagtctcactctgttgcctaggctggagtgcagtggtgcaatcttggctctctgcaacctccgcctcccaggttcaagcaatcctcccaactcagcctcccaagtagctgggattacaggtgtacaccaccacgcctggctaatttttgtatttttagtagagatggggtttcaacattttggtcaggctagtcttgaactcctggcctcaagtgatccgcccacctcggcctcccaaagtgctgggattacaggcgtgagccaccacacctggccaaacaagcattttcttatttaatccctataacaatctttttggtagttactacgatattctcagtttttagataagaaaacgttaagacttaaatgacttcctcagtcacttgagtaataaatggcaaaacagaatcaaaccaaataaaccctgtcccagatacaatatagtgtctctcattattaggatgctagtaaacaccaaagtggactctatcagttccatcagttactatcaagtataacacaatagtcaccttttttaaggtagatatccttttggaagtcttcccaagaatttcttatcttcaactcaactagttatctccactttgaaatacactattacaaccattaacctatgagcctctagagcacaggattcagtagtttctcttctcccagtgctatacaatgtatgcactcaagaaatattaaacagatgaacttttagcttcttttatgcttcctaaattccaaatcactatgccatattacataatagttggtctaggtcaatagcaatttcatttatgttattaggaaaatgtggtatgagagaatcagagaataaaattctgaagtgctaaattatggtggttatgctaatggcggaacactgctgactgtataagatgaaccaagatactcttcctccagggacttcttcctaatcttctaaatgtcctataagccaaattttataagagaactggaaatgtgcaaaactagggggtagttttgtttcttgcaaaaatctggtgataaagatctgagctaaaaatagcgagaatgatgggaaataattcaagagatatttcaaaagcagaatcatttctcactacatgcaagacaaaactcataactaactgcggaacctaagaccttctcagtcatctcatttctgtttcctacagcctagccagagtgaactacttcttaaaggtcctgaattctcacataacattttaaaactcccacaataactgtaatataggccgggcgcggtggctcacgcctgtaatcccagcactttgggaggccgaggcgggcagatcacttgaggtcaggagttccagcctggccaaaatggtgaaaccccgtctccactaaaaatacaaaaattagccaggcatggtggcgggtgcctgtaatcccagctactcgggaggctaaggcaggagaattgcttgaacccaggaggcagagttgcagtgagccaagatcatgccactgcactctagcctgggcgacaagagcaaaactccatctccaaaaaataataataataataataataataactgtaatataaaaagcagatagtgtgcagtcacttgtatgttacataagaaatagacagtagaacacaggaatgggaaaggcattcaaattttgtgttggaaaatgaatgaatgaagataatgcaggagaccttcataactgatttgagaagggactagcagctatctcttcatgatgagataatacaggccctacctctatatcaccattttctcttacaacatgatcttccccttctctctgcctgtcaaaattaaccacctccttaaagacacaatcaaaaattttctctgggaagtttaaagaaatcacctcctcacttctaccactgtccccacccatccacacaagcacacacacatacacaaagaactagtcccactgtctactatggtcccacagcacttggcacctgcctcattgtagtacttagtacagtgattcattattcctttcattattatgtactgtatgagaatatcactagagctagaatatgaattccataaagatatggatcatgtcttatctagcctatttccattaaatacctaccacagaacctcacacactactgtttaaataacatatctaataaataaatgaataaacaaatgaaaacaaatttgctaactcctggagacctaaaggaacctcaaaatgtctgtgacttaaaacatgcctttatgggaaaaaaaaaatatatcttcctatataaacgcttatggctaaccatgacctgcttcaacttaaatcagttttgctaccacagcaataaaaaatacacatatatggctagaagtcgatgcaaaggccaaaagcatccctaccagggctgaaatggccaatggggatattccaaattttatggttgcaaaatgacccaattaatcttagatttcagcaaagtatacatgctaactgaacaaagacaaaagtcactggagctcaagtcattattccaagtgactctaagctgttagtccctgtgttaatggagcctgttaaacaacccagtattagaaaacactggagctcagagggagcatgctaccccatgcacatttcccaagtatcctcacaataaacttctattactgaagataatctatgtacttctctaccttgagtcttaagagacctaagtaacagtaaataatataggaaaccaagcagaggaaagaatcacacaccaaatgtgaactggaaaaagtgacaacgccaattagtaaagattaggtgggctgaacacggtaagattaggtgggctgagcacggtggctcacgcctgtaatcccaacactttgggaggccaaggcaggcggatcacaaggtcaggagatcgaaaccatcctggctaacacagcgaaaccccgtctctactagaaatacaaaaatttagccaggcgtggtggcgggcacctgtagtcccagccacttgggaggctgaggcaggaaaatgccgcaaacccaggaggtagagcttgcagtgagccaagatcgtgccactgcactccagcctgggcgacaagcgagactccgtctcaaaaaaaaaaaaaaaaaaaggattaggtagaaggtgaggattcagttctgaacataatgcctttaaggagacagtaatcaaatatttgggtttttggttttgggggtttctgttttgttttggagacagagtctcattctgttgcccaggctggagtgcaatggcatgatcttggctcactgcaacatctgcctcctgagtccaaacaattcttgtgccccagcctcccgaggagctgggattacagaagcacactaccatgctcggttaattttttgtatttttagtagggatggggtttcgccatgttggccaggctggtctcaaactcctggcctcaagagatccagccacctctggctcccaaagtactgggattacaggtgtgagccactgtacccgaccagtaatcaaatgttatttaggagactggaaatagtgaataagactgagtacaaaaattccaagtctcaaaagtatttgtgggtcatttcaatcaaattgaagccattagagtagataaactcaccaaggaaataactatgcaaaataaataaataaaggaggaaaagatagaaaatgcaaagtcactgtcaattatgcactgtgaagatcagttcataaccgaacataaagcaggcagagaaacagaggcaacaggagaatcaaaatgccagagaaaacttcaagaaacagatatgaggaatgttaagaacagagaaaaagtttctggtcttgccaaaacaataactaatttgcaacctagagtagtttcattaataaacaaggcctgaccatgttggaaggctgaaacagaatacactcgtagaaacagatttttaaactggggggcaaaagtgtgattacaggaataaagtcctaagagctatgaaaagggacatgttcaaaggtcagataaaaggaagaagagaaaaaattgtcgtgtgacagaagcaaaaattatgtagaacaataatcaaatgaaattaagatgaaagtacataaggcagcacctcttcctaacagccactgtatttcaatcttctctaagaagtagcagaaagcatctgtgttaaattatatgaaaacatgagggcaggacaggaaagaaagtgtgaagtgagaggactggagctgtttctgaaaagtctgcaaacaccaaaacacatgaaacagctcagtcagtcataaaaggccttacggcagaaaaaatgaagggactatatttggtcctctttctttattttctctgtttccaaccttggaacagcagtttgcaagtttgtggacaggttgtaacttctgctaaggatgtctcttcagttttgaagagactcaggaaaagttcagaagaaaggagagagctgtttatgattggctaaaggcttttttttattattgtggcagaatatacacaacataaagtttactattttaacatgtacaattcagtgatccatacattcagctcttgtgcaacaattactgttatccatttcccaaactttttcatcatctataatatggtgatctagtaagaaattcctggcacactgcccctaaaacctttggaatttcccgaatgataagggtggaagaattatcttttgctattcataataagtccctttcaaacatatttgagcttatgctaaagagatgactcttggtaggcccctacaaagctgcaggggagtgggtagggaagctggtcacccaagaaatcaatcatgtgattacatagtcagaactttcagccccacctccagggaggggagaaggactagagactgacctaatcaccaatgaccaataatttaatcaatcatgcctacagggtgaagcctccataaaaaccctaaatgatgggactcagagaatttcttctggatcgatgaacacatccacgtgctgaaagagtgatgcaccccaactccatggagacataagctcctgcactggggacccttccagacctcaccctatgtgccttttcatctgtatatcctttataataaactggtaatagtaagtaaagtgtttccctgcattcaatgaatcattgtagccaatgactgaacttgatttgtagccaagtcagaagtaccagaggcctggggcttgcaactggcatctgaagtggtggaagtcttatacaactcagtccttaacctgtggtgtctgacactcactccagggagatagtatcaaaattgaattaaatgctaggacagagaactgagagctgtagggagaaaaccccatgtatttggtgtcagaagtcttataagtgtagaaaaagttttttatcatctccaaccaaaattctatacccattaaataactttccattttccacttccccatagtcccgtgtaaccactattctactttctgtttctatgactttgactattctagtggaatcatacaaatttgtccttttgtgtgtactttgcttcagttagcataatgttttcaaggttcatccatgttgtaacatgtatcagaattttatccctttttaaggctgaataatattccattgtatatatatataccacattttgtttatccattcatccgctggtggacacgtgagttgcttccacctttgggctgttgtacataatgctgctatgaatataggcacacaaatatcttgagaccctgctttcaattcttttgggtattgcattaatccgttctggcgctgctataaagaaatacctgagactcggtaatgcataaagaaaagaggtttaattggctcatggttctgcaggctatacaggaagcatagcagcttctgctctgcttttggggaagcctcaggaagcttccaaccatggtggaaggcaaagggggagtagcacttcacatggccacgtggccagagcaggaggaagagagagagatggggaggtgctacacacttagaaacaaccagatctcgtgagaaccctatcacaagaccagcactgtgggatggtgctaaaccattcatgagaaactgctctcatgatccaatcacctcccaccaggtcccacctccaacactggagattacaatttgacatgagatttgggcagggatacagatccaaagcatatcaggtatatacccagaagtggaattactgagtcacagggtaattctatgtttataatttcttgaggaattgctacactgtttcccacagtgggtgcactatttcactctcctaccagcaatgcacaagggctccaattgctccacatcctcaccaacacctgtgattttctgctgtttttttttttaataatagtcatcctaaagactatgaggtggcatctcattgtagtttccattgcatttccctgattactagtgatgtcaagcatcttttcatgtgcttattggccaatgtatacattttctttggagaaatctctaagttccttgcccactttttatttgggttatttgttttggagaaaagcttttaaagagagacacagaggaaagctttctgtacaatcagatctagctctctagtcaaaaataattggtgatatagtttgcatgtttgtcccctccaaatctcatgttgaaatgtgattcccaatgatggaggtggggcctagtaggaagtgtttgggtcatgggggaggatccttcatgaatggcttggtgttgtccctggcgatgagtgagttctcactctattaattcacaagaaagctggctgtttaaagagcctggcacctcctcttctctcttggtccctctctcttcccatgtgacacacctgctcccccatgccttctgccatgaataaaatcttcctgaagtgtcaccagaaactaagctgatgctgctgccatgcttgtacaacctgcagaaccatgggccaagtaaatctttcttcattaattacccagtctcaggcattcctttatactagcaacacaaaacagactaatacaattggtatctgccctctagatcttttaggaaactaatcatggagaagaggcactggcaagagtgctaacccagcagaagagaaaaaacttccacccctgagaacagagatttctttttcataaagtgccttctacctgatttcagctctgtaactgtcaatctctttttctcttctggcagatttccctatccactagagcataggttttaatgaccacactgctggtagctgtatcactactaatagtagctacttaatgagtcataagtgttactgctatgtgctaggcatgatccttcatctcatatgtgaaatctcatttaaaattaagtcctactaatgatgccgagaagattatcatggttcttacacaaggatgatatgcaaattcattaagtgttccatttaagaaaagaaaaaagaaaaaaaaaaaaaacctcttgtaccctagcagtttcatcttgaatactgttaaaaaaaaaaaaaaatacatctttaaaacacatgaaaggttttcatcctttagtccttcaatgtaacattattaaacgatgtcaaaaagtctcaaagttagcgttaaataacaagcattttctaaattatacattgaggagtctgatcttgaatccacaaaataaaacatcttttctacatcaactacaggaagtacatttttacctcaaactagtaaaatgaaaggttttgttgttgttttttgagacgaagtcttggtctgtcacccaggctggagtgcagtggcactgcagcctccgcctcccaagttcaagcaattctcctgcctcagcctcccaagtagctgggattataggtatgggacaccatacccagctaatttttgtatttgtagtagagacagggtttcaccatgttggccaggctgttctcgaacttctgatctcaagtgatctggccacctcaacctaccaaagtggtgggattacaggggtgagccaccatgcctggccattttttttttcaatcctgctcccttttgccttttaaaagctcaacattttataaatatttagcaaatgtttagctctgaagtaataaagttgatttttcttaaaaaattcaactagaactagaagtgaacatcgtctttttatactcttagaaagttatgtgtttctcatgaaaaaatgttcaccatcactggccatcagagaaatgcaaatcaaaaccacaatgtgataccatctcacaccagtttgaatggcaatcattaaaaagtcaggaaacaacaggtgctggagaggaagtggagaaataagaaaacttttacactgttggtgggactataaactagttcaaccattgtggaagactgtgtggcaattcctcaaggatctagaactagaagtaccatttgacccagccatcccattactgggtatatacccaaaggtttataaatcatgctgctataaagacatgcacacatatgtttactgtggcacaattcacaatagcgaagacttggaaccaacccagatgtccatcaatgacagactggattaagaaaatgtggcacatatacaccatggaatactatgcagccataaaaaagggtgagtttatgtcctttgtagggacatggatgaagctggaaaacaccattctgagcaaactatcacaaggacagaaaagcaaacaccgcatgttctcactcataggtgggaattgaacaatgagaacacttggacactgggtggggaacatcacacaccagggcctgttgtagggtggggggagtgaggagggatagcattaggagatatacctaatgtaaatgacaagttaatgggtgcagcataccaacatggcacatgtatacatatgtaacaaacctgcacgttgtgcacatgtaccctagaacttaaagcacaataaaaaaaaaaaaaagaaagtgatgtgtttcttcaaaagatgctgacgacgtcagacacactttttaaacagtttggaagctgtcttcagagacaaatgctttacaatcaatatttcatttaatcttcacaaaactcaaggagaaggtagtatataacttccattttacgagtaaattcagacagaaaagctaaataacttgcccaccactgcatttcagtaaatggcagagctgagattagagccaacatctatcggactctaaagcaccagctcttaattgcttcactttctatcattgttttgatagcaaaatagatgtaatctgatgatctcatagtgtatttacttttataaaacagtattaaatttatgggggtttaattaattattggcaccataaagacctgaaaccacctaagaaaataaatgctctgcaatagacagaagagcttttttaattatatgaaagtcttgtttttcaactctatcataccatttcctcttaagttgggctctttgcccaaaagtactctaaaattataattttctggcaaggagttttaaaagaagctgaaattttctcttcttccttcacccttggactctaatttttattatctaagaattttctccacttatcataaactggaaagtgatatgatttctttacatttcttgtaacaaacctatacaaaattaacaaacactgcaacatactccctatccctaagacatgttattacattcgctttcttaattactaattactcaaaaatcacaaattcagaaaatatagacaaatttgaaaatgctctaacatattcacgtcctattaaaataaatttgaaaattccctaacatattcatgttctagtaaaataaaaattaaaaataattttattagaaatatggacacctataaggctcatacattttaatccagttcgttgtaagtattctgaaataaccatacctagatttgagaactaaaaaaggcaactgaatctttaattgatttttttcttctttttgagacggagtctcactctgtcgcccaggcaggagtgcagtggcatgatctcagttcactgcaacctccacctcctgggttgaagcaattctgcctcagcctcccgagtagctgggactacaggtatctgccaccatacctggctaattttttttgtatttttagtagagacagggtttcaccatgttggtcaggctggtctcgaactcctgacctcaggtgatccacctgcctcaacctcccaaagttctgggattacagccgtgagccaccgcgcccagcattttttttttttttttttgtcacccaagcgcagtccaagctggaatgaagtggtataattacaagtcactgcagcacaacctcctaggctcaagcaatcctccaacctcagcctcccaagtcactgggacaaaggcatgcgccaccacgcccagctaattttttgtttgttgtagagacagggtctcaccaggtcacccaagctggagtgcagtggtacaatcacagcctgctgcagccacaaccccccaggctcaggcaatccttccacatcagcctcccatgtagatgggactacaagcgtgaaacaccacacctggcaaattttttttatttttagtttactttagtttgagacagggtctcactctgtagcccaggctggggtgcggtggcatgatcatcgctcactggaacctcaacgtcccaggctcaggtgatgctcccacctcagcctcctggctgtgaccacaggtgtgcaccaccatgcccagctaatttttgtatttttttgtagaaaccaggttttgccatgttgcccaggctggtcttgaactcctagactaaagcaatctgcctgcctcggcctcccaggtgctgggattagtgcatgagctactgcacccagcctaaaatctgctcttatcaacagtggtgttatttgtcttggattattttattttctatctttttcatttaaaatgacactaggtcatctgaaatatttagtggtgagaaaaaagtaagactgggtattaggattatagtgggtcaaagagcaaccagagcaaataggaagaacataaagataaaagtctgctctgaatagtctatatcacgtaatttgaatttatatatgcccaatttctgactcaaacttagaaaataaatgtgtagtggagagactatccagagaaaagagctcaaaaccaccagtgtcatcacttttggcagaatatccatagtttgaaagaaaaaatcagttatcctatctatgaataaaatgctattaaaaataacaggatattagttattaggatattagtctccaggttaggatcttgaaatatcatttcttactaagagaaaccacggctttttggagaaatggatgattccagatctaggacaagaagtatacaagatgggccccaaatatcacagcagacaacaaggaaactatcaaaaaccactagggtcatgttatctcctgaagagactcccactaaccaaaggtgagacaatttgcgcttcagtgaaagtgattccaatggattaaatccatcaagtatgtttaaatccatcttctcataatggcatttaaaagaaaaaaaaatggccacctttggagaaagacagggaactaattcgttatcttgaaaacttgtaaataaaaggaaagaatcaaacatttatcctgtctttcctttatcaacagtaccactgggtaactaaacagaagatgaggggaagttactttttataaaaacattccaattaataaatgaaagcaaaatgatgtatttagaatttcattatattgcaacacccactaaccatccacagccgctaacatcacaaaaaagaaagacaattagacattatgatattcccatggtcttgccaaaccccatctatatatatatatatatcacaatgcctaagggatcgaacttgagtctgctccatctctggatccagctgcacgtttgcagaaaatacagaagacaaaggaacatgttgaactgacctatattaagcaatcagcaaaatccaactctgggaaactagtacaaacaacctgggttctccaacaggaaaaggaaaaggatggaggactaaactaaagattaaaagtgacaactcatatcaaaactgctttttgggctgggtgctgtagctcatgcctataatcccaacacttggggaggccaaggcaagaccacttgagcccaggagttcaagaccagcctaagcaacatggcaagaccccatgtctacaaatacacaaattacctgggcatggtggccaatgcctatagtcccagctcctcagaaggctgaggcaggaggatcccttgagcccaggagggtcaggctgtagtgagctgagattgcactactgcactccagcctcagtgacagggcaagatcctgtctcaaaaaacaaacaaacaaacaaacaaacaaaacacaacctagagacagtgtttccctcttgttgcccaggctagagtgcaatggtgcaatctcagctcactgcaacctccacctcctgggttcaagggattctcctgcctcagcctcccgagtagctgggattacaggtgcctgccaccatgcctagctaatttttgtatttttagtagagatggggttttgccatgttggtcaggctggtcttgatctcctgacctcaggtgatctacccacctcggcctcccacagtgctgggattacaggtgtgagccaccgtgtctggccaaaacttactatttcttaatcatcaagactaacctacagtatctagcaatgcacatttgggttattactacacaagtcaggaaaatgattacttatagggaaaggccactgtgatctatttctcaacctgaggggtgattacaaaggtatctgccttataataattcaccaagccatacatgtgttctgtactaatgttttattttgcaataaaaagattttttttaaaatagcaggttaccagcacacctgaacatgtcaacacctaaaaacggctagatatgttttccattctctactctaactgagtgaaaacaataggataaaaatagaaatcaggccgggcatggcggctcatgcctttaatcccagcactttgggaagccgaggtgggtggatcacctgaggtcagtagttcgagaccagacaggccaatatggtgaaaccccatctctactaaaaatacaaaaattagctgggtgtggtggcacacgcccgtagtcccagcggcttgggaggctgaggcaggagaattgcttgaacctataaggcggaggttgcagtgagccaagattgcaccattgcattccagcctgggcgacagagcaagactccatctcaaaaaaaaaaaaaaaatagaaatcagtgtgcatcatttcctccctacccacttcctcttctaaaggaaccacttaatatcacattttaggccaatcagattcactttcttgggattatgaaattccaagaaagagactatagatatccaaacctgttctcccggtctttcctcattccccaagttgtttcaattcaaaacataggagccaggattgattctttttttcccctcattccccacatctagtctatcagcaagtccttcatttataactccaaaatatcgcaaatctctcaacttctatctccactgactctaccatctcaaatcacaaactattcaaatagtttcctaacttgtttctcttttattcttaaccctctacaatctactctacccaaagcagccaaaaggatgttttaaaaacataaactgcttaaaaacctttaatgacagcacacagagctctgacttaaatccaaattcctttccatggccggcatcattgaatccgtgcccatctctctgagctcatctctagccactgtcctcttctccaatccaggcacactggtgtcatttcaattcctcccacacattaagctctttcccacctccaggccttctcatagctttcccccctgcctggaatacttttcccttgctactcacatggataacttctcaatgtcaggttacaacttaaatatcaccttctcagagaagcctctgccaactgccctattaagcaggtttcaccatctttctctacacactacttatatctttcatagctcaagctacaacaagagtgtatgttatatgagggcaaagaacccacctgtttcattcaccaatgagcatctggaatgtggaaaacaattaataattactgaatgtatgaataaatgaggaaatgaatgaagtaaaggccgaatgccaattttgccatgagtagtgatcagtaagtaaagaaagccagttttcagaaagaacagagcaacacaacagagaacaggagactatgtggcttggttccataaacagagtcaagaaaattagctgccaattataaattataaatgtgtgtgtgtgtgtgtgtgtgtgtgtgtgtgtgtatcaagatagcagaaacatctgaaaaatttactcaattcacctctatactaagatgtctggtattatataaatctataaactaattcagaactcaaaataatactacctaaactaattatcattaatgttaacactttgtaattctcattttgctatgagtcatttttcaagatatactcctatgatgtactttcagaaattcaaggtaatcttcatgtcgatattcacggtatgtatgcaaacaatgaattttttttgttgtttttttgagacggagtctctgtcgcccaggctggagttcggtggcgcaatctcggctcactgcaagctccgcctcccaagttcacacgattctcctgcctcagcctcccaagtagctgggactacagatgcccgccaccatgcccggctaattttttgtattttgtttagtagagacagggtttcaccatgttagccaggatggtctcgatctcctgacctcatgatctgcccacctcagcctcccaaagtgctgggattacaggcgtgagccaccgtgcccagcccaatgaacgtttttgagacagggtcttgctctgttgcccaggatggaatgcatccacacaatcatggctcattgcagcctcaatctcctgagctcaagcaattgtcccacctctacctcccatttatgtaaatgtgtgggtctgtactgagtctcagtatcaatgaatttttttttttaaatgttgaaagccagtaatatatgatggcctgaagtgttcctagagtcaactaaagactgagtttctctagttgacatgcaacagaagtttgtttaccggaagtattgcaaattttattgtcgcactccctctctccaagaaggaagagccaactgactattcccatcagcacggcctaaagcaatcctaatcaagttaatgccaccctaaattaaccaagaaaagccaaagggaagacagcagatgctttagggaccaagttgttaattcagagatgctcctgtttggttggttcttttccccttggactaactactttgaatattttgtccacttgcctacctctagaattggaaattttccctagggccttcctctgagtctgctggggtttttttaagagttcttagagttcatcttctcaaagacaactccagctctctatttagtcaatctctctgatatacacacaattttactttccaacattccaaggaaacataaattagaaatatacacataaaatgacatccacccctcttctccctgcaataatatctttgtgatattcctactatctacttaactggtgtgttgctttctctcacccacttccattcataagcgctgagagttatctgctatctctctccattcctaattcctggcctgagatccgggctacagatgctacaagttgatgtgggctcttcatgctgaagaattcatgagtactttctgcttaactcctctatattctcaacccgatccctttgctttttctttccataataatctgttttctgatgggtaatccatccaaacactcatttgcccttatgaaattagtgttttctagctttccatttgcgtgaaggacccctaacatatgacttcaaccttcaattttatttcccccaaactaccctttcacactattaaaaataataataaaaaattgccacagaatccaactatagcttaaattaaagaactcacctgtcttgagagtaagtatgcttcaatagcttattcttttactatccttttagtgttttcattgttcaatgctaacctgccctccaaccataccttaatcaacgaattacacattttaaataactactaacactataacctatttgaggaacaagcctatctggtaaagtgtctcactccagcagtgatattctgtcctctctttgacaagtattaaatatattttcatgctgcccacctgtctatcatagagacccacctcccttctatgaaggttccacctggtgaagagcccatgttttctggtcatttacctttctacctatcaaagctggactattatgtggtcatttttctctcagctagcagttcccctataaaaaatccaataaattcggctgcgcggtaactcaagcctgtaatcccagcactttgggaggccaaggcgggtggatcacgaggtcatgagatcgagaccatcctggctaacacggtaaaaccccatctctactaaaaatacaaaaaagttaacctggtgtggtggcaggcgcctgcagtcccagctactcaggagggtgaggcaggataatggcgtgaacctgggaggcggagctcgcagtgagccgagattgtgccactgcactccagcctgggcaacagagcaagattccacctcaaaaaaaataataaaataataaaataaatccaacaaattccatctaaccaaaatgctaattaatgatcatttaataaaggagtccccaactcctttacagcacaatacagtggaccagtactggtccatggcctgttaggaaccaggcaacacagcaggaggtgagctatacgcgagcattaccgcccttgctctgggctccagctcctgtcagatcatcagtagcattagattctcataggagtgcgaaccctattgtgctgtgcatgcaaggaatctaggttgcacgctccttatgataatctaactattgcctgatgatctgaggtggaagtttcatcctgaaaccatttcgcccccaaccaaaccatctgtgcaaaaattgtttcccacgagactggtccctggtgccaaaatggttggggatctatgatttaatgaatttcccttcccagagggaaatccttttaataacgactttggccagcttgggcaacatggcaagacctcatctctacaaattaaaaaaaaaaaaaattaggtatggtggtgcgtgcttgtggtcccagctaatcagggaggctgaggtgagaggatcacctgagcacagggaggtcaaggctgcagtgagccatgattgtgccactgcactccagccagggcgatagagtaagacccaatctcaaaaaaaaaaaaaaagttaaaaagaaaaaaaaggacttctgaagacctcagtgacaagtatgttaacgaaatctaaggaatctaaaaactactctggtacctcaagttggtgacatgggtgaccacatctattgcctatgtttaacacaaaccttgttaaggagaccaaatcaatgaatatgagggtgagaggtgccttaaaaatcatctaggtctctgagtcatgattcttgaactgggctacacactggaatctccaactcccagaggagaagaagatgcccaaagaagcaaatttcaaagtcagtgacaaggccaggcctaatacccatgcctaacattatgtgttgatatgtgtacatacatacatatatatatacacacacatacatacacacacacacatacacacacacatatatatgtaacatactaaaaatataaaggcatgtatgggaaggacaaatatccaattcatgtcagtgattaccttttgggggatgggaagggagtgtaattgagaagaaatacacatggtggcttcaaatgtattggtaatatttttattaatatttcttaaactggatggtaatacctaagtatctattaaattaggctctgttcttttttctttttgttttgtttttatttttatttttgtttctttgagacagggtctcactttgtcatccaggatagagtgcagtggcacaatcatagctcactgaaacctcccactgctgggctcaagcaatcctcccacctcagccccacaaagtgctgagattacaaggcgtgcaccatcgcagtaggccctcattatcttctggatatctaaaattttgtaataaaatagaataaaaagatggtatataatcaaatgtatatcacattaggaattcagtgaaatatctcaggctagaaagtactcagaaaacatacttgatgaggtaggctttgatggaagaataaaacatagattattcttcaggcaaaaagtaacacaaacttttctaaaggaaaaatgtgaataaaggtaaagctgggagtacccacagcctataacataaataaagaacaacgggggccaggcacggtggttcatgcctgtaatcccagcactttaggtggccgaggcaggtggatcatctgaggtctggagttggagaccagcctggccaacatggcgaaacgttgtctctactaaaacacaaaaatgagctgggcgtggtggcgcccgcctgtaatcccagcctctcaggaggctgagggacgagaatcgcttgaatcaggatgccagaggttgcagtgagccgagattgtacccctccatctcaaaacaaaacaaaatagttttgaaaaccactggactaaagcgtccagctagaaggtactgctgcaattcaaaagtgagggtcataaaaccatggaatgggttttatggggtagtactcttgagaaagaaaacagaaaaaattaatccaccaactttttaatagaaaatttgataggctatagtgacaaactagatgggataatgaaagagtaagacctacctgaaaaaataaaaaatgccaactgagcagcagcttctagtcatacttgaacatcaacgacatcgataaggccatgtaaaagtcagcactaaggaagtgttattcaaggcagaaaagcaaaatggcacttttataaggattaagagcagaataagcaacagagaccaggagattacagaaaaagaggaccactacatcatggaatgataagaaagagagtttcaaaaagagccatcactgtatacaacaagagggtgcacagcctttgtagccaatcagatgcagaattctggcactttctccacttgaccaagttatttaacgtctttgagcctcatataataaggaaaacataagttaacaactaacactgttgaacacataggggcttcaaatatatttgtcaaattttatttcttaagctcagtcgtgatacataaatatttattaaattagtccccattatcttttgttgtttttgttttgtttttgtttttttgagacagggtctcgctctgtcccaagtgctttacatatcacctcatttaatccccacaatacatttcacagatgaagaaattaaacttagaactagcataataagtagcagagccaggattactatttcttaggatttaaataatgtatacttaaatttcctggcaaacaggatgacctcaaaacgagtagctatatttcattattaggagataataatcaataggggcaaaactgccagtaattcctgtcatagccttccatgtggcaaactctctcaacatcctcatctataaattaggattaatgcctataatccaatctactccatagggttgctgtgaggattaaatattatgaatatgaaaattctataaaaaatgttgagacattcaaatatcagggattgctgtcacatatctttcgccttcaaaaatgcttttgcggcatttttgttcactacttcaaaataagactctgaataagctaaaaataagtctgttaaaagtgcaaccaccactttgaaaagtataaatcaccacagaattgctgcctacacctgcccctgactcctccaggttctctaatgtctccacaagggcaaggattctcttacacctataatgaaactctgataacttacagtacagctaatcaatagagagctgcacttcaattcagagttgttcaaactggactactgtgttttctcagaggtgctccttccagttcttccagaaaagaaaaaagtgcccaattctcttatattgtattaaaacggtgcccaatgagtagaatgcaggtaacttacaaaatgctagaaaagaatctatcaattgacttgctcaagtgctctgacagcaggtcccttttggaaactccttcacgaccccccctttttttcacctgaacagatggcttccaggcttcaaggctcacatgtctagtcacacaattcacaatagctcccaaagttcctaacttttcaattatcccatgttcttgaacacacctttcatctaaagatctctagctgtcaaagcatacgaactctttaatcttcacaacagcactatctgagagattactatccttattttataagttaaaaatgaaagactgaggttaaatattttagcaacatcaaacaattcgttaattcattcttggggagagaggaatacatattatgaacttctgtcaatggacaacctagatttggcttcctaagatcattgcaaatattagctcaaacacatcccactcttgtatgcatacatttccaacacaggtgtcaaagattaaatataaactattaataacagtaaataccataccaaagcagcactatttttacacgcaaaactatattgggggagggggttctaatttaaacttcccactgtcttgcatccataaatacttttgaacttgagggggaagggggaagaacacctgtcagagcagcacatccacaatgttttacagactgtgtagctattaatatttaattcctcccgccccgggaggtcaggccgcagggagcccggcgctgcccacccgactttccacgcgccaggcctgccggccgcaggggaggctccggctcccgctcccctcaggtcccctcgcccgtggacagacgcggcgggacactcggacccgcctcccgacctcagcgcgcccggctcggggcccggcgggcggggagaggctcgcagcagggcctggcctagccacccccgccccgcggccgccggcgccgcttccctccttcttcccgctccccgattcgttacctcttaggcgccggcggctgctccatggcggccggggacagagagagggacctggtggacggcgaaggccgaaaggaggaaaggagccggggcaccggccggccgagcctagggcaccacagagggaaactctgggaactcggaccaactttcccgt

SEQ ID NO: 252 - DNA, 371051 bp, Homo sapiens
tatgctgggtggcacagtgaaatttatttgtctttatgatttacacataataattaaacacacaaaagaaaaaacactgtcaagatggccatatgtagcttaggaaatgactggtcccaatgcaatcatataaatgttcattcagcgtaaaaatgagtttctttttaatggttttaatcttttttttttcagtccccaaggcttgtaccactcagtacaaatgtttttgctactgggttatcatcaggaacatgatgtttaccaattcccaggaaatgaataaaatcaacagaaacatcctgtgacaacagagcacattttcatagaaatgaaattgatgagcttattacagtttgaatcagttcagctattagatctacacataaaacatgaaacaatattaacaaattacatttgtattaagtttttatttaaaaatatttatcacacttttttgtgcaagggttccattgatttctttggttttaaacacgatagatctattttacctaaatatatatagttctatttgtaccaaacatcaaaaatcaaaaaaacaaaatttcaaagggtaaaaatggaattattgcttcaatataaaaaaggcctagcccatttgagaactactgccattattgctttcctatttgaaaaactatcctggaaatcaaggaatgtaccccatagctccctgcagaaagtataaattggttgcacattatcatcatattaatatgaccctaccttcaccaaagctatcctgatcttgtccttaaaaaatgaaacaaagcaaaatagcataaataaataagtttacctaaggggatacaataaatagcctagtatactagataggaataaagaatattgtaacataaagcccttcagtgctgtacaatgcaacaatagctttggattttcaaggtttagagaccttgaaaatccatttcataacagttttattactggtatgcagctgacagaacaagagaatacacttcttttgttctcctcatcttagagtgaatgcacagcagatacaactgtcaattctgccttttgggaatttacctgggcatgtaccattgtcactttttgacctctgcctaattgtagggcaaaatcttaggattaaaaatatccaaatattccttcaattcctagtggtttcttggtctccagaatagttaaaaacagagaggaaattagactcaaaagttttgctgccttcttttctttgcatccatcgcatccagaatgggctgtcttttcgcagtgtatctctgacgaagttcttctatctcccgttccatcatggggtccagtgcttttaaccgcatctgtagttcttctaaacttagatttttcaactagatacagaaagaaagataccaatacaatgaaattatccacattatccacaatcaatacaatgaaattagactttaatgtctaatgagttttaacataaatatttcagcaaattctttacatcatctttgaagtatagttcaacaattaaaacaggaatttcttccttgaagaactcagaggtcatatcttgcaagaacctccagtaatctgcaatgaagcaatccgatcctctgcctttaataaagggcaaatgagaaaaatacgctgatggaatttgtaaaaaggtacaaagacaaatccaccactgccaacaaacagattttcagaatatgttccaggtatattcactctaactttttacatctttgccagctactgagtgctacaataatcatgaacacttgcagagatcactcaagaatgtgacaagactgaataaaggttaaattaaccattctatcctccattttactaaatgcttaataaagaagatgactgtggtagggggcgggaagtaaggctgaataggcctggtggggccccaaaagcaggaagccatgatcaattctggagtaggacagttatgtaagagtaatccagatttggttttcttttcttcttcttcttcttcttattttttttgacacaaggtctcaaacttctgggctcaagagatcctcctgccttgacctcctcagtagctgggatgtgccactgcacccagctcaggcttggttttaaaatgataaaacttgcaacttactttttgttttaagaagataattgcctttggttattttatgagtcaagctaggaaaaatactcattacttatagtcatccaaagtagcatttctcagcagatccttttactcgccatccctggccctatcgtgacttctgcttccaaaaaccaaattcactcttagctgaaaaagactctgaggatactgaaaagaatgagtcatagactctctgaaggaaattcaaaaaaggagttccaaaaatattttgagaaatgacagtgttatggagaagagtatgcaggcttccatgatgatgactttgaaggtgaatgccactcacttcggtgcataagaagttctggtatgtatattaataatcagccctgttattttgtagtcatatgtcatgaaagaacctagcttttaatattatgccataaaacatacatttatatatcatatgtagtattatacactttcttcattgatttttaatccaagtagtgatcttgcatctgttacatgctcagtgctgttcaaatcactgtggagatacagaataagacaaacagggaaactccaaactttgaactgtacacatcggtaatggccacattgaaaggccaatgtataccacacaaccacatttcccaagaaagacatgcccaactatgtctatgtaggatccagttccacttctgtgttcttcaacatcatctctatttcagcccatgttaatctttcccatttctaaatttctatgtaacactcataatttaaacaacacaatttagtatttgattctaaatcatgtactattttataattgatttttatgcatgagtttcatgtccctagatattccaaaaaatacttagactttagagactgtacatacaccaagaaactatcctactatactgcaaataacatgacgtaaacgtagatagataaatatgaataagaatatatgacccaaaggagtgggttactctaagatcagaagaactaacatattatataaagcaaacaattatcattactttaattctgaattaagatattcctgtaaatatcttgtactacttttactggggcaaactgccaataggtttataaatattgtattgcagtaatagactgaactcagaaaaagaagctacttagaagaaaaattttcttcctttaacagatttttatattatcaatgcgtaaaatttgtgaaaaacaggtctgtgatattagagaaacattatctaacattattaaggaattaggtgttcatgtaagtaaattaatgaagtacctaaatcttagttctttaagtgataaaactttgtctcaatatcacatacacacacatatacacacacacacacacacacatgtgcacacacacatgtatttacatatgctcttttttggttctatgtgacttttaggatttttttctaattttgtgaaaaatgatgttggtattttgataggaaatgcactgaatctgtagactgctttgggcagtaaggtctttttcataatattgattcttccaatccatgagcatgggatgtatttccatttgtgtcatgcatgatttctttcaacagtgttttgtagttctccctgtagggatcttttaccttcttggctaagtatattcctaggtaatttattgctattactattattattattaattattttacagctattgtaaaaggggttgagttcttgatttgattctcagcttggtcactgttggtatataatagtgctactgatttgtaccactgattttgtaacctaagactttactgatatggtttggctgtgtccccacccaaatctcatcatgaattgtaatcctcataatccccatgtgtctagggagacacctggtgggaggtgattggatcatgggggcagtttccctccatgctgttctagtgatagtgagtgagttctcacaatatctgatggttttataaggggcccttccttcttcaatctcactctgctctcccctctcaccacgtgagaaggtccaggcttgcttcaccttcaccttccaccatgattgtaaatttcctgaggcctccccagtcacatggaactgtgaatcaatacacctctttcctttgtaaattacccagtcttgggtatttctttatagtagtgtgaaaatggactaacacagttaactggcactgaggtagtggggcgctgctataaagatacttgaaatgtggaagcaactttggaactgggtaatgggcagaggttggaatagtttggagggctcagaagaagttaagaagatgtgggaaagtttggaacttcctagagacttgttgaatggttttggccaaaatgctgttagtgatatggacaatgaagccgtggctgaagtggtctcagacgaacatgagaaactcactggcaactggagcaaagatcactcttgctatgctttagcaaagggactggtggcattttgcccctgccctagagatctgtgaaactttgaacttgaaagagatgatagggtatctgggggaataaatttctaagcagcaaagtgttcaagatgtgacatgggtgctcttaaaagcattcagttttatggattcacaaatagatggtttgaaattggaacttatgtttaaaagggaagcagagcataaaagtttggaaaatttgcagcctgatgatgtgatggaaaagaaaaacctgttttctgggggagaaattcgagcctgcagcagaaatctgcgttaagtaataaggagccgagacaatggggaaaatgtctccagggcatgtcagagatcttgccagcagccccatttcatcacaggcatggaggcctaggaggaaaattagtttcatgggccaggcccaggggccctgctactctgtgcagccttgagacatggcaccctgcatcccagccatttcagttccagtcatggctaaaaggggccaaggtacagctcgggccatggcttcagctcaagccttggtggcttccacatggtgttgggcctgcgagtgcacagaagtcaagaattgaggcttgggaacctctacctagacttcagaggatgtaatggaaatgactggatgtccagtcagaagtttgctgcaggagcagagccctcaaagagaacttctggtagggcagtgtggaagggaaatgtggggttggagaccccataaagagtccccactggggtgctccctagtggagctgtgagaagacagccactctcctccagaacacagaatggtagatccattgacagcttgcaccatatgcctggaaaagctgcagacactcaataccagcctgtgaaagcagctgagaggagggctgtaacctgcaaagccacaggggtagtgctacccaagaccatgggagcccacctcttgcatcaatgtgacccggatgtgagacatggagtcaaaggagatcattttggaactttaaaatttaatggctaccctgctgggtttcagatttgcatggggcctttagcccctttgttttggccaatttctcccatttggaataagagcatttatccaatgcctgtacccccattgtgtcttggaagtcactaacttgcttttgattttataggctcttaggtggaagggacttgccttgtctcagattagactttggacttggacttttgggttaatgctggaatgagttaacacgttggggaactattgaaaaggcatgattgtattttgaaacgtaaggacatgagatttgggaggagccaggggcagaatgatatggtttggctgtgtccccactcaaatctcatcttgaagtgtaatctccataatcttggtttgtaatccccatgtgtctagagagagacctggtgggaggtgactggatcatgggggcagtttcctccatgctgttctcatgataatgagtgaattctcacaagatctgatgggtttatgaggggctctttctccttcactctctactctctcctgccaccatgtaagaaggtccaagcttgcttcaccttcaccatctgccatgattataagtttcctgaggcctccccaggcacgcagaactatgaatcaactcgatttttaaaaacatattgagacttgttttaggcctatcatatggtttatcttggagaatgtttaattttggataagaagaatgtatattctgcaattcttgggtagaatgttctgtaaatatttgttatgtccatttgttctacagtgaagtttaagtcctgtcttcattgactttctgcctcgatgatctgtctagtgctgccagtggagtggtgaagtcccccactattactgggttgcacctatctcttttcttagatttaagagtaattgttttatgaatctcagagctcaagagttaggtgcatatttatttaggactatatcttcttgttggattgatccttttatcattacataatgtcattctttgtcttttttttttactgatgttgctttaaattctgttttatctgaaataagaatagctacccctgctcacttttactttccatttgcatagaatatcttcttctacccctttgagtctatacaaatccttatgtgttgggtaagtctcttgaagacagcagatatgtggtttgtaattttttatcaattctgccaaccagtatcttttaagtggagcatttagaccatttacattcaacattaatactgaaatgtgaggtactgttccagtcatcacgttggttgttttctagatactctgttttcttcattgtgttattgtattacaggccttgtgagttttacgctttcaagaggttctattctggtgcatatctacctttcgtttcatgattcagaactccttttagcatttctcgtagggatgctctggtagtgacaaattctctcagcatttgcttgtctgaaaaagaatttatttctccttcatttatggaacagttttgctggatacaaaattcttagttaacggttttctgtttaaggaggttaaagataggaccccagtcccttctggcttgtaaggtttgtgctgagaaatctgctgttagtctgataggttttcctttacaggttacataacgcttttgtctcactgctcttggtgacatcttttttgcaacgaatctcctagaagttcttttttaattaaaacactttttttttttgtgggtgcataccgggtacctgaaatgttttgatactggcatgcaattgtgaaataagcacctcattgagaatggggtatccatcccctcaagcatttatcctttgaatacgatccaataacactcttcaagttattttaaaatgtacaattaagttattattaactatagtaaccctgttgtgctatcaaatagtaggtcttattcattctttttattttttattttttttgacagagtctactctgtcacgcaagctggagtgcagtggtgtgatctcggctcaccgcaactgatgagaaagcaaaaaatgtccatcaaaatatgaatggataaagaaaatatggtacatatacacaatggagtacattcgtgtgccatatctgtttctactcatgctgttttccttctctatcctatttcccattttatcatcttactcatccttcagtgagttagctgtgcatgggcctatcttgccagctagattgcaatcttgttgtgggagatagagtgttttactcatctccgaacctactatgctgtatttattttaaaaatatctgatttcagttttgtggttgtatgaggttgagtttacaggaaatctgacttctgcataagctacatatatcgctaggtcttcaggtgggctgtcagagaacttcaaagtactcactgacatatttattgagatttttctatggaccaagcatagtagaatgaattttcattcacatcttgaatagtttttcaaacttctttatgttgtttttcacctttctctcgtatctcctttggtagcttaataatcaaccttttgaattctttataaaaagatatttcaaagatttcatcttggtttagatcaattgctggagagctaatgtgatcttttcaggggtgttatagaaccctgttatgtcatattgccagaattgtttttctggttccttctcatttaggtagaaatatatggaatgcttcacgaatttgcatgtgagccttgcacaggggccatgctaatcttcactgtatcattccaattttagtatatgtgctgctgaagtgagcaccgtctcaattgttttgaacagaaaatctttataaagtgttccacagaatatactgccttctaagcagaggacatagaacctaaaacagtttccttgatatgagttatcattatttttattatggatggatgaatattgtttttagttaaattaaaaagtcaaaactactttttaatatgagtcaacactttgtttgtaaattgatatggtttggtacatgagtgacagcttaaataagaaattcattttgttagtgatagcccttgataattacatttcattcaggagatgaaagatcaatatacaaaactatgacatttctcagtatttctaaaaaaaaaaccaagtaaaagatacgcaaattaataactcagttactagctcttgtataaaacaggagcataaaaaactcagtgatatgagaagttagggtggaaaataagattaaatcaattcactgataattctgacatttcaaacctttaataattagaattatttctgaactctacaagaagtattgaaagtctgcttattactgatcagaaagagttgtcagtaaaattagaacttcctttaagtttacatatctagtctactataaaaacctaaaatatcacagtcaagtgataaaacttacttcataaaataattcatcttaaaatctctggggaaaaacactaagatttctatataattttgttttgtcaaaaatagtcgtaattacatgagcgatttttaagaagtcaaatctcaaatagcagaaacgggaatatgaaggttttgaatacatcaatgtaataacatttcaagacctaatgattctatgagttgctggaacaatcagtctgtcaaaataaatgagacactactacaatgaagcaaatggtcttacatgttaatgttaacacatttagtcaaacagtcaatcaagagaatcctaaggtttgctgtgtttactgggaaaacaaactcttcctagcaactgtttaaataaatcttgcagatgctacagaccttattagtggcctttgattaaaaaaatatgggttgctaatactgtatcctgactcatctattttcccatctgctagcaattctaacaatatgaactatcaacagaatggctaacaacaagaattttctatggcagttttgatgctgaattgcctatagcatttttaagatttaccagtgcatgtctcagactgttttgagtttcttgtggcctggagcaacatactcttttttcccttaatattccattttagctgaaatttttactgtgttgaacagaatcttgtttggttttagaaaacactgttgatggaggctgccacacatttaactaacaatgagaacaggaaacacaacaaagcactagtaaaaatccagtcaggtccactgattggtttagatatacataaacaggcaaggggccttttgcccataaggctgagccacagggataacaggtagtacttaaagttaaaaaaaaaaaaaaaaaaaaaaaagaaagaaagaaagaaaaaaaaagaaaagaaaacattcatatattaaggcattttcctgatttaattcctggcactgagaagcatacaaaaaaggagcattctagtcaatccaaactactatgaagcctgtttaaagaaaaccctacatatacatttaaaatatgcatttacaaaaataagatagtgataatttcaggcacttgataacactatagaagaaaagctgaattcctcactgtaaaaatgtgatcttaaaagctgcattaacatcaaatctactggcagaccccccttccccaaacagacattatttatcctgttctgagctgagaggcccaggtcttcagctgactgaataactaaaaatattctgggattacaattggaaactaccatgaatcattctgttttggctgtttaacttcagagcacctagaagaaacttaggattctagattttcattcccaaagaaaaggaagaatacggtttctcatgaatatcaatgaaggagtaggagaaagtgccaattactgattatttacaatgtgctgaatactatcctaaggtcctgtacactaagtcattgaagcctagcaatcaccttagggggcagatattaccaaccccgtttgacaggtgaggatgcttagagagatcaaatgatccaccctaggtctctcagctagaggtgcttatgtaggccctcaaaggcaacatctaacccacataaatttgaactgcagtctactgatagctgtttcatgggtttcccatgaactacaaaagcactacaaaatccaatgatcatgtgaaacagttttttcacaaattgtttataggttaaaaatagaaaaaattacttaaaaatcccaactttcctgtcagattgtacctggtgaagcattttacttataagctattcatgtattttagccatcactggccatatgaaataagtgcatatgtgttaattaagcatttttctatttaaccagctctttagccaaagaaacacatttctacatagccctttgggatagatttcctaatgttatcaataaatgtaacagagataccctgacaaaaccaataaaacatgtctccttcacattccagtgagactttgcctatgtctgttcagactgttccacagttggtttggtgctgtgtttaccttgaatctagtgcaggagttacaaactgatgagcattactataattatcttgtcttagagaaatctcggccacccatttaaaaaaggaatgatgaaattttcgttgcattcctcaatggcagctgagcacccatttcttatgtgcattttccgtttctggtaagtagctttgcttattaaaaatatcaggaaatacttaatttgggcacacttctgatatattgtaagcagctctaacattctaggcccaggacaacaaaatttaagtaactcaaaagcaaccagtaattaaatctttctggatctattaagggcagatgaaaaattgtattacctttgatttcttatctcagcgattctgattagcactttgaatagtttaaaacaccaatgaagccgtaaataagaggttaacaaattaagtgattaattttctttttatacttcaatttaagaaaaacattatatgagaaatatttgttatggaagatcacaaacattacaaaaacaacagtggttaaagtatatctgtaactagcttactgggtagtcaaacctctgtggagcaataatataaacttaaagtaatttaatttttctccaattacactctttcggctatgcaaagtcaaatttccttgacatatcccacagtaaatcttgggatgatttcactgatttctggtcacttttacttattaaaagtccagaccaaatataaacttcaatctcttattaagtgcaaattttgtcccttcccttagcatgagcttgcaccaatttacagtggggaaggatgatgtctatatctagaaccttctcgccgtctctttctaaggtctggttcctctagtgctgggagcaggaaggagaccggatgttattatgtaaatggtgacttgtcagtgaggtatgtttccctggtcttgctctggtttgtttgattactagtggtttgtgcacagaaagcgtgtgtatgtatttcctgatgttgtggttagtattatcctagtgcccaccccttttatagaggggctgcccaacatcttttctgagttagatattgtctcctctgacctgaaagccacctgggcagcattatgacttctgacctcctcttttggagtaaagagatcatggaagttctctacactctccagggactagtgggacccaaggaaggtaagggtcactactccaatggcccttagttatcccgcaggcctcggctctacctacagaagtctcctacctacaaaaatctttgggagagaagcagatatcagtgtctatgctaatataccttccaaacttccaggaactaaaggctctgcctttagtggcacaccagtgggtctacagattcagctagctcagtaagcaccttgctggggtaccaggtaaccgtatccctttcctgcaggcaccaccattctctgtgaatggatctctggaaggctccttatttgactttaggtaaggagagaactattttcttcccctcccaccaggttataaattccatttggatagggcctttgtctagtaaacagctacatctctagtgcctagaacactgcttgaaacatagtaggtgcttaatcaatatttattgaatgaatgaaaaatggtgggtctcttagtaatcgctggagggaggcggctggcttcagttgttggtggcatgctttagaatatcgggtacttaacacctgctgttttcagctgtggactctactaacaattttgtggtaacagaaagtcccttttgatgtcatagtacacatctattaactctatttaaaaaatgtgtgtgtgtgtgtgtgtgtgtgtgtggcatcaagttggtaaatttgcagttgaagtaaagcaaaaagagtatctgtgaagatgagggtattttttcagcatgtttaattaatattactacaggatagtttcatgctccactacatgtttattctgcatgtctgatgatacatttatttcaataataaggggctcatccttttcttagaataatggcttctctcaaaaaattctccaaaacaataataaataccatagttgactctttgaggaaacatgcatggagtgaagtgtgctggaagagcatcattcttactaatgtcacaattttctgcttcactgacatcacaatacttagtctaacaatttaaattatactatcttcatatcataaaaatgtaaatatttgtttcttgaaaatctataaagtagttttaaaatgaaagaggttagctaaaacccacaaatcatgcaatttagattgtaatagataatttttaatagtgaagcaacatctagaaataaacaagagtctcatattttagtttcgaagcatctaaatccacagttcatttaaaacagttcagaataagaatcgtggtctgttaactatttttaaaacaataaaactcaaaatatgccaaaatgtttctaaaacacttcaaaagaaaaaataaattcgatcatagttctgcattctcacttgccacatgggccttagaagataaaatgtaccaaaaaggaaacattttagcattctcaattttagaatggcatggtttgtggctgaaacaatatttaattttcccagctactgacagacaaatgtacaaattaaactaaaacacccatgaagagattcagatatttgtaaggacacaagaaaaaaggataggaggctcttatgaaaatgtttaaaaagcaaaattgattttgtctaccttaataataaataagctgtcttgtgcaaacttaaaagcaaaatcgtcgcctgaatgaaactgagattctattgttttttcattaatatttgttttaaaatatgctcacaaatgctatgaatttaaggtaaaagaaggtagagaatgagaataaatgaacataagtcctgctagttattaacttagatgtgtctcatgggggaagaatcaactttcaaatgtaaatgtttcaaatcttcaactttctgaattggggaaaggacaacagtgtttgtgggttatgtcagcattttagactgcgcaactaatatgcagaaatcacagaaaataaagatgagagccgggcatggtggctaacgcctgtaatcccagcactttgggaggctgaggcaggcggatcacgaggtcaagagatcgagaccatcctggacaacatggtgaaaccctgtctctactaaaaatacaaaaattagctgggcgaggtggcgggtgcctgtagtcccagctactcgggaggctgaggcagcagaatcgcttgaacctgggaggcgggggttgcagtgagctaggatcgtgccactgcacttcagcctggtgacagagtgagactccatctttaaaaaaaaaaagaaagaaaagaaagatgagaaagtaatatgccaccattacttccaaaaggctgagtaaacattgattacaaactaaaattttcacacttagatgattataatacacgaatggtccaaaaaggcttttctttgcgggggcgggggggcggtctgagaatggcgccaaattagatttttagaaactgtttttcggtatcaactaatttaatagagaacatggcatcaaaattttatctctaataataccttgcaaaatgagtgtgttcccaaatgttcctgcaagtcttcagcgctggggctggaccaagctgcacctcttgcaaaggcagcaaggctttggttttatcctcccttgagccagacacctgccttctgagtggcctcactactaatgtggacatggaagcagaggcagagaactgaggttgggggacagcacaaagaatggctgatcttactttacatctactgggaagccgggagactgtggtcatgagtggaaatttggggatcagaatttcagctctggtttgaataatatacattaatatggagtagttttgctagtaaatcttcacatttttattttacaagatgaaatttcagttcagtcttaaaaagtccattttaataaggataaaaggaaaaatgcatctttaattattgaccatatgaaagacatattgttggtttacctcctgtggaaaaagtaataacacagctatgtggctgctgaattcaatgtgctcttgaggaactttccaaaaaatattagtaactgactgacatacactgttattcaaggaagagcttatccactggataattattctgaaactggtttatattcacatacaatatatgtaactctcaatctgaaataaatgacccagcagacctagtgctgagctgctagtacctggtactaacagatcctagaattctccaaagcattcttagacaagaacaccgtgagtgaactttccattattagagtcagagtagcggtgcaataccagaaatgatcaactaattttgaaaaataccacatgcaaagaaattaccttcaaactgccaaaaacactgcaagctggtccacacaacactgcccatttctggatacccatgatttacctaagttcttctagcctattttcagttaggaatgcccatttgaatgaacctcctcctgctacagttctcttaaccacagtgcatgatcttgtgactctgtcaggtccaccctagccctgccaccgccaacccacagatctcttctaattaccccagttgtgagagacagtcatagtcttaatcattttcttttcacaggggtgttcactgcctcatctcacccgtactcagtacaaggccttttaagtaggccaccctcactctcacagttgtttctatagtcagaatagtcagctgtgctggaccaagctgtcaaaagaagggagagataactcttaaatactgaggaaattgcagattctgctagctattttttaatttttcaatgaccagaaactgtctttcattggtctttagtgagtgtcatccttaattatatcaactaattttaaagatgacatttttcctagacaattttgctagggtgacagcataagcttccccaacccttggtaaatctctgctctaagtataaaaaacaagacactgtttactgactcttaagaggtgtgggtttttaatcttgcagggtgaccaagtgttgaatatttggtaacaatttcgtaaaatcttttatatcccacttagaaattaactgatagaacacctgagggagagtggtaaaagtggaagcagtacaacagaataaaattaaatgatcctaaatcaactgcaatgtaccaaagccttctgaataggcaggtggcttctgaaaagggtaagggtgaatgaagttacagcttgactggctcagagagtttataggtttgtagaggatgagtggcttacagctcgatcactggctcctgaaaagttaggaagctgggccactatcagatcaatggtatcggaaactgagaaacatgaagtcactgagctctacagatatgaatagtggcatccactgaacccgctcataagggcaagatttcaacctctaagagagggctaagtcgctggctatacagtaccctctggtggccagatttgacactgcagatttttctgccttttaagaaaagaggcctggtttttttccttttcttttttttttttttttaatgcatagacttaccattgggttacgtcttgataaagccatcataaactaaaaatatctgcatttagtacagctaacctaccaaacatcatggcttaacctagcctaccttaaacatgctcagaataattaacattagccttcagttgggcaaaatcatctaacgcaaagcctattttataataaagtgttgaatatttcatgtaatttattgaatactgtactgaacgtgaaaaagagtggctatacgactactccaagtaccgtttctactgaatgtgtatcactttcatatcaccaaaaaactttaagtggaaccatcatatacctgggactgtctgtaattcaaaatctttctagacaaggaaggaatcaccagtagcactgctgggctatgggtaggtgggcaactacctactaggtgtaaatctgtcaaccaaaaaagtaaattatggtggctttaagggagaaaatgttcctctgaatgtgtttaaaatcccatgggtgtagctacttaaatgaagaaatctggtgagtacttagctatttaaaatttaattctttgcaggtacttactttacaagaagtattcttatatagagagattcatattgctataaatatgtacataatagctaacatgcgcttaccactggcagacactatgctgttatttaataggcaataatcctatgaattagtattattagtatcaccatttttcagaatttaagttttcagaggcaccaagagtttgaactttaagacatttagctaataaaaaaatgtggccaggatttgaatccaagggaactgaattttggagctggcactcttaaacactatacaatgcagttaaatatatgtagtttactgcccataataaatttttccaaaaaagagatggcttcttaaaaattttaaattagattcagattagtatagacacttgcaagtcaatgatgcttaaaaactaaactaaaaccctatgccagttgagtgtttatttcctggaatgtttactcacatacaccttatggtggagaggggagtttataattggccacagagcctgagacctaatatttttgaaatcataatatattttacagtacttcacaatttacaaagcatatttacatacattgtatcacatgaacctcaaaataatgctgtgaaatggggcagataattctgtaaacaggcattattcttaactttatagatgattaatgaggcttacaatgataagtcatttccttaaataacacaattctctcaaaatctaagatgttccaaatgactgaatgcattatgaattagcctatcataggctttatcatctgtcacataacatttaaaaaaagatttctcacaataaaccaaaataaaattttactttattttatttctgctttatctacaataaatattataattcaacagtaattactattgttgaactagcaaaacccacataacaaaataaaaatcagaacatgaaaagctatagtaaggagaatgagaacaagtatggatcataaaatccagaattaggagcgaaatggtccaaaaattatgagattaagatcaatgattacataaagcactcagcatttttgtaattacttaaatttgtaaagtgccttcaaaaatttgttactcttttataatccctaagagatcactgagagacaataatagcctttacacagcagatgaagaacattttgaaagtactatgaaattcagttattatttttgtttaaaagaaaacatcttgtgattctaaatcacaagagcccgaaattctttctgaatataagcaatgccatttacaaacattcctgctgcacccatcttctacaccccctgttgtaatgaattcgcatacctgcctccgattacaggctggattgccccaaagtagtcttctcagaaacctatctacacagttagcttctttctcttgtgcatcttcaaactctctttgtctttagcatcaacatgatatactttctgatatttcccatcttaaacttttattgttttttcttatctcaagaaaaccctgccttgactcacggccattcctccagttgtcacaattccatccctcttctcctttagaaagtcaaacttctcaaagtatggagaaaacaataaccatattttaaattggcaatcaaacttcaacttgctccatactggcttctgatcccctaatgctctccaaattcctcttgttaggtcgccaaagttaaatgaattctttttagtttctatcttatttggcccctccagctgtacttgatactttgtccacacctttccttcttgaaacctccctctcttggctcctacaacaccatgctctcttttctcctaaatttatggccatttctcaatctcctttattggcttcttctcaactactaaatgttagaactactcaggactctgggcttttactatatactccatttcctaggcagtctcatacatgccctgggctttaaataccatctatctgatagtatctctaatatagatctgtcttctgagttccagaacttagcaattctattagatgtctcctgggtattgcaatactcagtaagttcatatctgacagagaccttctaaactgtttatcttttaacctttcctatttcactaaatggctcttccaccatccaactagttgcaaatgctaagaacctaccatattcaaatgttgccatgccttgtggtgttcatactacttaccaagatatgtcaaatcgatgtcctcctcttcatctgctgtcatctccccagtcaaagccctcttatcttgagcacactgtttcaatagcttcctaactagtttccttctatctttgctcccctccaattcactctccatacagcagccagaattattgtttaaaaatgtatactgggtcatgtcctgcccctaagatacggaaatggctctttcttgcatatgaaatccaaatgcggccttgcctgaatctaatcctgcctaggtctgcagcttcagcttgtgctactctagccattactcctatgtttccatcatgactgattctctttcagtttctcagattcaccaagctctttgcatgtgaattgggagtaaaatcgtccaaaaattaagaggttaggattaaatgattacatgcctttcctttgcttagaatgttgttccacactccccactttggcttcaagactttgttaacacagttctgtctactgagagtgtcctttccctcatctctgcctgatgaagttctattcatctttaggactgatcttaaatgtcatcttcataaagtcttcctggtcaaattttccctgtaagcatactgagttacttttttctccatatacctaaagataattttgcatatgtctctgttataacatttatcaccgtactgcaatcattttttaaatttctgccacattagaactgtacaatatgagatacgtgaatataggactgggccttctttagatccccaaatttagcaggtgcctaacatcatccaatctgtcacccattaatattgctttaagaataagagccatcttacatggcaacaaccactagtgaagattgtatttattaacttgttagtgtttgtcatcacggtgacatacacatattcagaaaaatgagtcaatattaataattaaagacgttactgtgatgaagtttcctgaaatctgagctcatctgtatacccatatccaatgacttgaatgtctcaatcaattcattggctagcacaattctcaagccttattagggaccataatttctatggttgacatcttaatgctgagtaggagccggaagctttgtggactctcaggttcatgcacctgaaagtcctgtgcttaagtgtgtgcatgatcttgctcagaagcaccaagaacaggggtgagaagagagaatgtagaacatccattgttatacaagaggcagtgacaacagagatggcctatttaacttacttcaaaagcctttaattctcaagcaccaggaaaacaattttagagctgactacaatagatcttttgctagactgttctgaagactagttttttagaaagtaaaaccatattaccagaatattaatccacaataaggttgaatacaatttgttaaagaacagactccatgtactattacaaaaatgaggtctgacctgaaacaccatccatttgaaatatttaaaaataaaaatagacaactctcttaaggaggttttttaaagcatcatctgatatctacgctatgataaaagtcagcatcaagtttaaagaagtgaaacaaaacactgtcaccatgcccctatgagctaaaactttgagaattataaatggcggatttaacaatgataacctttccattcttttgccagacgcgaaacaaattatgctagttcctcctctagaatttcttgctttttctgcctatgaccttctcagctcacccacaagcagcaccattcattgactgaactgttatttgacagtttgtcataatcaaatacggtaagcagagtatcacgatgttctagttcactttaaagcaaactatttaggactataaattccatctaggccttagatacacttcaaggcaaaggtagggatactgggcagagaaaacaccaagatttgacttttactccaacatgtacctaagtgtagactggaagtttgtattcaaaacattgggggagaaaagtttaatgttacctgtgtattcaacatataatatcctctgttttatccagataattcatcaaaatcagaggcatgcaaggaaggtgagaatcaggctgtgatttgcttacagatatgaaatcttgggagcaactcagtccagtgaagagacttttattgccccacaaactctaatattgggcagacttgggtttttactggttaggtgatgaaaagtccaaggtaattatcaggactaattagaattacaaaggacactgacacggggtcactgtaataaagttatactttatatttaccagcagtcttagacggctatgggtaaatgttctggctctgcggccccctgaaaagcaggattttcattccaacagaaaaaggaaaaaaactgattccaggtggaaccaatgttgcttccccacccttttttcagttcagagttgacaatcatgttataaaatgaaaaaggcaaatgcatgaacagattttagtgttgcataaaacaaaacttaccacaaaactaatgtggctttgttaatgatatgaataatagattctgggtaaatggtaattattcataattaatttcatttcaaaaacagccatagccaaaattatttttacacagtcaactcaaaatgtttccaaattctctaacatctataaattaaatcactcttgatgatttccactacaaccatgcaaggcttaatacttttacaacaaaggaatttagaatatgtcaccccaaaatacattactctggcatactgactattttgagtaaaaggtacttgaaaaacagcaactgcaagaactctctgacctttcttcttcataaaagcaggaaatgaaattcccgtgtgaaagacagcctccctctaccagaaggaaagcatcattcttatcatcaaggacgggaagctgagaccgaggaaaatctgtacaaacaaaccttgttaagctaacccttatcttcctcgttacttctctgcccaattacctactctgcccaagctcctctgccttgtcacagtttcacaatttactactctttcgccaaaagagtagtaaattcagtatataagttttcaattctaactgcatctgtgggtcttcatttccttacaaaggctccttgccatgtaaaattcataagaaataaatttctatgtttttctcctgttgatctatctatgtcaatctaattcttaggcctagctgaaataccccaaaaactggtaaaggtacaatttcacctcacctacaacacatacatatcctttaaaaacatctttctcaaccccaactccctagcagccatggtgcaccctcaatgtccgtgtttgagaattaagggttcctgagcttttctcctctgcaaatcccactcatgggtccttcaccaaatgtccattagcaattcattcagccatttcctatctcagtctccaccagaaagggccacccctgcagctctgaaatgcttgaggggcttgggaagctgaaattctgtggtataaggtttcaatggctagcctcgcataatcatcacacttggcggggggggggggggtgggcgggggggggccctaatgaaggcaagggagagggaagggaaaggacacagagaaaagccttcaggagtctgtttcagggcatctcagtcttggcactaatgaacgtttggtggggtcaggggtaattcttggttgtgaggggctgtcctgtgctttgtaggatgtttagcagcatccccagcgtctattcacaagatgccagtagctttccccaagtttggacaacccaaataaatcacccctggttgagaaccagcagtctactctagagtcttgagcatagagaggtataggaagaaaattaaacagaggaaagaacctgaattcagacagacccctgggctatgtgtagaagaagcaagtggctcttggtcacatgctgctctttgtgaacatgactcaatgtagcggaaatttgagagtgagcacaaggacaagaggaatggaagtcaggaaatgagaggaatctgtaaggaagaattccaacccaaatactctgcccctcactcacaaggtgatccctatgtatctactgaagagtactcaaactctttttcttaaggcgctggtttataaaggccatcaggaagcagactgagatttgggggtggggtggaagaaggggagttgggaggtagagaagggtttcccctacctaaactaagcttgggcttaagatccatcgagttcgcctcccgagcagagcaaagaactgaaacatgcgagagggttgctgtgaagcattttagccaacttttccaagccagatgcctggagttctcactgaggaagctggcagaacctagaaaaatccttattactccctcaaatttgcagagggacttcagatgactaaaactagctgcaggaaagaaaaaagacattttcttttctgcctagccatttataaagttttttaacttgcagaaaatcactgaagttctttcagtttcggagcctctaaaataaagtggaaatactataaacacatgtcacagagatgttctgaagattacatgagaccacagatgttaaagggcctagcacaaaggtggcataggtggctccctaccctctgtctctccttcatttttagttttctttgggctcatgcaccacatgcccacatctgtgccaccagagctttctctatctgctcttatacactatatttacgagcttctgtcgttatcttgttctgcgattttcctctctccctatgttcctgatgaggtggcagtggtacttgctgctaaatacatctaagtcctttcatcactggtgacaagagttcatgtgagaggtagcagtggagaagatgcaggaaaaagaatgccatagtgaggatgacatacttcatcactgttttacccttggcagctctcactccacctgcatgaagacatgaaaaaatctctttctgcgtgatagtgcaggtgtgtagtttagcaggaaacttgacaggcagttaaaagacaaagaagcggccgggtgcggtggctcacacctgcaatcccagcactttgggaggccaaggtggggcggatcatgaggtcaggagttagagaccagcctggccaacatggtgaaaccctgtctctactaaaaatacaaaaattagctgggtgtggcagtgggtgcctgtaatcccagtgactcgggaggctgaggcagcagaattgcttgagtccgggaggtggaggttgccgtgagccaagatcctgccactgcactccagcctgggtgacagagcaacactccgtctcggggggggggggggggcgggaaaggtgaagaagcatatcaggagttcagcttttgctaggtcagagaaagttcttaacagactaactcttttgcagataataaactgtggacaaaacacaaaaaccaactactgaagtctctaaagaatgaacaaaaacacattcttccccctccacaagaaaacatttacaatgtctgggatgtaatccaaaattacttgacatatgaagaatctggaaaatgcaatccacccccaatggaaaagacaatcaacagaagccaaccttgatacgacccagatatcagaaataacaagactttaaagcagctataattactgctgaggtaagagaagacatgctcattatggatgaaaagaatgggaaatctcagcagagaaactagaaatataacaacaacaaaaacaaataggagctttaaaacttgaaaaattcaatatctgaaataaaaagcttactggataggcttaatagcagaatgaagatgacaaaaaattgattggaaaaaggtcagtgaaaattacccaatctgaagaggagagagaaaaaaatttaaaaagaaagtgtttcaggaccctctgaagtcccagaaggtggggaatgagagaaagtggtgggaaaaaacatcagcataaattatagctaaaaacagtcctaaatttggcaagagataaatttataaattcaagaagctcatgaactgtaaagaagattaaaaacaacatcaatcacaaaaataaatgcctaggttgatagaaaccaaaaataaaaaagttgtgaaaggagacagagagaaaaaaacatatacagggcaacaattggaatcatcggacttctctttagaaaatatgaagtccagaagacacctggaacaatattttaaactttctgagataggagaagcacacttcactttaaatataaaggcacagacaggttaaagtaaatggatgtaaaaagagcatgcaaacagtgaatgattatcgtactaatattggagggggaagcatatcacctgcctagctgccacagtatgatttcaaaaaaaacaagaacattcaccaagaacaaacaaaaaaacctcttcaaatagaccatggaactgaattcaaacttgtatctgataacagcgatgacaatatctctctataacaatcctgaccagcatatatcacaattactacagaggctactgacaagaaatccaaccttggtatgctgtacacgactgtcctcccaccctcccagtgaaatcaaacaaaattaataatagtctactacatcagagggactccatttgggggaaagtttcaggctatgctcttgcctcaaaattggtggggaaaacacatagacatatacatacacacaaagcaaatacagcaaaatgttcaaaattgttgaatctaagtagtaaatgttaagtgtttattgtactatttttcagctttttgaatatattaaaattttttatactgaaaaaagagaaaaattagccagaagagctttattcaaaataccttcccctctctttccttcacattttgatatattcttgttggggaggtgtatcaggatattaactgtatcttttgatacgaaaaaaagtcacatgattctggtatatttcaaccactgctagaaaatccacatggataaatgctagaatgagggctaggactttttctagtttgtccattactgcatctagtatattttcaaggaaaaaatgttcaatgaataaatgaaaaatagctaccctagatgtttaataaaaaagacatctgcacttgtatgtttactgtggcacaattcacagtcgcaaagatatggaattaacctaagtgctcatctacagatgagtggataaagaaaatgtgttatatctatatcatggaatactactcagccataaaaagtaacatcttttgtagcaacttggatggaactggaggccattatcctaagtgaagtaactcaggaaaggaaaaccaaatactgcatgtttttacttataagtgggagctaagctacggatatgcaaaggcatgcagagtggtataatggacattggagactcagaatggggatgtgggactgaaaaaatcacctactgggtacactattcgggtgatgggtacactagcagcccagcttcactattatacaacttgcccatgcaaccaaaaaccactagtatccctaaagctattgaaaaaaaaaaaaaaaacttagtaagcctcctagactttataatctcaagacacgactttttaacataaattctgaacattatctggaaaaactgttgactggaatacgtttgtttggtattttttcaaggatagaatgatgttttgataatcagacttctcctttacttgtcacttagtaaccttctatactaaaaaaatttagtcattgaagtgtaacatgtattcaactgaagctagttgaattctcacgtttctcacactccccttgagctggcatcaaagattaacttaaaaggtcatgaaggaattcaaattcaaggaattcaaatttccagcatgcccatcttgacactttgaaataaatataaacacatcctgatgtcacttcattacagcattcccttcccaaggagctctaaaaagaaaataacctgcaggtgaatttttgacatgcaagtcttgaagataaaacaatatagcattcttccagatcagttatatgctttaaaagcattatttctccctgaataaaaatgaatccaaaggctgtgattcctaagaacaactgaagttaaagctaaatgttctcaaaacaattttacatagctcattctaaatgttctttaccaacttttaaataagaatgacaaataagagacagtcaaatgtttttatggatcttctgaataaactacgtaaagataaaaaatacatgtaagtataaaatacaatttgtaaatgagggccgggattagcaatgccaggatggataaagacatgttttctcgcatttaggtaactttgtcccctatgagatgaccctcagaagttgtctcgacgtttgctcagcagtgatttgattcaatgaccaatattcaaacagcactcccttagagactctacgcatgacctctgactgcttggtgcctaactctccacatatgtcaaacagagggaagaataattgctagctacctcccagcaattctagaagatttaatgaggcagggagccagacctccatggtgagtcaattattccctgggtagaagttatgttatttgtgaggtgccgtatttctaaggataacagagtattgtacaagcattacaaataggtatttctcgattcctcaaagtgttgacattaaatctttcagaataatatactcacctagtaacaaatagtctaatattttataaaacagtttgaatttgatggaatgaaagcatacggattttataatgttgtttcttttctgattattagtgagagagaacaatcttttaggacaaatgggtttaaaggaatagacagataagggagaagctctctaactgaatccagacctattaaaatggcgaccaggtaccatgacctatgtatttcattgagctggggccaagtccagagtccactaatttcagcttgctcaagtcaaggctaggatgctgccgtgatagaaaagatatggaactgctgaagaaatgtaattcaattcttataaagaaatggggcccaatattaacttacatgattaatataacacacataaataaaggcagtaacaaacacttaattttggattagtgatgtcacaggatctttaaatagttcatacaggatggtcatgctctcataagttaaaatggagaaaattgattttttacaccagattagccacacaatattaatcatataaaatgtttccctgaaagtcttggcataaaaatgggccaatgtgctctgttttgcctttttccccaaagtaaatttagatgggggtgaggagggaaaactttagaaagcaatcacaaatttcaaaatcaataaattcaaattgtttttaaggcagtaaatacatagtcctgccaaatgctgcaggaaattgatgtacaatctgtctggcagttggaccatgtgaaaaaattttaaaaagaccttaaaataaccaagattctgaaggctcaacaaactttgttttagtaagacaattttcctggtccataaaaaagataaggaagtaaaaggtgggataaccaatttaacttagggtgtggtgaattatcttgggtatcttaaattggtacttaatttggtctgggctcagaagaaatggtttaccatggtgattaagaccagctgctaggtgtcatagatttaaattatacaacagaacacaggagtgtgtttgaacacagacgggtaggacagtctccaaaaagctaagagtgccacctctgttcagtgaaaattaagtcagttttttactaccctttaagagctgcctccactgatttggccttgaacatagactgaatgagaagatttagtttcccaacacatgtgccaccatgacttaaagacttaatactaagtctttaagtattaaagacttaatactaagtccactaagtagacttagactaaagtccactttagtctaagtcccacaatttttcagaaagaccaggaggccatttaaacaaagaaaataatttctttcctacaaaaatcaggggaaatactaacctttgtcattcaaaatagttttagtttgataccaaagtatccttattaacactttgagcagggacaccaacatattttattttattgttcacttagaagttataaaagtagtctacattaaatgaaaaaattcaaacaataccaatataaaaatgtactaaatagtgtaagttcacttttgactctgaacccccagctaccaaactcaccagggaaaactactgtgatttgttgaagtgaagggagcgaagagtccacattaaattagaatataacagtacaagtttatggactttttacatcaatatatgtactttcaatgtgactaaacgatttcaccatttactatgctttttctttttcaaagtaactataaagacaggtacctttggggaagaaaaaagaaaagaaaaaaagtaaatataaagaaaacactggaactagattttcaatggtgcagttaataaggattagaaaatactatatataatagaaaatataagatttaaaattttaagatcttcttgttatgacaaataatatctatatgcataatacacatatgtacatgtgtatacatacatatacacaaactacatattacagcatacaaaatactgagtaacacaatgaatatgatctttttggatattcttgaaaaaagtaaacttcatcatttgatttatctagaagaattttattggccgggtacggtggctcacgcctgtaatctcagcactttgggaggctgaggtgggccgatcacctgagatcaggagttcaagatcagcctagccaacatggtgaaaccccatctctactaaaaatacaaaaaattagccaggcgtggtggcacacacctataatcccagccacttgggaggctgaggcaggagaatcacttgaacccaggaggcagaggttgcagtgagccgagattgtgccattgcactccagcctgggcaaaatgagggaaactgcgtctcaaaaaaaaaaaatgtatttataaatctaatgctttagtggcagaccaggagacaacccacatacaagtggtcaatttgaattttatctagaaccattactgttgccctgaaagccagattcactttagtcagctaaattttatggagtgtgttttataaacaaagcattgtatgaagctctagaaaatagtcagcagaagacagtccttcttctcaaaggctttccaacacattatcaagaacatacacagtcacaagcaattacaatttgaaagtagcacacagataaagaaattaattaccactggtggggctggagaccgtttaacagaacagataggtttaagctgggtaagatttcaactagcaacacaggaatgaagggtgcttgaaaacagcacagaaaggcacaaggaaatagtacagacaattgtacaagtaaagacaaagaagtaggaggctgccatgtacatgtgaaggataatgaagtggcagggcaagactagagttcgggggcacagagaaggcaggaatagaagatgagcctggagaagtagatgggggcagattttggagcctattagctataaaccaaaaaatttagcatttatattacagaagtagggggccatgaaagtctcaaagtgaatgacatgatcagaataatgatgcatgagttaaaatggaaaagaacagttaggcagagtacgacccatgacaaagctccaaagaagaggtaatgttgcgtagattaaggacagtagcaatgaaaactggataaaggaaacagaccgaaagacacattctgaaggcaagttgacataaggaaaagatcttaggccccaggctaaagatttgaattctggctcctccaactatttgccttttggcgttgggcatgtttcttagctcctttaacatatagtttccttatctataaaacaggaataatgcacttgcctgtgtgtgggggaaaaaaaactgtgagaaaaatacagaaagttgtctagataattcatgtcaacacacttatttattcaacatcatataatgataaaaagaataaaacgtagccccaatctggttggggaaacagacatacaaacaactaaagtgacaatgatctgatgtaactggacctatattaggagtaagatccaacagaaacacagaggataaggtgtgtgtaaagccactaaagaccgtgtaaaagtgctgaaaaggttcaatgaagttccacagaggtgatgtgtgaaccaggctactcacaacttttaatgtttcttattttcacatcaaatcaccaggtccttcaccacataaattatagtacacaaccccctaggacccagtggtatcatttgaattctggagtgtgaaagtccaaaggaaatggtggaggaaaaaaggggaggtgaggggagaggaagaaagattagaggagtatgaatgaattttaggcaaataacttctcaggaaacaatacttgaaagaaagccagataatacttagattctcagtgtgatacaatattaaggcagcaaaactcaaatgaaagaatgtaatgagttccaggtgtcgtttagtagatttttttcagtaggtgaagttgagttgaggtggctactgtcagtgtcaatgccctgtctgaacaagttttaatttaacttcaagcaatacataggcttttgtttagactgtttgcatatatttgtctactgctgctaagaggcaaaataacctctttctcgagaaagtgagataaaactatgattgcaaaaatgtttattttttaatcttttcatgaatcaagtaattttatctaatttattcaacaaatatttattgaatagttactgtgcataaggcccagtggggaatatgagagaatataatatgatatagattttatcaccaagaaggtctgagtctcataagttcactataaagtagaaggtaataaattcaatgagaagtatacagataaagtgccacacagtataaaggaaggagattactttgagctgggaggataaggatttggcactggcactaggacagaggggactatgttgtgttactcatgcaacaaacatttactgagcacatacaatgtgcatgcacttacctaaatgcaatgagactttgaggtgatttagtccaattccttcacttaattcactagaaaatgaaaactcggaaacctaaatagctaattcaaggccaagatacaatttgaattgatatctccagtctgcaagtccaataatttctactacttaccctgtcacctccaaaactcagtctaaattttttgtcaggtacaatcattatttcaaaaggcattccattccacttataaattaatttgttataaaatgtgttttctaacatttagttaaaagttgccttcatttttaactaaaaatgaagtggctctagtggctccccctgtagttacacagaacaaatagaatcctgtggccatgtgatcatccttcacatatatgaagacaatcctcacgtcccccactctagtaggcactcagtaatcactatagttggggaataagctccggaattagatgggcctggatgtgaatctcagcttcaacattcacttggtgtgtgatcatgagccaagttacttaatttagataatctgtgtgtttatttagacaatgggaatgtttatgtccttcatgccttccattcaacgtaatggccaataactatgatcaagaattggcacaacttttggtgtaactgtcagaacactagagtttctctatacacattaagctggcactgaatcataagaggaaaagttgcaaaactgaaaaagatggcagcacctgtctttctctcccacttctcttcctctctggcataactagtctgtgagtgacagctgtgaaatactaaagactgggcgacatggcttttccagataacctgtgaagaatggtgaagcatggcttcatcaaatgacctgtgctaatagagctgctggcaaaagtgcagtcattttattgagataaaacattgaaaataattttcataaaataaggcacagatgctttaattagaaaaaaatgtccttgagggtgggattcagatgcagttttataacttgtacggtgccttaaatgcattaaaagatagacaatggtacaaggactattctccctagtggtaacaaaactgtttcctagttactagggtagggtagggaggaaatgaaaggaagaagagaaaatctagagtttattcttttcctgcttctaatgttataagccaatgctaatgtttagtagtcacaacctcgtctgctaggcactgcaactaatttcccgtatttgggtagaaaaaaatgcatcatgtctcaaagaatgaactactgacagaaatttagtgactgatactaaaggtagatacgtagctgcagggtatgagaaagaggagacacagtcctaaaaataacagcaaaactaagatgaaaatgcagagaagtggtatggtacattggtagctatcccctaatatctattctacctttcttccatagaaatatcgttttagccaggcatacagtcattcggaataaaagcaacactttcggtctctattgcaactacatgtagccctatgaccaagtactgacccgcattatatggacgtttctgggcacctttctcaaaagatggctggggcatgcccatttcacccctttctccaaccagctgcctgaagtggagatgcctccacctttgaccatgaaactgagagcctcaccctaggcatggtgagtggtgagctggaaggagtggggctctcgatgcagaaactgatttttccatttttgttaaacaatgctgtcaaaaaggccctaaaaactatcttttgcacatatctatttccttagattacattcctagaagtgagtgagaggatatgaaaacataatctgtcatggaactagagttaaaaaaaaaaagaatatgaaaacattctaaagctcccaacacatatggtgaaattgttcttctgaaagtttaaatttacatgttctctacatgccttcccagcccaatgtcaggagttaattttatcattaattggtaagagctctcttatattaagggtgtgaataccatgttataaatacctcttcccaattaatttacctttcaatttagttactatttttgttgttgtgcagtaacttaaaatctttatgtaataaacctttttaaaaagtggtttctgcccttactattatatagtaaaaagtcttcccacgtatcaagattatgtacatatccacctatattttttctattacctttttgctttcacttaacctttaatccacatgaaatttatttttccacacatttagccgattgtaccaacaccaagattccacacattcaataatagatgctattgaatataactattcctaataactgaaaattccacttttatttattctgatatcttgaattagtattattagactgttttaattattgtggctttagaaaaaaattttatactcacttatgcaattaattcacattatttcttttttttacaaaagtgtgtttggtttacacctctaagtgaactttagaaacacattgtcaggtttggcaaaaagaaaaaaacacctgaaattttaactggaattgtattaatgatcaatagagagcaattggggtagggaatgcataactttaaaacattaactctccccattattcccacaaatatgagatgtttccccatttcttaaactgtttttatgtcccttatgttctatagtttatttcttatagttagtcgtagagtttacttgcttaaacttgaggcaagtttccttagttacagatcttttatttatatttgtgctattataagtaggatctttaaacacatacttgtctgtgctggtatagaggaaacactaatttctgaatttattttgtaattgaccatcatcttactggtatgtttttaataatgctcataagtgttagttgattatcttgggttttctagttagataactgtattttcaatttcaaataatgatgacacttctcacttcctttgcaatatttaaacttcattttcttgtcttattgcattagacaaaactttcaaaacaatattaaataatagaggtaatagctgacactcttttttccacccctgactttacttcttaggacattttcctattttaacccataaaacagctgcatcgtatcagtctttcatctgtttttacactggtcccaacccccaatccctaactatactgtaagttccttgaaggcaaaaactgtgttttgctaattttttaaatcactgtagcatccagcacagtgtctggcacagagaaaataaatcattaaacggatggttctcaaaactggtgagtcactggaattacatgggagcctttgaaaaaaaccaactgcaagtttcacaaaccatttacaagtcagaaattccctgttcgtgggggtgcgaatctagacgtgtcaaaagcttcttagatgatttctgacggcccacaggtttgagaaccactagtctagtatttttatcactcccggagattctgtttcagagtcaggggcctgatttttagtaaatcttcctgagatgattcagatagaagcaggtttggaaactactgggttagacagtaattcaaagaagggatcagagttttatttttttcctttatgttgtctgtatatttttcacatacaaaagtggaaaagatagcaagatatataaagaaaaggccaatctctcctacctctatcttctaaaagtagccatttattactgtgtagtggcatccttccatccctcttttcttgcttacacaaaataaacacgagagagagagagagagagagagagagagagagagagacagagagagagagagaagtactctttctgtttttattaaaacaatcagacacttattttgtaatttggtagtatttaaaaaaatgttatttcaaataaatgatgatgaaaccaatatctgttctcttgtctatatagatttaaatttagcgatgagtataaaaacattttcatttcatttttaattctttagcaggtataggaacaatttgggaagattcacctaggaaattttttttttttttgcgggggtggggcagggacgaagtctcactctgtagcccaagttagagtgcagtggcacgatctcagctcactgcaacctccacctcccgggttcaagcaattctcctgcctcagcctcctgagtagctggaattacaagcgtgtgccactgcacccggctaatttttatagtagagatggggtttcaccatgttggccaggctggtcttgaacgcccaacctcatcacctaggaaattctaaaactatcagttaatatactaaaggatatgggttcataggtcaaacagcatcttaaaaaccaggaggacagtattaatacaggaaggctaaaaatggcatataaagccttcttttctatacttataataaagtaattaaaagctacaaaaagaaaaccttttatgttacttatgcttagctattactcattttttagataaaagatatttttaatacaaaagcaaaactaaggcacaactgatctccacttacatgctttaacaaaacataaaaggcagcactcaaatgtacaccagaaataaaaattctaaaatagaactactaataaaaggaatgtaaattactggctaagacagaaacatcatattttagaagactaagccatgattttggtgaaatcagtacatcattcgtttgttattattaaattttcataaagcatctccaaaaagctcaatgacacacactaataattgttaaataatgcaaatgaatacttctaaattctccagtactgtaaattagcagacagtgtgggagttgcagagaacaatgagagagagaagtaaaaacaaagcaagcagtaatatgatatcttaaattaagttgcaatttctgatttactccaaaaggatctttctgggcaggcaggatttaaagagttttaagaaatgatgtctttctgcctgtcaggagtgtgttagaagtatatttaattctgtgaagttggaataggaaagagaacatgggggagaactaagttaatctagaagaggtgtgaaattggagaaaggcctaaaaatcaaatgcaaatatgctgaagatagtaataattttaaaaaggaaatagtttaaagaaagggaacaacattcagtgtggtaaagaagtggtattaaaaatagtgttttgtatttttttttggcaggaatggaatggattttatggttagataaatcaagaagacctacaatggcagttaagatttgaaattgctagatatttggcaagagaactgataaaaagagaggggagtaattatcaggtgtcacccacaccctgaaggctgcacccactcttatcctctaattcctttgacccagagtaacacttctccctcttcctgtccagatgtggtttctctactagtgctctaggtcccatcccctcctctttccttaggaacttcattccattgactatcttcagtcaatcctccaattcctgccattagctctttcagcatataaaaatcatcaagtatgccaggcatggtggctcacacctgtaatcccagcactttgggaggccaaggcgggaggattgcctgagcccaggagtttgagaccggcctgggtaacatagtgagacccaactctacatttttttttttttaatttgccaggcatggtagtgtgcacctgtagtcccagctacttgggaggatgaggcaggagaattgcttgagcccaggaggtcgaagctgcagtgaactgtgtctgtgccactgcatttccatcctgggcaatagagcaagaccctgtctcaaaaaaaaaaaaaaaaatcatcaagcgtttcatatctaaaagcaatataaaataaaataaaaagtttctttaatcttatgttctcctttaactattatatctcttcttttcacaagcaacttctaggaagaagtctacttcttccctccttgattcacttcccgctctgaagcagtctggctttaggcgtcaccatctcatggaggctgcttcacttaaaagcaacattgatctccttaacaccttatccaatcttcgggttttagctctcctatgattcgatcttgctgaagctttttacacattcatttcctctttcttgaaatgttctcctccctcagtatctaagatgtcacattcctttctctgttgttgctccacagggacccatctcagtctaatattattctccctctatactgatgacttgaactataccaattaaaagatgactcacaatccagaaatctctagcccagatctctgtggaactccaattctggttatgtctaagaagcatctctttctgaatgtctgatggtacttatataaccaaaatgaattcatcatattccaccttaaaaagtcactattccttaaattgaatggatccaccaacccctcttctctccttcacctagttattcaggtaatctgggacttatctgagatcttccttttctcttacttcccagatctaatcactaaggactagagattctctcaaaactgtcccctaatatcaatttcattgcttttgttcatttctcatttggactatgtcatattgcaacaatccccttaatgatttctctacttccaatctcaattttttgcaattctgtttcaagaggtcagcttgctgtaatttttcaatggctttcagttatccataagcccaactcccaacctccttgtaaggtataaacgctgctgcctactctccagcctcatttctaccactttccaactcaatttcatgctctagcaacactgaacatgctttcttatggctagtccttctgtaaatactgcagcaccattttttccacttgtctatctggtacattcttactcattcttaggtatctgtttaaatgctaacttctctaacagcatcccttttctctcaggtgaactttggtgttccttatatattcctaactgtagttttgaagactcttccattaaacaatgatcttattgcattataattgtttgcatgggcatcttaacttcttaactggcttagattagggaattaaaatagacattggctgggcacagtggctcacacctgtaatcccagcactttgggaggctaaggtgggtggatcacttaagaccaggagttcaaggctgcagtgagctataatggtgccactgcacactagtctaggtgacagagtgagaccctgtctcaaaaaaaaaaaaaaaaaaaaaaaaaagagagagagagattatgaaaacatttactgggagacctaacccattttttgcttcaggaaaccaatcttaaacagtgccaagaaaggcaagccaaagacagtggatgaagacagtggtggtgatgctggaaaagcccaggcaaactgaagcacagctactgtggaagagagaacagcaggaaaaaactggagagacaccaggagcccaactgtgaagggactgctaagagaaggttcagctttgtgcttccagtcactgattcaaactttcttcatgaatccaaccactaaattaaacaccagctttctaaaagctgcacattctcatactataaaagaaaatatatttcaaataaaatactttccaggctttccagaagaaaaaatccatcccatgtcacccactgtgactaagcacggaggaaacagattaaattagggatattttgcccgtacatctccaggctgcatgaaatgaaaacaaatgagagtcaggactctcaaaagtttcacagttctaaccatcaacgcaatgtgccaagcaacatagtaaatgttcacgtttcaaacaggaggaatacattttaccttttctatctgggatagaagattagattctaatcttttttggttttccactcagatgagcaccttaagtgggatcatatttctatattacaggtacttttttttttcctgaaagtctgtgaatacttaattcaaaggccatggacagcaacctagaggagctctgaccatgaaaaatgttttataaatagttccatgtgcactgttcatctggagtctcactagagatggataatgaccttgtattttgtactcatttactctgaattagccaaaccttctgtttttaattacatacttaattcacctagcatggtctaattacataaaacaaaacatcatttaaacaaaaggtggccttgaacttaatctatcaaaacaccagttagtttttaaagtttttagttcttaacaaactgccaagacatgcaatagcaattttccaaatgtgatcatatgcttttatagcaacagatttactacataatcaaacatctgtatatacttttgtctcactattaatgcaaatatgcttaagttttgatagacttaaaaatcttaaagctgaagttcatactacacaataatttttaaatatccatagtcattttggccttgaaatgacaagttatcataaccatggctacttatttacaaaatggtccagaactttgtaaaaactcatgttcagaattttccttaattcttcacagtgtaaattagtagcccttctctgtgttatcatagcaccttatatattttcaatcacagtatttataatgctgaatagttattggtttaaagatctgacccccaactagattgcaaacttcatgaaagcagagtttatgccttttatctctatcttgccaacatggagcacagtgcctagcacagagcaggtcctcaatatatatttgctgaattaatgtattaaaatacaatgttgtaaaactatctcaatttatgaatatgatcttatatgtagaaaatcataaggaattcaccaaaaaattattagaactaataaacaagttccaaaaggttgcaggatacaagatcaatatataaatatcaattgtatttctatgcagcagcaatgagcaaacaaaaatgaaattaagaaaaccaattccatttacaatcaaaaccgttaaaatattttgtaataaatttaacaaaagaaatatacaacctatactctgaaaaccataatcctcaaattgatctacagaatctagagatccaatgcaatccctatggaatcccagctgacttctttgcagaaattgacaagctaaacctaaaattcatatggaaattaaaggaattcaaaatagtaaaagcatataatggaatcctattcggccttaaaaaaggaacaaaatttgtcacactacaatattgatgaaccttgaggatattatgctaagtagaataaaccagtcacaaaagataatactgtattactccatttatatgaggtatctaaaatggttaaattcatagaaacagaaagtataatggtggttgccaggggctgatgggaaaggggagctgttatttagtgggtttaaagtttcagatttgtaagatgaaaaagttctggagatctgtctcataacaatgtgaatatacttactatttaactgtacacttaaaaatgatgaaaatggcaaattttatggttttttttaaccaaaataaaaaaaatttttaaagccaaaacagtcttgaaaaagaacaaagttggtggacacacacttttcaacttcaaaacttactacggagctacagcaatcaagacagtgtggtagtggcatgaagatagacatatagatcagtggaacacaattgagggtccaaaaataaatcttcatatttagagtcaattgattttctagcagggtaccaagataactcaatgagggaaagaataatcttcaacaaatggtgttggaacaactgaatattgacatgcaacagaacaaagttacttctatctaacaccatatacaaatattaactcaaaatagatcaaagacctatatgtaacagctaaaactataagactcttggacgaacatgtaagtgtaaagctttgtgacctggagctacacaataattttcttagctatgataccaaaagcactagtaaaaaaaaagaaaaaaggaaactggactttatcaaaatttaaaaatgtgcttcaaaggacaccatcaagacagtgaaaatacagcccacagaatgggagaaaatagttgcaaataaaatatctgataaggaacttgtatgtagagtatatacagagctcttacaactcaataataaaaagactaataaccaatttaaaaatgagcaaagggtctgaatagacatttctccaaagacaatgtgcaaatggacaataagcacacaaaaagatgctcaacatcatcagctattaggtaaatgcaaatcaaaaccagaacgagataccacttcatactcactaggatgactataatcaagaagatagacaatagcaagtgttgcgaggatgtagagaaattggaaccctcatacactgctgacaggaatgtaaaatggtgcagtcactttgaaaaacaacctgacagttcctcaacagagcatttccatattattcagcaattcttctcctaggtatactcaagaaaaaggaaaacgatgtccacacaaaaacttgtacaaaattgttcacaacagcattattcataatagtgaaaggaataaagtgttatctgcacttcatccttacacggcctcatagtattccatattatgtatgaacacaccacattttgtttatctgttcatcaattgatggatatctgggttgtttctacctttttttttttaaaagctattatgaataatgctgcaaacttttctgtctttaaatcctgacatgaagatctgggctgaggcaggggtagaggggtagagaaaatgcctatcatcaagttcttccctatgtctatggcctagatggggtgggtgtcggatggtgctgaggcaggaagaggagaggagaactctcagtaagttgctaatgagaagagatcccagaagctagttcctgtgttccattctgcagtaacatgtcctctctaccatgagtgatacaataggagaatgggtgaacactcccactgtggtagatcctaagcaaagcatgacatggccctgccctccaagaaattttgtccataagataagtcactatttcatgttactgtaataatttttgtcattatctggagcaaaaaggaggatcttttgcaacaaaagagtttatgaacctaaattgctcttgtcaagatcaccaatgacctccttgttgctaaatatccaatagtaaattataagtcctcatctttcttgggcattaacaaaatctgaaccagctgatccctctttttagaacactttcttctcttggcttccagaatatcacactctactagttattttcctacttcgctgatttgttccttatctgtcccctttgctgattcctcgtcttctccccaatctctcaatgttagagtgccctggggatcagtccttaaaccatgcagtgagctgaataatggtcccttgagataccatgtcctaatccctagaatctctgaatgttacctcatatggcaaagactttgcaaatgtgattaaattaagtctcttatgatcctaagaatggggagataattctgaataacttggatgggccctaaatgcaatcataaatgttcttttaagagggcaggataggaattcaaacagaaaaagacaaccttggaagcagaatcagagggaaaagatgctacactgctggctttgaaaatggagaaaagggctatgaaccaaggaatgcaaggaatacagatctagatactaaaaagggcaagaaactctagattctcccttaacagtctccagagcaagtgtggccctgctgaaaccctgatttagccccataagacttagtttggatttctggtccacataactataaaagaataaatttctgttgttttaagccaccaagtaagtctgtcataatttgttatagcagccataggaaactaatacagattttggagcctggaagtggggtggtacaaaaacaaaaacctaaaactatgaaagtggctttggacttgacagtaggcagaggctagaaggagtgggaggtgcatgatagaaaatactcagattgcctaaaacagatttttggtagaaatttgaacattaaaggcactgctggtaacagctcagaagaaagtgaggagcatggtagagaaatcctaattcatcttggagaacacatatatcatcataagcagaatgttggtagaaatataaacacagtaaagatggtactggtgagggctcagaaggagatgagcaacattttattagaaactgtaggaaaggagatttgtcatatagtggcagaaagcttagctgatgtgtgtcctacaattatatacaatgatgaacttagatttagatgatttggatgagatcttggacttttgagctgattatatttaggtgagattttgggttgaaactgaaatgggttgaggcttctggagatactgggatggggtgaatattttgcatgtgagatagatgtaaatccttggagacaagagggcagactgtggtaagctcctcaagatattcatgccctgatgcctggaacctgaaaatgctacctcatatggcaaagactttgcaagtgtgattaacttaagcatcttgagatatggagattatcttggattatctcagtgggccctcaatacagtcacaagtgtccttagaagaggggaggcagagaggttttacacaaaagaaaaaggtcatgtgaccaaaaaaaaagaaaacaaaaagaaacagataagagagaaaagatgctatatcactggctttgaaaatggaaaaagaaggctggtgtggtggcttttacctgtaatcccagcactttgggaggccgaggcaggtggatcatccgaggtcaggggtttgagaccagcctggccaacttggtgaaaccccatctctactattttttttatactttaagttctagggtacatgtgcacaacgtgcaggtttgttacataggtatacatgtgccatgttggtttgctgctcccattaacttgtcatttacattaggtatttctcctaatgctatctctacccctgccccctaccccatgacaggcccccatgtgtgatgttccccgccctgtgtccaagtgttctcactgttcaattccaacctatggtggtttttgttgccactgcttttggtgctttagtcataacctatgagtgagaacatgtggtgtttgattttccgtccttgtgacagtttgctcagaatgatggtttccagcttcatccatgtccctacaaaggacatgaactcatcccttttttatggctgcatagtattccatggtgtatacgtgccacatctttgtaatccagtctatcagtgatggacgtttgggttggttccaagcttttgctattgtgaatagtgccacaataaacatacgtgtacatgtgtctttatagtagcatgatttataatcctttgggtatatatccagtaatgggatctctgggtcaaatggtatttctagttctagatccttgaggaatcgccacactgtcttccacaatggttgaactagtttacactcccagcaacagtgtaaaagcgttcctatttctctacatcctctccagcatctgttgtttcctgactttttaatgatcgccattctaaccggcatgagatggtatctcattgtggctttgatttgcgtttctctaatgaccagcaatgatgagtattttttcatgtgtctgctggctgcataaatgtcttcttttgagaagtgtctgttcatatcctttgcccactttttgatggttttttttttcttgtcaatttgtttaagttctttgcagattctgggtatcagccctttgtcagatgggtagattgtaaaaattttcttccactctgtagattgcctgttcactctgatagtattttcttttgctgtgcagaagctctttaatttaattagatcccatttgtctattttggtttttgttgccattgcttttggtgttttagtcataaagttcttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctagccagttttcctagcaccatttattaaatagggaatcctttcccgatttcttgttttcatcaggtttgccaaagatcagatggttgtagatgtgtgttgttatttctgaggcctctgttctgttccattggtctatttctctgttttggtactggtaccatgctgtttcagttactgtagccttgtagtatagtttgaagtcaggtagcgtgatgcctccagctttgttctttttgcttaggattgtattgcctatgcaggcttttttttggttccatatgaaccttaaggtagttttttccaattctgtgaagaaaggcattggtagcttgacggcgatggcattgaatctataaattactttgagcagtatggccattttcacaatattgatgcctcctatccatgagcaaggaatgttcttccatttgtttgtgtcctcttttatttcgttgagcagtggtttgtaattctccttgaaaaggtccttcatatcccttgtaagttggattcctaggtattttattctcttagtagcaattgtgaatgggagttcactcatgatttggctctctgtttgtctgttattggtgtataggaatgcttgtgatttttgcacattgattttgtatcctgagattttgctgaagttgcttatcagcttaaggagattttgggctgagacaatggggttttctaaatatacaatcatgtcgtctgcaaacagggacaatttgacttcctcttttcctacttgaataccctttatttctttctcttgcctgattgccctgaccagaacttccaacactatgttgaataggagtggtaagagagggcatccctgtcttgtgcaagttttcaaagggaatgcttccagtttttgcccattcagtatgatattggctgtaggtttgtcataaatagcttattattttgagatacgtcccatcaatacctagtttattgagagtttttagcatgaagcgctgttgaactttgtcaaacgccttttctgcatctattgagataatcatgtggtttttgtcattgattctgtttatatactggattacgtttattgatttgcatatgttgaaccagccttgcatcccagggatgaagctgacttgatcatggtggataagctttttgatgtgttgctggattcggtttcccagtattttattgagaattttcgcattgatgttcataaggaatattggtctaaaattctctttttttgtgtgtctctgccaggctttggtatcaggatgatgctggcctcataaaattagttacggagaattccctctttttctattgattacaatagtttcagaaggaatggtaccagctcttctttgtacctctggtagaattaggctgtgaatctgtctggtcctggactttttttggttggtaggctattaattattgcctcaatttcagagcgtgttattggtctattcagagattcaacttcttcctggttttttggtcttgggagcatgtatgtgtccagtaatttatccatttcttctagattttctagtttgtttgcgtagaggtgtttatagtattctctgatggtagtttgtatttctatgggatcggtggtgatatctcctttatcatttttttactgagtctatttgtttcttctttttcttctttactagtcttgctagcagtctattttattgatcttttcagaaaaaccagcttggggattcactgattttttgaagggttttttgtgtctctatctccttcagttctgctctcatcttagttatttcttgccttctgctagcttttgaatttgtttgctcttgcttctctagttcttttaattgtgatgttagggtgttgattttagatcgttcctgctttctcttgtgggcatttagtgctataaatttccctctacaaactgctttaaatgtgccccagagaatctggtacgttgtgtctttgttctcattggtttcaaagaacatctttatttctgccttcatttcgttatgtacccagtactcattcaggagcaggttgttccgtttctgtgtagttgtgcagttttgagtgagtttcttaatcctgagttctagtctgattgcactgtggtctgagagacagtttgttgtgatttctgttcttttacatttgctgaggaatggtttacttccaactatgtggtcaattttggaataagtgtgatgtggtgctgagaagaatgtatattctgttgatttgggatggagagttctgtagatgtctattaggtctgcttggtgcagagctgagttcaagtcctggatatcctgtcttgttgatctaatattgacagtggggtgctaaagtctcccattattactgtgtgggagtctaagtctctttgtaggtctctaaggacttgctttatgaatctaggtgcccctgcattgggtggtacatacatatttaggatagttagctcttcttgttgaattgatccctttaccattatgtaatggccttctttgtctcttttgatctttgttggtttaaagtctgttttatcagagactaggattgcaacccctgcttttttttgctttccatttgcttggtagatcttcctccatccttttattttgagcctatgtgtgtctctgcatgtgagatgggtctcctgaatacagcacattgatgggtcttgacgctttatccaatttgctagtctgtgtcttttaattggggcatttagcccatttacatttaaggttactattgttacgtgtgaatttgatcctgtcattatgatgttagctggtcattttgcccgttagttgatgcagtttcttcctagcattgacagtctttacaatttggcatgtttttgcagtggctggtaccagttgttcctttccatgtttagtgctttctttaggagctcttgtaaggcaggcctggtggtgacaaaatctctcagcatttgcttgtttgtaatggattttatttctccttcacttatgaagcttagtttggctagataggaaattctgggttgaaaattcatttctttaagaatgttgaatactggcccccactgtctactggcttgtagagtttctgcccagagttccactgttggtctgatgggcttccctttgtgggtaactcgatctttctctctggctgccctgaatattttttccttcatttcaaccttggtgaatctgacaattatgtgtcttggggttgctcctcttgaggaatatctttgtggtgttctctatatttcctgaatttgaatgttggtccaccttgctaggttggggaagttctcctggataatatcctgaaaagtgttttccaatttggttccattctccccatcactttcaggcacaccaatcaaatgtagatttggtcttttcacatagtcccatgtttcttggaggttttgttcatttatttttactcttttttctctaaccttgtcctctcactttatttcattaatttgatcttcagtcactgataccctttcttccacttgatcgaataggctattgaagcttgtgcatgtgtcacgtagttctcctgccatggttttcagttccatcaggtcatttaaggtcttctctacatgtttattctagttagccattagtctaatcttttttcaacgcttttagcttccttgcaatgggttcgaacatcctcctttagctcagagaagtttgttattaccaaccttctgaagcctacttctgtcagctcatcaaagtcattctctgtccagttttgttccattgctggtgaggagctgccatccttttggggagaagaggtgctcttgtttttaggattttcagctttctgctctggtttctccttatctttgtggtttttatctaccttttgtctttgatgctggtgacctaccgatggggttttggtgtagatgacctttatgttgatgttgatgctattcctttctgtttgttagttttccttctaagaatcaggtccctcagctgcaggtctgttggagtctgctggaggaccactccagactctgtttgcctgggtatcaccagtggaggctgcagaacagcaaatattgctgcctgatccttcctctagaagcttcatcccagaggggcatctggctgtgtgaggtgtcagttggcccctactgggaggtgtctcccagttaggctacacaggggtcagggacccacttgaggaggcagtctgtctgttctcagagctcgaacaccatgctgggagaaccactactctcttcagagctgtcagacaaggacgtttaagtctgcagaagtttctgctgccttttgttcagctatgccctgcccccagaggtggggtctatagagtcagcaggccttgcagagctgcagtgggctccacccagtttgagcttcccaggctgctttgtttacctactcaagcctcagcaatggcggatgcccctccccctgccaggttgctgccttgcaggttgatctcagactgctgcactagcagtgagcaaggctccgtgggcatgagacccgccaagccaggcatgggatataatctcctggtgtgccttctgctaagaccactggaaaatcacagtatttaggtggaggcatcccgtttttccaggtacagtctgtcacggcttcccttggctaggaaagggaaatcccctgaccccttgtgcttcctgggtgaggtgatgccctgccctgcttcagcttgccctccgtgggctgcacccactgtccaaccagtcccagtgagatgaaccaggtacctcaattggaaatgcagaaatcaccgtcttctgcgtcaatcacactgggagctgcagaccggagctgttcctatttggccatcttggaatggaatccatgtctctactaataataaaattagccaggtgaagtggcagatgcccataatcccagctacttgggaggctgaggcaagagaactgcttgaacccaggaggcagaggttgcagtgagctgagattgcaccacactgcactccagcctaggcgacagagcaagactccatcaaaagaaaaaaaaaagaaagaaaatggagaaagaaccaaagactcaacgaatgcagctccagatactgaaaagtaaaagagattctctgctagagtatttggagggattgtagccctgctgatagcatgatttagcctcataacacttagttcaaatttccccagagaaggtgtggccctgctacaactcaggtttagccccgttaagatttagtttggattcctggctccagaactgtaaaacaacacatttctactgttttaagccactcaatttgtggtaatttgttacagcagccatgggaaatgaatacagaccccttcccttctctacatatactcatttctttgttacagcagccatgggaaatgaatacagaccccttttcttctctatatatactcatttctttggagagtcctttgaagatcccattcagtctcatggttttaaataccatctatatactgattaccacaaattccagcctagaactctcccttgaactcccaatttggacacacaatcgtatatttggtatgcccacctggatgcagaagaacttcccagccaacaagttccacccacagtcttccccagttcagttataggcaacaccatcctggctgttcaaacaaaaaaccttggaattatcccggatctttcattctcatattcagtcagttatacaattttgttgcctatatattaaaaagttatcaggaacctgaccagttcttactgtctctggtgctctttgcccggatgactgcttctacccttgccccactcaatcaattctgaaatgtggtcagagtaaactttttaaagtcagtcagttagagatcaagttatttctctatggctacatatttcttttagaacaaatgcccaaatctttacaataccttcagaagcctaccatctggtgcaccctaccacttccctatcctgctctccaacttcatcttcttatgttctggccctcactcattcagctgcccaaaatcaatgtatcactttagtgttcccccaacacaccaaaggaagcttccacttcagagtctttgctggtccctctacttggaatgttcttccttcagatatccggatggctcactccctgcttggtcctttacctccttcaagtctttattcaattgtcactttctcaatgaagccttctccaaccattctactcaatattgcaagccctttaccccaacaccggcctcattaccttacgtggttcttttttctctccaaagtacttatcgtcttttagcaaactgtatactttactaatttattatggttattgactgttttctccattacagtatatgctttgtgaaggtagagatttttgtctggtttatttgttgctatatcatgaatatctagaacagtgccaggcatgtattacatataactgatttctagtatataggaagtagactgcactaccctagtatttaaggtcctgatgaatccattacaaatattttatttcagacttcaagtttttatctatactgcttcaggaaacactttatgttaactattatcataggtggcaaattcctaagttacagcaatattacagtcaccctgctgtaataatcacctatctactagaaaggtagaaggaatagttgtggctcatattgtatgattctacttacacaaaatgtcaagacaggcaaatccacagagacaagaagtagaccagtggctgcctaggactagaaaaagaaaagggtgttgggaggaaatgggaagtgactactagtgggtacagggtttctttttgggataatgatgaaaatattctgaaatggattatagtgccagctacaaaactgtatatgtactaaacaaccattgaattacatactttaaatgggtgagttatatggtgtgtgaattatatctcaataaagtttttattaaaaatttttatgtggctgtggctggttatgttttggattgcttaagaaataaaacaattttggggaaaattatgggaaaacaaatttaaaataaagttcttaacaatttaggactaacaattactatcacaatttgacagtaattaattaaagtaagcaaaattattaggattctaaaaactttcaaataaatattttaactgcatagccttgttctatttaatgacacaaaagatttaggaaaggtcaaggtaagaactaatgatgtattcttacataccttataaattgagtaaacaaaaactcagggaaactcatctaaaaaaataaaaaggttttcaaaactcgacccacatttgcccaatcaggtactaactagtctttccccaaccatctttttttttcatctgaaaagtttaatgatctaacctgctagagattcagcatatgatgaaagggagcttgcagaaggcaaaataattatacgaacaaaatatctttccttttcttaacttggacaaaatatatttagacagaattaaatggcagtttcttgggtggttctttaaagttttcctaggcactcttaagattggtataacaatataaattttattatatctttaagcatctcagaaattacacttataatttatgctcataattataaatagatgtgtctatgtaaaatgtacagtgtactcatttaaaaatctagattcacagcattaaaatacttaggctgttttatataaactacaaacaaaaatacaagttttacttagatgactattgtgcagattattaagagactggtaagtttaatgaaaacatcctaatggaattattttattaaggagaattactttgacatttaaatttttacttgaaagaatcctacctagtaatcgaatagctttttaagaacagtgtataaaataaactataccataaacttaagcctagagttcatcacagattaaaacttttaaactttaaactaatcataaattaaagtatacactgaggaataagacatatacagaaagagaagtactatggccaacagctttttaacaagactgtaaataaaccttattttaccaatattaaaggattcacctaccatattctattaaaaattctatttttctactcataagttacctcaataacaaagatgtgaaaatctaatacttttctaaaacttactaacattttatttaaagtataatatctaatgcttattgacatttattcaaatcacttctttttaaataaaaacaagttctctattttgaaattttgtaggactcaatatcaggtattttgttaaatggtaacttagaataaattcaaaagaaaggtttaaaaaagaaaagttctaagcttttaaatgatcctatcaatattggtgtccgggttacacacaactataaatcaaagcagaaactggcaaaataaaagaatgatgttgacatacattattctaatacgtaatggatttctgtaaagaagaattactagagacaatagatgccccttttgttatgctgctattaagtattattgaacagtcacatttagtttaatgcctaatccagaggcatgccacaaatatgcaagtcctatttttgtctatgtctgaagacggttatgtgtgttctttttctccttccaatttcctaatcagttttgcaaatagttacaaaatttttaccaggccaaacagccccctgctccctaccctcacccatatatttgccttcattttcagcccctgtaacatcagagggtttttttttaaaactgtaaataaatcctgactaattatgatttattcacagctgctctcaatgatattatgaactagtatccttttccactattaataatttctataaaatatttaaatgcagtttttttttacaactagaattctcatttgaacaaacaagaaaatgtcatactgaaggtaaatacatcaatttaaaaatttctcttataaataagtatgttttaagtttaataaagtagctagcacagctgggaacaggaaaaatgctgtttgcttcaattttgcaagcatttgatttgattggatggcaaaatcagcttgactgtgttagaccttaaagcctaacggtgacataaaataggtaaaataggataccctgtgagtaaggtgggtgaagtaattgataatacagagatattttgcaagtggctcccttgactgcattactttctaaagggaggtgaaaggcacatagaagtcactgaaaatacttttgttgaacaaacgaacattaaaaactaaaaaggagttttgttagtgtgttattctagaaaaaaatataaaattagaacattaaatattaatttatacttaaaccaagtaatcctaaatcggtctcaaaaaatatgaataataacatattctaacctcaatgtgtataccttattaatattttctcatgttctggaaaattaattaaaacaaaagtggttcttattaaataaatgaataaaatctattgagacaaatgcttattcatattttttgaatttgaatcacttcaaatggaatatctaataattcagtatttacatatcccataactttaaaaatataacaatgtaagatactgaatcttaaacatacaagtagctactacatgttttgcacacctataatttgcatctattaaggattaaaaatattaaatttctttttattctaaaattcaaaaaaagactatattttaaatatagtcatacctaagtattttagaacattttcgcttaaaggagagctaattgatgctaccctaaatacaagaagctaaatatattaagtacatcaatatgaaatggagtatgaactggtatgtttcctgaatgccttctcttacattgttactaattcattttataatttaccatgaattaaaataatagtttcctaaaaatgactcatggaaatatatgggtgtataaataccatccactttctcctggaaatgtattatcaatctgaacacagaacacagaacctgaagagagaagctcaagtgttttaaaaatatttcgcctctcctcagcagctgatttttccatgcttgttttaaatattaatataaaacaggttttccttaaattacaaaataaaggtaactttaaagaaatattcatttaagttagaggttatgtattaaattgttgccagtgatactgttttaatgttttagttacgaaacagaaactgaagtgaaaaaaatcccacttgcataattttttttttaaattttttaattattattacactttaagttttagggtacatgtgcacaatgtgcaggtttgttacatatgtatacatgtgtcatgttggtgtgctgcacccattaactcgtcatttaacattaggtatatctcctaatgctatccctccctcctccccccaccacacaacaggctccggattgtgatgttccccctcctgtgtccatgtgttctcattgttcaattcccacctatgagtgagaacattgcataatgttttaaaacaacctttagcttgtaatctagatgtaatttgtttttaactttcagaacaataaaacaataaatagagactatagtaattgattggtctgaattgttctaagttccttagtatgaattctgtttcacagttaagccttagactcaacttgtttaaggcaaatagacaaagtataaaatattactttggagatacaagataagtataatttttgaagaagtctcagtttagaattttagatgacataaagaattaatacataaacaatatgtgccacatgtgagcagtatgcacttaataaaatatttgtatgaagctaaaaatttcttaccaaaaagttagtaaaaatagacattattattattccttccttgaaaaaacctaaaactaaatctttaagtaaatgatctataagaattcttagtctggtccatgtgattacatggtcctatgtacccagggccactggaaattctgtaagcttagatagcatgaattctgaatgttagacattgctgttcaataaaaaataacttgtattaaaatttcgtattttcactttcatggttttatttccaagtctggttattttcactacaacctgattttccagatcagtggtgtctggtcaatttatctatgggtaaaataattaagtgttcatatgtctatacccaaatgctcctccagagcagcaatttgcttaagttggcagtgcctaccgcttggcatgcaacaaggctgtcacaaaaaaatgtttactgaataaatgatgaatgaaggaaaaaataaactaaaatatttctgtagagaaagaaacatgaaatgctctaaaatgtcagtcatgtcagtaatgtttatttttacagaagaatgctgactgaaagtgtttaactgtcccctgaattgtgagactaaggctcacaacaaagacaaaaataatgtacaagcaccacctatcttgaagacagccaccaaccaaatggggccaaatcgccaaccttgagtttactcagaggttgaatgagccccaccactcccaaatcatcacccagcctacataagagggcaagggtacatcaggagcactggggtgcagtttttgtcataggagcttcctcactcaagccaagttgcacagcaccaagatattacatcaaagacacgttgtggtttcctgcaagaagaggagactggcatctcactttccagctggactgaatactgaataaagaacctgcaaacttgccctggtgctgccagtggagtagaatttagcctgctgaagtgttcatagatgacctggcatatgtccctagaagttggggaaaatatattggcctagaaacttgtctacttcttatctagagatttctgaagatgggaggcttgggtagagcagcctgcagcagcagacctaatagggccacagaaatagtatacctgggtggggcgggggagaagtggagagtacctctcacatttcccctatctacccactaattctctgagaccctagaaaaagaacaccactgactcccatggctcatatgagagaaccaggactggggaagaagcaagggctgctggtcaaacacatcaatgccccatctagagagaggggaggagtttgaacttatgaaacagaaaggagatatagctacccatctctgaggaagagctcagtgataaaggaagccaagataaagctatcatcccaagaaaaccacatattccaaccacatgaacatcatattgtcagagacattttgcagcacttagaaccagattatgccagagtgagacccactatcttcagataaccacgttcactcagatgatgacctctgcctctcttgtccttcctccatgctgcctccttcccctctctctccaagaattagacctaggaggggagaaagcatgccaacagtcttaggccacttaggtggtcttctctaagatgtagggtggggaaggatcaagtgagacttaaatcaaatttgagattaaaatcttaaactacccagacttttactaaatgaaagtgaccaaaaagttgtagcatttgtccaaaggcatagttaagagtcagaaaagggagattagaaagagcatgcttcaaagtatgttttttaaaaaaagtaatttcagatatattgccaatgagttgtaactgtttaaaagttatttacaccctgtggtaggatgaatgctcaaaaaactgctaacaaaaaacttgatagctaaaactattctttaagttcaagcatagactgatacctgcccccacactccccctacctccccacaaaaaaaaaaaacagtgaaatcctactcatggtaaattctcaggtgacagctgtaatcggcctacatttaagcttggttcaatatatccatgggtagatagagccagcctctgctcactgttcctgccccactcaccttacatttgggataccctagaaatccatttttggtaatcatctctcttcaagggtctctctggttgatctcatatacttttttccatgccaaatagtcccaaattcatggttccattctgtactttcaactatctaatagatttatatgtcctccagacactgaaaactctatacatccataacatatcttgttagcttatcctccacacacacccagtctctaaaatctgttcttccctttttctattctttatctcaaacaatagcaaaaccatcaatctaattatctaaatcagaaaccttcttcttcaccctaatcctctatataaaactgatgatcagatccagatgattctaaatgatctaatctagatgatttcttgaatgtagactctcttctctaattccactatctttgccttaatccacttttaacaatttcaacagtctttaatccagttatcctaggtctccagggtctccagttcctctctatgcttcactttgacaccaaaaaacaagtttgataagagttttcccctcataaaaattttttattagctatccattactcataggattacggctaaacctagaagcctcagcttggcagttaaagcctttaccacctaggttactactgcatcatatccaatactagtctgttcagcagacatggttgcctttaggacctgttctctgacccagctgaaatgtgcaaaaaagcattctgtgttgctggctaagccaactcagtctgcaccccgcacctcggcctgctccatgtctgtattcctactttattcgaatgggcttcagttttgctactacccagagtttggattcagtgctatgatttatgcatctcctctttctcttgactgatggctttacttctggctcaggctaacctcttcactaaaggcttagtgatagtatcattgttaaatagtacaaagtaaactcttaagtcagatttcctgggttcaaatttttgctctaccacctacaagctatgagattttgaccactgaacttaatctctccaggcattagtttcttcagtttttttttttattcttgcagcttttatgaaagttttcttttttaaaattttattattattatactttaagttttagggtacatgtgcacaatgtgcaggtttgttacatatgtatacatgtgccatgtttaaaggataataatagtaccttctgtaaaggatctcctgcattgtcaggaaagtgctttaaaaagtactcactacatactaagatctcaatatgtgtcagctgctgtttttcccaatacttattagtttattagccaaaacaaaaggacaggacaccctctgagccataaaattatatatgtagataaacttcacacaccattttcaatataaagactggctacttagaaaaacaatttcagatgctgaagtttccaacttaaaacagcctcctatcatgagtcatagcaaaatgtggcatagttgcccaaattaatagaagcctaatagtttaaatatggcgtcaagaggaaaaaaaagtataaatgaccatagacaaggaagaaattcttacaggtgagagtaactgatatacaatatggaaagacaccacaggttgactaattctggaaaattctttaaaaaatgacaacaaaaaagatgaatttccacatatcgaaagagctgctactaaatgatgactactagacacccaagggttacagatacttaataatcttcttcagttatttgaagaatattttttctagaagaatatacctctaattttataataaaagatggaagatagaatttatttgcagacttgagctataattcactgttccacaaagcaaggggaaattatctgcactttatttctattgtgccttatacagatatgctaaggggaaagtattttaatgttcataatcaaaacaaaaatgattaaatggtcaaaaccaaaagcaacgcaatttcaggaattctgtactatcactgaagttctaatgaattagtatatttcttttcatcaaagaatataggcattaaaatgacaattttagatctttcattagcaaagataatccagaactcgctagtcgttccactggactagttagtacaagaatatggccgataattaactttttatatatttatatatttgtagccttggctattaggtagtttcatttgcattctcaaattaagatagagagttaaaaactaaactgaaggtctgtgagaatgaaacttgatactctaacccaggttactgagccttttataagatgccttaataattaataatactatactgcatatcaaatttcaacatgcaccattactgaattcatgaagaaaaaaaggtctgttgagaaccatgtaaatgtgtcttcaaaataaatcagtaaggtatcttttttccaaaatactttcatctgctatgagaaacaacattagtttgaatgcccctatcactcatttatctccttaaggtctgtctatcgttctggaaaggtgtttcaacaactgatgaacacaattacaaaacaagactactttggttttgaatcaagacaactagattctggatttttaaaaaaagtctattatttactgaaaagtcttccaacatgaagaaaccaacctaatgagggctttctatttttatgaatgagaggtactatggaaaaggctaccaacctaatggcaggaaggaggaaaaggtgtcagcattaattcaagtaggccaacaaatatgataggcccccaaacaatgatgtgcatacttctaactgtggaagatagacatgagaagtatgatggaagtcagttatagaaagatttctgatagtgaactactatgcatactcagaaaacctgaattaagtataaaattacaaaaataattttagatttaaagaaatttcatgacagttcaagtacaaaactattccatcatcaaaacacaacctgatatatgcattactagtttcctcaatcaatttttaaaacttttttgaaatcgaatgctttatttatttcaaaaggtaaacactgttgggctatcagtcttaaattagaagatcataaattacattgtccactctttgatcctaaattccactattggttaacatctcttttgatgtaatcaccccaatagtccccagtgcttactgactaaacatccaaaattgggttatgaatagaaagcccacatagtcaaaataacttccttagacatcaacattagccacaacatatgcttggagtacaatatcttgttttaaaatgtagagtagtcaatttttcaatgtaatcttctaaataaatgacattttaaaaagagcaaactactatgaggagagtttgtgcttcttggagctctttttgtaagtcatttttcttttgccatgtgctttaaacatcttaataaattataacatgttgacaagaaaccacatactgcacctgtgctttctatcttaattaatccaataagtacaggcctgctcacttaaatttgtaagggaaatgatgatataatgagttttaacttaaggtattaattacctaaataagcagaattagcttaatgtttcagtagactttgcctagacacaaccaccaaataaaaatttcagaaattatggaagccttaaacagcaccattaggaataagaaagtgaaacgctcattctacctcagatagccaagtggattaaattctactaaagaaaaaaattttaaaaaccagtgcagcagttcagagacactaaaatctttgttgcttttaccgaagaatcaattaaatctagtttagctgcccagtgactaaattattattttctacttgtacataaacacttttctttgaagcaggtcactttcctttcaaaacaaaggttatgactatcttaaatgcctcagcagacggatggtcaaaacctcataaaaattctacatggacctagacaatcacatgacacaactgtgcacacgccacaccatctgttggatatgactgccagcacagatttcgtgagctggcaaaggactgaaatagtcaagaattctgcaactatttcaaagtgcaggcttctcattaattttaatttcctgttggctctacaaggaatgactgagtagtgaaagcacaatatgccacatacacttgagttcatgccacatgtacacctgtaatcataaactcttatccaaagctatccactggaacatttgggattttgtgtgtttatttcttctttaccctagaagaaataaatctgaaatatctatagttgtcttttcatactttgttaatactcttgcaaacatctggaaatacttgacaataatcatttaattaatgcaaaggtaatcgatgacaatatgcttaaatacttcactcaactgaagtggtttcctcagtccacagaactaaggactgtagagaacaagcagttctttgactaaggagtacactacaaggaaaactatagccaatatctcttttaaaaccagaaacattacctgcatttaaacaaagcagataacatgctgctatactggtaaaacaaacaaacaaacaaacaaacaaaaaactggtagatgctgctggcttaagtttttaccttaagctgtctacagggtctgtgttgctgagggcttactaaaggggtggccctgctcctctttttcggggctactctagtttctttatcactccttcacagttgctggctatagaggagggtgaaaagaccctgagaaagaaacatttctccagaacaagtgaagattcctaaaatgtccatgggcagctccagcagcagggttggtactttctctgccaaccctttactgttttctgcattttgcaacagtgacttttgttttgtttccctgtaatcatactcacttgctaatgcaggcaacaaaggtaggactgcggaaaaactaggaaagccccaggcaactttatacttggggagcaaagttagtttttttcccttctctgccacaatttttgggactttttcttcagtgtggccctggaggattcttgtgtcccttagctcaaaagaacaccaccaactgaataaatatttaagaatcagagtaattaagaaatgttaacttactattcagtatgagtcacaaccaaaaatggttgatttacctaatttctcttatactagtaattactgtcaatccaatttctttcttttttaaaatttggaaccaatgtagtgggttaacagatggcttttgaagtttttgttcttattccaaaatctttacattacccaaaatatatctatttaaatatgatactgtaatttctgcaaaacattatctacatgctctctatttaacactaaacaatctggatgttaaggctgtttggaaataattctaacaaaaactgaaacattagactagtgctataataaacagacttgccttttacatttgttttagaaatcttcataagcacatcctaaacataacttttttccggtagggttaaaaataattcaattagcccaaatatattttatctcctatctttttatgataatccccaatttggtgacatcataaattcttttatcatctccttacattcaggaacataacataagaaaatccatagaaaatcccaaagacaaatgctaacgatttaaaaggaagtacacaaattctattgcatacaggctttaagacaaggaatgcttcctaccctgcacatctgtctagcaggtgcctttccgaataagttttgtcctttaggaatctgctctgagtacctcaaaagacaataaagtgttctctttcatttttttttcttagaacccattttcctcaaggcagaaggatgaagccttctctgtcctgaaaatatggtcaaaacaactttggcttattttaagcaacttctatcaaatagacttaggaattatataaaatacagttctcttctagaaggcggcctcgagatgcatcatgaagagggaagataaacacataaaccttagtatgctttatactttaatgagtcatattttttaacattctgtaactaatagatgagggaatgaataagaccagatttccctcattaacagctggtatctttgcttttagtccacttccccattttgtgagcaaagcagtccaccaaatcacttacgctgtgctccacctatgcttcttcttttaaccattctctctttgcccctcttacacccttttccttgtcttttgccatactcactactactcttggcaattatttgttcatcttctggcaatgcttcctttattcatctcttatttatttccatttccattccgctcagtggcgattacaaacattttccactttcctcaaagtgatgagagggttgagcagttccagttgacaggtgtaataaatgttgagaaaggaagaactgttctagtcactccgtccctcctgcaattccctttttaaggctatctgccctatataagtcaaaaataaataactctgcaaaaattggatccagtcatatgatctcttgatatccctttccaactgtgagaacatcttcctttattatttttttttggtactgtcaccatttatcatttggttcctcaccttaactaatcaaaatagtactcttcaatctagtatttcagctatttctgttaatctttcctcctcattcttgtttttcttttcaattttattcctatattattttaagcttgtgccacataaccgatttcccctaccctgagtctcttcctatcaatccttcatgctatcttcaatattaatattcttaagatacttttcatcatgtcatcctccaacttaaaaccttcagtggctttccactgtctattaaataaatattcagactctgtaaccttgcaagctttcaccctctgatctggatctacttttccattttatctctcgtatttttccagattaactaccacagacttgaaggtctctatttcattgccacccaacacagattatgctttcctactgctaagctttttattacacatcattccttgtagttcctgccttctctctttctgctatccatttatcaatgcttagacaaagtcctcttccacattataatttcatatacaactccagccttcatcaaatctccctcttattcaaaaccacatggcaatgtctgagttattgttctggattacaatttaccacttcattaactcataccttgtcctcttaataaatcagtataatttatttttacccacagtgcctagcacaatccaaagtaaaatatttgttaaattagcttaatgttttctaacaaattttggaatttccagatagaatgactacaaaatctatgaggggctaaaaatgtttccaaaagttactttcaggagttagccattggaaaaatagattcacaaaactaaaatgagtctaagacagacagtagaaggctacatgtcaaaaattgtgtgtatgtgaaaaatctgaaagtagagtactgcaatggtcattatcaaaatcattaatgaactctgatttcctaaattcaacattctaatttctgttgaattttaattaacaccctttctattagattgtctgcaaagtatactgtaataattccttccatctcatagcaccctttgccatgtaactttgctgttccttccatcatgaggtgaaatttatttccatatcttatgaattaggactagacttctgacatattttgacaacagactatgacaacagtgacactgtgcaaattctttcccctcttctcttatgcattttttatgcaaaaaaatgcataacacaaaattaaccattttcaagtgttcagttaagtggcattatttacattcacactctcatacaagcatcactaccatccacttctggaacgtttttcatcttgcaaaacggaaactctgtacccatcaaacaataactccctatttctcacccgtgagaaccaacattttattttccatctcgatgaatttgactattataggtaactcatataagtagaatcatatagcatttgtccttttgtgacctggcttatttcacttagcataatgtcttcagtgcttatccatgttgtagcatattgcacaatttctttcctaaggctgaacaatattccattttatgtattacaacatttttttaatccattcatccatcaatggacacttgggttgcttctacctttttgtcattgtgaataatgctgccatgaaaaagggtgtacaactacctctttgagaccctgctttcacttctttggtacatacccagaggtagaattgctggattatatgataatgctatgttagtttttttgaggaaccaccatactgcttcccatagtgactacaacatacttccaccagcaggtgcacaaggaaaggttccaatttctctacgtcttcagaaacacttgttattttatgtgtttgtgttttgataatagtcatttgaatgggtgtgtagtatcttattgtagttttgatatgcatttctctaatgattaatgataattattgaatcttttcatgtgtttattagccatgcttatcttctttggaggaatatctatttaagtcctttgccctttttttttttttttttgagacagagtctcgctctgtcacccaggctggagtgcaatggcacgatctcggctcactgcaacctccatctcctgggttcaagtgattctcctgcctcagcctcccaagtagctggaattacaagcatgcaccaccacaccccagctaattttgtatttttagtacaggtggggtttcgccttgttggtcaggctggtctcaaactcctgacctcaggtgatccacccgcctcagcctcccaaagtgctgggattacaggcatgagccaccatgcccagcccctttgcccatttctgaaatggactgtttgggttttttttttgttgctgttgagttgtaggagttcattatacattatgaatattaacctcttatcagatatatgatttacaaatgttttctctcattccattggttgccctccactctgttgatagtgtcttgtgatgcacacaagttttccattttgatgtagtccaatttatctattttttgttacttgtttttagtgtcatagcctagaaatcactgctaaatccaatgtcacgaagtttttctcatatgtatttcctactaattttttagttttatttcttactgtaagatctttggcccattttgaattaatttttgtatatggtgtaaagtaagactccaacttcattcttttgcatgtggatatccagttttcccagcacgatttgctgaaatgcctcttctttgcccccactgaatggtcttggcatccttgccgaaaatcatttgaccatagatgtgaaaagtttacttctcagctctctattccattggtctacatgtctgtctttctgacagtaccacactgttttgatttcagtagcttggtagtaagttttgaaatcaggaaacatgagatcttcaattttgtttttctttttcaagattgttttgactaattagggtcccttgagaatccatatgaattttaggatgagtttttttctagttttgtaaaaaatatcattaggattttgacagagatgacaatgactctgtagattgctttaggcaatattaacatcctaacaatattaaagcttataatctatgaatatgtcttttcatgtattgatatctaatttctttcacccatatttttgcagttttcagtgtacaagtcttttacctacttggttaagattattcctaagtatctcattctttttgatgctattatcaatggacactgtgcagatcctacgctgatgtcaagaggccttacaaccttgttttcaccttcttggaaggctactactgccacatacaaactccaggcttgcctgatgagatcatatgacctagccaatagttagcacaattgccaacacatttgggaagtaattttagagagagtgttcagccccattcaagtcagcagatgactgcagtcacttaagaaaccccaggtaagcccagcagaagaaacacttagataaacctagacaaactattaacctacaaaattgtggttttgatgaaagtaaaatagttgttattttaagccattaaattttggggtggtagaaagattaactgaagcaaagttaaatcattttatttgccatttcttaaccatgataatttattcattactttgtagctcatttcaaagtgtttctcagagcccattaagatgtattccatactactcagccataaaaaagaataaaatcttatcttttgaagcaacatggatggaactggtagctattatcttaagtgaaacaactcagaaacagcaaagtcaaatactgcatgttctcacgtataagtaggagctaaacaatgtgtacacacggacacagagtgcggaataatagactatggaaacttggaagggtgagaggggaagaagggagtcagggatgagaaattacctaaagggtacaatgcacattatttgggtaatggttatactaaaagtccagacttcaccatgatgcaatatatccatgtaaatttaaaaaacagcaatcgtacccttaaatttatgccaaaaaaaaaaaaaagatttattccaactgacacaagacaactctttgaggctaaatactctacattattcattatattcatgaataatttaaagcttaaatgtcagcattctaaataatttataattttaaaaaagtagataggttaaaatgaaatcttattaggactaaagatgtattgattttatttttctaactgcttactacaatattgaaaaaatattaagtagacattgcaatgatgtttgcaagctaacctgtgaattatactgctaatatttgctagcaattagtactaaatttattggggatagattttgaaactttattatctgattatttaaaaactcaatcacaatattgaggaaaaaagtacttaaaatatttataattgcaaagcatttagagtcatgttgtctaagcaaaatggtttattattacttaaaaattcttaaatttaaaaaatgtacatatttatatttatctaaaattgtatttacttatccatacgtttattaataaataaaactataaaggattataaagttattttgtttgggaaaaaaaatcttccagaacaatatgcaaaagtaacattattatttaaaatgtggttaagtaaaaatttactccataaaattttcactccattaaataactcattttgagaatttactctctcaagttctggaaacagttactttaaaatagttcatctgtattttatgtattctttaaaagaagtaagaagaaccagggtagaagaaataatgagaaaatgtaacaaaataggtgataaggcagttttatactgaagtttatatgctcctaggtacagaataggactattatttctgagaaaccaagtggaattaacacttactcaaatagaaaccaactcatatactttaaaaattgaagcaaattctcaaactctatgtcataaatacctttgcttcattaattttggcaactgagtttactgaatgtcagaagtatctcatatttgcattattgaaaacatcttttaaaatagttgtcattttagttttaaggagtcctgaatatttatttaaatttgagctatgatttatttaactataaaaaagtatttctctgcaagtacatttctataagcaagctacagtttcacaatttctctaaccatgtatatggctgtataatgaatattaacatatggtctataattgtatatacatacacacagttcatatacatatgaactatgcttctcaatttgatgataaaatatagaaggagaaaacataaattgaagaattaaaatgtacttacaaagtcaaagtctccatcttgaggaactttccagttatcaggaaaaacgtttttggacatagggaagggttcatgcatgttctgattacagttttcgtgactcttattcttgaagtcttgcttatcaaagtagtccatgaaagatggtctttgtacttgtggtgaggttgcatttccttaggtaaacaaagaacataaggaaggtataagttcttacatttaaggaagtattttctttgaagtatgatttttttatgaagccatataataaatttgcactggtcagattcaaggccaacataattaatttcataaagaacaaagtgaaataaaataagaattaaaaaatacccagaccaaataaaaattaagctgatgattaggcaaaggtctggaatgtttagattgtagaaacatttcagaagtttagtaaaatcattatcagaattttattaaaaatcatttcagctttatttcaaatttctcaaagaaagtaaattttaaaaactcaggtgtttttggtgggctttttttctttgcatttaagcctgcattgctattgttattgtacattttcagctgtaagaaattatgaggacttggctaggcatggtggcctgtaacctcagaactttgggaggctaaggtggaagggatgcttgagcccaggagttcaagaccagcctaagcaacatagtgaaactctgtctctataaaaaatacaaaaaattagccaggtgtggtggcacctatctgtagtcccagctactttggggacagaggcgggaggatcacttgagcctgggaggtcaaggctgcagtgagctatgattgtgccactgcactccagcctgggcaacagagcaagaccctgttcaaattaaaaaatatatatatatgaaatacataaactttaaaaaaattaaaaaaaatcataagaacttactcagtttcctcttatatttatcaaactgcttcctcagtctttctgattccctctgtccctggacttccatggcttcgcctgccacacttacatccatgtctcccaacactacttctctagcccagactttgcgcctaagttccataactaactttgctagctattagacaacttaatctgaggtgagttgccaattaatttaccagttctaaaactaaattcaagatctttcccttcaaacctacagctcccccgacatattctatctccactaaagtcaaccttatttactcaatccccaaaataataaagttgagaattaattcagactcctcccttcccaccatagcaaactgattattaggtcttttaattctacttctcagtacagttaactataaccccttttctctacttatcattgcaactgtcttagtttagcttctaatcacttcttgcttaggccattgtagcagcctccaaactagtctccttgcttccaatatcacagttttgattttaatttccatattgtcaaagtggtgacctttctaaatacaaaccaaaagatgtcattctgctcagaatctttcaatggctcttcattttttatactgaatgactaaataggaaataaatatttggaataactagatttttaatctggctatattggtcttgatcagtggttttcaaattggatccttaaagccccagggctccaaataaatgtcccagagaccaccaagaaggcatttcccatataattctccaaatagaaagtaagctactttcctttttcttttctttttttttgagatggagtttcgctcttgttgtgcaggctggagtgcaatggcacgaactcagctcattgcaacctccgcctcctgagttcaagcaattctcctgcctcagcctcccaagtagctgggattacaggcatgcgccaccatgcccggctaattttgtatttttagtagagatggggtttctccatgttggtcaggcagtaagctactttcttaagaattttttgtggggagtacacctccccacaagggaccctgatgggcaactgtaagttacaaaaagtatttttaaaacgtaaaattgaaatctttccttccgtaatttacactcatgttccaaataaattactctttcgtataattgtccctcaaatatctgaagacagaggtaatggctcctgtcttggctgtctatttttaatataaaacatccccagttcctttcataggatatatgtttcagattcatcatcaacttgtttacttgcctatggagacattctagtctactgttcctctaaaaagaaacataatattcataacagttatctgaccaacctagattgcatttgtaatagtcctagcacagttgaaaactacagttactactatgacaactaagtaacaatgttagttgggacgagctttaaggtcattttggtcaaaagaaagcatgttaagacttatttttagtctttaaaaatatgagggaagcctaaatcgatgcctactttatgtggcaaatcagagagtccggaattcttaatcaaacttcaaaaaacaaaagggggggggacggagattgaactgacaggtaaacgtcctatctcctctttcctttctccctacttttggatctctatgtgtgttatttgacagattggaagcctaggtgaggcggcttaggtgaggttataagagagagtggtaatggtgatatttattcatcaaaagaattctgtctcattgccttaaaataaaatggtttgccatatcaaaacagaggttttattgacttcaccttatgtgttttaaaaaaatttttataagataaaatttaccatcttacttctgggtatatatccggaactgaaagccaggtcttgaagagataactgtaaccccatgtctattgcagcattattcataacagctaaaacatggaagcaagccaagtgcccattagcaaaatgtgaggaaggaaattctgacacatgctacaacatggatgaaccttgaggacattatgctatgtgaaataagctagtaacaaaagaacaaaatactgtatgattccacttatgtcaggtatttagagtagtcaacatcatagagacagaaaacagaatggtggttgctagggactaagaggagtgggaaatggggagtcggcgtttaacaggtacagcagttgagttttacaagatgaaaagagttatggaaattgatggtggtgatggctgcacaactttatggaagtgcttaagattaatactattgaactagatacaggcatatttcgcagttattgcaggtttggttccagaccactgcaataatgagaatatcgcaataatgtaagtcacataaattttttggtttcccagtgcacataaaagttatgtttgtttgtttgccttcacaacgtcaattttcttaaaaatttctttttaacttttaaggtcaggggtacatgtgcagatttgttacataggtaaacttgtgtcatgggggtttgttttacagattatttcatcacccacgtattaagcctagtacccatttgttttttctgatcctctccctcctcccagcctccactctctgaaaagtcccagtgtgtgttgttccccagatgtggccatgtattctcatcatttagcttccacttgtaagtgagaacatgcggtatttggttttctaaaagttatgtttaggagtgacatcagaaagatggctgacaagagaggcctggtgctagtccactctcaacaaaaaaagaccgaggcaacagataaatagctaagatttgactggagtgtcagtgggagaaccctggagaataacgagagagtgcagaggcacctgtgctgcttagaagtccagtttggggtggctgtagtgtttcttaaataataccgcagtgaagtttgctgtatcagttaactcttcctttcacaaaatgtttctctgtagcatgagatgctgtttcgtaacattttacccacagcacagtgtctctcaaaattgtagtcaatcctctcaaactctaccactgctttatcaactgagtttatggaaaattctaagtcctttgttgtcatttcaacaatgttcacagcatcttcacaaggagtagattccatcgcaagaaaccactttctttgctcatccataagaagcaactcttcatctgttcaagtttaatcatgagattgcagcaatgcaggcacatcttcaggctgtacttccaagtctagttctttcgctattaccatcacacttgcagttacttcctccactgaagtctttaaccccttaaagtcatccatgagggttggaatggacttcttccaacctcctgttaatgctgatctttttacttcctcctatgaatcacaaatgttcttaataacatgaagaatgatgaatcctttccagaaggttttcaacttacttgatccagatccatcaaagcaatcattatttatggcagatattgccttataaaatgtatttcttaataataagacttgaaagtctaaaatactcatggatctatgggctacaaaatggatgttgtgttagcaggcatgaaaacaacattaatttccttgcatatttccatcagaccccttgggtgaccaggtgcattctcactgagcagtaacagtccaaagataatctttttttctcagcagtaggtctcaacagtgggcttaaaatattcagcaaaccatagtgcaaacaaatgtgctgccatccaggcttcattattccatttatagagcacaggcagagcagaatgagcataatttttaagggccctaggattttcaaaacagtaaatgaacattggcttcaacttagtcaccaccaccagcctgtcctttgaagctctgaagccaggcattgacttctcctctgtagctaggaaagtcttagatgacatcttccaatagaagacttgtttattctatattgaaattctgttgtttagggtagccaccttcatcaattatcttagctacatcttctggataacttgctgcagcttctccatcagtacttgctgcttcactttgtacttgtatggtctggagatagcttctttccttaaacgtcatgaaccaacctatgctagcttcaaacttttcttctgcagcttccttacctctttcagccttccagaattaaacagagttagagccttgctctgggttagactttggcttaaggaaatgttgtgactggtttaatcttctatccacaccactcaaactttctccatatcagaaagagaaaggctgtttcactttcttatcattcatgtgttcactggagtagaacttttaatttcctttaagaagtttttctttgcattcacaacttggctgtttggtgcaagaggcctagctttcacccagtctcagctttcaatatgccttcctcactaagtttaatcatttctagcttttgatttaaagtgagagatgtgtgactcttcctttcactttagcacatagaggccattgcagggttatcaatgggcctaatttcaatattgtgatgtctcagagaaaagggaggcctgaggagagagacagagacaaggtaatggcctgctggtggggcagtcagaacacatactacatttatcaattaaattcgccatcttatataggcgcagtttgttgtaccccaaaacaattacaatagtagcaccaaagaccactgatcacagatcagtgtaacagacataataatgatgaaaaggtttgaaatattgtgaaaagtaccaaactatgacacagaaatacaaagtgagcacataacattggaaaaacagtgccaatagacttgcttgacacaaggttgccacaaaccttcaatctgtaaaacacagaatgtctgtgaagcacaaaaaagcaaattgcaataatgaggtatgcttatgtttaaaaatggttaagatggtgaattttaggttatatgtattttaccacaataaaaaaaatttttttaattaccatcaaaaatgtgccattcagtagcatgaagtattgtgtgaccaatcttcaccttgcaaaatggagactcttgtacccaatgaacaacttgccattttcccctacctctagcaaccaccattttacttcctgtttttatgaatcttactactctggatatgtcatataagtataatccattaaagtggtatttttttgtttttctttgttttttttatgactggcttatttcatttaacataatgacctcaaggttcattcatgttgtggcatgtgtcagcatttccttccttttcaagaataaataacattcaactctatgtatatactacattttgcttatccatttgtctgtcaatgaacacttgggtttttctacttttgttgaataatgctcctatgaatattgttgaataatgctcctatgaacatgagtatagaaatacatcttagagatcctgctaattatgtggctttgtgttatttactcttttttaaataagtttttctctatgtgcagatctttagttgcaagtaatcttattttttaatatctatccagaggccttttttgctttctaatgggtgttttgatggttgagcctaatctctgattaaatgaatgattacaatacaatgtaaacatgtgaataatataattattggtaaaagtaatttttatttttaccctatgagtatgttgtatgtatgtatgtatggatggatgggtgggtggactgactgatttgattgcctgacagggtctctccttctgtctcccatgctggagtgcagtggcatgatctccgcccactgaaggcttgaccttctgggctcaagcgattttcccatctcagcctcctgagtagctaggactacaggcatgcaccgccacactcggttaatttttgtttactttttgtagagatgaggtcttactatgttgcccaggctggtttcaaactcctggactcaagcaatcctcccattttggcctcccaaagtgctggcatcacaggtgtgggccaccatacctcgctgagttatgtcttttaaatgtgtttccatctttacttttcattaaaccgtaagttccctaatgtagaattccaaatcctttacctaaataatttcacagataactctattaatttgtgtttttgactgtctacccagatgttgaatacctatgaacaacagcaggagccatggtttttcatcattacttttgaattagtagatgctatatgtatttcattactagcattggtgcactgctgataatgtatttgagaaagtattgtgactactacaattattattaggctggtgcaagtaataacagaatgatctatcccagtagagtcagaaagaacctgattttcagaatatacatgtattagtggaaaaatagaaaaagactctcaacacaactgtttatctaaggaccaatcctctaattacagctgttccagctttagatggctagaaaatgtgacaagacatctgggacccaaatggtacccactgtaaagatattgagacattctatgaaatttaagatagtataaaacaccaatatttgtggtaaacctttagaacttagaacactctcatatctcacattcaaagctcatgaaaaagaaactccttagagacagttcagcatgaaaacagccaaagctgcctttagatttcctgtcataacagactttacaagtatgttaaaaatgaacaaaatatatagaagagaaggtgtaatatttcaacgatcaataaatatgctaaaaataaagatatggtgtctatggtgttcatcttcaactttgttccctgaaatcaacaacaaaaatagaaattggttaatttgatgggttacattactgacatttagacaggacacatacattccattaacattttcagcagatttttagtacctttgatttgtctctaggcttcatcattacaagacgtatttctctatattcagaattgaaactcggttcccatggtaacctcttatactaaaatagagtctaggaatttaacctgttattctccatttctgccccattttgtaagtttaaaaaaattacaagtgtagctcaacttacacatattttttataaaccaattgagtaaatcaaaccataaagctgggagaagggggataatcccttaaagaaattctttgctcaatattctttttgtttctttttctttttaaagggaagattaattctgtaatagaattatatatttagttgtaagttctgttttcatcaagaagtcttaaaatgtgtcacacacataaatacatctgaaaactttaacattcagtattatataataagggttatcaagtttgtcaaggaaagtcagaatcagggaggagagaaaaaatggtttctttagaaactaactgctggaaaagtaagaaactcctaaaccaccattatcaactgcatttgataatgaaaagaaaggtttcactgaagcgtatttctagatagcattctttaaaaagtaaatttagtatttgtaggtgctttggtaagaacaaaacaaaaacaatagaaactacaaaaagcatgcattgtagcactactaatccagtgaagacaacagcactctgtgacctatgttcctccccagatcatcttcctctctccacaccaagccaggaccacattgctttcattaattttttttttttttttcatccagcactggcttcactgctgaggctctcgttatggtcttgttttctcctcaactgggagataagaaactcttcatcccagaatctttacaaactccccagtgctgtaataaacagtcagggttctcttgatataccactgactcttactttggacctctatctgagaaaattcacccaaaccattattggagtaaattaaaaactaatcttttcctaccagaaactaacatttatagagcacctattctaatatgacctacatattaagagtagcagcatacactgggaaggagaaggagaaaaataaaatctcagaagttgcttttttcactacaaagaacagagtgggggaaattttaatcttctataaaaaccttcaaaacagaaagatgggctgagcaggcatttcctttagaaatgaggagagtaagaaaaaggctgaaggaaagacaatgttcttttctgcaatgagtcagagaagaaacagtttgattagagagaagtggtagcaacagaaaggggagaagcagactactccttggtgttgactaaataaagaaaggaaattactaggaaatttcattccaggaatctactcttccaaccccaacagccttgtgcgtgctcctgacaacatcccaatcaggagcttctaactgaagtcacataagccaccaccaatgttgtagtgtctcaaagtgaaaaatttgcctccctaatatctataatccctagcttcctgactaggggtgagaaagtatctatctcattggaaaaagtggccatgtaatacaattctggctaatgacacataaaaataagggtttaggccaggtatggtggctcatacctctaatcccagcattttgggaggttgaggcaggaggattgcttgaggccaggagtttgaagctgcaataagctatgggctatgatcacaaacaccatattccagtctagatgacagagtgagacccttctcttaaaaaaaaatcaagtaaggttttctaggaaagttctgttttcttgatataggcacaatcctttctgttttttgctcttttctactgcctggaatacagacttgatggctagagatcctacatttactctgcaggcaggagaacaagcataataccctaaaagatggtgtcacagaaatgatttctaatgacatcatgaactcactctgccagtgccggatactctgcttttggatttctcatcaaatgagaaaagaaattaatcttattttgtttaaatcactgttatttgggtttattggtacatacagtcaaattcagtccttaactgatacatttctattcccaaatggaggatgtagggagaagcagaaggagcagcaatctgcagtttcactgcagaaacatcccaatttcaaacttgaagtccactattatacagagtagtttaaatatcactacgtctcagatacattatagttttaaaggtttttttacaggctgacctaaaaaacctatggcaaaatgccttttggcttccatactcaaaaattttaaaaataacccactcctaagataaaaataaacattcttacagagttaacaaaagttttaaaagcaacttaaataaaagaaggagtctattctgtcagatttttctttttggatgatttaataacaagatactattaaccaagatatgtttacacttaattttttattcaaatgtataatgtatgtgcttatacttctaaatattttccattgcttaatttaaaacctagtattaacatttagagtatctctttgtcatacacacaaaaaaagattaaaaaacaatttttaaaaaattttaaagaggaaaacaggttaggtttgttttaaaagttaatgggagggggcagctgcaattgcccagtaatgtttaactacacaatatgaaacacatgccacaatgcgcagctgagtctccagggagatacatgttcacagaagtgggacagagaggatgatgtttctgacttacaatttattaaaaaaaatactaggctcttcaatgagaaaataaagcaggaaatctcaagatagtaaccactgtcatatgtgatgtggttgctatggcaaatactttttttaagcacaaaaagaataatcatataaaattgacatcaatttctccagctgcagccgaattctgaccccagcttacaaaaacattttattttaacaataattttaacgttcagaattacctagttcctcaattttggccctaattccttcaactagttgctcatggaactaaaaacctattagcaataaagaataaagtaactatcattcattctctttgtggataagaaattttaaagaaaaaggttgcttttcatctccttcatgcatccccaaaacatttacaagtaaactaaattgtgagaaatataataccgtagaaaatacgtcagtccacccacaattattcattaagtttcctaatttgcacatcttctaaacaagtaaaaagtcctcataaaaatttaaatatataaagtaatttttaaaaatactttaacaaaataatttaatttttaacttcttagcatgattatgacaaagatattcaagtttagagaataaaataacaatcataactttagtaaagtatgtgtcaacatcaaaaagatttatgaagattacctaatttgttcttctaaaaatattttaagatgtgggtggttccacctcattaatggccttcgaaatgtgtcctttaatttgctgccaagagtatagtgaatacatataaaaaccaggatgttaacacagaagctactgacatcagttttttcctgaacttcaccatactgtattttaaaacaaagaaggataaacataacatggagaaggtccacagactattcataaaagattaaaaagcttagaaaataatacctgcacaaaggttaaagagactgaaattattcagccaagaaaagtcaagtctgagaaagaacttaataagtatccaagtatttatgaagggttctttgcacagaaaatagtgaccagctgttttcaatctccaatgaagtcagaatagaaggaaacaaaaattgaagcccaaagattttagttaaataaaaggaaggagttcctgtgcgagtaatgaatattgtaatggtcactgtatctatgaaaatgctttcttccaaggcctgtacaggaaagatattttcatttttacagggaagactaatatttacatccttgtgtgtgttttgtgctaataaaagaggtatcctacaaccaaaatgcatacaccagcaggtctgagctgggttatacttcgttaaacgtcccacggaccaagagcacacagaatagtagactatactcagtgcccacagggaactccaaaccactgcagccacaccttacctggattcctcgtacttttgtaaaggaaaatgaatgatttctaattgcccagaaatatgatgggtatttgcacccagctgcaagagggacctgtagtttactgctgtcacctttattgtcatatcccgggcaacattaacctcctaagttaaagaggaatggaacagtttttcataaaagaatggtaagtgagaaagtagttcccctacacattctcctacccttgccaattatttcttggcatctcaaattccatccttagtgatttactcctttggctcaaggctgtacgattctgggagaaaatgtatttcatgagcattaaacattattaggcattttattcctgtgtatctggtctctttccaaaacagattttgggggaaaaaagggaggaaggaaaggatatgagaaccgagagaaagatattactaagcaaagaatacggcatggaagtagatgctcagaacaaaacaaattgcctcatacttcacgattttgtctaggaacaatggatgaaccagggagtagagtcagtcttctcttcttggtatctctcctcaactgacactaatatctagtatcgtttccagagtaactcctaaaaagctaaagcagaacttcatttgctttctcttactaattaagtaaaactgcatatatgtgctgtccaaaataaactctgaaattttcaaaatcaacaaatactatatgcatatacaggtaagacatttttaaaatgtatatttagtaaatattatttaacccagtatttaagaaatgataaacatttatgaaaggttaatataagtaaataatatacaacctaaacataaccggttatttctccacccattcttttttgtttttctgagatagagtcttgctctgtcgcccaggctggagtgctgttgcgggatctcagctcactgcagcctctgcctcctgggttccagcgattctcctgcctcagcctcctgggtagctgggattacaggtgcatgccaccatgcccagctaatttttgtatttttagtagagacggggtttcaccgtgttggccaggctggtctcgaactcctgaccttaggtgatccccctgccttggcttcccaaagtgctgggattacaggcgtgagccactgcgcccggcctctccacccattcttaatacaacatggtctccacctacatcgccatccagctgcctctctgttcaatgtgctccagtgtatctccagccttcttaaatactccaggtaagttctaaacacaatactccaggtgagttctggctcctgagagcagagggaagctgtttatttccttgttctaaaaagtggttatctgtcctagctgcacctcagaagcacttgtagagtttttaaattttaaaaaacgtattttaaaagcagagatgcccaagccctgctctagtcttcagaccagcatctctgaagagcgactgttacaatacatacttgtgaggctggttatttggacccaaaagcagggtttatcttgtaaatcaagcccactgctccagcctgtggtgatcttttaggatcctcgttctatcctataacatatttttattttgttccacttcatgttatttgcaattctgatggaccttcaccttatagcttcatccaagtttctatgaaaaattttgagctagccagggctggaggccgaggtcctgtatcacaaaatgagaaatcttccggtaaacaatttattatttaacattgtagtcgactgaaatttagcaaccactgccgtgtgcccctggtgagcctttgtatcatagaggctagagagctgaacaccacatttctcagaattccttgcaactagagttctgggtaagtgcactctttcgcaactggggtggtgggggcggtggggggaagcaaacagaagctatatgcctgctagtttagttatttccttcttacaagccctgtcatagaggcttgattatttacagcagcattctagcatctagtcaccagtttcacaggtactgaggagtggttgcagtaatatttagtagctttctaatccctaaatagcagtgagggttgatttcaatctgtattactgaactcagcggcgccagcggtagcctctggattgctattcctcgttgtggcagtagtagttgttccttatatgctcacttttgtggtgttgtgggagtcactcttgaagcctatgctacacagccttctcctctaggctttccattgattttcttaacttctacatctttaatatggcttggctctatgcccccacctaaatctcacgttgaattttaattcccagtgctggaggggggactggtgggagatgattggatcacgggggtagtttctaacggtttagcaccatccccctagtgctgtctcgtggctgagttctcacaggatctggttgtttaaaagtgtatagccccacccgctttgctctttctcccgttcagccatgtaggacgtgccagcttccccgtccccttccaccatgattgcaggtttcctgaggcctccctagccatgcttcctgtacagcctgcagaaccataagcaaattataccccttttctttatatattacccagtctcacatagttctttatagcaatatgagaacacattaatacaatctctgacttaaattgctttgtgtgtggaatacctggagtagattctgtttcctccaataaactctcactgatataagcacatttgagtataactgttgcactctcataacaggaccaccagctaggtcacactacatagtgtctacaagggtatcatgaaagaccttgtcaaatactttcctaatatcctaagatacaatattcaaactctgcattttctctgaccttgaagtttagcaatgctgtcaaaaaaggaaattatattattctgatacgatttcttctcagtaatctatgctgacttataacgatcctgatctttcctaaaggactcttaaatgttctagaatcctgcccaagagggacattgagctcactggccccagagtagtgatgtgattctagtgtcaaccctgtgtctatatactggtttcatcacttacttgctaggaaatcttgaacagcattcccaagtctcagtttccttagtgctaaatggtagtgaaatgctattttataggatccttgtgaggagtaaataagataacatatacaaaatcctaagcacagtgtttggcctgtagtaggagctcaattagtaacagctataacctgagaaattcacctttttctccatttccaaaaataaaataaaataaaatgtaaatgtacttttatacttccatgacactctcctcattttctcaaagagatgtcaaatttcacaaacagtggaaaacagttctctcatctcaagtcgtatcaatagatattatcaaacacactctcggtcaggagatgccaagtgcgctgagtacttctctagcatttgctcatcttgccattcaaacccctcttattcatgttgatgctactcagttcattttggagatcatcattctctatagaagcccctttgactagcttactaaaaaaaagagagatggagcaaggtcttggaggaggcagggaaaggtggaggcaagaatttgccgtgggaagaacagagttgctcgatagctcagcatctctggtcccaggaagatatgatttttatcaccgcatgggaagcagggctgacaatgcccagggcttcccggatgctccctcttatcaagttgttggaaggataaattaatagggtggacagatgaatattatcctttattgattatcaactatatttaaaacactgctaggcatgttttgaatttacctaatacacacacctgcacatatacacacaacagagagacaaatatttatcactgaaactcagacagaattaagcaacacaattactaaatgatttggcttcacatcccatgctcttcactataccacatcatttgttcagaaaacatttcatgaactcttaccaagtgctaggtattgtattaggtatcaaaaatacagtgggaaataaacaaaagcacacgctcacaataaagcatgacagtgctgtaagagtgaaagcttggggtgagatgggagcctattagaggggcacttattcctaacctggggttgatagaggaagcaacctcttaactgagcctgagtgaatgaatatgatttagcaaaagaagcataaatcccacaggaggatttaggcattgcaagtggccaaaggtaaaaaagctctgtaagagctgagaagctggaagaaggatgaagagggaatagaaaggtaagtaggaaccagagcatatactgcttcttaactggtgttgagctttagcctataagcaattggtagtcactgggagggcataagcagaagagaaatgtgctgaaatctgtatggtggggagggaatgaagattggaggcagaggatcagtttagaagcctcacaagtgagaaactatgaggacttgcactaaagaaatgcaagcagagatcatgagaagagaatagggatatttagggggcagaactgatgagatgttacttccatgaagggtgaaggaagaaacggaaattaagaatgactcaatttttcaaccttattccaaagaccacatttaaaacacctatacagcttctctaggtacttgcatgataacatttcactttttttctgtaaagtagggagcaacgtcatctactgaaactgagatgggaggcaggaagaagagatctagtgaagatctaaactagccactctgtagaatgaggaattgctgaacagagaaacacaggcctccaggaaagttgagggcccaaatgggggagaaggtcttgatctggcagccctcatctgtgcagatggaagattatctccagcagcactcaatagccagggtaaagatgcagagaagatgaacactgagactggaccatatcaaagttttccaggagaggcagaaaagacaagacattagggcagtggagtttagaatataagagagtggcagaagcaatgaaatatagcctctaagaggagtttagaacataagagagtggcagaagcaatgaaataatgaaatatagcctctaagaggagtttagaacatacgagagtggcagaagcaacgaaataatgaaatatagcctctaagctggatatagaagtgaagggagggtgtgctaataaaaagaaagcagactaggaactagggtcagggaactagagggctctcatgatagcatttcccaaaatgtgtttctcagatgcttattacacaggatgttaatcactgatacgttcctcattaaaagcttttcatggtcaaataagtgaaggaaagtttgggtaatgtaatttttaaactgtttccttcctgtactatttgtatttaataagttaataatatatactgtagttctctaataatttatctctaggataaatatgcatttcccaaataattctgattactgtatattatttatctatatttatcagagaatttcactgaatgggtatcttaaggaacacattttcagagggtctgctctgtgaaatgagaagcagggatggtagaacacttgaaaagaaagtatcttaccaaggcaggaggtttacctgaaagttctcttagcttccagagctatgtatctttaattctactataacacacacacacacacacacacacacacacacacacacacacacacagcttgactctgactctactgtaattagtattcattcatgaaaccaatattccaagagcatgtactattatgtggcagaggagatttatacagcattcttaccaggacaaacttcgtgacttatctggagaaacaacagatacacacatgaaaaataaaaacctggctggaaaatatggctcttcctcagatacccataagacatagtttccctccagggcaactagtgctaccaatctagccacagctctgtaagatcagaaagttcctccataaaaacagagctaactgagtagatctgagctgaacaaactaaaaagccccagtctttctttgctgaagctactactctcccagagtcacccatgatgaaataatctctcctaccccatcagtttgatgacatagattcttgacctggtcctaatctactccaggataataaatcctaaattgattttcttgaatgacaaccaacctgcttttacccagtgtcaagcattcagaattccaactggcacagactagtatggataaaacataatccataaggaagaagtagagatccacatgtaaataatggctagtgccagactgtgaaggatcttggtgacacagctgaagcctggacattccatggggaatgaggaggccttagggatatctgaataggaagactgggagcgggagggtaaaagtaatgccatcattgctaaaaacaggtttagaaagttattcttgggacatgcccatagggtccacgtccattttttaaaaggcagatcaaattttaaaatactttttgtcatttttctccacttcccttcaaagggtctgtgggtaattttcctttctagaggtaaggaaaataggcccataatttctagcttcatggttaaaggtataaaagagtaagtgtaaacataatttaaactgacaaggatgttaaatcaggcaactcacttgaaactccaatggaaaaagagatgaaattctaaatcttcagtacacattgtagagattttagaaaaccaaaaataatatactgctatcatcttattagggaacaaaaatgctaaagacacattagcaaatgtggctttgactgatgtgacataagctgagacctcataccaactaatttaagaagttttaaagatttagatcacgagaaaaacaaaactacaataattatatggtttcagaaaaagtaagtcttccctcaataacttcttcacatactttactactgctatactacaatatgacaatccctaggggttatactaacatcacttgattagaattttggaaacactgaagtctcacattacagaatgatgtctaacttgtaaaaacaaaaaacacagaaagttggctcatgggatttaaaatttgctgaggtccataaaacaactgcagctataaaaaccacttatctgttcaacttcaaaattggttttcactaaaatctctgtgacaaaaagtcatacctatacaatcagttataacaaaattataacatgtattgatttttgtggatgtcaaatctaaaagtcactatacaaaatgtcagaaatctgtggtataaagtatgatgtcggaaacatcatcattagtctctcttccttgaaatataatacactgcaatctaaatgaattagattctataaagactcatttttcttaactattatatatatgctgatgttcaactatatgactgcatgaaaagttgttcatatagtttcataaggagctcagtaactccctaaagacacaaaaaagcactcaatgatctaattgatctgttaagaatcataaaatttgagttaaaaattatatcagcttatggaaaattgatattacatgttgatgaaaaatgtgttaactgttttaccacagagtctttgtgatccacttgtaccccaacactagctggttctggaggccataagaccatcctctgcagtggagtgaggcacgttatggatgcagaaaacttactctagtcagatgcccagctaggaatttcaggaaatccaagatgtaggctgctttccaggaaaaaggcacagaagacccaccaatggcaggagatagaaaattcatactccacccccaggattatggcaatatagcaatctattacattttgtgcttcatgatcctctctatccaaagtacatatgcaaccatagtgggctacacagaactagggaatgtgaagaaagcagcagtactgagccacgtgacttgaagttatgggtcagacctcatggcggagtagcaaaaagaaaagggtgggcaaaaaggaaatggaagtatctgagagaaaattctggtatccattttgcagtaccagcaaatcacttgaatatttacaattttctaggttctacaatgctagaagtcatgtaattctgctgttctgccatggagaggcaatactcttcagtggaaagcagcctagtgcttgcttagactttgacactaaccacacaggactagggtaggagcatgacaggaagaaaaaggtcagttggtgctaagagaaaattcatttttgcctataactgtgaaatcacaatgacctacgatgttaactgcagtatcttaaaaaactgtttttaaaaaagagaagtgctagtctgtgaaagcattcctattgtcatcactttgtaagcaacagaggtcagagagaatgtttgatcatcattttagccactgcagcacccccagcactgtgcctcacatatgataagcagcagtaaatattcatgcaactgaatcttctgtatgagcatccctgtctcttaatccttctttctagtgcttcttattttcccaccttatttcttcccatagctcgcactgctctttgtggtttaactgataatttggacaacataaaataatagtctgttgaatttactggaagataattttaggttcacttttttaattgggaaagtaaatgttaggaacactatctttttctctctaaaatactttgcaaattaagccgtgggttagcaaccttcaacagaaaaaagttccataactctaagttgaagatgtgttgttttctgctatattaaaatacaattttaaaaaggtgacttgtgccatactcttttttactgttacataaatctaagaaacaaaattttccacagttggctataaaaagtaacacagaactagcctggttcctataaaagtatcctttcgaattagaaaactaatatttaatgtaaaaaagccacatacttttcatagttccatcttcttcttcctcatcctcactgtttatcaccatggtccccaagtcggattccaacatcgtgctattatgttcaatcatggtctgggccccttcactcatcgtgcttgtggcccgcatggtgcccacactctccacactagtcttcaccatggtgtgggaatccagctcatcttcatcctgcaagcaaaatactgcaatgagggaagacttttctatgacagctggatttcttaattcttaacaagagaatgaatatattatagttttaatacttattaaaaatactattagtactgattttaatataaatacatacatacaaatgttattttaagagtgaaaattattcaaaataacctaaagctttaggtaattacagatcaagcaacagaaactgatgaagtagaaggctgctagttgcttttaaaataaggattaagataggtaaactatcagcaaatgcataacaaagaatatggtgacaaaacaactaaatatatatgagagcacctttaagacagaacacattgacactttgtattataatgggcataatgatgtctataaccttgtaaaacagccattagctttttcttttaaattatggcaaaatatacaaatacatatatataaaattcaccattttagcaatttttaagtgtataactctgtagcactaagtatatttacaatgttgtgcaaccaccaccattatatgtttacagaactcttcattccccctttccccagccctggcaacctctattgtacttacaagaggtatctagaataggcaaattcatgagtactactattcataccatagtactaattcataattactattatacttatgaatttgcctattctagatacctcatgtaagtggaatcatacaatatattttgctgagcctaatgcattcaagattcatgcatattgtggtagaaaaatttcattcctttttaaggctgaatgatattccattgtatgaatacaccacattttgtttccctatttatctgttgatggccatttggattgttgacacctttggctactgtgaatagtgctaatgtgaacactgacctacaagtatctgtttgaatccctattttcagtttggttgggtatctacctagaagtacaattgctggatcacatggtaacttcatatttaattttttaagtgcccaaactgttttccacagtggctataccattttacactcccaccagcaatgcacaggattccaacttctccacatccttggcaacacttgttattttccatttttaaaaaataatagccatcctaatgaacatgaagtgttatcacattgtagtttgatctgcatctccctaatgactactgatgttgagcaatcttttcgcacgcttattagccatttgtatatcttctttggagaaatatccatttacccattttaaaatgggttgtttggtttttctgttgttattacaaattctggatattaattccttaccagagatataatttgcaaatattttctcccattctgtgtgctttttacttcatttatagcgtcttttgatgtaagtttttaattttgatgaagtctgatttatcaattttttgcttttgttgacaaatctcagcttttaaatgtttcacagaagaatcaagtcagtaataaaagtacaaattaaaagtgctctttagaacattcaccaaagatatactggaatagggtcataaaaataaattaacaaatcctgtttgaaagaccaactgataatcacagtgctttgggaggtcagggcagaaggccaggagtttgagaccagcctaggcaatgcagcaagaccttgcctccacaaaaaatttaaaaattagctgaacacggtggtgtgcctgtagtcctagctacttgatgggctgaggctggaagactgcctgagctcaagagtttgaggctacagtgagctatgatggtgccactgctctccagccggggtgacagagcaagaccccatttcaaaaagaaagaaaggaccaaagaatctgctatttagaaaaacttgattacgcacggaaattcatttatatttattccatttttagtagaaacatataagcaaaatctagttctggcagaggtcaaaatgcaaatctgagaacatcaatgttgagtttcagcaacttgggttgtataatataacaacagttggacagctgtttgatacctttcctcttcctaaacctacatgctaagcttgggcattaggtctcaaagtcgtttgcacttctttcatgatcctttctcttttagaagacctcttcattctcatgccttcaactatctaataagttgaggagtctcaaatcctgaaatcttcctatgtctttacttattacgtaaatacttaaagatgtctaaaatttgacagtcccaaatcagatattatttcatttatctctccagtctctcctatctgtctccatccccaacaaccaccacaaagcatggtaatcttcacttgctacataaaacttcaatgtcttcttacatttattttctctttcattccctatatatgcatcagtcaactagttctttaaataattctctcttagctccatctcttcttttccattcccactgctactgggtataatcctcactacatcataggtggtttactgcagctaatgcttcctgactgaggactctcccatctaactttctagagtcagacagacattagttcaaatcctggctcaaatcacttatgaggcataggatccttgtctccaaagattgatgattaaataaaaaggtaagcaaaatgcctgcatgctacctggaacaaggtagtttcacaccttcctcaaagtacacggcattatactaacctttcttgaatactatttctatcattctaatgaagaatctacaatggctcccagttcctgccttcattaaagctaaacatttctgcctaaatttcaatgtcttctatggaccaatcctattttcccattgttcatataacctccaatacaggcaggctggactttaactgaatctctttgccataactccatatgatgctatgttcattaaagacttcctttgtgtacgtcttattctctatccagaaggtccttcccctctatccatttaactaaatcatacctagtttcagatcaagtatctactacttccatggctaattcagtctttgttaattattctcttttctaaacttccatagaatttacaaccggcattagacacttctgtattcaatttatgatctcatattgcaagcaattgttttgcaaaatcttttataaatgtaagtaccctatggacaagaatgtcttagagtacctctgaatccactaaagtgcttcattcagtattcaaaacacagtaagggtttgtgaaagttgtcagaatcaaaatgaagtcatttctgtttaaaacaacaaaaaaacaaacaaaaaccaaccctgacaaatggagcaagggaaagccataaagagatggtcctcatgcataaatgcctgatagcgaaagctatcacaaaagactgccagaaccactatcttgcacaaaggccattgcaatcttacatgaaaaatactgcgaggacatctacccagcaactgcctatccaaccacagactggcgcacaaggataagcacttcaaaacaattaggcagttctccccatttttcctttaaaaacctttgtcttcctttaccccccgaatatgcacattgttttgtatagcacctttactcgcactgccctattctaaaataaatgttactttcttttagagagtctttgctatttaggttgacacgttcaatacatattgactttttcatggaattataaaatcaaggacctttacagttagagagaaactaattcaaaccatcattttatatctgaaaacactgaggtccacagaaaataagagacttccctaaggtcacacacctacttaaaagtaggtctgggactaagaaacaagttcttttatttcttagcccattattctactatatacatgtacctgaattatgtttaaatttttctctactcaaatgcttaagttggagatgtaagctcacaatttttaaaagcttatatcaccaccttctattcccagagtcccatataaattattccatccattctagtccaagccaccatcttctcccacttggagcatgaaaatagcctactgactgttcttattgtttccatttttgccccttttagtctcactcacataggcagattgatcccttcagaagacaaatgacatgttactctcctgctaagaactctgcatttggcctcctatcacacttagaataagatccaaaacctttatcatgtccaaatgtgatctggcctatcccatctagtaatatctgccaatcccatctcctatcacattccttcttgctcaccaagctctaaccaagctgacctcctttgctgtttcttgagcattctaaacatgttcttccttttgagcctttaaattggctgatctctcagactggaatgctcatccataaatcagtttgataatttatttaactcaggtatctatttagctgtgacctcttcggtgaagctttttctgaccaccaatctaaactaaagcctccatcattttccattcttctgtattcttcacagtctatatctggcctttacgaccactagaatgtaagtctgatgaagacaagagactgttttaacctctgaatcctcattattaaaacacctagcatacagtaggtacttgataaatatttatttaatgaataaatcaatttatattttcacttattaatcatccaacaagcatttattgtacatcaagtagtacaccagacattggagatgaataagatagtttaattccatttcagtttttagggagtttgagatctaagggaaatctactaccatgtgaacaataagttacaggacaatctattaagtgctacaagaaaagtgttgacagtaaaatgggaataccaagagtagagcctctaactctgcctttagaaagtgaagaaggtctcacagaggaggctgaacttgagtcagctcttaaaagatgagtagactatatatttaacatacaacagatacatttgggtggagtgttttacaactttttacattagaactacactcagacacattccttctcagctcagacaccccaagattgaattaggtgtcatgcctctgtattcccatagtactctgtgcttatgctgattttacagtactgtaattgtctattcacttaccttgtctaaatcccccattagactctcaaatctataagggcagtaaccacatcttgtttacagttgtattcctgatgtctggtaaaaagcaatgttcttattatgtaatttattgaatgaatgttaaatgcctcattatgaggtaatgccaaaacacagaatgaaggacaattttatgaggttctagtaacatgttcttattataaaacatagaatagctattaaagatattatactttgggacaggaaataatgccattaactacaattattcagttgatcatttatttaataatgaaaaaacacttatcaatgagttagaagcactatgctaaggtctttttaattctctttcggctgggcatgggggctcacgcctttaatctcgacactttgggaggccgaggtggttggatcacctgatggcaggatttcaagaccagcctggccaacatagtgaaactccatctctactaaaaatacaaaaaattagccaggcatggtggcacgttcctgtaatcccagctacttagaaggctgatgcaggagaatcatttgaacccgggaggcagaggttgcagtgaaccaagatggcacctgggagacagagtgagactccatcccaaagggaaaaaaaaaaaaagtctcttattaaccctcagaggtgctattattcctcttaggcaaaggaacctgaggctcaaataggtttcataatttgtccaaggtcatacaacaaataagtagagaagcaagaattctaggcaggtctaattctaaagcctaagacctaccttctaattatgtaaggcttttaaactatctacagcatttctcaagccccatttaactcatactacaggtttgcaagaacatgtttcattttccgaagtaaagagatgaagatgattttctatcagttccttttttcaaatctgctggttgaatatcttattttgtcacggttgcaaccagtttattcccaaaacactaactctattttaacacgtgtgagtcatttttctcttatccttgtgagattcaatgctgtgaccattaaacttaacaagaaacataacatctgattggtataaaatagtccttagcctccctatattctacattagagttgaatctacaaagggacaataaagcctgaacctctggattcacacaattggcttagataaaattgtaaaaacattgaattaagtttggaagggattgatcttactgcatattatttttacttacgtagtcaatttgctaaagaatgctaatctaatttacaaattgacagtaaaaaatagcaataaaaatagcatgaacactcaattcactaatgagagggtgacacacaaatagaaattaataaagtacagatggaatgataactagttaaacgaaattagaaaactcacttataatttggtgatggtgttgaaaacttttaagccacagcttttactttttaaaattcttaacttattcttgatattttagattagtattataatttcatttgatactttttatatttttataatgaaacatttatgttttttcaaaattatatttcacttacatatactctgttattcctcacaaaagaaaagcagaagaaaaacatgttgatacttcatagaaaaaggtctgcagaacagatgcttccccactgtagaaagcagccaattccagtaaggaatacaatagcattttcaatcagtggccatcatgtgccaggaatgcaaaacacagtactgatgataatccagtttatgaatcataaaatccacatggaatacaaatatttgaaaacattattaggaaatcctactccactgctaagacatgcttatgctaaaacagcctgagaaataatcagagattttgcattatctactagtagatatttgtaatatctactaccttaaagcattttctaaatactcagtaattgactgaattaaggataaaaagtatttatcacttgtgagactaatttgtcattagtgtcacaaaagacaaatactttagaatataaaattgtttctatattctcaaaatgtttagaatataaaaatagaatatttctcagttaggatacctgtttagtgagacagttagactactccttaaacaggtgtcctaaacggaaaatattctaattttatttttcttcttaaaatgacattaaacacttctttattgcacatgcaatcacataacagcatagtatcagtatcagagcagtgatcttaatggctttcattcaactggacaattctaacgagtatgcattctgctatagcatgaaaaaaatattcttcagaaaaaaacgtgtaaaatatatacttgaaacaattatacaaaaagttgcattatagtggtctaaatatttttaaaacctcttaaaggtgctaattaaacagcaaacaataaatgtaacaaacatactacaaatacatagctgagttttcaagatagtaagggctcaaaacggagctatggtaataagccaaatctaacttgaaggcttctttagaggcatgtgatgatgggggtgggggattagtggttaaataaggtttatattttaacagataaaagggaaaagggaagtatttggattctttccaaagtagaaatgaaacctccacttaaaattgggaattttgaaagtctacatcctcagcaaaaggataggcaagaaacaatttacccagtggcaaaggagatgacaagtcttacctgagctaggtaaggtaggggacagggattgggaagcctccctaaggtaggggacagggattgggaagcctccctttagaatttataaccatggtttaggccttcaattttacatcactcacacgctctaggggaacctcaaactgagaagttaaccaaatatagccccagtaaggtagcaccccaggtgcctgatagaaacaaatacaaatccatattacagggacgcatactgaaccctcaactcacaccattctcagagataaaatctagccaaacgtgaactcactatcccaaagataaatacatgagtaaacaagccactgagaatgggtagaaagaacaaacaacagaattaagatgcccttgctccttagaattaatttagtccccttagaaagctggatcttggggtaaaattagggaagaatagacagtggcattctaaactgcagaaataaccgagaacaaaagtagaaatattccagctagaatggaaagcaatgagtaagtttgattgaattagggaatgtcctacagctcatggatgctttcaacactgggagcccagcataagttgcttggcaaaggagtgataggaaccttgggaactaaaagatgatttggagaagggaaagactggagaaagactagaatcagacggttattactagaatccagatttgaggataattaattagagcctgtactaaaaagggtcatatagtaacagaaatgacaagctgaatctgaaagaaatcaccaaagaggaattaacattttctagaaagtttctaggcagtcaaatataatggatcaacaataactccaatattcagaacctaaagagatcaaactgaatctaaagagaaagttgagagagattttaatttgaataaaataggtaacaccagttatttgtaatcaaaaaatgacttactatactttgtcacttgaccatatgatcaaggaaatgaaatctaattattcattttcccatcaagtaagaaatcaacaaggcatgtccaatgcaactgcaagatgagcacaaaactggggaaaactagggtaagaatctttcacttctttcctcatgcataacggaattcgggggctggtgactgcttgatgctaacatgttaacctaggtcgataaatatattttaatcactgagttagaaaggcaaaaatcaaagggtactatcgtacatttgcttgtatgtctcgaatcatgtaagattcctactaaactaaaaacactctttcctatagcaaggtgaaactactgatgtgaccaacagagcattaccttgaaactgtacttccaactctggtaaaggatagcagttatcccattgtccttgttattaatacacaaggttgtacctgtttgttgtttctgtgttccaagtgaaattgcccacagtagatcaactggtaactctgatccaactgagctaaaaattactgagaaaacatcaaaaatagtctctttcaaatagccgcccttaagtgccacttcaatgtctgacgggctgaaaaaagtaacaaattggtattcacccattaaaaactaagatttacagtatctgaaaatctataaaaagaattaattgtcttctcactgctgtaagtaggtggtctttccctttcactacgaaatcagcttaatagcttatacagctgctgtctttgacatacctgtctttagcaaacagaaacttcatggatcctaactttttgcacattcacaggcatgttttaaagttacatcaaagctttcaggatctccaaacgtcataaaagacttattcatcagtataacaagcctaattggtgaaaaggcatgtgggcaggacttcagaggctccatgatgcaagactgtacaagtttttggcattataggagaagtttccaaacaaaagattaccttacatctcctgtgcacaatactaatatacaatagagtaaattaaaagtaaaagcaaccttaaccgtgacatttcttttttctttcacagccaaaagcatgtcaaaggattgacaaatataaagaaacttataaaatcaaatattttaaaataagaatgacacctttaaaaactgttgtgttcttacaagcagtttataaaacatccacaagagggaaccaaagacaaaagactaaaattccactatttggagatttacacaaataggtttataaaataggttattacattaactaacataccatcaatagctttcagaaataggctaatggtttcttgatacatttttaagcagtgatatatttaaaaatactgtaaccactgtcatgttgatacctttatataagcaatgtttatgttcctcaaggacaacaaatgtctttcacattcagtaacctccacttgcatataatagcatgaactcaatgaacaggtggtgattccacaaaatttatagaagtatacaaaagtaaataatgaatattcatattaatttatcaaaacttcattctaaattgcttttatatgaaaagatttatgattgtatatatcttatgttcttagaacaaatacaactaagggctaaagggtctttaaaaagatttttttcttttcttcattctttctttctctcattccttttctcttccattatgatagtatttttaagagttagcagaaattttgttgttgttctttttggtttgttggtagtaaacagaaattttaatacataaattgtatttttattgtttaaattttaacaacagaaatatcacctacataaacttagatataattttgtaaaataattttagaaaatttccaaaacatacaattcaaaagaagactacttgaaacatgctaaagtaacaatattgattttaacatacagtttacatcactgaacttcctgataaaaatgaaattctggggcagaaaaatgtcagggcaacaaaaaacaatctcccccacaacccaaatatttttcacacatttgacttaagcattgctgaagaaatacttcatgtgcaagtatacaccttattaattattaaatgcaaatacattctgtgttgatgattttgtggctggcactatccttaatgatgagtaaaagtcaggcaaaacctgtttaaaacagttttatacacgtgtttcttgatttgataagtatttaccaattaaatatttatgtaataaatgtttgctgtgtgccaggcaagtgtgttaaggtataatcttttccttgagaaatgtatagtttaatggggagttacaaaatagacaaacacagtgagataaatattctcagagctaaacgcagtattccatggtgaacacagaggagcacttgccaaactgaagcctggaggagccccatgaaaggcttcctctttccagaggaggcaatggctaggatgtcaagacaaaagcagcaacctacacttttctttaaccactttttgagcaatccaatctatgctcatggtttaactaccaactgcggaaagcactgatttcctaatttgcctgagttctcccttgggattcagaccgctgtatccaactgcctgctacacaaaatgacttaaatgacctatggacatcgcaaattaaataactgctaaagtgatctcatcttacacagaaatacgccttggagagaatactgctggagaatacttcagccacagtgtaagtgcaaagtgaaaaaacaaaggctctgactatgctatcaagaagtttagttgtaaataatttgttgttttttcccttattttttaaatggtcaaaggataactatattttgaatgaggaaaaagggcccagaagaaagggataatgtagctgactaaagaaacaagcagagaaggggccttttgagggaagtaaaaagaaaaccaagagcaataaaacaattactgttcatgcatacctctatcacagtacttgctacattgcattatgatcagttatcagtttatttgtctcactcattagattgcaatcttcttataggcaattaccatgtcttatttttcttccatatccatatttataaatgggaaaaatatataacctctgaaccagggagacaaggaaacatagtgaggatacagaaacatattaaagttaaaagaaaactgaggtctagttagtacaataagaaaaaagttataaagattggaaagaaactatctatatttgcagatgacatcattgtctgtgtagaaaatttcacagaatctacaaaaaactcctagaactaataaaaattagtgtgtgtggcaacgtcacaggatacaagggcaatacacaaaagtcaattgctttcttacataccagcaataaatgactgaaatttgaaattaaaaaaaatttcaacagaaaaaaaacccacttaggtctaacatattaaaacatgtacaggatctgtatacactgatgcaaaaaataaaagatgatctaaataaattgagaaacaccccatgttcatgaatttgaagactcaatactgttaaaatgccatttcttcctaacttgatgtatagatttcattcaatcccaataagaattccaggaagttaatttagaaatgttgacaaaatgatcctttctatggaaatgcaaaaggcctagaacagccaaggcaatactgaatcagaaaaacaaaatttggccaggagaagaggctcacacctgtaatcccagcactttaggaggctgaagtgggtggattgcttgagcccaggagtttgagaccggcctgggcaacacagcaagacaccatctctataaaaaatacaaaaattagccacatgtggcagcatgcgcctacagtcccagctacttgggaggctgatgtgagaaaatcacttgagcccaggaggtcaaggctgcagtgagccgtgattgctgtcactgtactccaacctggttaacaaagcaagatgccgtgtccaaaaaagaaaagaaaaggaaaaagaaaattggaagattcagtgtccaatcttaaaacttctataacactacagtaatcaaaacagcacagtactggcaaaagaatacacacatatatcaatgatgtatcattgaaacagaataaagagctcagaaacagacctacacaaatatagtcaacagatttttgaaaatgacacaaaggcaactcattggagaaagaacagtcttttaatcaaatggtgctagaacaaccggatatccatacggaaaaaaaaaaaaaggacccagatatagaccttacagctttctcaaaaattaactcaaaatgcttcaaagacccatataacatgcaaaaccataaaacctatagaagaaaactcaggagaaaatctatgggaccttgagtttggtagtgaatttatagacaccaaaagcatgatccatggaaaaaagctggtatcatcataataaaactaaacacttcagctgggcatggtggctcatgcctggtaatcccagtacttcaggaggctgaggcaggaggattgtagtttgaggctacagtgagctatgatcatccactgcactcagcttgtgcgaaagaatgagaccctgtctctaaaaaaacaaaaggcaaaaactaaaaactagaaatctctgctctgtgaaagacactattaaagaatgaaaaggcaaatcaaaaatgggagaaaatatttgttaaatacttactttataaaggactcgtatccaaaatacacaaactcttaaaaattcacaataagaaaacagacaacacaatttaaaaatggggaaaaatattgaacatacactttgccaaagatatataaatggcaaataagcatataaaaagatgcccgacatcttcatcactaaggaattgcaaattaaaacgagataccactaaacaccttttagaatggttaaaatgcaaaaacaaacaaacaaaaaccctgaccatacaaactactggtgcgcagcaacagaaactctcattccttggttagtaggaatataaaatgatacaactttggaaaagagtttggcagtttcttactaagctgaacataccataagatccagcaactatgatcctagatacttactcaatgtacctgaaaacttatatccatacaaaagccagcatatgaatgtatacagcagctttatttattgataactgccccaaactaataagtaactattgaagatggccttcaataagttaatggataaatgaactgtcatgtatctctgcaatgtaatactattcagtgataaaatgggctattaagccacaaaaaaaaccatggatgactgttacaaaaaacgtagtgttaaatgaaaaaagccagtctgaaaaggctacataatatatgattccaattatatgatattctggaaaagccaaaactataaatggtaaacagatcagcggttgaaagggggttgggggagagttgattatgtgaagcacaatggattttttttaagggtgatgaaactgttctgtttgacagtacagtgtatcatgtgtatcgttttgatgcctaataccatgcgtttgtcaaaactttacatcataaagagtgaacctactgaggcaggaggatccctcgagaccaggagttctagaccagcctgagcaatatagtaagactcccatctccacaaaaaatgaaaaaaaaaaaaaaaaaaaaaaaaaaaagtcaggcctggtggtgcatgcctgtagtcccagctacttgggaggttgaggcaggaggatcgcttcagcccaaaagttcaagacagtgagctatgtttgtgccactgaactgtagcttgggtgaaagagagagacccagtctcaaaagcaacaacaacaacaataacaaaaagagtgaacccaatgtatgcaaaattaaaaaaaaaaatttaggaggtcaggggatcccagggtgaaatgtagaatgtggcaaaaaaaaaaaaagtaactgtattaaaaatatattgaaacaaattcactgaaggaggtgagaagaaaaggtactaacctaagtaactttggagtaagtgaactgtgaattctgttagactaaagacaaaagaaatgatacataagcagtgtaactgataatgttgttttccatgttttccacatgggttaagaattctgaaaccactatacatgtatactggagttgagaaacttagtaaatgaatgataggagccaggtttctcaccattggagttgtaggttataaacaagcaagaggacccatctagaataataatggattagagtcagacacaacagtataaattaatgtttagtttaatacagatacagatgtatacacatacatatatatacacacacacacgtgcctacatatatagttataaatgtgtatatacataggctagtatacacacatatatctccttgcctcataagctgagagggcacagaagcaacaacatcccacagtacaaaaaagtccccctggaatccaaacttgatttcctacagttttccagtaaaaggaagtaggctccttattctagtactggaacaggaaatatacaagatgagcctagaatatcttatagtgtcagagagtaaggaagagctaaaaacaaaacaaaaccgcacaatgatggggatatgtcatagggacaaaggagtcaaaacaaaaggttcccaatggccaaagctggaacaatttaagcaaaataaataaataaataaacatagtagtattggattataatccaaaatataaactaataaccatgagtcaatattgatgcgaatgactgaataaatggggagaagagacaaatctcctgtgtagaaaaaattctaaatactccatcctcaagaaagtggagaataaccccccacttcttaaatgtgagctgtgtactgtgacttccttccaaagagtacagtatgaaaagaaagaaagaataattttactgtaaagaaacatgacatgctacctcagtcatgtgatcctggttaacatcaacagtggtaagtcatgttgacagaataatttactcttgatgtgatgagacttatatttatctctgggtcttttcaaaaaccaataagcctcgtctcatcattagaaaaaaaaatcccaattgaaggacattctacaaaatgtctaaccattattacccaaaactctcaaggtcaccaaaaacaaggacattccgagaggctgcgacatcatgaaccctttctgtgcctggcttatatcatttaacgtcctccaggtaaatacgtgcttgccacaaatgacaaaatttcattcatttttatggtatatacataccatgtgaaattagccaagcacagaaagactaaagaagctgatctcatggaagtagagagtagaaatggtggtttccagaggtaggggaggcttgtagaggctaggggtggtagggagagattggtcaataaatacaaaattacagttaggaggaataagttctggtgttctgttgcatagtacagtgactgtggtcaacaatactgtatatttcaaaatggcagaagattttgaatgttcttaccacaaagaaatgataaatgcatgaggtgatggaaatgctaaatattctgatttgatttttacacaatgtatacatgtatcaaaatatcacactttaccctgtaaatatgtataatcgttatatatcaattttttttaaaaaagagaagcctaaggagacatgatgactaaatgtaatatggtaacttgatgggtcctaaaacacaaaaagaacattaggtaaaaactaagtaaatctgaaaagaataggcactttagtttcaaatctgtattaatattggttcattatttagacaaatgtatcatacgaatataagatattaataacagggaagactgaatgtgggtggtatatggaaactctctaaactatttttctatttcttctataaacctaaaactattcaaaaataaaaagttaacttaaaaaattgagaaaatcctttgctttttaatttgagcaaatatttattatctgttttatcacaaggcccaacactacaacccataagtcagtggttctcacccaggccacacattggaatctgttaggaaggtttttaaaaaaatcctgatgcctaggccctagcctacaaaaattaaatgagaaatttcccagaataaaaatcaagcattgttttttgtttgctttttccaaaagccaccactaccacaaagagaaagctcaaatgatatagcaatttattaaatattttacatactatatcgagtatcacaaatcccaaagaatcatgtttctattagaggtaataaagcatataaactctaagtgattaatgtctacaatttttatattgacaagaactctgtattccattacttcaccaaaaactttttgcagtttcttttcagagtatttttaaaatattttacaaatttcaatatgtatatgcttttaaaaaatgcacttaagtacattctattttcaaaatagcatcatttattcaataatatattttaaactttcatatggcagagacaattcccataaatttgctttatatcatacacaacactaccgtagaatgctccttggtaacaacaaaatgttgcattttgaagctttattgcatagaaagaccaattttgttaatacatactctttaaaggtggacttgccataagcaattcaagtgtttacagtaaatatgaacaaacagatatattatttaatcaactcatgctaaagatttgggaatatcttccactaatatccagaaaacgaattcttactatgtaatacagttgacccatctcaacacctaatttacatcacatactcagaaatgccaaaagaagatctttgtcatatttaacaacacttaaactaacacaaaaactttgatattggattaaccttctacagaaatctctgtttgcaatttgtttaattttagaaatctgtacaattacctcagcacctatcaaaacatgtcaatttgtcaagatacattctcatcagacaagctttttctataataggtataaaaatcaaattcataaggcactatttccaatcatgctccatacttttcttgaataaaaaatattttaaaagatttgtttataatagttacccagggcacaggtgtatgcactaaaattttaaaaaccaacatatcttgtaatggttatcatataccatttcctttttaaaagccacattataaattgatgaaaatggcaatttaattttaggcccctaatttttccccaactgcaataagccaaactagatagaagtaaattaaatttggaaatttttctttatattgttataacccatacattttctgaaaattatgttaagaatgcaggatccacacacaatagacccaagtatcaatacttgatgtgaaatataaatctctcccttaatgtagcagcgaatttcagttctgaaattctgaaatcagagaaaaaatttgatctacattatctaaaaagttagttttatgaaatttttcaatggtccaatgctaaacttgctctgtgtcattatttgctccaccactgcttaaggaccaatccagagtctggactggaaacagctacagtaaaagctgccagagaatacaggtcctctgggctgaaaataaatcagaagcaaaagttggcaatacagatctctcaccatgctgaaaagacctttcatccatgaaataatcaaaaaggagaaaaaagaatggagaaaaatttcactgaaaacaactgggacaccaaaatatccatctaaaactttccgccatatcctaaaagaaagtcagttccccagtaccaaaactaagtaggtaatggccaaatgaatccctcaaactaaagcaaaagaaaaaaagaaaagaaccagaaagtttcatgggccaaaggtaaccaagctaagctgtgaacacaaacaagaggttgcaatgcaacaaccttgacttaacagatacacatgttaagtcaagcacagtatcaattagataacaaggggtccaagcttgtactttcgttccataacctagacaaaattattgtaaaagacacagtggttaagaaaaagaaaaatatcatttatgtctattctttttgttgtgttgttgagacagggtctagctctgcagtggcgcaaagtcgactcaatgcaaccttagcctcctgggctcaagcaatccttccacctcagcctcctgagtagctgggactacaggtgagcaccaccatgcctggctaatttttgaatttttggtagagatggggttttgccatgttgctcaggctggtcttgaactcctgagcttaagctatccacctgccttggcctctgaaagtgctaggattacaggcatgagccaccgtgcctggaccatttacttctattctaatcaactataaatttggatatgatttgctttaattgtcctgattccttgtaatgctaccttacagaagttttcccttccctgcttgtcactttgacaacttgtctaaaacaaatcagaattgaacaaactatgattttttctttgaattgttctaatttatgggcactcaaggagtttgttaatcactgaaatatacggagggttttatagatttataaagagatcatattacaaactcaatatcaaaaattataattttaggccaggcacagtggctcacacctgtaatcccagcactttgggaggccgagacgggcaaatcacttgaggtcaggagttcaagacctgtctggccaacatggtgaaactctgtcactactaagagtacaaaaattacccaggcatggtggcaggcgcctataatcccagctactcgggagactgaggcaggaaaactgcttgaacccaggaggtggaggttgcagtgagctgagatcacaccactgcactccagcctgagcagcagagtgagactgtcttagatagatgatagatagatagatagatagatagatagatagatagatagatagatagactgatttaaaaaataaaataaaaattataattttagaacagtccaagaaattacaaatggcaggagctcccatcaaaatggagattagaacacacaggtttacacctatccctctcaaaaccctctcaaaactacaataaagccacagaaaaggataaaccccaaaagacaaacagcacaggaattgaatagataacagtatatgggagatgtcaaaaatgtggaagctagaaaaatgtttggaagttagaaaacagataaatatgtaagcagctaactcagcagaccaaaaataagacttaagcttgcaaagagaaaagtcacaagaagcatgtgaattcagagtagtgaaccctaacatcttttacagcaaaatttgctggtcaactagttccactcttacacacagagctgccagaggtaattttagtgcttctctcaaatataatccccgtacatttgaagaaagcccataaagtgaaatgtcagagatcaaaacaaacacaaaagaacagacacaaggcagggagcaaaagataactcaaaataataataatgaaataataacgtagaagagaaagctatcttagacattaaatatctgatatgaaaaaatagcaagtttggaagataaacttgaggcaatctcagaagaataaaaagagaaaaagagggaaaaggaaacagaaaagataattgaaagactaacctaaaaggttcaacaaccaaataaaaggagatccagagacagagaggagagacagtgaaaattaccaagaaatagcaaacatgaaatcacatagaactgaagggtgtttccagatttaaaaagtcaaaagacactccatacgatgaatggggaaaagatgtataccaaggcacattattaggaaagttttaaataacagggacaatgcaaagatccaaaaactcccacattcaaacattcaaagaatcaggtatctgaatggcatctatcttctcatcagcattattgctgagcaaggaaaaagagcaaggtcttcaaaattataaaagaaagttattttcaatccaaaattttacacccaatcaatcaatcaatcaattaagggtaaatgtacaataaagacacggtcagatatgcaatgactgaaaaaaactgctgctgtcaggaagctactgggagatatgatacataaaaataaggaagtaaaacaagaaagacagaagacagcatcagggataaagagattacagaagaaaaaaaagaggacattccacaggttgatgttgaaaggaagtcttaggatgacagctgctcaacactcctaaagaggaattagttccgattagtaaaggacagaagactattgaagggatgaatcaataaaaaaaaaaaagtacggcattaataaattgtgtttgaacatacacagaggagctcagagatccagcagagagtttgggaatatagcatttgggaacaaactagtgattagaaaactgtaaaaacaacaacagtaacaaaaacggagacaattattggttctgaaaatcacaaaaagaaataacatgtaatgataatatgatataagtgaacagtatttacacagttataactatataagaatttgttttaattgtgattacataggaaaaattagacataacaagtaatcaattcttttacaagttttcaatttgtggtaaataattttatctgaaatatttcttattaaataaaatttactttttaccatgtaaaggaatgagaataagtaaatgttctttactggttttcctcaaaaaaaaaaaatatgtgtgtgtgtgtgtgtgtgtatgtatatttatacacattttcaaatatatgtatacaaatatacatatctatacttatatttaggaaaaccagtaaagaacaaatacatattacatattaataaaaataaaaatattaaagaatataaaaatatatattgtaaaaatataaatatataataaatatataaatatatatatgttttttctttttagacagagagagagagagataaagagagtctcactttgtcacccaggctggggtgcagtggcatgatcatggctcactgcagcctcaactgcccaggctcaaaccatcctcccacctcaggctcccaaatagctgggactacaggcatgcatcaccaagcctagctaattttgtgttttttaatttttttttttgtagagacagggtttcactatgttgcccaggctggtcttgaacacctgggctcaagcaatcagcctgtcttggcctcccaaagtgctgggattacaggcgtgagccaccgtgcctggcccaaatatatttatttttaattttaaaactagatttaatatctaccaactcttccaaacatatttgaccagttaaaatttgttttaaaatgttttttaaaaaattgaatctatatcagttcacaccagatcagtaatgttattttggtggccacaaggtagggcaaaaccagtaagggcaaccagcaaaaaaaacccgaaaactaaacaaacagaacaataacaaaaacaaaaaacctggccaaaatgttacaacagcagtagtgatggtataagtagtggcattaataaaaacaaaagctaaactttattgagcatactatgtgcaaaacattgttctaggtgtgtatatatgtaattatatcctcataacaactctatttgcagatggtaaaactgaagtagagaggttaagtaacctgcccaaagacataaagttatttgggaacagaactagaattcacatccagatagtatgatctatttttagataatgcaacctcccttttaccaagtaagtacattacaggcttctggactgacttgggctaattctcctgctgttcttttctttacctaattcaaaaggttctcaaaaggtagacttttggccagaaacagtggctcaggcctgtaatcccagcactttgagaggccaaggcgggtggatcacttgaggtcaggagttcaagaccagcctggccaacatggctaaaccttgtctctactaaaaatacaaaaattagctgggcatggtggcacacgcctgtaaccctagctacctgggaggctgaggcaggagaatcgcttgaacccaggaggcagaggttgcagtaagccggggatcacgccactgcactccagcctgggcgagagagtgagactccatctcaaagaaaaaaagaaggtagacttttgaaggtccctattgaacaggggtaaggggaaagaggggaaggcgggggaagtttctgtctaagaaatgctcacctgaaactgtatcaccacctgaggggaatgggttattcaaagcaccctggcatttctccccacacccatgctgagaattaattgctttagtgaagcatgtttaaagagaacatgacattattcagacattaaggaccgcaacctgaacagctctgagttcagaccataagaggtcaccagaaagtcctcatttcttttccaaggatagaagctctaagacatagtctaagaccaattagacttcttttctttgagtcattaataagttaatatgaagtcaaataacacctttcttcagataaaagtaaaggacctgatacatgcataaaagtgaaaagatttcattcaagcttaacatcaaaaagtatcccattttttgctcaacatttcacttaaaattcttctacatccatttaactccttgtattttacttaacattgtgatccttaagaaacgtctgagctccagtgacaagcaattcttctaaactccttatcagtcttttaaagtgctttaaaaatagcatgtcaatgctacattctatgccttatcttataaattcaattaacatcattctgctttgaaaatcatcatccaatgtaccacatgtagaatatttgctttgctgttttacttaaaaacaagtactcttttactgtataaatatttaaaaactcattcaagtacctgtacaatattcaataagccataccagcaaacttacaaattagtattttaaaaatcatcaactaagttcaagaaatacataagaatgaatactgcttgttgtgtaactaccaaattaccaaactgcatgcttacattttgaatactagagttaaactagtactaactgcacaaatcctgtatgcctgctttttatatacacaacctagattaaactttgtgttcatttagtcaaaaatgaatgtaaattttataaaaaatattttacttttatgaaaaagagtatcacttcaatgaaataaattgtcctactgaacatcaagagatgtgtagtctatgataaattagctgatttaaaactgtatatgtaattcaatttaagccaattcacaaaagaatcccaaaggaataaatgatataaactatttaagattctgagccttcaatgtggataaactttcctgagaaattacatctactaattttaaaagttgctaaaaataaatggcaatgtaggatatacatttactgtagaaagacttcagattcattctgcctatctcgttcttttaagtgcttgtgagagtgtatgtgtgtacatattgtatattttctatgcagggcaacaacagataaaataacctcaaaatggaagctactgcctgaaaaaataatctgaagaaagcatgtgaatattgctcaatgtgtgactctccaaactttttacttttttcttataatttcagtaaaaaagactataagagttttacccagaaacactaagctttgccccagagaataaatgtttattcaggaaaaaaaaatcataaaaacctgacataatttttaagtgctcataatatttcccctcaccttgaatatggacaggaccaagtaacatatacctaaaacgacttggtatcattggatttgaaactaagcagtgggcagaagctagaagcactttgaagacagttttagtaagagcctgaagagtcattaaaaaactgtcagaagcctgacagcctttaagaaagtttcaggaaggtaagggaaatattagaaagctggagaaaaggagattcttatgtggtggcagaaaatttagaaactgttgtattagtccattctcacactgctatgaaggaatacctgggtaatttataaagaaaagaggtttaattgattcacagttccacatggctggggaggcctcagaaaatttacaatcatggcagaaagcacctcttcacagggcagcaggagagagaactgctgagcaaagtggggaaagccccttataaaaccatcagatctcctgagaactcattcactatcacaagaacggggtggttgttccctgattcagttacctcccaccaggtccctcccatgacgcgtgaggaataagggaactacaattcaagaggagatgtgggtggcaacacagccaaaccatatcattctgcccctgccccctcccaaatctcatgtcctcacatttcaaaacacaatcatgcctttccaacagtcccccaaagtcttagctcattccagcattaactcaaaagtacaagtccaaagtctcatctgagacaaggcaagtcctttacagcagcactccactacttggtaccaatttactgtattagtccattctcacgctgctataaatacctgagactggttaatttataaagaaaggagacttaattgactcacagtttcacatgaagcctgaggaggcttcaggaaaattataatcacggcacaaggcaactcttcaaagggcagcaggagagagaagcgccgagcaaagagggaaaagccccttataaaaccatcagacctcatgataactcactcattatcatgagaacagcatgtgagtaactgcccccatgattcaattacctcctaccaggtccctaccatgacacatggggattatgggaactataattaaagatgaaatttgggtagggccacagccaaaccatatcaactgttggctataggaaccagaaaagtaacaggaaaagtaaaaaatgtacctaatgaactgggtggtctagcaaagcatgtaagatgttgcctggtttcttcttgctgcttataatcaaacacaaaaggagagagataagcttaagaaacgacaattaaacaaaagagggactgagacttgtcgattttgtaaatctccagcctctatagacagcaaaccatgctacagttatgagacagcttgcaagcaaacctcaaatccaggcaatagtcaggaaattatggtctaaatatcaagctgaaaaggtgactgtaaaatcctttgttcagatttctgacagatccatgcagttcctcaacagggcttctaagaagcttaaaggcattgtccctgcacaatctcatcaagaggccaaaatcagggaaacaattatctcaacaaaatgtatgagtatagattattctaatggagtaagctgcaatgagatttataggagacccacaaagtgtttttggcagaaacactaccagcattgactgcatagcacagagatgcacgaaatgaaaagagggctttggactccaaaatttctaaccacaggaagcaggctgagaaaactatctagctcaacacacaggctaccttccatgaaaaaggaagaactcagtgggcagagcaaaaaactcagagaacacagaaaggagccatgaaaaactatcctgaggtaggaatagaacttagttttaatgaagaaacttctaacatttgcttggctggattccaaaactgctatggaatagtgactcgtgcacttcctgtcttcctttttttttaaacagaactacccataatgatataattttatgcctgacccaccattgtacattggctattcggggtggtgggggtgaggtaagaaacatctcttttgtttataggtcttcagattgaaaggaactggacccaaggaacattatctctatctgaatgtaatttagaagatgacattctagattttgagctgatattgtaaagaaataatacttggggtagatgggatagtgcgtgtattttgcatgggcaaggaatgtaaataaggtgcggccagaggatagtctgagccagttttaaaacataaccataaattctttggcaattctcccctcaaaaggtggagcctcattcctattgccttgagtgcaggccagacctagtgacttgtttttttttttttaattgaggtgaacttcatatacaaaaaattaaccattttaaagtatacaaatcagtggcacttagtacattcacaatgtgcaaccatctcctctatctagtatcacagcattttcatcacctcaaaagaaaacactgtacccattaaggagttgctctccatccttccttctttcccacaccctgcacaccacaactgggccctgtcctggtctctggtaaccaacaacaatttgcctataattcaattgtaagttgtaagagttctctatacagtttgcttttttttttttcttttaaacagatggggtctcattatgttgcccaggctagtcttgaattcctgggctcgggcgatccacccgtctcagcctcccaaagtgctggtattacaggcatgagccaccgcacccagcttctatacattttggatactagacccttatcagaagcataatttgtaaatattttctctcattctacaggctgtcttttcacttcttgataatttattctcttatgcacaaaaatgtttaattttgatgaagttcagtttatcttttttgttatttctgctttagtatcattctctaagaattcactgacaaatccaaagtcatgaagaataaccctatgtttttttataagagttttaaagttttagctcttacatgtagggtgttgatccagccaatcagatcttatactaaaaggctgctgtatttgataaaacataggggtctaacttcattcttttacatgtggctatccagctatcccagtaccatttgttgaagagattgttcttttcccattaaatggtcttagcaactctgttaaaaatcagttggccatagatttatgggtttatttccagactttctattctattcccttggtctacatacctatccttatgctagtactacactgatttgatcactgcagtttcatattaagttttgaaaacagaagtgtgagtcttctaacatggttcttcttttttgatatgttttggctatttggggccccctgcaattacatatgaatttgagaactgacttttcctcttctgcaaaaaatgacctgaaatttggaaatagatctttaaaatctgtgaattgatttgaggagtactgccatcttcacaatataatgtcttctaatctctgaacacaagatgtctttctattgatttaggtcttttagcaatgttttgtacttttcactgtacaagttttttaactccacggttaaatttatattttaggtatttcattcttttggatgctattataaatggcattgtttgcttaatttcctttttacatttttcattgctggtgcctagaaatacaactgagttttgtggttgatgctgtaccctgaaactttgccaaatttatttactagctctagcagatttagatggttgacagataacaaacaggaagttgctctagctcatggggggctgaaacaaaggtatctgcaccagtccctcagggaaccaccagacaggtcaaaatgaaaactacaattttttttcagaacaaggatcttattgtccccgtcctggcaccagtgagctacaccgggaatatgggttgctggccccatagctgctgctgagctagaaaataaaggatattaggtatataagcaaaaatgtcataatgctttcttatcaaaatctggcactcccctggatgctgttaagttttctatcagattccagagttatgcaaaagttgatttgtcagttttttccagtttaacatagttgcttctgtggaggtaactgattcttagagctccttgctccaccactcacttgcttttaaaaactgggccgggcgcagtggctcatgcctgtaatcccagcactttgggaggccgaggtgggtggaacacccaaagtcaggagttcaagactagcctgaccaatatgatgaaacctggtctctactaaaaatacaaaaattagccgggtatagtggcatgagtctgcagtcccagctactcaggaggctgaggcaggagaattgcttgaacccaggagatggaggttgcagtaagccaagatcatgccactgcaatccagcctgggcaacagaacgagactcggtctcaaaaacaaaataaaataaaaataaataaatagaatgtggcagaagtgacagtatttaactcctgagactacaacataaaagacagtgagaggtcctctttgttctctctcttggaccactcactctgagagcccctgaatgagccatcctggaagtgaatcctccagcccttgtcaagccttcagatgactgcagctctgatgaacacttagattgcaatctcataagaaaccctgagaatgaatcacgtaactaagaccctcctgaaatagcaatctacaaataccatgataataaatgtgtgttgttttaaggtgctatgttttgggggtacatgatatttaaagctgagactcaaaagaaaagaacctagccactccaagagttctaagaaaaagagtgtttcaagtaccgggtatagcacatgcaaaggccctgagtaaggaaagatcttaagcatgttaaaaaaaaaattaaaaatctgaaagactagtgtgacttaagctcagcgaaggaaagaaaaatagtgaagaaagagacccccaaaggggcagaaagaaaccaaaattactataacaaagtcttaaaaagtagtaaaaactgataatatatgataaagtgcctttgaaaccacaagaaacaactacaaaaatttaacatttagaaacattaactggagagaaatctgaaactaaatgtatctatcatcacacaggaatccagggtaggaaatatgaaaccccctgagagcaagaaccaagggtctttacatctcccatatcacctactcatctttgtagaattaatgcacaatgacaaacctgaaaaaaataccttttgaagacactatttaaaattctaagtaatgaattcattggtgaaagattttaagtctagaatacaggcttcaagtatctcctcactaggtagtccatgacaacggccaaataaataactcatgtagctgcatatctaaagaacatgattataaatcagctctacaaagatgcacatttctccttgtcctgggctaccatgtgataaaaggttttataattggtaaaaagagtaaaagaatttcaaaagaattcccaactggataaccagtctctgaaattaaaactgaatttaatttagcaaaataattccatttgtatacagaaactgtaagatttttaaaatgaacttttatgggagaacatactgttacgaaatacattttcaatcagtaaaacataaaataatacatgtgttttcagattttatgactatttgaataccaagggttattctcctctatatctttatccagaaaaaaatatataacttgaaacacaaaggcaaaaaataattagcaaggtatagaagcactagacactacaaaccaggtgcagtggctcacacctgtaatcccagcattatgggaagttgaggtgggtagattacttgaggtcaggagtttgagaccagcctggccaaaatggtgaaaccccatctctattaaaaatacaaaaattagccaggcatggtagtgtgcgcctgtagtcccagatactcatgaggctgaggcaggagaatcgcttgaacccgggaggtggaggttgcagtgagccaagatcgtgccactgtactcccgcccaggtaacacagtgagactctgtttcaaaaaaaaaagtattagacactacaaaatgtggtaaataaatacaattattttatttcgttatttaaatgtagtaacatcaatataaagtaaaaggaattaatagctagtttaatatgctaggcctttttatgtcccacctgcaactcctgctatggtacgttttatctacagcatagctggtgaccagttaaaagaaaattccagaagatatgacacaaaactgtataaattcaagacaatatttatttaacaaacccagagttagtatcaactagatactaggtactgtggaagttcatcctatcaacattacattccactaatcactaattcttaagacatcagaaaaagatagcaaacatataaggcaaaccaaatatattttgagattcaatgaaaaaacatatcttacttgtatagtaaaacagtaagtgcttttaatatattttaacagaattacagacaaataactcagaagaaaaaaatcaactttttgaagataattacaaaccgaattttcttcttcctcttccaattctcgttgctgttcctcatgtcttttagctttgatctccatagcttctgtgatcaggtctcttaatattgatacaggtttggcattcttgataaaaggatgctaaaaaagtaaaattcaatggtataaattcaaaagatttttccgaattatagctaacaaatgttaaaacaacatgtaaatgttaaccaggatcacaggcttcaatgattgttttttcatctagaattaaatgtataggttaagaaaagagagtatggccactgcctagaaataaagaatttgctttggggcttgtttaaaaaaaaaacttaaagcacacatgcaaaaatgcaaccctgttaataaaactataatatccttaaagatctaattgtccaaaggaagtgtacattaggagtaaaaaagattaagttaaaaataggattacagattatattacacatagaaataaacttattttggtactgagttacgtaatttaattaatcttaataagttgacagccaaaatcagtggccaaaaggagagcaactattttgttacttctttaacatattttctattttattgtatcttaagtaatttaaccaagacaaaaatattttttcagaaaatgaatgttgcctaatttctttactatatataaaataacttgtcactttttaaaaaatatcaccctgatctagctaaaatagctaagctctctatcattctgacaaagagaaggaaaactatcagaatagacctaggttttgaatttctttttattgagaaggagggacatgagagaaagtagagtgaaaggttataattttggatagataacctaaatttggggcagcaatcagtttcagtaattttcatagttacatgtcagtagatagcatcaggtaaaagtgacctgactgagtgagtgagttatttgtttatttgtttgtttgagacaggggcttgctctgttgcccagatgcgagcacaatggtgcaatcatggctcactatagtcttgacctcctgggctcaagtgatcctcccacctcagccttcctaagtgctgggaatagaggcatgagccactgcacccagccctgagttattttaataaacttcaagagaacacaaaaatatatttaaagacaaaaaaaattgtgctgaagaagaaatagatacttgaaagagggtttaaaatggcaaacatatcatttgggacaactataagaaagaactttttcagagtacagaaatactaaaatcaattgtaaagaaccaataaattattttagaacagttatagattaatcttaccaaacaaattaagtcctattaacatatctgtggtagagactcctggtcatacaccaaaaatagagttgtggttggaccgacaattgcccaactggatcctacgtttctcaacttaacccattcaggtggttatatgcgactaagtgaatgcgggagcaaatactgtgttccacttcctggcctgggctatggagggctccttgttactaatggataagggtgagaggtcaggttctcccagagtcctgtactggtactgtgggaagtagtctcattttagctgattggcgatgaaagtcctgacccttcaccagactgcctctgaccccactccaacagggaggttgttgggttcttattcctgcctggtaggagtataagtctaggctcccacatggtcttcactggcactccccacttagggagggaatactttctacactgccttgtggagatgaatgccttagcatgacagccttctctgacaccgcctgagaaggactggacagcctcaaaaggatagaagtctaggttctccatttagcctttgctggtgaccggggtaggccatagttttcttggtggtgtttggctagagtagaacggttatcatctgaaagttttcagtcttactaggctgtccatttctccgtccttctgcttgaaagagcaggtttttatttctagtttgtgtccaatgttgtttctgggttgttggcttctccactacccagtgtgggataaatgagggaaaaagaaaccccagggaactcacagctatgtctttccttgagtcccaccatctctagcagtctattgccttctttccaccttttagagtctttttatgcttgttttatatacttacaatgtccatggttttagctgtactttaatgaggaagtatagagaaaaatatggttactcaatctgtccagcggcagaaatgccttcttcaactcactttaagcacttgttttatctgaagtgtttttgtataaatcattaattttgaacactatcagtttagaaattgataattcagaacatgaacaaaatttaagaggaaatatttcagattttaaaagaataaacttttcaagcagtctcaatttttaaaatacatcatcaagaatgtgataggttgatctgcagtaatttctgtcttctcattactttaggtggtttaagaatcctcaccctctttaatttttattttagacacatttagaaataggaaaactttactgcctattagaatctggtacattcatctttttcttgttgaaatactttataaaacccttcatataatcagccccttgcctgacataaatatatatatatattttttagtttccgttttttgccattcatgcattttttaagttatatgtattcaaatcatccatttttcttttgctttattgcaccggaatgaatatataaatattctcctatattaacccctagttctttcctatttccattttttgttttagtttttttaacatttaagaccttaatctatctggaaattactttggtgtttctgtggtgaagatctaagttaatcctcccaacaccccctaaaggcaggcagttatctcagcaccatttttactttgtttttccctcactgattagaaatgctatcttcataatatgctagtttcctttgtatattatataccatttgtgggcatttaattctgcttcattattctatctcatactggcgttacatacttttctaagcatttaacaaaaagatgtaatttgtttattaaacataaaatttgatttttctattaaatcaatcactatataattcagatgatgtttattttttgcctatatggttactcagtgactgaaaacggaatatcaaaatatcccaatttatttatttagagcaacctcttatgtctttaatttgtaacatacaatgctatattaatatatcaagtttataactatatcttcctttatattatgttctttatcaatattaagtgactccatcctcatttactgatttctgctgtcaattttgcttttttgatcatgttattcatactatctttttatattttattaaaatttcattgcctgtttttaacttttttttttaaataaaaacagacaattgaaacatttttattaggttaatttcactttttacattactacaacaataacaaaaataccaataccattgaatacaattaagaagtttacttaaatcatattcctcaaaatttggtgtgtatcatcacatgtgttagaatcatgggagcgagggcagagggttacttctaaatattcaaattctcggcctcccctagacaaactgaatcagaatttctaagaatgttgccatagaatctgcattttagcatttctttccaagtgatttttatgcaaaccaaaattaaaaatactgcattgacattttccatcccagtcttctgaagattgaaagttaacagcagggttggggtgggctggggtgggacaaggtcatgggaaatagcagcccaggaagcatcagcactgtcatcctcactgtggtttggatgaagtaccttttcaataagctcttctgtatctcttgataaacagttacatggtaatgaaacttttcaaggttatttccttgagaatacagctaaggcagcttcttgcgtctttccaagcagaatattctgatattattattaatctttatcttgtcttgttctgaaaacaatttgagctatcttatgaaattcatagtctatattagtttaagaagtagatgagaaaataagctcaggaaaataaacctatgggtaagagagagagtgtatgtgtgtgtgtgtgtgtgtgtgtgtgtgtaagagagacagagagaagaaagagagagaaggtaacttagagattaataaatacttcttttaaaaataggagttatttgtattttagtttttaattcaacctaaaccttctctctgtagggtttcacaattttaaaaaagtatgtcttttaatttaacaaaatgcaaacatgtatctctgctagtggagaaggtagtgaaaatctttttttttttaaagtttttttttcttttattattatactttaagttttagggtacatgtgcacattgtgcaggttagttacatatctatacatgtgccatgctggtgcgctgcacccactaacttgtcatctagcattaggtatatctcctaatgctatccctcccccttccccccaccccacaacagtccccagagtgtgatgttccccttcctgtgtccatgtgatctcattgttcaattcccacctatgagtgagaatatacggtgtttggttttttgttcttgcgatagtttactgagaatgatgatttccaatttcatccatgttcctacaaaggacatgaactcatcattttttatggctgcatagtattccatggcatatatgtgccacattttcttaatccagtctatcatttttggacatgtgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttagctgcataaatgtcttcttttgagaagtgtctgttcatgtccttcgcccactttttgatggggttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaaggccttgcccatgcctatgtcctgaatggtaatgcctaggttttcttctagggtttttatggttttaggtctaacgtttaagtctttaatccatcttgaattaatttttgtataaggtgtaaggaagggatccagtttcagccttctacatatgactagccaattttcccagcaccatttattaaatagggaatcctttccccattgcttgtttttctcaggtttgtcaaagatcagatagttgtagatatgcggcattatttctaagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggcctttttcacgatattgattcttcctacccatgagcatggaatgttcttccatttgtttgtatcctcttctattttcttgagcaggggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgaaactttgctgaagttgcttatcagcttaaggagattttgggctaagacaatggggttttctagatatacaatcatgtcatcagcagacagggacaatttgacttcctctttttctaattgaatacccttgatttacttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatatcccatcaatacctaatttattgagagtttttagcatgaagggtggttgaattttgtcaaaggccttttctgcatctaatgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattaggctgtgaatctgtctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctcggatggtagtttgtatttctgtgggatcggtgttgatatcccctttatcattttttattgcatctatttgattcttctctctttttttctttattagtcttgctagcggtctatcaattttgttgatcctttcaaaaaaccagctcctggattcgttaattttttgaagggttttttgtgtctctgtttccttcagttctgctctgattttagttatttcttgccttctgctagcttttgaatgtgtttgctctggcttttctagttcttttaattgtgatgttagggtgtcaattttggatctttcctgctttctcttgtgggcatttagcgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagattcttaatcctgagttctagtttgattgcattgtggtctgagagatagtttgttataatttctgttcttttacatttgctgaggagagatttacttcaaagtatgtggtcaattttggaataggagtggtgtggtgctgaaaaaaatgtatattctgttgatttgggatggagagttctgtagatgtctattagttccgcttggtgcagagctgagttcaattcctgggtatccttgttgactttctgtctcgttgatctgtctaatgttgacagtggggtgttaaagtctcccattattaatgtgtgggagtctaagtctctttgtaggtctctaaggacttgctttatgaatctgggtgctcctgtgttgggtgcatatatatttagtatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccttgtatttttagcctatgtgtgtctctgcacgtgagatgggtttcctcaatacagcacactgatgggtcttgactctttatccaatttgccagtctgtgtgttttaattggagcatttggtccatttacatttaaagttaatattgttatgtgtgaatttgatcctgtcatgatgatgttagctggttattttgctcgttagttgatgcagtttcttcctagtctcgatggtctttacactttggcatgattttgcagcggctggtgccggttgttcctttccatttttagcgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctttctcgaggagtatctttatggcgttctctgtatttcctgaatctgaacgttggcctgccttgctagattggggaagttctcctggataatatcctgcagagtgttttccaacttggttccattctccccatcactttcaggtacaccaattagacgtagatttggtcttttcacatagtcccatatttcttggaggctttgctcatttccttttattcttttttctctaaacttcccttctcgcttcatttcactcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgaacagatgggtttttggtgtggatgtcctttctgtttgttagttttccttctaacagacaggaccctcagttgcaggtctgttggagtaacctgccgtgtgaggtgtcagtgtgcccctgttggagggtgcctcccagttaggctgcccgggggtcaggggtcatgcacccacttaaggaggcagtctgccccttctcagatctccagctgcatactgggagaaccactgctctcttcaaagctgtcagacagggacatttaagtctgcagaggttactgctgtctttttgtttgtctgtgccctgcccccagaggtggagcctacagatgcaggcaggccttcttgagctgtggtgggctccacccagttcgagcttcctggctgctttgtctacttaagcaagcctgggcaatggcgggcgcccctcccccagcctagctgctgccttgcagtttgatctcagactgctgtgctagcaatcagcgagactccgtgggcataggaccctctgagccaggtgcgggatataatctcgtggtgcaccattttttaagcccgtcggaaaagtgcagtattagggtgggagtggcctgattttccaggtgccgtccgtcactcctttctttgactaggaaagggaaccccctgaccccttgcacttcccgagtgaggcaatgcctcgccctgcttcggctcgcacacggtgcacgcacccactgacctgcgcccactgtctggcactccctagtgagatgaaccgggtacctcagatggaaatgcagaaatcacctgtcttctgcggcgctcatgctgggagctgtagaccggagctgttcctattcggccatcttggctcctccgaaaatcttctcttgagaaaagtgaatggacaaataaagatttctcatttccgacaaaagaaaataaccagcattgatttgctatttctgttgttatgagtgcttccaggtggttgtctttggatctgctctgttcctgtgcacctcttcttggaatataaatttctgagcctcaatgtgccctgatgccgttcctttcttccaccgtaagagttaccgaaagctcggcgtccgtgatggggtagagggcttccgaggcgatcgggcagtgtcagtcttcagccgctaagccgagaagatctgggaaggagtcagagagccttgggccagagttccaggggctctgggagtggcggatttgaaattggtgagatgtatcttgggctggtcggtctgaggacctgaggtcctaggtggatctttctcaaggagcaaaaagcaggaggacgggggattgatctcccaagggaggccccccgatccaagtcacagcaccaaatttcatgcacgtccgtgtgaagagaccactaaacagctgtttttaacttttaacccaaattcttttaagtatgcctcatgtagaaacatgagttggattttatgtaagtttgtaagtttatctcatgtagaaagcatggagttgcatttatcttatgaactaagtgaaccatttagtacttaactaaatattatttaaaaaaattaaccacttatgttagtatataattatatgctaatgccattttatcacaattgttttacattatgtaaaacatacatgttttatcataatattctatcataaatgttttacatttgccatcttgttttttctgcattcttttttacgttgctttgcagttttaattttaccacctgctaatcttaaaatgcctttaaaaatatacagatagtccctgacttacaaaggttcaatttaggatttttcaactttacaatgctgcaaaagtgatatgcattcagtaggaaccatacttggaattctgatatttgatattttcccaggctagtaatatgtggtacaatactctcttctgatgctgagcatggaggtattaataagtcccagctcccagtgagctatgcgatcatgagggtaattaaccaatattctatagtgtactgtgttgtcagcattttttggatattgtgttttgtgttttcacattcaattgcgtctacaaaacactcaactacactaatgtatgtgttctgggcacgtttttggtaggctaggctaagctaggataggtgtattttaacacctttttgacttacaatattttaaaccttcattggggtttatcaggacctaactccattgtaagttaaggagcacttgtacttaaaaacttggcaatttgtctgataaaacttctcttctgactcaagaatactcaaataatatggtcttgctcttcatgtacccttttaactttattagccagttcctctttgttgatcaaaaccatgtctgcagcagttatgtagggaaagcatgagtacaaatgaaattggacataccgagattttgagattaagaatgttaagctctatagactaactgtagcataacactatagtgaattgacaatgaattgcataaaagcagggttgtggtaaattggacgaaccagataagtatattggcttttcttaaaaataactgcagcttagaagggtagtttatacattcccctgagaagataaagtataatgtagtttgaattttctatactttgttaaagaaatataattctactggtttctagtttctgtagtgttggtcttctctcacttctgttaatacataatcagtcactaaatccttctcattctttcatcagatttactattttctattttggcaactatttttttaaactcaggtccttaacaattcacacctgtattattacagtgcctcctcattctatttctatactttgttgcaatattatgttatcaaagacattcttttcttacattctcttgtttacatatgtaagtaaggtggctctcagacaaaattgaggcatctcatcctaggcatcagaatacccttcttgcttcactgttgtctgtatctaaactcagacaccacttctctaactggtgtttctattctggctaagcagatcttactgtgttctaaaatacatctcccatttttgtgtctttgttcatattgttcataccatttctcctccctaaaatgatctgcttcttctgtatgaggtatctgtgattaccatatccattcttctacttttacatttcttaatcatataggctgtgcatcatgaatgtaacttctacattgtattataattttttaacatttttgtctttcatttctcaaagaatataacttcagttttttgtgtgtttttggggtgtgtgtgtgacctttctactagtttgtcaaaaatgtttagagtaggacaggagtcttttctttcttattgctctacactcctctaggacactgtctttgtctttacagttgtttgaagttgtgttgtaagtacctctgttttccaacttgataaaaagggaagagatcatggaagactgctcactgacttactttatttatttatttatttatttatttatttatttatttatttattttgagacagagtctcactctgttgtccaggctggagtgcagtggtgcgatcttggctcattgtaatccctgtctcccgggttcaagtgattctcttgcctcagcctcccaaatagctgggactacagacgtgcaccaccatgtctggctaatttttgtatttttcgtatagacggggtttcactatgttggccaggctggtcttgaactcctgatctcaagtgatccacctgcctcggcctcccaaagtgctgggattacaggcgtgagccacggtgcctggccacttactgactttagaatctcggctgcccaccagcaggtataaggatcatcttcagatcaggaactccggtgctaatagactgaaactgaaccttgtcttttaacatctccagggttttaatttatctttaaaaactactaaaatttcaatttaataatctcaaaggatccttcccttctatgatttttaaaaatgtatacaataatctatctgtgtcatagaaaatcaatcactattttaaaaatccatcaggaatttctttttaaatattgtttctttgtttactggaaatgaatatggtataatctgtacacgtaagctatagatatatgtcaactaaaatttggtaatcagattgtccactgagagttaaactatgatttaaattaggggtccccaacctccagctgcagactggtacctgccttggcctgttatgaactgggctgcacagcaggaggtgagtgagcattacagcctgaactctgcctactgtcagatcagcagtggtattagattctaacaggagcacaaaccctattgtgacctgcacatgtgagggatccaagttgcatgctccttatgagaatctaactaatgcctaatgatctgaggcaggacagtttaatcctgaaacaatcccaactctgctcaccatccatggaaaaactgtcttccatgaaaccagtccctggtgccaaaaaggttggggacaactaatttaaatcataacagataagacatacaaaactccttgaagagacagaatggttcctaggcttcctgctaaataagactctaatgaggccaaagataattatcctacccccccaaaaaaaaatttaaatcagaagtttgttaggttaaatacacacatattaactttaatatgtacaagtactggatactaggagtccaaaggtagtaccctttggactactttaaaatacatatatatttcagcagggcgagatagctcacgcctataatcccaggaatttgggaggccaaagtgggcagattacttgagcccaggagttcgagactagcctgggtaacatggcgaatcctgtctctacgaaacagacaaaagttagctggatgtggtggcatgcatctgtagtcccagctactcaggaggctgaggtgggaggataggtggagcccaggaggtagaggtttcagtgagcgagatcatgccactgcactccagcgggggcaatacagtgagaccctatctcaaaaaatacatgggccgggcacggtggctcatgtctgtaatcccagcactttgggaggctgaggcaggcggatcacttgaggtcaggagtttgataccagcctgatcaacatggcgaaactctgtctctactaataatacaaaaattagccaggcatggtggcacacacctgtaatcccagctacttgggaggctaaggcacgagaatcacttgaaaccaagaggcagaggttgcagtgagccaggtgccactgcactctagcctgggtgacagagtgagataccatctcaaaaaaataaaaaataaaataaaatatatacacacacatataatatacatatataacacatacatatatatttcaaatgaatattgacaatatttcaaaataaatgttttaatcaatttttgtggaaaaataaaattttaccatcttaaccattactttttgaaaggtagtatttgcacataacccaaatcgcaaaagtctcataaacagttttcatcaaaaagcaagtctccatcccagtcctgccccatccatagttagttaccttttctggaggccagtttcttgcttatttttccagagatacttcattataagcattaagatatgtatatatgttgtgtgtacataggtgtatttttccagtaactctttttcttgtactttaaattgtttccaacttgttgacagacatttaggatctttccaatcttttacaatttcaatgttctacgaatatttttacacatgttatttcacacatggttaaatatttctgtagaataaattcctagaagtgcaactgttggatcaaagaatatatggatttttattttaaatagatattgctgtactggcatctatggagattgagtaccaagttacactttcataacaataaacattatacttaagagcctgttttccatacccctcaatacatccttttggaaaaatgggactttggaaagttacttttttttttttttccttttttctttttttgttcttttaacccaatggttcctttagagacagggaagtccctttttacaagaaccatgtttttcatccttttgtcacttaacaatagaaatcatttagcaaatatcaagttttgttaatgtgagacatacttattattagctgaaagttctaagactattctgttggggaaattaagattcacaaacacctattataaatattaaattatttctatttgcattaaattttaaggtagattttaaaatctactgacattctggatacaaagtctacttacaattattctatcaaaaaaaattgaaactctgaagctcttcatttagataatcctgtaactgatatttacaacgtgataatctcttcaaggagtccagggatcttgtacttacatattttatggtggagcaaaaagtcaaaggataaatgctgagtcaaggaacagaagaaaaaaaaaacatgagaaatagtaactatgaagacaaagattcctttctgaaaggagaatgctttggaaattttgttttaaaatgactctgggggaaatgaggggacgagaggggaggaaagaaaagaagggagcaaacaggaggggaggggaggtttacatctttagaaatcagttatgaaacacacagcaattctggccaatgtcagaaagctgaaaggtatgaagaaaatatccttcccttcgaggcacaagcactgacctgtaaaagttgtgttgcagtagctctctgctcaggattcttcaccaaacactttttaacaaaatcggtgaaatcatcggaccaaagttctggctttctgaatgttggtggtggatttgtgggaatcataaaaatagcctagtacaaatgaaatatccaaaagacagtaagaatcacactagcacaatcaaataaacaaatctctttatctgtctttttatcagactctaaatttgaaaaacaaatttaagctgttctaggatttctagtaacactgaaattcaggaagccagtccatctgctactaatgtaatcatttcccattaaatttcctctatttgaattgtagctcattgagcacatcattctttattttacctattacttttttttatcagtctctaaagaagactatatttctgacccactaaggactttccctaaacatatatattcccaaattttgctactacatgccagatttacttcttgtttcagttttatataagcattgctgcttaaaatgggtagtaggagtccaatttgcttttgcaatccagaatatttaagtaaaattactgctataatttgaaataatacttgacagagccaagacttttctctttttaaatatgagtcaaaatttcaaatgaaaaatttcaaaggtaatatactactttaatttattactaatgattgagtacttataatttagtggtaatgataatacattcagaaacctcaaaaatcaaaagccataaaaagagtccatctcatctctcgcctcctagatagtcaccctggcctgtttttgcttttaatctgagtatgtttatgacccaagaagtagattaaaaaaacaaaaacaaaaacctgaagacattctaaatatgaaatacaagtcagttagggggttaatgtagatgtcccaacatgagtaataaaatgttcaaactagaatagtatctacaggaatgaaatggaagaaatgaagcatgagatacttcaaaggaggaaccaagagtacatgctaataatattgttttggagaggtgaaaaaaggaagcatgaaaaattactccagaattcaagaaataagaaataggtaccttaaattgcaaggcactcaggtattttaataattgcctatatcattcttttgaatgccctcagaatatgcagccatttaatataatgcattatcattggtttcttacttggaaagtgatcaaatggactttctgtggacacagcagcaaagactcaatatccaagtctgttgattataggttaagagtcaatctttttaccagtatatgcatcttctttcaaaaaacgtaaattctttaatagattagaatattttatatacctcacgtcatgttatacatattacatctatgatagtctttcaaaagcagtgtagccagtattacaaaacaataaacatctttcaatcaaacaaatatttataaagcatttctgtgtgttcagaacaatgctataatttagaggtatcaaaacaaagggccacaggccaaatagtgccagtggacctacttcgttcagacaaaatcaatctcacattgccacaagatgaatctgctgtaattagactaatttaaactaggacatatgttcttccttttgcgtgagctctatctagcctggctcaattatctactttatgtgatggtccctttaaatatcagaccttataaacccggctattacagtttttaaaataggatacatatctcagacccccagagctcacagtcaacttgtgcagaaaaaaaaaaaaacacatatgaaacgaatagcaaacaactgagtgccagacaatgaaattctgcctgcaaataacctaattaatctcagacagctccacagttgaggcagaacctaataaggctttaaaaaatgagtaaaatggggttaaaagcagctgctggaaaaggcacacaaaaccacctgctacttccaactagagaataaaaataaatttgaactctcatctctgtgaaacagttcaaaggacttacataagcccctatatagactgacctcaaactgcaggtaaattatactagattgtctagataaatattgttcatctgcacttctgttgtaaactggtggataacacaatgatttatgtccttgaagccaatgctctcctttgaactttgaggcaatgagttgcagtcttatcttgagataatcttaacatataaggctcaccttagcagtagctattagaaacccaaggataaaaagcttaactctaactcttatttacccagtactctcataaagtgaacctaaaatgtcacattctaccctcaaatatgcattgaacaagcatgaacaccgagcatacagtccaaacaaataagtcttagcgtatgatctacaccaaaatgtctccaggaaaaccactatgccatttatttccattttttaaggttagctcatcaataatagattttcttgacagccttactgtactaatttaactaatttaacctaataatgaaccacagaggatcctcttaagaatctctaggttttatatgagttgattaggtattaggccccttctatagaaagttttggcaatcagtggctcactttagactaacaattcattcccttgccaccaaccaaatcacagggacacacattacagccatataatttatcttatctctaacaccattttgattgaagaatgttagtaaaataaatgacatgattatccttgtgtttgtttctacacaatgtgttgcttaactacataccaaacctctgattatgtttctaaaagaactactctgatcacaagcagtttaataacgcaagaaatctaggtgcttcaaaacaactaattatcttcatgcctgaaatgtcatgccttagactgcaagagtacccaggagatgtggaaagggctgaaaatgagaatcaacaatgactgaactttataatctcagtggaatgagtcaacacatgtctgactctacagcagctgagtctgtgaatgtatagaagtgatgggcatgccagaataacaaagaaattcatgctattatttaagaacctcagatatatgagcaaaaggttatcttcacaacaaataaatgagataaaggatgagaaaacactataaaactataaagaagtaaacaaatatagctgtttcctgatagcaaacataatacacaggtaacaagctaaataaaattttaaaataatttctggaaaggaaataaagtaattacactaatttataaaagacagtacaaataaaagcaaacagtacaatgtgatgaggccaatactggacatgagtcagaaaaactggcttgagttctaaatcactacctgactgtgtggctttagtatcattttgttttttttttccaagtaaggaggttgaactggatgtttatcaggtcccgtactgggtataaaaagaccctggcactctttaccacgtattaaaaaaccctggcactctaactgcctagcaattgaagggtaaaattatactaaacaagtattaaattgctagttaggaaagggatggagaagaggaaaaagagggaaggacaggaaaaggccttttagatgttaatataaaaatgtgaatctaggccaggtgcagtgactcatgcctgtaatcccaacactttgaggggctgaggcaggtggatcacctgaggccaggagttcgagaccagcctggccaatatggtgaaaccctgtctctcccaaaaaacaaaaattagccaggcatggtggcaggcacttgtaatcccagctactagggtggctgaggcagaattgcttgaacctgggagatggaggttacaacgagccaagatcacgccattgcactacagcctgggcaacaagagggaaactccatctaaaaaagaaaaaaaatgtgaatctaaatttttatcaccattccctcaaaagcaaatatgaaatatacagaaattttgaagagaatagtaaatctaaagtgaaactttctcctataataaagtttccacagtaagcacagagttaaagtattgggaacatgaactcacaattcactccagttccagtagcaatcattaatctggccaagaaaggccaatgtgccagcctggaaaccaaattaagggagagggtgcagctggtattctggaagtacaaagcaaataagagaaccagctctagatggcactgggtacataacagcaccattattagtaactatctgacctatttaactactctatgcctctgttcccatatcttaatatgggaatgttagggctgttctgaattttaaatagattaatacatgtaaaacacttagaatagtgcctggcacaattgtaaatgctcaataatgtgagctattattaacctaattttacgactgaggctcacaagagtaagctagcttattcaagatcacacagctagtaaagtgaatgtcaaaattagaacaagtttgattccttagcatatgctacctcacattaccactgcttccatcagatttctgctgcacataattttattttaagataaaggctctgttatatacattcagtctctagaaaaaagtggaaaagtatttgtaacaaagaagattatagttttactgtctctaacggtggaaaactgaagaaaaaaaaagtcaaacaattgagggtgctaagtaaactatatatgaataacataaagtaacatattgccataaaaactgacaaatgtgtgaattacaaaaccacaaagaaaagttcttaaaaagcaaaaatgagggagtaaaacagtaaagactgctttcacataaaaatgactagtatgcagcaataaaaactaaaagatggtatagaatcttaaaaatttaaactgtcaattcatagcagcaattatgtacaagattgtataagtgtctttaaaatttatttttactatgatggtttttaaatttttttttacttttaaaaattatacttgcagctaggcatagtggctcatgcctgtagtccctgagctgagaggctgaggaaggtggattgcttgagcccaggagctcaagacaagcctaggcaacacaatgagatcctgactctatttaaatatatatacatatatttaaaagtatttaaaaattatactcgcaattgcaaaagcttcatttgataccaccccttaagctgtcacctattccagtctgccccacaaccacctcttactcatgcactatttaaatcccaatacaatcaattgtaaatcttaaccatctttcaagactgaaatataatatccctttaatacaatccaacaatatcataaaacatggctgtagagaaaagcaaaagtgaacaaaagccaacacttaaagaactttatcacaaatttcactctctcagatagaagtcctatgatcagttcaactgacttttgtaagcacataaatgtatccatacctgcaatatattaacttcttcaagaaatttagagtctaatggaatataaaaatgtatatcagatcattttaataaaatagtgtaagtgctcaaatacatgtgagcaataggtattacaaaggatgacttagcccaaataggtatgtgagctaaatgggtatgggaagatgagatttcagctgagtcataaagaatgagtgagtcagtgaagcacagaaaggagaccagcatcttctcagttgtgaagtttgaaacctcatggagctgtgagagaaactgacttatttcagatgtagggcagggaaattacgaggtgagccaaaggcatcttgttgcccataaagaaagaaatcactcaaatactaactggatcacatcagaagttcagcacttgtagaacttagtatcagccataaaagagtctgatttaactgatctggggtgacgacaaggcacaatattttcttacatctcccaagcaattccaatatgtgagtaacatggagaaccactattctaaaatataaaatacaagacaagtgctatcactgtttaatatctcaacttcagaactttccatattttaatattgtactctgattagttataaactcattctaaatgccctggataacatgaaaactacctgaaggcaagacagtgtcttctattgtctgaatgtttgtgtctcttgcaaaattcttatgttcaaagcaaatcaccaacgtgatggtattagaaggtggggcctttgggaggcgattaggtcataagggctccacctttgtgaatggaattaatgccctcataaacaagtccccacagaaccatctaatcccttctgccaaataaggacacatagaaggtgccttctatgaggaacaagccctaactagacaccaaatctgctagcacctagatcttgaacttccaagcctccagaactgtgagcaatacatatcttttgtacataaattacccagtctaaggtattttgttatagcaacccaaacagactatacaatcacttaagttttatatgtcaactgcattaggcatagtacttctccatagtaaaacctaaatttatactgagagtgttgatataaagacatccagttaagtatggtaactgaacatactgatttacttcaactccttccccaaaatcctgctaaagtacagtaagaattttaaaaaggcttaacctccaaagagagaagggcaatagaaaataagagacagcaataaaattttggaaatagaaagtagatgaaagagtcataactgactcaaaagatctgagaaatcagtaagaagcacatcaattccctccaaataactaaaaaaaaaaaaaaagcctaagaacttggaagtaccaaatatatctaaagatagtggacacctgtaacaaggagcacacctggtaccaagatcttggcttctaaaatgccaatccccagtaaaagaaacctatgctccttgaggaaatgactaatttcaaaggtcaaaataggaaaatcacaaggttagctctgggtatcttgctaggccagaaggtaaggaaacactcaaagattaatggtattatgtcaaaaggacatataaataaccaaatttaggataatttgagcatcaaaataataatagtaataatgactataactgattataacaaattgaaaacaattagtctacagtgttttttttttttatttttgagatggagtctcgctgtcacccatccaggctggagtgcagtgacatgatctaggctcactgcaacttctacctcccaggttcaagcgattctcatgcctcagcctcccaagtagctgggattacaggtgcccgccaccatgcctggctatttttcacatttttagtagagacaaggtttcaccatactggccaggctaatctcaaactcctgacctcaaatgatctgcccaccttggcctcccaaagtgctgggattacaggtgtgagccaccgcacctggcctatgacaatatttttcaaagagtttaagaaaagctgttctttatagaaaaattctaaaaatacacagtaactgaaatacagtatcaacatattgcaccctcaatgtaatttaatgatcaattcaggcaaggaacaccaatggatacttgagtttggatatctgtcccctccaaatctcatgttgaaatgtggtcctcaatgctggaagcggggcctgggaaggaagggaagaaggaaaggaaggaagaaggaaaggaagaagggaagggaaggagggaaagatgatgtagagagatagaatgaataatgcccccaccccgcaagatgtctacgttctaatccccggacttgtgaatatgttactttacatggcaaaaaggattttgaagataagattaagttaaaagtcttgaggtggacagattatcctaaattatctaggcaggccaaatgtaatcagaagggtcctaaaaagtggaagagggagccaggagagtcagagggagatgtgagtttggaataatggtctgctttgaagcagtcttcaaataatgctgctttgaagataaaggaagagggccatgagccaaagaatgtgggcagcctttagaagcttgaaaaagcaaggaaacaaattctctctgagatactccaggataaaaaagcttccctgccaccacttcagatgtagcctagtgagatatgtgttagacactgtattttggaaagctccaaaataatctcctttgactccatgtcccacatccagggcacactgataaaaggcgtgggctcccaaagccttcagccactccatccctatggccctgcagggttcagcccctgaggctgctctcatgggctggcattgggtgcctatgggttttccaagtgcatagtgccagctattggtagctctatctggaggggtctggaggatggtggccctcttctcacagctccaccaggcagtactccagtgaagactctaaccccatatttccctcttgcattgccctagtagaggttctcatgaaagctacagccctacagcagacttctgcctggacattcaggcttttccatatctcctctaaaatctaggctggggttcccaagtctcaactgttgccttccttttagttatgaaaatggctgcagctggcttttgcaccctcaaataagtttttcttttctaccacatggctgggctacaaaattttcaacttttatgttctgcttcccctttaaatacaagtttgagttttacatcatttctttgctcatgcatatgggcacaggttgttagaagcagccaggtcacctcttgaacactttactgcttagaaatttcttctgccagataccctaaatcatcagtctcaagttcaaagatccacagatccccagggcaggggtaaaatgccactaggttctttgttaatgcataacaaaagtgacatttgctccagttcccagtaagttcctcatctccatccgagacctcatcagcatggatttcattgtccatatcactatcaacattttggtcacaatttaacaagtctctaagaagttccaaactttccctcattttcctgtcttcttatgagccctccatactcttccagcctctgcctgttacccactttcaaagctgcttccacattttcaggtatctttatagcaatgccctactccttggcactgattttctgtattggtctattctcacatttcaataaagaaatatctgagactgggtaatttataaagaaaagaagtttaactggctcatggttctgcaggctgtataggaagcatagcagcttctgtttcagggagacctcaggaaacttacaatcatggtggaaggtgaaggggaagcaagcacaccttttttttttttttttttttgaggcagagtttcactcttgtcacccaagctggagtgcagcggcatgatctcggctcactgcaacatccgcctgcccatttatggtgataacaacttcttcctctcttacttcctccctctctgtcttcgccctgcccccagctatccgtctatactagttttctatttctgctgtagtaagttatcacaaatgtagtggttcatacaacacaagtttattatcttacagctctttaggttagaagtacaatatggcttggctctgtgtccccgcttaaatctcctgtcaaattgtaatccccaatgttagcggtggggcctgatgggaggtgattggaccatgggggtggagttgtcatgaatggtttattatcatccccttggtgctgttctcatgatagtgagttatcataagatgtggttgttaaaagtgtgtagcaccttccccctttctctcttcctcctgctctagccatgaaagatatgtttgtggccgggtgcggtagctcatgcctgtaatcccagcgctttgagaggctgaggcagtcggatcacctgaggtcaggagtttgagaccagcttggccaacatggcaaaaccccatctctgctaaaaatacaaaaattagccaggtgtggtggtgggtgcctgtaatcccagctacttgggaggctgaggcaagagaactgcttgaagaagctgttatctccataaatgggcagtatcaggctagtatgatactgctgtagtgccatcagtatgtggtctccaccttccaatttacttcatggtttaagatgggtggttgaacattaccacacactgactccagaactcaaaaaaaaggggaagggaatggcaatatagagtattaatcagatctctttacccaggctccctggaagtccaacacaacatttctcttttgcagtgttctgaacacttttgaagctcttttccaagaggctgcaaaagcccatggaatttccagagatataaatgtctttgttatgctaaggagttgacacatgccaactgaagcccctagatagcttcaggatacaggatggtcagcagaaagaataagcatgtaattagcaggttagtatatttagctgcctgacctctggtgagtggatactaaagactgagctcaaacaaatggccaaaggtttaatcaatcattactacttaatgaaaccccagtaaaaactctgtacatctaggcttagcagagcctcctggttggcaaacacattcacatgtcctgattctacaaaaggaagtcacacaggctctgtgttccctctcagacaatcatatgggtctcttcatttgactggtcctcctgattagcatcctttataataaacctgtcattctaagtatagttctttcctgaattctgccagtcattctagcaagttatcaaacctgaggggatcaaaggaactgctgaatgtataaccatttagtcagaagtatgggtaacctagggacaaattaagtgtagctggtatctgaagagtggtcatgttggggatcatgcccttgaacttgtggggtctgagctaactctggatggttagcagtagaacagaaccacagtacactcaatttgtgttgaaatagaatactgtaattcaggtggtattcaaatgtattttcactgtttttcaaacatagcaaaatagtgaaattgataagcaactgatataagaagcactttttagacaaaggtgaaaaatactgtttctctaacagcttttctctacagttgtggttctcgaggtgttcatgaactccttcactgggccctttcagggatctaccaagtcaaatctttttttcataaaaacactaagccattcttttcctttttctctcaattgacatttgcactacaggtacaaaagcaatgacagataaaattgctggctccctagcaccaatgaagacagtggaacaaaactgtaatcattgtattcttcattgtcatgcattcacaatttttttgaatctgtgaattcacaaaaaagacacttttgattaagaaaatccttgatttaaaaaatactctttttagcaaatctttttagcatctttttagcattttgtagtgaaatgagaaatacgcataaactatacctgctacataatgaagtacaatggttgtctcaaggaaaattatctgtgattaaattgcatgttgaactacagcttttttcatgaatcatctttttcatttgaaagaaaaactgagagataaactttgattattcagatttggatactcaacagacattttctcaaaaatgaatcaactgaacctatgacatcatggaaacacagatggtttttgataacaattataaaatttaagctttcagttgaaaagtcaaattttcaaaagcttctatctgccaccatgaacttaacagtttcctagtatttagaaacttttctgatttttccaaatgacaaatacatgacattacccgttcacatatgaataaagatctattccaagtacaagatagagaaatagattttaatgtaacaaaatagaaaaactcactactatggtttcagattctaatactggaattaatctttagaaaattatcactgttgaattttggtgtagtatgaaaggaagaatatcataattaccagaaaacaaatgattagaatattgctccatcttaatcacatatcatatatgtgttaggccagatatttttcatacatttccattgaaataatgtgttacaacactcacaaataaaaaaaaaaattcaaccatcttctattaagctatccactcattatttttatgaaaatagtaattgattcatataaacaaaagctcttgggtcctcaattctttaaagtgaaaaggactgctcaggccaaaaagcctgaaaaccactattctatagtgaatgcaaaccagggaaactaacaggaatattttcttctgtttgatgcatgttcaccagcaacagtaccacaaacttgtttcattttatattatgtccttctaatttgtttacttttttacatatttgaaattttaacacagataaaatttggtatatagtttattttttctaagtaactgtattttaatatgcctgaaaaaataatgaagagacatggttcacaagacatcaaaagagcatccagaaaaatgaaattggtaatgtgtctccattctgtccaagaggatgccctggaccactaaaaaatatacctggtccttgcaatagataaattcaagtggtagacacggatgagcatagcttgatgcagtagtcaataagatcatccaactaatcaccttattctagtaaccattttcacctgacagccttctggtcaaaatttggattcccatgtaaaactgacttcagaagagaatatggtgatgaacatctgattacttgagggttaaatatctatttttaaagtaataaattggaattttgatttgtatatcagtgaacttggttaagtccatcctatgagacagttctatatttattacattggcagatcggtcttcgaataataaatgctgctctgtgatcttgtctgggtagccaactgatcttccttagaaaatacacaaccacaacccttccgcaagcattatgctcatactacatcactgattacctaaattcacaccctgacaaagaagagggctctgccaataacaaagcatattaagttatatatttcagaataacggaataagagtgaaactttactaagaatagtgaataaaataatattttaaatgttaaataagttttgagataaggccttttaatgtttaattttagaataattctaggcattttaacagcataataactcctcaaaaaaagaagtgtatggtttggatgtcactttaagccatgaaatttttatctcagctatttaaataaagtatctcatctgaaatatggtacaatgtatactttacactgcattagctataacaataaataatggatcataaacatttacatataaaaagaacaaaatgaaaggtaagactatgcggaaaaaatactagaacaaccactagaagtttacaaaaaataagaagacagtacaaaaacatcaataaaatagattgaaaaataaagctgatgaactaattgccttgaatgtatcagaaaacttaagggaagacaaaatattagaaatcagtggccaggcatggtggttccgcctgtaatcccagcactttgggaggctgacgcgggtggatcacgaggtcaggagatcgagaccatcctggctaacacagtgaaaccccgtctctactaaaaatacaaaaaattaactgggcgtggtggcgggcacctgtagtcccagctactcaggaggctgaggcaggagaatggcatgaatctgggaggtggagcttgcagtgagccgagatcagagatcgcaccaccgcactccagcctgggtgacacagtgagactccgtctcaaaaaaaaaaaaaaagaaataattgacatatatcagataaactaattgcatgtattatcaaaacaatttcagaagcatgataaaattaagaatctggaagaaaactttcatagtaacttatcttagtaataaaacagaaaatgaatcagagcttcaaaagcaagaaagaagaaccaatacccccatccaaaggaactatctggaatgtaccaaaatgtttcaaaacagaaaaaaaaaaaccatatgattacaaaatgagaaaaaaggaaataatgaacaaaagattcatgtaatgtaacttagtataatttgaccataagattagggaaataaattaatactagtcattagcagtttttgtatcatctggtaaaagagttccaaggacaagaagttcaacaccatgaagtactattagaagatcagaatattatatgcaatactgcctagcttcattttaccaaagtgcaacaataattcaattcaatccaaagtaaatcaatagcatccattgattttctttctattctattcccacctctgactcctaaaacagtgcggcacacacgtcttagctctatcccagtgcccccaccaccatatgccacccttgcaatagctgtgtcttgtccatcactagcctggtgcagtctgtcctaatgaggaaaagcagggaagatgcccgcataggctcaggaccatttaaatggggaatcctgggatcctgggtctgcagagcatgatctaggagggaaaactatgggctctagcacagagatgtagcatggcccatgcagggcataatctttgggcaaaggctccagttaccgggcctagtgcctataattgacatactatcctcaaaattatcatttagcataaaatcatcctgattcgagttaaaatattatgtcactttacaaccaaagtgcaaagactaagttgttatagaatctgtgaaagttaatcaagtaatcaaaacatagtaaaatataaaaatgctcattataaagaacacatcattcaaaatccagtcatatctaatagagactacaaaacttaagcagatgtttacacaaaggcctataaactcaaactgatacaaagaactgggttaaagctaaacaagcagaggtcagcacagagctcctgtgattgaatcacaataaaacaatacactagtcctaagatagcaagaatatgatgcaataagtgaggctctggtcccaaaacagtataatgcccagtacaaatcaatttcacaaaaatctataatagaagtcaatgtaaattaggattaagaaaatcaaaattaacaacaaaaaatatatgaagaacaaaaaagaaacaactgaaaatatgaaaagtttataattaaaaaaagacacacagacatatatacatacatcaaagtctacaatcagaaaaaaacaatagatctcagaaatttagtgtgaaatttaagagtaaatagtaagttttagaaagaaaagaaatctgtcaacacagcccctcattttcgtgcctagggaaaataaggcttaatctacagccttggccaaatatgattgccagataaataaacccttagattctaccataagttaattaaaatgataaaaaaaaattcatatattagtttctaactccaaatttctttaagaaaaccttatgattcacaagcaaccaaccaattccaaactctatgccagtggttcttaacactggctacatattagaatcacctgggaagcattctaaaattgcttattccctgaactcaacccaaagaatctggtgttgtctaggcctaggttggttggtttttaaaaaaatgtcctatatgagtgtaaggtgtatcaagggtcaaagatcactgcatgaatcaaacagtatggatccaaattcccactacatttagcacaagtttggggaataaaaacttaccatttttagagacagagttcataaatagaatgggagaaactaggaaaactaattcaggggccaactctaggcaacaacaatcaaactgttccccttgctaaataaataaatacatatatagtatataaaatatatataaatatacatataatagacatttatataaatatatatgtgtatgtatgtcactatattttatatttcatctaaaattccataaattagaaagtcattgctgtttaaaaactatgtgtaacttctgcttctaggaagatagagtagatgtacattttcctatttctctcgttaagtacaaccaaaaaccatggacattatgaataaacaagcatacgaagatccagactgggcacagtggctcatgcctataatcccagccacttgggaagccgagtggggaggactgcttgaaaccaggaattcaagaccagttcaagaccactgtttctaaacatatatatatatatacacacacacacatatgaattctatatatacatatatatcaattctatatatatatcaacccatatatatagagagattctaatatatatatatatatatgaaagatggagagaaggcagaacagctagggatcttggaacccaaggaacataactgatgacttccctggatcttctttgtcccttatatattccacacttggggccagataagccaacaaccagaaaaagctaacaggtacaaacaaaaaagctccgacaaaaccctgcccaaaagatgaagagaagaacaccatggaaagaagaaaactttaggcaaatttcactctatgtcagccaaacaccacagaaaaaactgtagtcccactctaaccatgtcagaaaggcttagtggacagcctaaagttctatcctcatgagactataacaaggtcccacaatactcctgacatggtgagaaaagaacaagtagggagccaagaatttcacccctctggaaagtaaaaggacagccccccctagcagtgtcagtagacagcaagtagaacctgtacttcctctccaaactggcagcaatgaggtgatcctcccactacccactgaggaggactagaaaaaagttaaattaagactttcactaaccagtggaaattaggtaagcaccaatacaatagagactacacacggagagctagaatcaccactctgactcagcaataatgaggagccactcctgctacttgagtagggcaacagagactgaaaggggaatctggacttcaacaaactctacctggcagtgatgagctcccttcccctcttaaagtaatgtcataaacattcacctaaaacagaaggtttaaataagatccagtctcagaatataatggggaaataggtcctgttttcaaccaaaaattactcatcagaccaagagtcaaaaaaatcacaaactgaccaaaaaaacaaaaaagataaaagtcaacaccaaaaaaagacatgtcagaagtatctgacaaatattttaagagtctttaaaaaaatgcttcaatgaacaatcatgaaaataactgaaacaatgtaaaaatagaaagcctcagctttaccagtaccttgtgataatttatgtacatatagaataatactaaaataaaccaccaaaaagttttgcatagaaatatcctcataaacactatagataaatcaaaagaaaactcttaaaaaaaatcaagtaacccacaggaagtaaaaaaaaagaaaacagaaattaaaaaaatgcaaaactttagccataacatattaataattacattaaatgtaaatcgcctaaatatgccaattaaaaggcaaaaactgaaaaggtagattttaaaatgcaactcaattatatgtagtatataagaaactaacttataatataaaaatacaggcatgttgaaagaaaaatgatggaagaaatataacatgcaaacaataatcaaaccaaagcagaagtggctatattaataacagataaaggagacttcagcaaagaaaattaccagagacagagagggacattacatagtgatgagacataattcaccaagaaaatataacaagcactaatgtatatgtaccaaccaacaagctataaaatatatgaagcaaaaactaaaacttgaaaggagaaatagataaattcaccattatcagtagaaatgtcaatatcctctaacaacaagagataaaacaaatagacagaaaatcagcaaggatacagaagaaatcaacaacaccatcaacaaaatttatagaataccccacctcaacaacagcagagtacttattactttcaagtaatcatggaccatataccaagagagaacatatactgaggcataaaacatacatcaacaaattttaaagaactgaacagagtagagtctccaagcacaatggaatcacattagaaatcaataacagagacataataggaaaatcaagcacttgaaaactaaagaacacgctttcaaataatctatgtgtcaaagaagatgtctcgatcgggggaggagccaagatggccgaataggaacagctccggtctacagctcccagcgagagcgatgcagaagatgggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgatggatgcacctggaaaatcgggtcactctcacccgaatactgcgcttttcagaccggcttaaaaaacggcgcaccacgagactatatcccacacctggcttggagggtcctacacccacagaatctcgctgattgctagcacaaagcagtctgagatcaaactgcaaggcggcagctaggctgggggaggggagcccgccattgcccgggcttgcttaggtaaacaaagcagccaggaagctccaactgggtggagcccaccagagttcaaggaggcctgcctgcctctgtaagctccacgtctaggggcagggcacagacaaacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccctagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaatggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctaattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgaaagattttgtgaccaccaggcctgccctaaaagagctcctgaaggaagcgctaaacatggaaaggaacaaccagtaccagccgctgcaaaatcatgccaaaatgtaaagaccatcgagactaggaagaaactgcatcaactaacgagcaaaataaccagctaacatcatcatgacaggatcaaattcacacataacaatattaactttaaatgtaaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatactaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaatttaactcatctccgcaccaagcggacctaatagacatctacagaactctccatcccaaatcaacagaatatacgtttttttcagcaccacaccacacctattccaaaattgaccacatagttggaagtaaagctctcctcagcaaatgtaaaagaacagaaattataacaaactatctctcagaccacagtgcaatcaaactagaattcaagattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaacaaagaaaaaaagagaggaaaatcaaatcgacacaataaaaaatgataaaggggatatcaccaccgatcccacagaaatacaaactaccatcagagaatactacaaacacctctatgcaaataaactagaaaatctagaagaaatggatacattccttgacacatacactctcccaagactaaaccaggaagaagttgaatctctgaatagaccaataacaggagctgaaattgtggcaataatcaatagtttaccaacgaaaaagagtccaggaccagatggattcacagccgaattctaccagaggtacaaggaggaactagtaccattccttctgaaactattccaatcaatagaaaaagagggaatcctccctaactcattttaggaggccagcatcattctgataccaaagccgggcagagacacaaccaaaaagaagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacagaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagatagggatgccctctctcactgctgctattcaacatagtgttggaagttctggccagggcaatcaggcaggagaaggaaataaagggtattcaattaggaaaagaggaagtcaaactgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaatagaagaggatacaaacaaatggaagaacattccatgctcatgggtaggaagaatcaatatcgtgaaaaaggccatactgcccaaggtaatttacagattcaatgccatccccatcaagctaccaatgactttcttcacagaattggaaaaaactactttaaagttcatacggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggagtaaagatttaaacgttagtcctaaaaccataaaaaccctagaagaaaacctaggcattaccattcaggacataggcgtggggaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtgaggggaggggggaggggtagcattgggagatatacctaatgctagatgacgagttagtgggtgcagcacaccagcatggcacatgtatacatatgtaactaacctgcacaatgtgcacatgtaccctaaaacttaaagtataataaaaaaaataaataaataaataaataaataaataaaaaggtcaacatcaaaaaaaaaaagaagatgtctcaagggaaattaaaaaaaatacactaaaccgaataaaaatgaaaatacaacaaatcctgttaaaatttgtaggacacatgctgctacttgaagagcctagacaaagaagaacaaaaataaatgcaagacaagaagaaagaaaataataaagagtagaaatcaatacaatttaaaatatgaaaaaagttaaaaatatcaatgtaacaaacagctattttaaaaaacacacacacaagaaattgacaaacctcttccaaaatgacaaaaaagacaaaaagagtagtaaagtttctaaatatatttttgttttttaagcaactgtaaatggtattgcatttttaacttcaatgtccatgaattcattgttaatgtacacagaaaaacaactgattttttttttttttttttttttgagacggagtctcgctctgtcgcccaggctggagtgcagtggcgggatctcggctcactgcaagctccgcttcccgggttcacgccattctcctgcctcagcctcccaagtagctgggactacaggcgcccgccactacgcccagctaattttttgtatttttagtagagaccgttagtatttttgtattcaccgttttagccgggatggtctcgatctcctgacctcgtgatccgcccgcctcggcctcccaaagtgctgggattacaggcatgagccaccgcgcccggccaacaactgatttttatatcttgcatcttgaaaccttgttgcgcttactcattaattctatgagtttattcattggtattttctatgtagaaaatcatatcatctacaaaaggagatggtttcatttctacctttccaatctgtatgccttttcctttcacttcttgcctttttgagctggcaagaactcccagtactgtgctgaatgagtagtgagagtgaacatcgttcctgttcccaacattaggggaaaacattcagtcttttaccattaattatgatgttagctgaaaggtttttataggtattcttcatcaaattgaagaagttatctttattcctattattctgagatcattcaataccgtaaatgggtgctgaattgcatcaaatttttttttctacattatgtgacttttcttctttagtctgttaatatggtgcattacattgattcagctgaatggtactctccccacccaacaacccagctgtctgtatgttcttaaggtggaagctcagagtgttgttttttttaacactatgaccctgaataaagcaacatatctatatagctagtcccagaatcactggtaattgcttacataagaagctccgtatggccagatgatacagattgtggacacatgagaaaaaccttcttgttgcaagtaaaatatatctgtggctgagaaaaaaagaccgtcaaatgaaaaattctacatacaaaaaaaaaaatcagacattgggcacggtggctaacgcctgtaatcccagtactttgggaggctgaggcaggcagatcacttgaggtcaggagttcaagaccagcttggccaacatggtaaaaccctgtctctactaaaaaaaaaaaaaaaaaaaaaaaattagctgagtgtggtggtgcatgcctgtgttcccagctattcgtgaggcaggagaatctcttgaacccaggaggcagatgttgcagtgagctgagattgcgccactgcactccagcctgggtgacagtatgagactccatctccaaaaaaaaaaaaattggatttttttggtttactttccctgattctattaatcactgaatacaataaaccaaatactaaataggattagttatgactcataaataaacataaggatgtatattacattgccattcattcattgtatgtaaatttcctacagctagactataatatacagcttcccaaagcaatctaaaagtaacaaactttaatgatatagcacaactgaagtttggtatagtaagtgcaaataagtattgcaatgacaattcatcatggtaaactcaagggtctgtaaaaaatcaaattatcgaggaccgagttcaagaagaactatattaatacatagatttctgtaacttggcagagaattccctacaattgctacatttaaagtaatcaacacatttctatatctcagaagaagacggaaattatgtgttcgcctatcctaatgtattaaacttttattacaatagttttagtatatttttagcttaacattaaggtagaaacattctatcaaactaagaaatagaaattgctctgaaattgcaaaaacctgtactatttcccattttaaaatcagaaggattacttctacagcatttaattgttacatcttacaataataaattacatgggactaatatgcataatagaacacaacggtagtagtaataatgattgagcagtagtatatttacataccgataaaagaaaacccatgtagaagaaactgaagaaaataaacgctagagtgaacaaatgatgagtaatgctccaaaatacaagaaaaagaaagaatgggatacagaatagaggttgagagattggacttgagcagagaaggaaccctcttcctccacatggaacatattgtgagggagggaagaataagatgagaaggaggagaaaaagaaacgaagaaaaaataaagggaaggaagaaaggaagaaagagagggggaaaaaagacataaaggaaggaaggaaaagtatagatattgactgttacggactgaattgtgtcctgtccccccaccaccaccactaccaaattttatgtcaaagccctaatgctccatgttactgtatttgcagattgggcctttaaagaggtattaaggttaaatgaggtcataaaggtggggctctaatccaatatgacttgtgtccttataagaagaagaagagacattaggaatgtgtacattcaaaaccaaaggccagggctgggcacagtagcttatgcctgtaatcccagcactttgggaggccaaggcaggcagatcactggagcccaggagtttgagaacagcctgggcaacgtagcgacagcccgtctctacaaaatatacaacaattagccaggcatggtggtgtgcacctgtagtcccagctactcaggaggctgaggtggaaggatcatttgagctcaggaggtcgcggctgcagtgagctgtgatcacaccatgacattccagactgggagacagagcaagaccctgcctcaaacaaaaacaaaaacccaaaggccatgtgagaacacacagagaaggcagccatctgcaagccagagggagacctcagaagaaaccagacctgccaacaccttgatcttggaagtccagactccagaactgtaagaaaataaactgttgttgtttaaatcacccagtctttagcattttgttatagcagcaggaacagactaatacattaagttagacggagggacagaaacagtgaactgctaatagtctccagtttttctttggaccagaaagcaagtctgacaaaaccaaggagagatggggtaaagaaattttgcaacagacccagaagagaatgaggtggtaggcgtaggggaacatgtgaaaggattgccaactgtccatttcagattagaaatcaatcttttgggggcatcagtcttcacagttacataattgcagttaagcagcctggttacgaggaacacagcaaaatgggaaaggtaaaaacctttgaggttttttaagtctgagtgataacctagctctatcagtgtagctgtgtcttgggttgttatctagagttataataatgatagttacatagagtgtgccaataataatatctactccttttagagttgttttagagttatgtaaaactttatcatagagttggtcagatagtagacaataaataatagctactatacttattactatgggattagtgtagtattggtacattgttaggaagatacagcaaaaaagagaaggaaaaaaaggaattaaaagaaagtggttcagccgggtgcggtagttcatgactgtaatcccagcactttgggagaccaaggcgggtgggatcacttgaggtcaggagttcgagactagcctgggcaacatggtgaaaccccatctctactaaaaatacaaaaaatgagccgggtatggtggcagatacctgtaatcccagctactcgggaagctgaggcaggagaatcacttgaacctgggaggtggaggttgcagtgagttgagatcgtgccactgcactcaagcctgggcaaaaagagtggaactctgtctcaaaaaagaaaaaaaaaagaaagtggttcaagtgacagagtagagtcttggctagatagaggagtaaagtgaatgcctgaggatactgacaagctggaaaacaggaggaaaaataagttaaatggcctgaggatgaagtccagttgaattttaaacccaagaaaatgagaaagatcgaaagattggtaattaaaataaaatcctccagagaagactgctgagtgtgaatcagcagctacttcttatatgtaacaccacagagaaacataacaaaaaaagaaagccagctaaatggtcgtggccttgtcattagctagcagtgtatcttgaaagaaggcgcttaaactgtgagccttactgctatttgaggattactgacaaattacctctggtttctcctttattccacttccactgtaccctctctccgacaacacacacatacacacatacacactcatcattatagtaaagatcaagaaaggcagtaaacaagagcaaagatctggaaagaaggcacattttcaaaactgacatttgtcttgtgcatcctcccacttcccttttccctctcccagtcccacctctacaagcccaaaaaccccagctctcactgctggctctgctcccagaaaaagcccaaagtgccatgtttctctttgacctttcttccctccctcccacctattaaaacttccactgagtctatctcagtttaacaagggaaaaggcaaactgattatgccttttcataatgatgccaggatgaacagtaactcatctgtgcttaaacctcccaagtgtgtttggcttaaaaattgaaacgaatctatttggcaaaatttcaggcagaatggaaaggggataatttggggcaaggagattttctttcttccctgttttaaagttgtgaggaagaaaaagaagtgtttgtcgtaactgacaacagacaaccaccacagaaaaaacatccacagcagctcagaatgctagactgctacacttaagggtactttttaggtgtacaggcctgcataggatgctgaagtggggggcttatgatagcaaacatgaggaagcaatctaccctactataaccctgaaaaaagtggttcagaaccatctaccacgtcatggtaatgactctcttttctcttccctttattacagaggctgcccctcaccctgccccccagatgctcccctgataaaaggaggtggggaaaaaggaggcagccataaaggcagcagcaggagtgaactctccatcttagttatttcctgttagaagtggggaaagaatctgcagcatagaagccttaacagaagcctgagtataaagcaagaaaatagctgtagatagaatcacatgaaaaagtgactatacaggaaaaggtgccattcaatgagaaaagggggaaaagtatcactgaagaaaagaaacactctcttcccaaaaaaggtagaaatacaatcaaatgtttcagagcagggatcagaaaacttcggcccacatgccaaatctaaccagtctcctgttttggtaaataaagttttatgggaacacagccacactcattcatttatgtgctgtctatatggctactttcacattataatggaagagctgaatgactgcagcagagaccatataacttgtaaagactaaaatatttactatctggccctttacagaaaaaaggccctgctttaggaggtcaggggtaagaaggggactgagatgaggccatcggatttgataataagtgatctctggcaaatatgaagaaataatttaaaagaagtttaaaagaaactaaatgtattctaataaagtagagacaatgaggataaggtattctttcaaacagcctctaggaacaaaggaagactacatgcaagtctgcatggggaaataagaaattttcttgatctcaccaatcttcctcctcttggagtcactctctttaatcaccaaccaaacagcttcccaaactagaaactgcagaattttggtaagtgattctagctccacactgctttctgtatcctcagttccaggtgcaatgcttagtatacaaaagataatgtttgttgagtaaaacaatttaagagtacagaatgtagagagaaaagattgagaagagagaaaaaaattctgtccccacttcatacctggaaaaacattccatgccacctctaatggctatgtggcttggactcaagtcttaagagtcatcataggccaggcgcagtggctcatgcttgtaatctcaacactttgggaggccaagcccagcagatcacttgaactcaggggttcaagaccagcctggccaacatggtaaaaccccgtctctactaaaaatataaaaattagccgggcacagcagtacatgcctataatcccagcactttgggagactgagacaggtgtatcacttgaggtcaggagttcaagatcagcctggccaacatggtgaaaccctgtctctactaaaaacataaaaattagccaagcgtggtggcatgtgcctgtaatcccagctacttgggaggctgagacaggaaaatcgcttgaacccaggaggcagaggttgcagtgagccgagatcgtgccactgcactaaaaaaagaaaaaagaaaaaaaaaaaaaaaaaggtctggttatttaaaagagcctgagactcctcccctttcttttgctcctgctatcaccatgtgacatactcatgcccccactgcctcaggaagtaaaagcttcctgaagcctcaccagaagccaagcagatgctggcatcatgcttgtatgacctgtagaactgtaggccaattaaacctcttttatttataaattacccagcttcaggtatttatttatagcaatgcaaaaacaagctaacacacacacagcaaagcctaagatttacatctatgtttactaccaaaaattttatagatttagctgttaaatttaggtctttggtgcattttgaattaacatttttacagggtatgaggttggagtctaatttcatttttgtacatgtgggtatctaattgtgccagcacactatgttgttttaacatcaaatgagaaaatatataagataatttgatactacaaatatttgtggttgttaaaattcaggtactaagcaaacagctcagtagaatactacaacaaacatgtaacctaattctcctgtctctagtttctcctttaatatctgttttatatctgtgtaaaacacagtccagtaatgcaacaactctacataaaactaaagatacctactgctgacagaattagaatttctggaaattctgagacagaacttgcccctgatttttccagtttatacaagctatccacaatccttcgctcatggcctccttcctctcttttcaattttccaggctcatctcttaccattgttcccaaccacttggtctggctacacaatgttactagacacatctgatgtgaagtactcttgaaagactctgtagattactcatgctagacttttggctttccttaacctgggggttccctgaagcagaaagaattttatttatccctatattcaagagtccaggagagtgcccaacacaaagcaggtgtttcataaacacttgctaagttaaaggaatacacaggcaggcatggtggctcacacctgtaatcccagcactttggaaggcagaggtgggaggatcacttgaggccaagagttagaaactagcctgggcaaaatagcgcaaccctatctctacaaaagtaaaattttaaaaatcagccagtcctagtggtatgtgcctatgttcccagctactcaggaggctgaggcagaagaacagcttgaggccaggagttcaagacagcagtgagctatgatcacaccactgcactctatcccaggcaatagaggaatatcctgtctccactcccctccacactccaaaaaaaaaaaaaaaaaaaaaaaggaatgtgcctataaatggaagacagtgacgaaggtaaaggaataaagtagacgaaggcaacaggtttggaaaacattaaatcatcttgtttggcaggaaaaattgtctatatagggggatgttgagagaagcctggaaacctggatgggacagcaagagtaaaggccaagtgaggaatttgtacagtgatagttttttagggtaacttgatggatttttagacacagattataccaattctcttttcccccaataagagatttgtgactttggctaaattatttgactcagaaaagactcaagtacttcatacacaaaattagactaatctctttagtatgataggctcagctggtaggcccatcaccctagacacagaagaaaaaaataatcatgctataataaggaagcttgacagtcatttacgagagtttaccaacttttgagcagtgaaatctactttccaaataaactcatacatggaaccctagtacagaaaccttttttaaacccacaataattgaaaggggcatgaaaaaaactggagaccccacacacccaccttccttcctctcacaaacattggttcatataatcaagtggacttcaaatcaaatatggggaaccctaaacactactttagaacatggtcaaaagtttactaatctagagggatccaggtaaagtcatacaaccaagattcccctttgtggctactgattcgaaaataaatgctagggaggaaacaaagataaaaactaaagatggaaaggaaggtcctactgtaattttcctgaccagaccaatggagggcataaactaggatggtagtattaaaaagacagaagccaagcaaatataacatacagaaactgttttcactttgttttccgtattcttgatgggaaccatgctgacccaggagagactgcccctcccaaggctagctacttcttagacagcaaactacccctccttgagtgcttttcgcatgcaaaccactcaatctaaaactacctcccatccatccccagtattcagctctcacagaactcttatattctgggactattagaatagtcccctgttctaataatcacgccagggccaggtatcaaacaacttgggggctgctcttatatgtgactatgccgacattattaaaaccagccaattctaagcctccttaccctgcctcgcctgttccttctcactaaaatcatgataaaggctctcccccatgatttccctagctatttctgcctcctaaacaaccctggtgcttccctatgagcactatgtggcgtggcatatatgccaccctgtctgatgtgccatgccctctccacttagaaactgtatcaatcttttcaatggcagttgtctcctgacgtgttagtttcaccatatttgaataataatataaaccacattttaaaaatagttcaggaccaagcaccaaacaaacagcacgtacttagagaataaaatgtgaagtattaagaatcagtattaaggctgggcatggtgggtcatgcctgtaatcccagcactttgggaggctaaggcgagaggactgcttgagcccacgtgttcgagaccagcctgggcaacacaatgagaccccatctccacaaaaaaattttaaaaattagcaggggtggtggcacacgcctgaagttgcagctacttgggaggccaaggtgggagaatcacttgagcctgggaggtcagggctactgtgaaccctaatggcaccagtgtactccagcctgggtgacagagaggaacagaagaagaaggagaaggagaaggagaaggagaaggaggagaaggaggagaaggagaagaaggaggagaaggaggagaaggaggagaaggaggagaagaaggagaagaaggataaggagaaggagaagaacaagaagaagaagaggaagaggaagaggaagaagaggaagaggaagaagaagaagaagaaagaaagaaacagtataaagatgagattttctagttatgagagatgccaaagcagaatgttttaagagataaacctgacatatagtaaacatttctttttttttattaaaacacattaactataaatatgtttaacatcatttcttatcttcatcattcaagatatctgagccaaaaacctaggccaaaaatcctgactctcatttacattccacatttagataatcagaaaatacaaatatccagaatctggccacatctcaacaactttacctttactaccctggttcaggccgccattatctcttacctggactactgaagaagtaacctcctcactattcacctggcttccattcttgtcctgctacaatcccttctcaatgaagaacgagccgtttaaatcacacatcagaccataccattcctctgctcaaaaccctgcaatggtttcctgtttcactcagggtaaaagctaaaggtcctgccgtggtttatgaaggctctaagtgatctggttccctgccatccctctgatctcatctcctacttctttcaccatcttatccagctccagccacttaaacctccttactgtttctaaaacatcaaacacagtcacacatcagtttactctgactagaacgttctttccccagaaatctgcattgctcatttacttagctccttcacatctctactataagtcaccttattagacaggcctttcttgaccatcctacatataatatcacaaacatatctgtcattctgtatccctcttatcctgctttttcttcatagctgttatcagtacctgatatgctatagttttcgtttttttgtgtgtttttttcccgagacagtgtctcactctgtctcccaggctagagggcagtggcacgacctcggctcactgcaacctccgcctcctgggttcaagcaattctcctgcctcagcctccaaagtagctgggactacaggcatacgccactatgcccacctactttttgtatttttaatagaaaatgcgtttcactatgttggtcaggctggtcttgaactcctgactttgggtgatccacccgcctcagcctcccaaagtgctgggattacaggcgtgggccactgtgcccagctttttgtgtgtaatttactgtctttccccactacaaataggtacctaagagattggaactttgtttcattcactgttatgtatgagtgcctaaaacagtgtctgagcaggcactcaataaatatgaaataaattaatataccaaagcctttctgagggatttacacttgtactgctcaaaaatccataaacctcgcaaagagacaaaactggatcactagtggtaatatataaaaatgtaaaaataaaaatgtagtcttctaagaaagatagaaggcttgacagtaaatgattaactaccaaaagaataaagtataaatgagagattggcgaccatgtgaactcacctcaagagaataatagatacctacaaatgaacatgtgaaaaactttataataaaactatataattaagcacagagaataagactatcttgccaagatttgctaacttggcaaacatccatattaaactcagcttccccaattccagatacaaatgaaattgtgaatttggcaattcactggagagaaagactgcattacaatctaggttcacattaaagttacctcattcttctcaacttagatctgacgcagaggaaaatttttaacagattctattggacatatgccatactatagtcagtaaagttcaacattaacattttagatgttaacctaaatgatttgttttcctaaaactaaactgcactaaaaaaatatgcattatgagtataaaatgaattattttaaataatattttgtcaaagaaaaagcaatttataacaccagtccttccctcgtattttgatttcattcatgtagtgcctcacccacagctgaacacatggtagcactcaagctgttcactgataagagagagaatattctttccttcaaggtttattaaatatagatatgtccacctcaaccttcccagttattaaaaaatgcaaatgaaaattatgtaccccaaatttgtatataaatgtattaatcatttatttaataattagtatgtcataaagcgtagtattagatactgaagacacaaaataaaaattacacatgctgctatcaataacttcataatgtggtagagaagtcatataaactataacagaagatgataacttgtatggtcttggggcacacaagatgcaaaggaagcccagaagaaaagttcccaagatagaatgtgtagaaaaaagatgggagaaaatgcaggcataaagtaacacttagaagaaggcagaggtaaacctaacactacctacaaatgatagtatggctaaaggaaaggaaatatcacatgaataaagatgtatgcagagcccaaggtcttacatgacacccttaaaaatttggctattaatggggaggatcttaagtaagacagtaatatgagttgtgtttcatttaagatgatcaatctagcagcatcatgaagtttactttagagaggagattgagactgcagattattaaatcagttggtactgatccagaagaaggtagaacgatggcggtggcgttggctttgccagctcaggactgagtgcaagtaacagagaatcagccagattctccagaggctcttcaggttctcctctgtctttcagtcagcagtctcagtccatttgcggaggaacattggtgttacagcagtggcgtttaataaggaacttgatcctgtacagaaactctttatgtacaaggttagagaatacaaatctaagtgacagacatctggaggatctgttgatactgatccagagtaccagcaagagccagagaagaagctttttaagctcaagcaagtgtatggtaaagcagacatgaatacattccctaacttcaaatttgaagatcccaaacttgaagtcatcaaaaaaccccaggcctgaagaaataaagtaaaattaacctggtaagttgtcaagggttagctgtacaactagctagaagtttcagaataaacatacattcacaactgtcaaatgttcttttaatctcgattccaaataaattagttggtgatgtggagtattaaaaaaatctggaaggaaaaataaagatgtggacgaaaagaaggggatattacttgagagatattaagaaagttacagagatgggaactggtgaataatgaaaacttgaatcagcacagtggcagtggagctggacaggaaggagggaaggaaacatcaacaggacctggtgactgattaaaggcagaagattgggccaggcacagtggcctgtaatgccagcactttgggaggccaaggcaggcggatcacttgagtccaggagtttgagaacagcctgggcaacatggtgaaaccctgtctctaaaagaaaaaatatatatatatacaaaaattaaccaggggtggtggtgcatgcctgtagtcccagctactcgggaggctgaggtgggaggatcacttgaacccaggaagcggaggttccagtgagcggagatcgtgccactgcactctagtctgggtgacagagtgagaccctgtctcaaaataaaataaaaaataaaggcggaagattggacagagggaggatactcttggttaatggcaccaccatctaaccagttgtttcaaatacatagttggttcaaatataaagggagaaacaagcctgatgaaaaaacagtgaaaacaacttggagatattggatttgaattatctcaaaatagtaaagaaaattatataagcagattactagaaatatgtctagaattcaagacagagataaaagctggaggaaagccagggaatggagacagcagtgttctctactgctgtcttaaccctttctttcagagccacatataaaagcagttcactggcacctctgcttcctgggtccaagtgattctcccacctcagcctcccaagtagctgggactacaggcatgcgtttttatactattttgagagaattcaaatgcaatatccccaggttattttcactgttttttcattctcccaaaggaaaactgtttgtctcctaaatcaaggagcacgtgagcctgtaaagttccatagcagagaggaaataagtgatgggtaggagaaaaaaaaacaagaagaaagaggcatacccttctataatactacagccagaaaagggtaaaatgaggccccaaagttcaggcatatgtatatggccatttaactaggactttttaagcaataagcatgctgtgcttaggctgtctcagcactattgttaaatgctttaattatgtaacttttgatacattcatgttatcatatgttgtaattattgttgttactattacattttctctatatagcacttattatgtatggggcaatgtactaagtagctttacaaaaattatttcttttaatcctcaccaaaaccctatgaggaagtatttctccattttatatatgagaaaactgagggatagaaaggttaaataacttgccctcaaatactcagcaaataaaggacagagttgaaaatggaacccaggcagtctagctccaaagtccatgatcttaatcatcaagttatactacctcttttcaggtggataaagaatacttttggttactaacttaatctgaagacaactattttctagtaggaaatatttctaattttacaatacatgtaggagaaaattgagtttactgatcagaaacttgctagactacattattaagtaaaaaaacacacagaattaaaatattatttaaaacatctgtacatttttaatctgtataaacatgtatatataacaatagttctcatctatataaatatgtacatataataattgttcttaaattttactatgcatcagaatttcttggtgggcttgttaaatgcagattgctgaacccctacttcaaaccccaatctttcccctattacttacgaaataaagtacaacttcttttcagcatggcttacctttggccatgaggcatcgtctaaccatctttcaataagtttttagtacattacctatttttttatgctttccctaatacaacccttcctaataaagccatacattccttctatgattccaaagcacctctaaaatagtaaaaaacagaacaatgataataatatcaattaactctgtggggcattcccaaggaaacatgaattacctcattcaatcctcataacaactcctcaggataaagattataattattctcactgtacatatgggaaaaaagtgagacatggagaggttaaattgggcatggtaatacaatcagcaagtagaaaagctaggattctaccactgcaattatactatataagcaattactagattgttcagtacttggatactatttagatactagatttttctaagtactaatgtaaataatttccttattcatttttacacttatttaactgacatttactgactgcctatcatatgccaggcattgtgttaggcacgaaagactatcatgttaaaatacaagggaagacccagtacctgctctcttgagacatggaatccagtggaaaaaccaaacattaaattaaaaatcagagaaatatttcaagaaatatgtgttaaagacaaaaagtacaaggcactccaagattataataggaagatctaagctgtttatagttattgtactggcagtgtcctattacaagagtataagttacacagaatttgcatttcaggatgccaaataattccatttcaaaatgacgctttcaaaatcaaattaattaattataagaccaaagtcatatagttaaaatttaaaacatattatttaaaatgaaatttaaatatgtcagctctttatttttccccttagcaaatggagctattacgcatctgacacagaatgtaataaatataaactatccaaaactaataaaatagcatttgaaaatgtccttgcaatattggtcatgataaaggtaaaataatatgccaagttcctgacaatcctagtagtgcataaagtacttccattttggacaatgctaactttcttatgattgaattagatccatgacttaatatacatcatttgtaagattttttttttttttttttacaaaaagcagacttctttcataataaatttcaaaatgaaaaccaatgtttttttacagaggaaaaatgcctaaaagtccaaatactgatcttacaaagagacatgaaaggtaaaatcaagtatgaaccaggcctggattcccacatcttcagtttctatttatcaaacagaaaaatctttccaactttctcctttcctgtataagaccaaaactatgcaatattctgtttgtattacaattacactaattcaatgcaggtcacttgctttttactgagtccagatgacattcagtaaactaaacatgggccaattagtttaaaaaaaagaggaagaaaagaaaaaaggaagaaacgagtgagttctgattgcctttgggtaggtcatacagtggctacagagcatcacagcctgaacttcattttggctaacaccaaccatacggctaacattaaggactagcattttttattcctttcagatttctcacatttggaaattccaatttaaataattttctggtgaaagtgaggacagcactcctgcataatatcagttttcccctaattcaactccaatgtcttattttggagctactaaaatggaatctgcacaatgtctaaaaaagtataataatcctttttaaccaatttttttatgtattacagttttaaatgagcaaatgaaactgataatttagctgacacaaacccacacaaaaaaagatggtctaaagctatgaagtttcaacatcaatgtttgtaatctcaaatcaacctgaaccaccatacaattaggtatatgacaaactaagtaatagaaatattcataactaaaagcaatattatttttaaatatcttattaggtgttggcacccaacattttcttataatctatcatgtaaagaaatctgttttactattccttttaaactctctactcatgctactttaggtgtgtttctagaaataaatactaaactctctgctaattttttttggctaagaaattttttgaaagttataatgtaactaagttaaaatgtacatataatcataatttgatatcaagactgctttcatacaaaaaacctacattaattaattccttaagtaaatttacactttatcaattgttggtattttaaaaagtactcaaaagaaactcttcattcaccattattacaaaaatggaagtctccaaatatgtaaactagcttgatttttaaatttgttacttatttagcctaatttttttaaacttgcctaaatttaactgaagaatattatgttcctgcaagtgttcatgaatacaaagatacagtaatgaagatggaaattatttactctaacaattctgactgcatgactgttaaatcacttacatacggccaaatgatctacaaggaagcagggaggtcctgaaattgtgtactcatatccattttcaactactgcacaggtgacacaaccaatcaaggcattactgaaacagaatgggaatagaaaggacttagtgaataaaagtgacttctttagacaaaaatgtagaggttagcttgtgaccaaggtggaagaaacagcagcaccattcctcccattgcttgttcatattaagagaaaactgagaccactaagaggcaaaggacagaggacagcaacaccagcaaagagacaggcagcagtggggtcagagcatgagaacagtattaagagttaaacatagagcacagagggggtggtttaaaatgtcagttttactcaattatttataggacagttcttggaaataatgttacaatgaaatgttggttatataaaaatcttatttaatgtagtaattactatttagacaagggcaaatatagtaaatattaagtaaaaattaacaataattaaaatgggcttatggtctgaaatagacatattatgggaaaggattactgttctaacaactacgcataaagctgtgaaaaggcaatagttatactagtctgtagaaacagtactctaaaagttacaataaggagatacacttttttttttttttttttgagcaaggtcttattctgtcacccacactggaacacagtggcatgatcacagctcactgcagtctcaacctcctgggctcaaccgatcctctcacctcaggttcctgagtagctgggactacaggcgcatgccaccacacccagctaattgtttttgtatgttttgtagagacagggttttgtcatgttgcccaggctggtatgaaattcctgggctcaagcaatccacccacctcagcctcccaaagtgctgggattataggcatgaggcaccatgcctggtccaatatggatattaatcctcctgaaatagatgggattttaaaatgcaatactcagtttcaatgttgaaatgtgctcttctttcactgaaaatgacatgacactgtgaaagctttcttctaacacaggaatttttagaccttcacacaagttttcataatgtttaatactttcaataagcttcatgactattaatgctttggggaaaacttactttttgtttctttatttgcttttcaaaaccaaaggcatatagtaataattcattatgcttttacaatcaggtttcatctgatgtcaatgttacctttcatatctttttaagtgtttttccatgttaacgtgaaggtgtgtttcttaacttcacatagcaagaaacaaagacacgcctttgttcaatttaaatattttggttcctggccaggcgcggtggctcacgcctgtaatcccagcactttggaaggcttaggcagatggatcacctgaggtcaggagttcaagactagcctggccaacatggtgaaaccccatctttactaaaaatacaaaaattagttgggagtggtggtgtatgcctgcaatcccagctgcttgagaggctgttatttgttatatgttattccatattccctattctattctattctattctactcattcagagacaggatctcaccccatcacccaggctggagtgcagtggcgcgatcacggctcactgcagtcttgacctcctggactcaagtgattctcccacctcagtctcccaagtagctgggactacaggcacaagccactatgccaggctaatttttgtactgtagacacggggtttcaccatgttgtccaggctggtctagaactcctgagctcaagtgatctgcctgccttggcctcccaaagtgctgggaatacaggcttgagcaactgtgcctgacctccatattcattttattcaaaagaattttatacacaaaattgtggcaaaacttcaaggaagaatatattcttttgtagttctgtaatctagtggaaaaatgtgatataaaaaaacataaaagttaatgatatactagtgaagggttcctaatattcaattaactttgattttattctcaatctattttatactaccattcttcttatgaaaatatcttcaacactttcattgtaccaataaacaacaatacaataattaacaatttgcatttattattaaagtattaaatttaaaactccaaagcacctacttgaaaggaacattccaatataatttaattattcttggtcatttgctcatgtttccttaaatataaatacagtatacctaacaaataataagcataattataaatattatcacattttacaattttttattctaataaagaaaacatatgctcaaataatggaatttaactataaaatctaatttttagctcattgaaaaaacataaaaaaggatgatcaaactatttaccagtcttaaatatttaagagtataatatgtttatactactatatttatatgttataaatacagactatatattaacacatttataactatagtaatatgtatttatatagtataaaaatatactactatatataatactggctttttaaatacatttcctaatttcctttatttactactttaactttgtagtttataatttacaaatttcccagcactatatcttccccacaagaagatttccctttctagtggctactaacatacaatgtttaaggattaattaatgatagattggttaatgaatctgcaaaatatttagctcttttatttccatttttctctcctgctaattgacttttgaccatgttagtgtttattaagctcaagatccaaattagctaaattcttgccctcccaaacaggaggcagtctaaagcaaaggtgttggttgactgcaagttctggtggaatttacctattaatcagttctacaccattttgtcaaatctgaaccaatatagtgccaaaagaacattcttaaatattaagacttttatctttggcatacaggattcattcatccaacaaatacatactgagtaactactatgggccaagcactgttctagtgcttaacatatattagtgaacaaaagaaataagaaattcctgccctcatgttgccaatttaccaaccctgtgctgtgctccacactaaaaatacaaaattgaagatactaccccttacttaaagaagatttaatctaatcaaaggcaagaaaaatgtcctcaatgcaacttatcatataatgctaaaatatgcatatgtaaatggtagcagaagcatatataaagtgccatgaagagtagaggggaagaagcctctgtgcagatgttactgagtacaacatcacaaggagtataattctctctgcctataacaatcaaacacaggcattccaacctgagaacagatatgcccaatacagctttatatctaactctatgttgtctttcttagaggtaaatcaaggtgctgctttacagaccttcataattaatgtccccttagcatcttcaagagttaatggaaaaggagggaaaattctaatcactacatgttgacactttttagtagccaagaaaagttctcaaagaatgacaatttaaaaaattaacttgtatacactttctaggttaaccgtgggcctcaataatccctaccattccaatacacaaatgtcacaagttctcattcatatgtgagagctcaaaccagtggatctcatgacatatggagtacacttgccatcaccagaggccaggaaggggagcggggagggaggagtgaaatggagggaaaagggaaataaatgtatttattggcactgagctgtacacttaacaatggtaaagatggttaatttttaaaatattttcaataataatattaataattatccttaccatccttatctcttattcacatgaagacattagttaccatttattaagtgcctccagcaggagaggcactgtgtacaccctttatataacattatttctaaggcttaaacctttagaagattagtatttttattacccagtttttcacatgtgaagactgagagtgggagagattgtataatttgcccaaggttgtacaccatttggcctggaatgtaaaagaaatccatacgaacacaaagtcaaggatcttttcactctacctgatagctgcccactcccataaagaatctaatattgagggatattaattcctcttctatgattatttttaaccatcctatatgtagataaatatgtaaactgatctaaaacagtttacatccttgttgaaaacaggatcacatatgattacctagcctgctaacccagacaggcagatggatggacaggcagatggaagaatgaacaaaatctcaagtataatgacatccaaactgtttaaatctactgcacagtgttcttataaatcttcaatggcaagtccatttgactgacactatttctaaaagaacaattaggctaggcacagtggcccatgtctgtaatctcagcattttgggagggcaaggcagaaagatcacttgagcccaggagtttgggaccagcttgagcaacatagtgagaccctcacctctacaaaaatatttaaaaattagctgggtgtggtggcacacacacctgtcgtctcagctactccagaggctgaggtggaaggatcacttgagcctgggagatcaaggctgcagtgagacatgattgctctccactgccctccagcctgggcgacagagagctcaaaaaataaaatacaataaatgaaagcacaattaaacaaaaaataaacttaccttgagatctttgtaacacctttattatccctattattacctcatcttctattaatgtccttctggctcactccagccacactggcctctggttaagaatcaaagagccaagcatgttcccatctcacacagactttgtactgtctgttccctccaatcaaggcagtcttaccccagatggctcactcccttgtgtgcttcagtctttagcttagatatctccttcttaacaaggcatccttgactaccatttaaaagtacaatcagaccttcatactccctaatcaccatccaatgatatattttatgtatgtgttatatttattatgtctaacccaaccagaatataaacacaatgaaggcaggaatttttgttttactcaaggctatatatcctgcccatagaaaagtggctgatgcacaacaaatatttgttgaatgaataaatgaactttgtgaccaggcacagtggctcatgtgtataatctcagcactctgggaggccaaaggaaggatagcttgtgcctagaagtttgagaccagcctgggcaacatactgagacttcacctctacaaaaaacttaaaaattagctgggtgtgatggcatgcacctgtagtcccagctactcaggtcaatgtgggctgaagtgggaaaatctcctgagctcagatatttgaggctgtagttactatgatcacaccactgcactccagcataggcaacagacaaagaccccaactcaacaataataataacaaccacaataataataatactaaatgaacttcattatttggaacctaaagaggaattgtataagttcaatttcatcactgataaataattcaattaaagacttcttttaaagccaagttttatattatttagcactactgaacttccccttcttataaaatgtttgcctccttactctggccaaaaatcttcttttcattgctctttagaagtttaacatgatgaaaatcagtgtttgactttaaaagtcaaagtatgaatgaaaccgaacttgtatagacacatcttttagctctcatttcaataaactgttattaaatccataatcttttgagagagcaactcacagattaaaaattaaaattaatattttatctgatgctttacggcatccattgtattgaatgcatttgtttaatatttctaagtctttagaaaagcttctgagaaaattgatttccttatgttgtttacagtctgtgaccaaatatttttaggacattcacatgaataaagggtcccaaatgcaacagaaattataatcacatcataacttaagctttaaattattcatgtcttttatgtttaacaaaaaaactattatccaaaactatttattatattaaaatatttttactcaacaatctttttctcctaaggtcaatgaaggcatatgactcctccccaattatataactttttattattttaattaaattaactgataccagcatgttttaatatcatccctacacatttagaagaagtaaataacctagagatcaaaatacacagtaaacccatacaaacagcagtttttcattgccatctctctatatataaacattgaatgcaattctatgaaagtatggctccacgtattcagatgaggaatatgtctgtttacatgtgtctctttcccggtccacattacagggggacctgtgtgtgcctccgtggttaagatttactgcatgttcacattaaagtctcatttccaacatttaaacatgcagccacaaagaccaattagaacagttattagtacaacccttggtgtaccaaagatttgggagttcataaagttgaaattgattgtttatggacaattacaggtaccaaaatgatttaaaacatttcaatttttgctctgctgaacgagactcatttaaacagcagaactagaagcagagacttaaatatcaacttgtaatcaaaaatcaccagtaatgtcttagcagcgtgttcatcctcctactcagtagagtccttaaacatacagggactccaatattagcttcaaaacattttcagaatgtctagcaaaaatatgtcaaacctggatctctgacttaaaggaacacacaaggcctaagaaataattgctgtctcaaatactgtggagttaataaggttttaaagtatataaagttgctataggctaaacggcacattttatattagacaccctttcttgctaaacactgtattatatattaaactgtagcaaaagtgaatgaatctatgaggaaaatcaaaatgaaattttcaagtactcacataatgacatacctctaaactgtgaggtactttatgacagagtgtgtgattcattcatcttttaattcctagtgcttgaatacaaagttgatattcagtaaacactgattgaatagaaaaatgagtaaatacaacttgaagaataactatgtaatgagatttctgattttacaaaacactttcactacttttctaattatatatatatacatatatagatatagatacagatatagatagatatagatacagatatagatatcgagtagagacagggttttgccatgttgctggtctagaattcctgagctcaagcaatccacccacctcgaactcccaaagtgttgggattacaggcgtgagctatcatgcccagtcgtgcttcaccacttttcaatgtcaacttcaagaaaatgaaaattgcacctttctgaacaaactttaagtctaccctaaactgctaagaatcaacactaagagcagatgacataatgtgtgggaaaataaaaagtcagccagccagctggacatcagtctcttctctgactgctatgactaaactcttcaaggttataacttttcaaatgctaccactgtaatgaactatttcattgctagtgttacctcctttccttggtcttcccctttctagacaagaattcctgttattatctcattcccttcttgactgcactttacacactggtttcaatttgtacttgacctagttcccagaaaacacccagttttccttttctcacttagtatcttaatatttgtaatattaataacccacttatctattcaattgtttaattgtattttatctattatctattcaattgtttatttctatttaattgtagtaactctattcagagctagcctatgcaaaagagaagacagcagtcttcagatgtgacttacttagtacagaaagatcccaaccctaatatatacaaacacatacacatgcaaacacacacacctgctataaaccaaaattagagatacatttctttgtgttaaactcctgcttcttgaggttcttattctccctctgtccctctcaattgttctgtcactctttacctcctgcttttttctgttttacagtaattctctccagctaacttcactcttctttcttctacatacaacatccaatgtgtccaaaaaaattctgtgggtttttgtttcaaaatatatccaaaacctgattaggtcttaccacctccactgttaccaacctaacacatgccacgatcatctctcacttggattactgcagaggcctcccaactggcctctttccttctatctttgcccaccccgcccccacaatctgttctcaacaaaacctaagtaatcctttaaaaatgtaaatcagatcttatcactctgctgctcaaggcctgccaggggtctgtctacaaggcactactgatctcacctacctccatcacctcccttacttcctgtctttctctgacattatctcctacttctttgtccctagatcactctgctcccttctgcctctccaaacacaaaagggctttccattgaccattccatctgcccaaaatgatctccccaggtatatgtgtggtttactcccacaatacctgcaagcctctactcaaatatcaccttcccaaggaggctctgaacaccatatttaaaatcacaaatttgtccaccaaaactccctgtatccttcttagtgtacactctagttttctttaatcatttccaaaacacttatggctttctcatattctatataaattacttattatatattgttttatatctattgcctccttctaggatgtaatctctgatatatcccaaatgcctagaaaggtatctggcagagtagacaccgaataaaaatttgaatacatgaaaatatactagactatcttaaaatacaataaatatatagtatgttctttttgtttgttttttgagacagggtctcattctgttactcaggctggactgcagtggcacgatctcggctcactgcaacctcagcctctcagggtccacaggcaggtgccaccacgcccagataatttctgtatttctttgtagagacacagtatgccatgtttccaaggctggtgttgaattccttgatacaagcaatcctcccacctaggcctcctgagtagctgggattgtaggcatgagccattgcacccagccttgatgtcattatctaatgtctcctccttaataaattgttaataacccttaataaattgtggctaacataccttttacaatacaactctagaccattaatgtgtcccataaatcctgtgtgcatcaggaggtatcttttttgcctcaatgccttttattaatgcactgtcagtattctacttgggctttattcaaatacaagcctataaaactactgaatctttttccatccctcctactttcccattcttgatttttcccctacctttctctacaactccaggtgaccagcaatgacaacctaatatgtatcactccataccttcttctccatccttaaataaccacgtacaaacatatgtagagatttaaaattctattttgtttctttgggaatgaagttgtccccatatatgctccttcacatcttatttttctcatctcatagcaaacagtggaatataactacattaattggtatacacagaactccattctttttaatggccgcatgttacaaggccaaaatgtatcaaatgtattcaacttttcccaccttgtttccagttttttaccactaataaaaatactgcaaaaagatccttgctttgaaaaatgcatatatccttacatatttatgcttttatttttatgagataaattctaggggtaaaactgccaaaactgctttccaagaaaagaagtaaatgtcacatttctaccacaaatgccttttgctctaatttgccaccaatattgagtggagccataacatttttaattttggatatatgatgatatctcagccaggcacagtggctcaagcctgtaatccctgtacttcgggaagccaaggcagatgaatcacttgagatcaggagttcaagccagtctggccaatatggtgaaaccccatctctactaaaaatacaaaaataagccggctgtggtggcacccacctgtagtcccagctactcgggaggctgaggcaggagaatcacttgaacctggaggcggaagttgcagtgagccaagattgtgccacagcactccagcctgggtgacagagcaagactccgtctcaaaaaaaaaaaaaaaattagcccgggcatggtggcgggcacctgtaatcccagctacttgggaggctgaggaaggaaaatcacttgaagccaggaggcagatgttgcagtgagccaagattgtgcactgcactccagcctgggcaacaagagcaagactctgtctcaaaaaaaaaaaaaaaaactcaatgttactttaatctgcatatcctaaagtactattaatcatcttcctatgtgtcattagtctattgggatttgcatttctgtcaactattcatctctctccctgttttttatactggattgtcttttgacactaatttgtagttttttttaatatcgtagatatcaaccatttatctgtaatttgaagtataaatatttttcccaacctaccgcttatctattgagtttgctgccaatgagatcccacatataagttacaaaaaaaatcattatatgattagatttatttttctttcatagctcctgcatttcctatgttggttagaaacttctcccaagtttctaattcatgcatatagtccagaattcatattcttccatgtaagtctctagtatacttagaatttatttaggtattgtaagagaccaaagattcaattttctttcagatgaacagataattccaaatgcatgattatcattttcccattgagctcaaattttcacatttatcatattaaattcccaacagactattgtaattacagtagctttagaatttattttaatatctggtaaagctattcatttctcacttttttctccataattttcttagtcaacaagtatgaacattatgttacccaattccaatgtaaaccataaaggaattttaactagaactgcaattaacttttaaacaatttttggtaaaagattattatgatatagtttttgcatggcaacacaatattataagaattgggaacatatttttaaagccagcatgctctttccttcatttcaattccagtgtaatgtctttcaattagatttttacgaatttcttcctacagaagtgtacttcttttgttaactttattcctaaggattttctagtttttgaaactacttttaattgattactttttccaatttttctttaataacattattatcagcactgagaaaggctaccaatttctgtgtattttatatacaactattcaccaaattatgttattaagtctgataatattttactggtaccttttggatatcataagcatacaatcatatcagcaaaataaaatgtatttttcctcttcttttctaatgttcatacagattatttcattttttacctcattcaacatgctagaacaaaactaaataacgataatgataataatgataatagaggacatacttgttattagaaataacattagcattccactgtttaaaatgtttacttttgaagaatggcccggagggcagccaagatgaccgaataggaacaactctggtctacagctctcagcgtgagcgacacagaagatgggtgatttctacatttccatctgaggtaccgggttcacctcactagggagtgccagacagtgggcgcaggacagggggtgcagcgcaccatgcgcgagccaaagcagggagaggtattgcctcactcgggaagcgcaaggggtcagggagtccctttcctagtcaaagaaaggggtgacagagggcacctggaaaagcgggtcactcccaccctaatactgtgcttttccgacgggcttaaaaaacagcgcaccaggagattatatcccgcccatggctcggagggtcctacgcccacggagtctcgctgattgctaggacagcagtctgagatcaaactgcaaggtggcagcgaggctgggggaggggcgcctgccattgcccaggcttgcttaggtaaacaaagcagccaggaagctccaactgggtagcacccaccacagctcaaggaggcctgcctgcctctgtaggctgcacctctggaggaagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctggccctggagccgcctaactgggaggcacccccaagtaggggcagactgacacctcacacggccgggtactcctctgagacaaaacttccagaggaacgatcagacagcagcattcgcggtcacgaaaatctgctgttctgcagccaccgctgctggtacccaggcaaaccgagtctggagtggacctctagcaaactccaacacacctgcagctgagggtcctgtctgtaggaaggaaaactaacaaacagaaaggacatccacaccaaaaacccatctctacatcaccatcatcaaagaccaaaagtagataaaaccacaaagatgggggaaaacagagcagaaaaactggaaactctaaaaagcagagtgcctatcctcctccaaaggaatgcagctcctcaccagcaacggaacaaagctggacggagaatgactttgacgagttgagagaagaaggcttcagacgatcaaactactctgagctacaggaggaaattcaaaccaaaggcaaagaagttgaaaactttcaaaaaaatttagacgaatgtataactagaataaccaatatagagaagtgcttaaaggagctgatggagctgaaagccaaggctcgagaactacgtgaagaatgcagaagcctcaggagctgatgtgatcaactggaagaaagggtatcagtgatggaagatgaaatgaagcgagaagggaagtttagagaaaaaagaatgaaaagaaatgaacaaagcctccaagaaatatgggactatgtgaaaagaccagatctacgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaagttacccacaaagggaagcccctcagaccaacagcggatctctcggcaaaactctacaagccagaagacagtgggggccaatattcaagattattaaagaaaagaattttcaaaccagaatttcatatccagccaaactaagcttcataagtgaaggagaaataaaatcctttacagaaaagcaaatgctgagagattttgtcaccaccaggcctgccctaaaagagctcctgaaggaagcactaaacatggaaaggaacaaccggtaccagccactacaaaatcatgccgaattgtaaagaccaccaatgctaggaagaaactgcatcaactaacgagcaaaataaccagctaacatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagattaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacactccactgtcaacattagacagatcaaccagacagaaagttaataagcatacccaggaactgaactcagctctgcaccaagcggaactaatagacatctacagaactctccaccccaaatcaacagaatatacatttctttcagcaccacaccacacctattccaaaactgaccacatagctggaagtaaagctctcctcagcaaatgtaaaagaacacaaattataacaaactgtctctcagaccacagtgcaatcaaactagaactcaggattaagacactcactcaaaaccgctcaactacatggaaactgaacaacctgctcctgaatgactactgggtacataacgaaatgaaggcagaaataaagacgtgctttgaaaccaatgagaacaaagacacaacataccagattctttgggacacattcaaagcagtgtgtagagggaaatttatagcactaaatacccaaaagagaaagcaggaaagatccaaaattgacaccctaatatcacaattaaaagaactagaaaagcaagagcaaacacattcaaaagctagcagaagggaagaaataactaaaatcagagcagaactgaaggaaatagagacacaaaaaacccttcaaaaaattaatgaattcaggagctggttttttgaaaggatcaacaaaattgatagaccactagcaagactaataaagaagaaaagagagaagaatcaaatagaagcaataaaaaatgataaaggggatatcacgaccgatcccacagaaatacaaactaccatcagagaatactataaacacctctgtgcaaataaactagaaaatctagaagaaatggataaattcctcgacacatacaccctcccaagactaaaccaggaagaagttgaatctctgaatagaacaataacaggctctgaaattgaggcaataattaatagcttaccaaccaaaaaaactccaggaccagaaggattcacagcctaattctaccagaggtacaaggaggaactggtaccattccttctgaaactattccaatcaatagaaaaagagggaatcctccctaactcattttatgaggccagcatcatcctgataccaaagcctgacagagacacaaccaaaaaagagaattttagaccaatatccttgatgaacattgatgcaaaaatcctcaataaaatactgacaaaccgcatccagcagcacatcaaaaagcttatccaccatgatcaagttggattcatccctgggatgcaaggctggttcgatatacagaaatcaataaatgtaatccagcacagaaacagaaccaaagacaaaaaccacatgattatctcaatagatgcagaaaaggcctttgacaaaattcaacaatccttcatgctaaaaactctcaataagttaggtattgatgggacgtatgtcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatcaagggtattcaattaggaaaagaggaaggcaaattgtccctgtttgcagatgacatgattggatatctagaaaaccccattgtgttagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaaattaaaagggacgtgaaggacctcttcaaggagaactacaaaccactgctcaatgaaataaaagaggatacaaacaaatgcaagaacattccatgctcatgggtaggaagaatcaatatcgtgaaaatggccatactgcccaaggtagtttatagattcaatgccatccccatcaagctaccagtgactttcttcacagaattggaaaaaagtactttaaagttcatatggaaaaaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggatcccctatttaataaacggtgctgggaaaactggctagcgacatgtagaaagctgaaactggatcccttccttacaccttatacaaaaattaattcaagatggattaaagacttacatgttagacctaaaaccagaaaaaccctagaagaaaacctaggcattaccattcaggacataggcatgggcaaggacttcatgtctaaaatgccaaaagcaatggcaacgaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagacaccatctcacaccagttagaatggcgatcattaaaaagtcaggaaacaacaggtgctggagaggatgtggagaaataggaacacttttgcactgttggtgggaatgtaaatgagttcaaccattgtggaagtcagtgtggcgattcctcagggatctagaactagaaataccattgacccagctatcccattactgggtatatacccaaaggactataaatcatgttgctataaagacacatgcacacgtatgtttattgtggcactattcacaatagcaaagacttggaaccaacctaaatgtccaacaatgatagactggattaagaaaatgtggcacatatacaccatggaatgatatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtgggaggtggggggagggatagcattaggagatatacctaatgctaaatgacgagttaatgggtgcagcacaccagcatggcacgtgtatacatatgtaactaacctgcacattgtgcacatgtaccctaaaacttaaagtataataaaaaaaaaagtttccttttttatatactttatatttatgtactcaagaaaggctgttgaattttattcaattttttcagcatccattatcatcatctaattttccttcttcaatttgatacaccctacttgatattctttaatttatgcagaattattttcagttaaaggctattaattagtgcgtcctttttatttcaaaaattcttatttagtatgcttccagtcactctatcattatccattgggatttggtaatatatatagaaagatttattgtttataactgtttcttcttcataatctttcaaggcctcaattctgattcatttgctgtttggttatagttagttcaagtattttcctcaaatgaagcaaatgagagttatattctgtcaatctctgaatatctaaacatatctttactctgaaaggtggatgaaatactggttgagtcactcattcatttattatttaataagaattactctacgtaatacagatggatacaaaatgacaaaaaactccctgcctttaaagaatacatatattccagcagacaaagacagacaataagcacataaatgaatcaattaattaaatataaaatggttagaagagctaagaaaaaataaggcaaggaaaggaaaatcttctataatatatacataacagtcaagaccgacctctgattttgacaataatggccattcacccatatatagtgctttctaagtgccaggtactgtggtaagtactggacacacatcaaatcattcaatcacaaacaacccttcgagatagttactatgaaaataaaaatgctataactggtgaaactgaggcacaaacaagttgatttaccaaaggtaaaacagcaaataagtagtagaaccaagctgtccagctcttaaccattatgttttcttgcttctctgataatatgccatttcagtagataatgaaaggaaatgagggcaggagagagacccatagggttatatggaagaatagaattcctagcgaaaagaaaagccaccacaaatcttataaacgccatgaaaaatagatataaatacattaaaatatttgtattataatcttagactcaaccttaaaatatgtggctgaaacaattcctcacatgtatagagaaatgtttaggttatattaccttatcactcaagaattgatcagataaagtactcaggattaaaatgcaaaaaagcaaaaaaaagagtattaagagtatcttaatgtgatttcttaaaatttatttctaaaactaaatgctagaattatataaagtgaagaaacacagacacattctcaataaaaatggaaataaaactagaataacagtctacctaccacccctatgtaccaatactgtaatggatcctttacacacaatttctcatttagtccttacaataagcctgtgattccaataaatctattgtgtccatttaatatataaagaaagtaaaatttaggagaatcagtatattgccctaaagtcacataataggaaaagtgggaagaaataaaatacaaatttgtaaaacatcactgtataccttaaacatataaaatctttatatgtcagtatatctcaataaagctgctgaacatatgaatttgtatgatggcatgagcacagactattagatccaagaaaatcaattgtctatggtaaataagttcagcaaaattataggatatatggtaaatccaaaaaagtaattccctattgaagctggactgtgcggtagagaaaaaaaatgagctttggagcaaaatatgcttgattcaggtcaggcagagaaggctatggagttaactgaagagggagtgctgctgagattagtacctgcagggtcatgcttgcaataaccctagtggatgcaccagtgacaaagttgctcagcaacaacagcaaactaaagcaaacatatctgttcctagttctgagagatcaaaaggcaaccaacccaaactatgtaagaagttaagaaccttactccctttcagccctcattctcttctcttctcaatactactacttttacctcctgttaactacctcatttttctttctttccttgctctttgactctttcttgctgacgcttcccttctaggtctcttttttcctttcaatcaccccctattgaactgctttcttccctctcaccaccagtttggtttcaagaggattcttaaataacttcattacctccaaatacattttgatctcaaaggtcatagctcttcttccaatattagtaatttaagaattactaatgagacaaatccacaggttaacatgaaacaattccacatgtcacagagttaaaaaatgggtcaaacacactgacctgtttatgttaaaatattatatggctttagaaaaaaattatgccctaaatacaacatgcgctgcattaacaactgcattaacaacattttagtcctttagatatgcaaatacttattgtgttacaattgcctacagtattcagtacagtaacatgctgtaaaggtttgtaatctaggagcaataggctataccatataccctaggtgtacagacagctatattatctaggtttgtataagttcactctatgatattcttcacagatttctcagaatgtatttccatcattaagcaatgcatgactgtattaaaaattctttcatacaatttttcattatttttgcaaaattcaaggagtaatatatcacttatttaacaaatgttaacaggatatttcagaagattggtgtcaaaaagaaactcagttattgctttaatgtctctcagcaccaaatttcttttccatttggacttaataacaccttacatatacaaatgattcacaaaagacaagtcctctacagtttactatcatgagactcagaaaccagtatcacacaatgcttttaattcttatcatattactaaaattttatcagaaacagatgtcagcaatacaattttgatggaattacttaactttttttttttttactttcataacaaattaagcattgctcagttgaaaagttataatgtcacaagccttgaggcagcattaggtgctataatttgaaccgatgcagtgtagagtttgcatgctagtagaaaagaatttattagctacattgttgataattatttaactagcaaactccaagttttcttaaaaacacttccaatcaattaaatatctaagaaaactaataaaataactcaaagttttctagatgtataattaacatagcaatacataagttagcaatatagctgcaaaacaggtggaaaatataaccattaaaatgacttccatcctttcggtaggaagtagcttaaaaaaacaaataaaaataaaaacaaaaacaaaaaataaaatgacttccaaagaacaaaccaggcaaatggtttatgtccctaaataagctgaagcctagagataaagaaatttagtgggtaaaaaggaaagataatctatactaaaaacaaaaccaaaaaatgaacgaagacgatgaatggataaacaaaacgtggtataaacatataattgaatattatttagccttaaaaaggaagaaaatcacatgctaaatacagatgaagcttaaggacattatgctaagtgaaataagcccattgcaaaaagaaaaatactctatgattacacttacaggaagtatctaaagtagttaaattatcatagagacagaaagtagaatggtagttaccaagggctggagggaggaagcaatggggagtggttacttaatgggtaagagttgcagttgtgctagatgaaaaaatcctgcagatctgctgtacaacaatctgaatacatttaacgctactgaactgtgcactgaaaaacagttaagatggtaaatttttttaaccacaattaaaaataagagctttttaaaagaatgtaaagtaaaaatggaagatctgtgcacaatttttcttacgggcaaagaaatggtacatcttacaggtaaaacatgtatgttatgtgttacaactttagggaagccaaaggttttaatatctgatgccccatgaatgtgatatagcagctctctccatatcaattctgacaaacactatcaactttatttcttaaaactgtcccttagccatattcattcacccctctcccaccaatgttgtaggattccaagccaagactttctgctttgaagccctttaccaatgcaatcagtacccaacatacaactttccatccagtatttgtcagtcaagatatcacattaggttttcccttccctcttctcttcactttcccatcatcactgtagaagcctctgctacctgggacttcctctccctcctcaaaaatgaagaagaaattaagacattcccagataaacaaaaactgagagaattcactgctagcagacctgccctgcaaaaaacaaaaaggaagttcttcaggtagaaatgaaaggacactagatactaacttaaatccacacaatgaaatcaagagtacagcaaaggtaactacagaggtaaatgtaaaagacagtataaatgtatttttttcttttctttgtaactctttagagcactcctaccataagtataaattacaatttttaaaatgtcacgctacaattcaataggtaaatactgaacctgttttaagaagtacgttttatatttcacttctagaatagagataactaaaggaaatacagcctctttgaaaataaggaaatgcttcaaaacaaatctgtggtagatgaactatccctcacatgtcataggcatatagtactcttataacttgattatttagctcaatgaagttttaaaatactaaccacatcttattttacctcttttatatctctgggacctgtccctttttctctatcaccgcagctaataccttaatccagggtatcatcatttctcccctggattattggcagcctcctaatgggtattcctaatattagtcctgctccactttaatctgtttcctatactgatgccattagtgacataacaacaacaacaaaaatcagatcccaccattctgctcaaaattttcaagtggcctcccataatcttcggggaggaaaaatttaaattcccaaataatatacaggtcaggacatgaccactacctctgtctccagtattagaatcaccacatacataaataatctacacccacattctctgctacagcccttaagagttatttaggatcccagaataccacacatctacttttatacatgcttaccttctctgattagaaaaaccttactttgtctacccccatctctacttctttagtcttcaggactcagtgcctatacctaccacccaccctaactcccaataatgctgagttatatcatctcatagattctagtcacaattaccacagtacttaccaaaatgtactataaacacctgcttgctatgtatttatcccacagactgtaagcttcttaagcataaagattgtttccttactcctattttttgtccctagtatacgcaaaaaatgtctgccatggagtaagtgtttaatcaatgtttgaaaaaaatgaatgaaaggatgaagcaggttgtacattgagagacccatggagaagctgttcaatttttactatctataacaaagacaaacatcaaaattaataatctgataaaactgaaataccaaaattaatctttactttgtaatcagtaaaaataagtaaatcgatatactaatgtaattcttaatttttgtagttcattcttcaaaatattttattcaagcaagtgggatccagcaaaaaaatggagaccctccccaaaacttttacaaccagaaaatgagcttctttcaaattctgatgtggaattcccaagtaatcttgcagcaaattaaacaatatgatctatgatccatatgtaggccttgactattaaacttattttgtcttattaacagtattggagggatttttttaacaccatggattaaaaagtgaaaatgagttttttaaaagtaaagcttaaataacactctatctactgttttgcaaatgtgttatgaaggctttgaaaccacaaaatttccaacagacctaaaaatgtataatgtgctatatgtcaagctgtatttctttttttttttttaaactttaagttttagggtacatgtgcacaacgtgcaggtttgttacatatgtatacatgtgccacattgttgtgctgcacccattaactcgtcatttaacattaggtatatctcctaatgctatccctcacccctcccccaaccccacaacaggccccggtgtgtgatgttccccttcctgttaattcaagatggattaaagacttaaatgttagacctaaaaccataaaaaccctagaagaaaacctaggcaataccattcaggacataggcatgggcaaggacttcacgtctaaaacaccaaaagcaatggcaacaaaagccaaaattgataaatgggatctaattaaattaaagagcttctgcacagcaaaagaaactaccaccagagtgaagaggcaacctacagaacgggaaaaatttttgcaatctactcatctgacaaagggctaatatccagaatctacaatgaactcaaattcacaagaaaaaaacaaccccaacaaaaagtgggtgaaggatatgaacagacacttctcaaaagaagacatctatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacagtgttggtgggactgaaaactaattcaaccactgtggaagtcagtgtggtgattcctcagggatctagaactagaaataccatttgacccagccatcccattgctgggtatatacccaaaagattataaatcatgctgctataaagacacatgcacacgtatgtttactgcagcactattcacaatagcaaagacttggaaccaacccaaatgtctaaaaatgatagagtggattaagaaaatgtggcacatatacaccatggaatactatgcagccataaaaaatgatgagttcatgtcctttgtagggacatggatgaagctggaaaccatcattctcagcaaactattgcaagaagaaaaaagcaaccaccacattttctcactcataggtgggaactgaacaatgagaacacaagttgtatttctaaggtaggagaaaggttacatagtctttaatactttctcctttacaacaaacttttccttatatataaaatacagcaaaaatagtaccttttgttcaaaggattgttgagaagactagaattcacgtaccacacttttgcctcatgcacaataaaaactttttacatgtttaggtgttattattactataattattatgacatatccaagtcccaaaaagttatcagcagtatactctgcaaaggaaaagaaaacacaccactcagataagtctatattcattaatgaatatatctacataccaaacctgcccccatttctttctactgattcccatctaattgaagaaagattttagtagtattctgctgtggattgactcttaaatcacttcactaataaagtcctatgaaaatttaaccaccaccaaaaaaaaggggatcagcacttaatcgcaatcctggattgcaatatgagtgatcagatgctaccccggtctgggtcttcatttcttcatctgtccaatggcaatcacagttcctatcggatctcatagggttaactatctgtgagaatttaaagattataatttatgtagaattgtttgctaagcttgaaaatacttcataaatacagactaataatactattgctgtacaatgccaaataataaatattctacgttttaagcagattgtctttgcttccttcagaaccaggtcttgactctttagcccaacttcgtttggtttggatatataaaacgacatcttataaggtgttcccttcaagggtactttatattactatgcataagaaatgctttccatattaactgaaaaggagatgaactaataagttcaccgaaagcataaatgactaagaggagagagaatgatctctggctttgagaattctcttagaagtactgcctataatcccagctacttgggaggctgaggcaggagaattgcttgaacccgggaggcggaggttgcagtgagccaagatcacaccattgcactccagcctgggcaacaagagcaaaactccgtctcaattaaaaaaaaaaaaagtatctaggtatagtaagtagtttaactaaaaacagtcttagaaacatggatcccaattcctaccctaaattccactaggacacaacattcttataattgtatgtactgttctttcttgccaaggtactcagcactaagaaggcaaattcccagaaagaatgaaaagtgtaagaatgtatgtgcactaactttaacttcctactgtgtgtcaaacactatctttacctactttctcatttaactctcaaaacaaacttgaaaggtattacatcttttttacagatgattacgttacgtaattcacagagatcgtattagagagaacaaaatgctgaaactaaaggtctgactacaaaggcagttctttctatttcaccacactattgatcctatgaagcagaagtcaaaattttaaaatgtcatcagagggttgtatccccattgaagtagctggttacataaaccaccaaggtttctttttgtttgtttgttttttgagatggggtcttgccctgctgcctaggctggagtgcagtggcacaatcatgactcactgtagcctcagtcttcccaggctcaagcaatcctcccacatcagcctccggagcagctgggactacaggtatgtgcaactgcgcccacctaattttattttttgtagagacaaggtctcactatgttgcccaaactggtctcaaactcctagactcaaggaatcctcctacctcagcctcccaaagtgctgtgattacaggcatgagccacaaccacacccagtacccatcctgattttttttttttttgagaccgagtcttgctctgtcgcccaggctggagtgcagtagcgcgatctcggctcactgcaagctccgcctcctgggttcacgccattctcctgcctcagcctccagagtagctgggactacatgtgcccgccaccacgcccggctaattttttgtatttttagtagagacagggtttcaccatgttagccaggatggtctcgatctcctgacctcgtgatccacctgcctcagcctgccaaagtgctgggattacaggcgtgagccaccgcacctggccccatcctgatttttaaggaaacttcaacacgagttcttccagtcccttttaaatgatggacactgtcaagaagtaaatttcacctaataactggtttatccagaaagaaaactgactcctcattcaaatggcattatattaaaccagaataatctccttaccttgacacaatggtttttgtaaatgtaaaaaaaaaaaaaaatcacacagaggtattctgattcatccaaggacattttctatattagcctagtaacatatagaataaagtaatatacaagaaaacttaggggtagacaggtatatattcagccacatgcttctcaataagaaaaatgatttatctactgtaagaaaaagtaaccttatagtaaaaaacagcagcagaatattacttgtaatagatgttaaatatttagtgtctctgttagttctatatacagttatacctaatcatgttaagtgtagagatttagcctcataaatatttctataacagaatataacctatatttcttaatacacaaggcaaatgtaaataaaacaaagatttgctggtctaaatacccaattctttaaaagtaaaccaaaattttcccatataaattttcctttggagaacacaggaataaatcccatctgatgaaggaaattatcaaaagaatacacattgatctaacatgtctggctcagtttgcctattataaacaattctggtctctggacatgaaaaactaataattttcagccacttgttttattacatctaagtctcaattattcacaactaaaaaagatagaataatgacattttacaatgtcccaaacacatgaatcaatcatacagcaggtggaaaaaatgctagaaaagataacatttgtgtcagctttacctctctctcacaggagtctcaacagtgtaaaccttaattcgtatatcttgactgcccagagccttccagagaaaaggatcatattgtctttttaaaaaatctcaattgtcaataactgaaggaaagcaagcatagctttccaaaacaactgagtccagatattttttccattgttgctgtcaattacttttctaatttctaattataattctaataaaaacttcagcataactaagaaagacaaactaaaactactcaggaattttcatgcaaaacttccaattatgtgtcctaaactcttttactccaacatgagttcacaaactctgacagatgttttataaccctgtttaaatatttagtcagtaaaaggataaaatttttaaaaaacagaatgatttcattcttttcaaaaaccagggtggtctatgggcaattttggtactagcagtgttgccgggggaacaaaatgaaaacaggtgtcatcaaattcaaattaaagatttacttctattttaaaccaccttaaacaatgtttccataaactttctaactgatactactataaatttgacaatattttataacaagaaaaggattataaattgtctgtagaccatcaaattttaactgtaacaaattttgactgattggcaacacttccttttaaaaaacttttttcattaaatatgcagcatcattttaaaaattgaatgtataaaaggcaagtcaaaataagaaaagagagcaagtatagactctgatagtcttttctgaaagattttactttgttttgagcctatgctgttttaaaaataaaaaacgaagtacaaaacaaatgttaaattcacaacatataaggaaaaagtgatacaattagtaacatgacaatcataacttttcctcataaacttaattgaactacaatcttcaatgttaaaaaaatccattaatttttgtgtcttattttggtaatgaaaagagtataaatacttggtttctaccattaaatagcacttatttttactcttaaaagagatgatgaagcaagtgactcaccatataaaagttaatcaatgcttaaaaatacattagagtattagacactttctcagttgtttaatacagtttcagtgacaaaatacacttacttttgttaaaagctttaattaagaaatgaacatataagaaatttttaaataggtaatattgcagattggttatgttcttcttaataaaactgtttaagattctttcagaatggattaaatacttacccagtgaggattctagatacaggtaagatgaggtgtacattcttcagtattattaatttaaacagaattaatttctctttgtattagttttgacaggtgaaaacttcttaaacttttaggggcatttaatcttgcactgaggagagtccttttatcttgactgtgaataatcaaattccattgtcatttcaaatctttcagacagttcaaagttttatttttagcagtgcttcagggaggcacaagttggttcactagtgtggaatcataacttacagtcagctccaccagttggattatttccaatatttattagtttcatcaactagttttcaaaaaagcttaaagtttcagtattaatagataaatgtctttgaaactaatatttctagcttaaagtttccattaaattgtatttataaaaataatacaaaatcttttttcagattactacatgtattttaatagtaaaagaaaaatatacagcattatataatgttgaacaatataaaacttcctttacagttagtttaaaataatctcacttgcatataattataaaattactatactcatctattgcttactttgaaagtgattaatcaaagtcagagaaagccaaccatcaactgaagtgtgttacaaatttccttctcagaggcacatcaaaaaaagatgagtcaattctactttaattaaaaccttgtttaagaatatgaaataagtgttttctgtataattccaattatatttcaattgtgttcagctttcaaactgcctctgctacttgattacacgtgccaaattaatcttgtcttttttttttttttttttttgagatggagtcttgctctcgctctgttgcccaggttggagtgcaatggtgtaatctcagctcactgcaacctccgtctcctggctccaagcaattctcctgcctcagcctcctgagtagctgggattacaggcacgcaccaccacacctggctaatttttgtattcttactagagatgtggtttcatcatattgatcaggctggtctcgaactcctgacatcatgatccacccacctcggcctcccaaagtgctgggattacaggcgtgagccactgcgcccggcccattaatcttatcttttaaatcatatcaacagttctaaaaaaagacttggattttttattgttctagtgggtattgttctagaagcaagactcctctaattgatcataacaccaagcctaccccttagctgacagttcagatgtgtgtttttggttggttcaaatacaggaagacaccctttgtatacatttgactaattagtcaaagaataagaaggcaggggaaagaaatttatctaaaatattttttgactaatacatagcagtcttccaaaaattcaaagtggaatttttagagaaactacatgttctaacatgttctcttagggtgcttcatacagatcgtcaaggaagtatcccaaaaaaaatcaatgaacacccggaatacagggtcttcaacagaatcaagcaacatgttacacaactgagggtaacaaagtatcagtccctacaacacttgtgtcaaacaaatctgtttctcctttcaccttacttacctcctttctcctaccctgttctatgtatggcctagcccttcgaagatacccaaacacaggaaagattaaagatccctttcaaacgatagaagatctctttcacacgatagatgataaaatgaagagatgttcagaaggctgtagctgctagcattcttccaccataagcttctccacctatatctgtagtagataactgtacttttagataacttttcaacccttttgaagggtttcaggttaacaaatatttgaaaattagtactcacaacactgtatataaaaatgaatagaggccaggtgcagtagctcatgcctgtaaatcccagcactttgggaggccaaggcaagtggattgcttgagtccaagagttcgagaccagcctgggcaacatggtgaaaccccatctctacaaaaaatagaaatattagctaggcgtggtggtgtgtgcctatagtaccagctactccagaggctgaggcgagcaggtgcccaggctcgaggggttgcagtgaaccgtgatcgcaccactgctctccagcctgggttacagagtggggcctcatctcaaaaaaagaaaaaaaatgaaagaagtatggactcaggaaagaagtactgacacatgataagcaataatctagatgcaaataaaaatcattagatttaatataacatctttaggctcaaatggaagctcactaaatattaagtcaatcaacactgatagaggcaggaagcagaaaaatcctagtcagacagggtgaaaccccaccttcaagtcaaaaacagcctgaaacccatgacccagagagagaacttctatttctgtttgcctgctctttcccaactggttctttctgaataatgctttttaaccaatcaaatgttgccttttccaatactacctgtggcccatgggcccccccgatcctgtgcccataaaaaccccagatccagccacactgagggagatgacccaacttcgagtgagagaccaccttcctgtcccctctctagactgagagctgcttcatcactcaataaaattctctgtcctcatcacccttcaattgtcagtgagacctcattcttcttggacatgggacaagaactcgggacccactgaatgtgggggctgagtgtgcagttgtggcagctgtgggatccacactggagtgcaagccagatgcggcctggcaggctgagtaaatggggcacctgctcctgcgagcccagcaaaggggccaagaaaaatcctgcatcaacactatttaaatgttaaaggaaaagtcaatataagtaacatgtataacacactaaaaatatattaatgataaggcaaaatgaaattagagaatgtataataaagctctgtgggataagaaccttctcttataacattctgtcaatggctgaacttccagaaacattacctatgaaattaaggacagcctttgtaaatagaagggctaactccttacatggagacttaccacccagaactattgtctgaatccatctgagggggaaaaaacccatttccatggtaaggaacaaagcagagacaaagttcattacagctacatacaaatggaaatgccataaattacataaaagctcatacaacaaagaaactagcaacttggttatttgtatacatagaaagacagcaggaaataaaatattttatattatatgaaaacaaaatgcttaagaactcactgacacagttatttgacaaatatgctgaggtttttgtatataaattttttagtttggggtttttttttgttttttgtttttttgggacagggtctctcgctctgtcacccaggctagagtgcagtggtgtaatcatggctcactgcagcctcgacctcctgagctcaaaagttcttcccacctcagcttccagagtagctgggaccataggcacataccaccacacttggctactttttaaaaaatcttttgtagataacagtgatatggtttggttctgtatccccacccaaatcttaccttgaattgtaataatcctcaggtatcaagggtgggaccaggtggagataactgaatcacaggggcagtttccccctgctgttctcatgatagtaagtgagtcctcatgagatgtgatggttttataaagggcttccccctttgcttgccactcattctctctcctgccaccctgtgaagaggtgccttccaccatgattataagtttcctcaggccttctcagccatgtggaactgtgcatcaattaaacctcttttctttacaaattactcagtctcgggtatttcttcatagcaccatgagaatgaactaacacagacagggtctctcaaacttgcccaggctggtcttgaactcctgggctcaagtgatcccccaacctcagcctcccaaatatgtagacccagcactttggaaggctgagacatggtgggcggtgggtgtggggggttagggggttagggggtgtgattggtgggggtgttgtgccaaggggcttgaggtctcaaagagctacgatcccgccactgcactccagcctgggcaacagagagaaaccttgtatgggaaagaaagaatttttgttttgttttgttttacagctttgggaaagatcttttctatagaatcatatatctgatattacaataaaattatgactcaaaaatttgttttacataaaatctctcatctacatgtcctcaagctaattacttaaacaacatcaccatctcttccacaggcactagcacatttagaaaagaaagaggtttgggttttgtttttttcctgtactcaaagttcagctaagtaaagaaacaattatttcccaaaggtttcaaagcaattgcctcagtaaatcaaaagaatgctttcctattagcaaagccatataatttaagagtaaagggttaagatgatttaattttctcaaagaaaaaagtgaaaagttaggtggctatacagttaatgaccagaattctggaaaactgccaaattcaggcacattctaaccatcaagttattactatttagtggaggtcgggggcagtcactaagaactttttatgcaggtttaaattttacatacagagaagccatataattattgtgaaatacttcaagggattcaagaagaagctatgacagtttgctgtgtttctttaaaaaaaaatgcacatttactgactttgagtggtatttagttccaaaaatatcaaaaatatcagaaagataatgtctatatttaatatttggtattacatattttggttatggcttctaaactttctcatagcccaggcactcagctattcaacctaaatttttccagttgcctcaatgttatataattcccttttcaattttgttcagtcatacttaggatctactttatacaaggatgaataaaacactattttacatctaggtcataagaccaggatataaagtccagtgtctgggttctaatcctggttctaccaattactagttctttattctctctataccttactttgatcatctgtaagctgtagatatagtactaacacccacaaaatagggtttgatgtgagaatcaaataagttagtatacaaaaaatactcagaacacaaccatataaaggaataaaatgcgtgctacaacataaatgaacctcaaaaacattaagctaagtgaaagaagccagacacaaaagtcacatattgcatgattccatttagataaaatatataaatccataaagacagaatgcaaactggtggttgccaggatcggaggggtggggaggggcaggtgggatggtggagaatggggataaaatgcttaacaagtaccgggttgtattttggagtgaaagaaatgttttagaactagataagagttctgaaggccactgaactgttcactttagaatggttaattatatgttatatgaaattcatctcaataatttcaaattttaaaaaaagaaataaaaaacaatttattaacaccatccaaaaaaatacttagaacaatagcagtgatacaaaatgagttcagtaaatgtacactgtaataattatcaatgccacataaactggtaaatatgtagaatactatgctacattccaaagattaaaataaatatacataggtttggagtttatgttttcttttaagtactcattttaacaatttatttctcctaaattcagcatgaaattatgtaattcatctacaaggaactctcgcttcctccaaaagagacactcagagagaaaatacatatgaaaaatggaaactaaaaatttattttgtacatttactgctatatgtcatccaagttatgttattttaacatacagtgcttatgtgttaaactatctgggaaataaagagatgacatgcatgaagaaaatatacacaaaaggacaaccaaagaattattttgtaaatttaaccccacaaattataaatattatattgttacattcagttgtttaaacaatatataaaataccactaaaagactcatacacatatttataaactcaatgaaatgttcaatttgtgatgaatcagaaaaaaatgagaaaacatcttcataatgggatacaaaaatggaatttagaactggatcagcctggggaaagcaaattttaaaaagacaaaatcatagggctagatttgtggatatgagaaatcaatgaattcatttttgaggcaaaaaaaggtcaaagtaaaaaagcattctatatatcaaacttaacacatttatactatagtttaaagaatatgtcaacaaatgaagagatcacagttcccaaataattatagcagccaaaaggtcaagtctaaaaacccttcacttcaaataaaaagctactaggagagactatgaggtactttctactaatatctcagaagaaaactcatgaaatattcaaaagcaagagaataattcgtatcttccgtttctttgcctcacatatttgttttactattagaagaaggctgtttttttgttttctttgtcatgactaatgtttatcttataaatttctattaaatgtgttaccaaaagttcctgtcgggaatggtaactacatttcacatacacatttataaacaacaaaagagaaaactgtcattaattttaatatggaattaaattattagaataaactttcaaacatatgttgaccagtcaaagaattgtggcatgatgcatgtagccttcactgtttcaaaagcacagagtttaggtcaagctccttaaaacagccaaatgttttaacaagtaaagaaaaatatacataaagtgcttcatgaataaaagtagttcaaatgaacaaggcttgtggaaaataaagcactgtacagattttatatcaaacatgccaagaatgttaataacactacactacactatatatgagaaagaactctccaactacaagaattgttatattaaaaatatacatgttatctttttctgttaacatctttaaacaaataagtcagctagcttcctgaaatgatgtaaatgtgattcaacctaaagatgtgattttcttgcacgtcatgagttccataaatctttgaatacaaatattatgcattttatatgccatcttatctgtatgtctataaaaaaaatggctgagctatggaaaaacagtatggtggttcctcaaaaaagtaagcatgaaattatcatatgatccagcaattccacttctgggtatatacctaaaagaattaaaagcagggactcgggctgggcgtggtggctcatgcctgtaatctcagcactttgggaggccgaggtgggtggatcacgaggtcaggagatcgagaccatcctggccaacacggtgaaaccccctctctactaaaaataacaaaaaactagccagacgtggtggcgggcagcctgtagtcccagctactcgggaggctgaggcaggagaatggtgtgaacccgggaggcggagcttgcagtgagccgatattgcaccactgcattccagcttgggtgacagagcgagactctgtctcaaaaaagaaaaaaaaaagcagggactcaaacagaatatttgtgtgtccacattcatagcacgattcacaagagccaaaaggtggaaacaatcgaagtttccatcaatagatgcacagataaacaaaatgatgtgtacgcataaatgaaatactattcagccataaaaaggatatgaaattctgacagttactacaagatgaatgaaccttgaatacattgtgctatatgaaagcagccagacagaaaaggacaaatatttcttgattccacttacatgaggtacccagaatagtcagatttatagaaacagaaaatacaatagttctaacttgaagctagaggagaaagtagtaggaagtaactgttttaacaggcatggagtttcagtttgggatgatgaaaagttctagagatgaatagtggtgatgttgcagagtaatacgaaagtatttaatgccacttaaaaacagttaaatggggcggggcgcggtggctcacgcctgtagtcccagcaccttgggatcacccgaggtcaggagttagagaccatccagcccaatcaacatggtgaaacccagtctctactacatatacaaaaattagccaggagtggtggcacatgactgtaatcccagctacctgggaggctgaggcaggagaatcgcttgaacctgagaggcagaggttgcagtgagctaagatcatgccattgcactccagcctggggaacaagagtgaaactctatctttaaaaaaaaaaaaaaagttaaacggtaaattttgttaagtgtattttgccacaataaaaaagtaaaaaaaaataagttctgtgtatggatggtagtgacggctgtacaacagtgtaaatgtgtatataacatctctgaattgtacacttaaaaatgttaaaatggtgaatttatgcttatttccacaatatttttaaaagctggttaaggtctttcagtaattagcttcactctaaattatttttaaggcagatcagaatatagttgctcagaggcttctaaatactttgtaagcaactgaaccaccactacagctaaccagcacccctaaaccaattattgcctagcaaagtattactgcctttcaacccactggccctgcctaagtctggcaaccatataaaatgcttgatactgcttctgcattaataagcagtgagctcttcaaatgtaacacttgatgtccagggcaggagcaggttatagacatagtatgcttaaatctactttccccatggttgatgactagacttaaatcctcagtcacattccctgctacctgactggggccttgtttcattatctgtcgcccttggccctactccttacatctttaatcctctcctctgggtcctacatctcattctaaaatcagactaagtctcctcatgccattaaaatcttccctggactctcaaaccttcaaatctcaccgcacccccaccccccgcccccaccgccacccaacttactcctcttcttggctaccgaacttcatttctggatcccccaggaattgacttcagcctgctacttgactgaattacactcctgaaagttaaccatgacctccaatctgataacctattattcatactacccaaactaaaggcaaaaaagaagaaagaagaagaaagacaaaggaggaagaggaaggaagaaggaagaaggaaggagaaggagacggagatggagatggagacagagaagaggacaaacatttgtaaaaggtcatcaatcacaacctccttaaaactattttctcccttggctgaaactctcctaattcttctcttactctctggtctcttttatctccttccaccaaatctccaaatatgggtacttgtcattctgccttcaccctttttcttccctctcctaggaatttttcagaacttttcttctcaaaacttcgcaaaacatttgaaaatgttttttacattttatatgaataccatcagcacaagaggttgcagaaggagtcaggtagttggagaacaattctgcctaccccagtaactaagaagctggcaacagaagtatgcttccctactgcacatgtatatatcagtgtccaaggttaagaaaaccacatttgtattttttggcaggtacaatacattttaaatgaaaaaaacatttagaatgttttcttttcaaaatgattgtactgatagaaggaagtatctaacaatctgttcattattaattgcatgttttctgatatggttaattatttaggcttgatgtaatcactcagctggttaagactgcttactgatacaaagttaaagataggatgtacaaatgcaattaaatatcagtttcttaaggttaaaaaaaataataatttcctccaatagagagttcttaacattctatgtggaaataaaatttgtagaaaagaaacagaaaaatgaaatccatagagaattgatatgctacaccttaaattaaaacttatcatcagaatacttaaattcttaaaaagtataatttatgatatttaataaataatttatgagtatgaaaaattaaaaccatggacttttttaaactttaggattaatgactagtaatggcttctttgcataagttgcttcctttcgccttaaacaaagaaaccatacattttaaagttttatcataaaaacagaatgtatatgaaattatttcactttagcaatttttaaagtattttaaggctcaaaaacttaaggatatgggaaagtgatcaagatgtagtgatagaggaaaaaaagaaagttataaaacaatgtaatctcatgattccaattttggttaaaaaccagtatgtactaatgggcacagtagatacacaaagtacacagaagcccatatatcaaaatgttaatggtaaatcttgaggtagtacaagtatttttattttcttccttatactttgttttcttcctttatacctttattcctttctatagcaaacatgcatcacatttacagttgagttttgtggaagaataaactctatatttcattccatttctgccttcctgcttatattttgatagactaggaaaggaccatctttcaaagctgtgcagagtaactctttagcattgtcagtgctctcatatacctaatccatcagcaaatcctgttaatccacttacaaaatataacagaattcaactactcactattttcactgcttcttcaagagaagtcaccgtcatctctcggtttatgcaaaagtctcctaactagtctatgtaattccacccttaccacctttctggctctaatgtcactcctctacttagaaattctgtgacttctcatctcattcagaataaaagtctaagcactgattgtgaccttctaggctctatgatctggaccaggaatcaccatgcacactcccacttcagcaccacagaacttgcagtaagttggctctgcctagatattctacatccagataccctcattttcttcagctttttattccagtatcatcttctcaatgaggccttcactggcaatccaacacaacacatcaaccactccaccctacccttgaaatttcctatcttgtttccctgttttattttttctactctagcacttatgactatctaagacacatgatgtatttatttatttttgatattatctccctccctcagtagaatataaactcaataaagagaaatttttacctttgtttttcctgctgctgcatccctagtacctagaatagtcccaagcacatggtaggtactcaatatatatctactgaataaatggataaatgcattccagtgaatccacaagcttaaacccacagcttctcagttacagtaatagttggctcaatgaatgtcatgaaatgatagcaacacatttattcatattctgagaatcaatgactttctaagtgactttgcatagggcaagagagctgaagaacagctatagtaaacaataatgtagacatattttctcaagcctaaaagggagcatctaggatcttagcttcaaaatttatgaataaaattatgacttgatttggtataacaaaggtaaggtaccctgagatcatattgctgttattgttggtactaaaaagtaagcaaaactgtctaaaatcatattgttactcttctaacttttccattagaatattcaataccagtctgtgaaactggatatataactttccttatgcaaacaaaaaactagctgaatatcatactactatgcacctgagtatctgttatctgaaagatctttggatcttttataaacatcaatcaatgctgtgcagacagagctaagagggaaaggcaattagatactgtgaaaaaatggaggcaatcagaagaaatacagtccatggtggcagtgacagagctaagcaggaggtatggataatctgggtaagtgccatggaaaaataaatatcatgattgaacttgaggcaaatggaaacagttcaaattggcttcatacactactctgtggaacatatgatgtccatatgtccattaccaacaaactgaaacatggaaaataacaaaagccgatgctatgatggctataagaacacacccaatgccagtctctaccacaccgcagcagcataacttactacagctgccaggtaagttggctaagaagtcagaagcaataagaaaaaaaggagaaagaactaactataaactgttctctttccctacagaagacaaagttgggatctatactagaaagtagaatgtagcaacgataaaggctgaaagtaaagcacaattttttctctgtagacagtttctaaaagtataaactactttggaattaaagaaggcaacattttatccaaaactacaaacgatttaagatccagagaactaaataaaataacagaggaataagatggaataacttccaaataaaaaattataaatatgacctttcaagttttgaaatacataatagagtataaaaagaaactgaacaaaagatgtggtgggaatccattatgttttacatcagttttaattagtctaccaaattttccttctatagtttctaaccccacctttcttttttttttttttttttggtgttgttgttgttttgagatggagtctcactctgtcacccagggtggagtgcagtggcatgatctcggctcactgcaacctccgccttctgggttcaagcaactctcctgcctcagcctcccaagtagctgggactacaggcgcgtgccaccacacacggctaatttttgtatttttagtggagacagggtttcaccatgttggtcaggctggtctcgaactcctgaccttgtgatccaaccacctcgacctcccaaagtgctgggattacaggcgtgagccactgcacccggcctctaacctccacctttctatactctctaacccccaaagcgattcatcttcaagatacaataagagttgacataaaagaagtagagcttaacttaggcaagtatcatgaaggaccaatttacacagcaaagccaaaactgtaaaaaaaaataaaaatataaattttttaataatgtttaagtgttaaagcctatctggtggtcctgaccttttcaaccaatcaaaaccaggccagtcagatgaactgtataaaaataatatgtacaactactacatatccataatacttaaaatgaatgtttaagaaaataatctcagcacttattcagaaatatactagtgtcactcaaactatacagtaatgaaattcagcagctaaaaatatataactattttacagtaaatatcaatgtcattcctgtttcaacctgacttcccattctacccctaaactcccaaacttgaaaccaactacaatttcttgagtagctggagtgtggtttaggaaaggaagctatgcttgtttgtatggaatctgccatttcctccctgccaaaacacttgtttaaaaagtcatgtaatatttctattaaattgtaaatgcagtcgacaaggaaatggcctactagcagtgtattacctttgtggcagtgccaacgggcctacagcaaaatagtgcacatgataatttcaacatgcattcccaagtaacaaaattgtgctttacataaataccacagaacctgagcaagatccagaaaaagcaatgaaaatctgcccaagctttcatgcttgcctatatcaattgtatgtcataagtaaagcaaaatagaaaagcatctacatatgttcaagaagcttgtgaagttagatcatataaccctgggaaaactattgcagcttaaatctgtgtatttcttgttaaccactgtaacaactcactaataaaaatgaagaaaaaccatggatatcaaatgaaccaaaatgtactaactacatacaagtccttaaagatcatgatgcaacttattaacaggaacatattttcagtgtaagccacaattgttatgttaaattacttctttctttgatatcattcatttgattacagaatgtaagagattcacgagcattccaattaaaatggtgaccttcagtttataagtcacttaccgaaatgcttacaaagtcaccgctaatcatttatttcttaccttgcattgcatagcacaactacatttaattatgcaaattaaatgatcccagatgtaataaagatggttctattcatgtgaaagttatacttaaaaccaagttaacaaaattaaataattaatctgtaattaatatagtcttctaggacagctgaattctattctacagcaatttaactaaaatgcatatttattttataagtcaggtatgacttgtctttctttttaaaaatatcaatcgacacataatttcaaaatttaaacctgatagagacaccatttcctccaaaaatgtaaatttttaagtgttatacacatgaaattagagtaaatacctgccctcagtatacctccttccaccttcctaccctatgcacacctagctatttatgtctcctaaaataaatgctagcttaaatctctggcacaaatagttactattactggcttagaataaaataaaacttactatgaccaacagagtaagtccacacaattgcttttaagatatatatcttcaataatgcttaatggttgtctgttaaaacagttttcatccccaattagcaaaccaaagctactatatcctgaggccaaaattaagggtgcccactactgatttttctgatctctaataaggaacaggaactaaagtgccaaaaaataaataaataatataaattatatcaatttaaaatttaaatgttaaataaataaattgtgctaagtaaaagtttgaaaggcaagctgtgagggatgacagctctttcaagttggatttgattagcatttaattactttcactttttaatttatttcattgattcttatgctaagttgtaagtacaacacttattattttaagaaagaaaaatctgagcttaccagatttcagtattaacaccacagaagtatctttgagataggaaaggaaataagcacatattcaacaaaaatatttattggatattcttatgttagaatctgctagattcatttagacacacaaagatgaaacatacttgaatttaaaacttagatttagtagggaaatacgacaactatatcaaaataactatgataatacacagtaagtttaaaagtgccataagaaaattatagataaggtgatatgagaattcaaagaaagaaaagattttttaaatcagtgggatgaggaacttctaacaataattagacttatctaaaactaagctttccagaagtagaaagattacgggaggaagacatcataatctacatttggttccaggttgaaatgcagaactgtaatatgctatgataaagaaaatagtaaacaaaacactaccctaaatacacaatgtaacaagatacactcttgagggtcactgatattaagaaccacagttctcagttattttcgatcaaggaatccttgtttcaaggagttattattttcatttgatggaaaactatgaactatcttaccagaaaaatacatatctgcacaaacatcaatatttaagtgcaatttcataagatgtgctgactgaattctctgccccagaaacagctcattctaccctcttgtgaatcatggtttccattactgggctagtatgcagtataggggaaaatgaagaagtaaaaaataactgtttttcatcattagaaaagataaaatgtatcacagtcctaataggctcattattttcatattgcttccagtagaggctgcagaagacatctcagcagccataagcaagaacttaaaagttttcagcaatctcccctggctagcaataaactgtcaataagcaggttcaggcacagaaacagtaattcctttgggtactgtgtaacgtcccaatacctcccatcctactgaatgtcctacaacaaaatcaggtgatgaaaaacaactgctcgatccttccacagctcaaagttccttaagtaacaatagtaaatattaaacgggcatcctctgtaagaacctgaactaatttatagtctcaatatgttacttcaaaagcaacttcataaagctagttcatatttctacagtacttagtattttacatgtattgttcatatacactatcccttttgatcttcaaaaagaactctgtgaagtagatggatgagggtccattataactaattcagagataacaaaattgattcaagcctcacaagtctcaaacatcaggtcacaccattattacgtagcaacaatagaagcattcggactttgttagaatttggatttccaacacctggttcagtaattattgctctatagattcaagttgcaaatcattactgggtcataaaatcaatgtaatggatttggaccacacattttttaacgaaaagatgaaacagaatagaatactgtgatagaacagaagtcagagtgaatcacaaataaggaaaataagtatggtttcatgtatattttgtttcacttatgtgtgtgtgtgtgtctgtacacatgtgcataatggatcacactgtgaaaatatttctaccatggaccacaattttaaaagtctgaaatgtaaatgtcatctttcaatcattaataaatcaatttaactcatctcctttaaattctcccacacaaatacagagaaatattgcatttgtcagtatcccacattaaaatcctaaaaagatgaaatgtagtataattctttctcagtaagtattactctaagcaatacttaatggaaacacgtctccaaaactataattcatatttatataatttgtatgtcagtaggaaaatgataattatttcctcaatattaccaaactaatcatgtgtacagagcacttggcaataccaacagcaaggttagaatacagacgaagagtaggaatgcctctttcctgtgtaagtatcaggggtgaccccagcaggcttaatctagagaagttgagacctgtttattctcttcacttgttcatgtcttaaagaataataactctgacaagacaaaaatatgttgaaactgtcactgtaataaaccttaatccccagtttagggtctaggatgccttataccaccaccacccttcaatgtgtatcaggaccacaaagcagagaactcttaactttcaaatggagtaaaaatccatgtcttggaagcagtactgaaattccctgatgatcccatttctcccactcctctggatccttggatgatgtgaaagtacggttaatagaatcaaggtatcacctaaaataggcaaaaaaatagggaagagaaaggaaaggaaaccaaaggtagagaggggggtgaggggagagtattcacctacacaccctgtcaggaaacaaaaaaatgaaaagacaacagtaggaagaaaagaaaaaaaggaagataagggcaggttcaagggagaaatgcaagtaaagtatgtaatgacaaaataataaaatttttatctacaaccatatgatcttatgtaatttgagataatatatacatataactgaataaacgttttacagtgtatagcttcctattctaatcaacaaaactcttatctaccctttcctattaaataaaacagaaatctaaatgattctaacattaaaatgctagttatcactgaactataaattccaaaagaacagtgaacatgtctgctgtgcttactactacttcctaacagctcaagtggtacctgataagtgtgcaccaagtatctacagaaggaaataaaggaaagggaaagggagtaaaagaatacagaaggcactctagatgacatttaatttctctgacacaaaacaaccaatttgggagagaagagatactgtccaactggtcccaaagccaaatttattgcctttatgttagaatatgcatttcttgcattaacaatattaaatcaaaaataatttaatattaatgattaaatttagtattgacgaaaacatgggactgtcccatcatgagaagatacacatttacatggcagaaaatttcaagagtgtcattctcgttgctaaaagattcattaaaaattatttgtactccaaaaggtcccactagctcccaagcaattactcctaaccagaatgaaatgtatgaaataacagatacagaattcagaatatggatggcaaagaaactcaacaagatccaagagaaagttgaaatccaacacaaaggaaacagaaaaataatctaagatttgaaagacggcacagttattttaaggaagaaccaaacagaacctctggaactgaaaaatttactagaggaatctcaaaatacagttggaagccttaacaacagactaaaccaagcaaaagaaagaatttcagagattgaagatcagttcttcaaatcaacccagtcagataaaaataaaaataatttttaaaaatgaaaaaagccttcaagaaatatgagattatataaaatgaccaaatatgtgacttactggcattcctgagagagaagagaaagtgagcaacttggaaaacatatttgaagatagatataattcagaaaaaattccacaatcttgctagagggatcaacatgcagatacaagaaatccagataactcctacaagatactacacaaaatgactattcccagggtacacagtcatcagaccatccaaggtcacccaaaagaaaaaaccttaaaggcagctagagaaaagtgtcatatgacctgtaaagcagcagtctccaaactttttggcgcaaggaaccggtttcgtggacgacaagttttccatagatagggttggagggggtggtttagggatgaaactgttccacctcagttcatcaggcattagttagagtctcatgaggactacacaacctagatcccttgcacgtgcagttcacaaaagggttcacgctcctaagagaatccaatgtcagtgctgatctgacaggaggcggagcttaggctgtaattcttgatcgcccaccgcccacctccagctgtgtgacccggttcctaacagttcatggaccggtaccagtctgtggcccaggagttgggggacccctgttctaaagggaaacccatcagactaacagtagacttctcagcacaaatcctacaaaccagacaagattaggggccaattttgagcattcttaaaagaaatgccagccaagaatttcatatcttgccaaactaagcttcataaatgaaggaaaaataatgtatttcccagacaagcaattactaagcaaattcatcactgccagaccagccctacaagagatgcttaagggaggtctaaacatggaaacaaaagaatgacatttactaacacaaaagcacacgtaaagcacataacccacagactctataaagcaactatacaatcgagactacaaagcaactagctaacaaccctgtgatgggaacaaaacctcacatatcaatattaaccttgaatataaagggcctaaatggcccacttaaaagacatagagtggcaaactggaaaaaacaaacaaaatccctctttctcttatctgcaaaagaaccatctcacaagtaacaacacccatagactcatagtaaatgaatggagaaagatcagttaaacagaaaacaaagaaaagcagaggtcttatattagataaaatagactttaaacaaacgactgtaaaaaaggacaaaaaagagcattatataatttttaaagggttcagttatacaagaagacttaactatccttaaatatatacacactcaacactggagcacccagatttatgaaaacaattacttttagacctaagaaaagatgttgacagccacacaataacagtgggagacttcaacaacccactgacagcattagactgattatcaaggcagaaaactaacaaagaaattctggacttaaatttaatgcttgaccaactgaacctgatagacatctacagaatactctaccaaacaaccacagaatatacattcttctcatatgtacatagaacatactcaaagactgaccacctgctcagtcataaaggaagtctcaataaattcaaaaaaatcaaaatcataccaagcatcttttcagaccacaatggaataaaaatagaaaccaacaccaagaggaactctcaaaaccacataaatacatgaaaactaaacaacgtgctcctgaatgacttttgggtaaacaatgaaattaaggcataaataaaaaagttctttgaaaaaaatgaaaacagagacacaacataccaaaacctctgggatacggcaaaagcagtgttaagaggaaagtttagaatgctaaatgcctacatcaagaaaatggatctcaaattaacaatctaacctcacacctaaaggaacaagaaaaaactaaacccaaagctaggagaagaaaataaataagtaaagtcagagtagaactaaatgaaattgagaacaaaaaaccatacaaaagatcaatgaaacaaaaaattggttttttgaaaggatgaatgaaactgacagactgctagctagattaaaaaaggaaagagagaagatccaaataggcacaatcagaaataacaaaggtgacatcacaacgaagcccacagaaatacagcagatgttcagaggctactatgaacatttcagtacatacaaagtagaaaatctagaggaaattgattaattcctgaaaacacaaaacctccaagattgaactaggaagaaacagaaatcctgaacagaccaacaagtaacaagattcaatcagaaattacacacctaccaatgaacaaaatcccccaaagagagagattcacagctgaattctaccagtcctaataaaactattacaaaaaatcgaagaggagggcctcctccctaactcattccacaaaaccagtatcatcctgatatcaaaatctggcaaagacataacaaaaaaagaaaattacaggccaatatccctaatgaacataagacccaaaattcctccacaaaatattagcacactgagctaggtggaatggctcacatctataatcccagcacttggggaggctgaggcagaaggatcactggagctcaggagtttgacaccagcctgggacatatattgagatcccatctctccaaaaaaaattttttaattagccaggtacagtggcacatgcttatagtcctagctactcaggaggctgagatgggaagatcacctgagcctgtgaggtcaaggctgcagtgagccatgactgcaccactgcaccccagcctggatgacaaagtaagcctgtctcaagaaaaaaaaatttatatatatgagcaaaccaaatccagcagcacatcaaaaaattaattcaccaccatcaagtgggctttattcctaggatgcaaggatgattcaacatatgcaagtcagtaaatgtgatttaccacataaggagaattaaaaacaaaaaccatataatcatctcaatagacacagaaaaggcttttgacaaaatcctatactccttcattataaaaatccacaacaaacttgacatcaaaggaacataccttaacataataagaggtatctattacaaactcacggccaacatcatactgaatgggcaaaagccagatgcattcccttaagaactggaccaagacaaagatgtccactcttaccattcctatccattatgtcactggaagccctagccagagcaataaggcaagagaaagaagtaaaagacatataaataggaaaaaaagaagtcaaattatctctcttcactgacaatataattgtatactagaaaatcctaaagattctgtcaagactcctaggcctgataaatgatttcagcaaagtctcaggatataaagtcaatgtacaaaaatcagtagcacttctatacgctaataatgttcaagctgagagccaagtcaagaatgcaatgccatttacaattcctaccaaaaaaaaaaaaaaaacaacctaggaatacacctaaccaaggaggtgaaggatctccacaaggagaactacaaaagactactaaaagatagcagagacgacacaaacaaatagaagagcattccacgttcccaggttggaagaatcaatattgttaaaatggtcatactgcccaaagcaatctacagattcaatgctattcctatcaaactaccatcatcatttttcacagaattagaaaaaaactattccaaaatttatatggaaccaaaaaggagcctaaatagccaaggcaattctaagcaaaaagaacaaagccagagacatcaatttacctgacttcaaactatactacatggtactgtaaccaaaacagcaaggtactggtacaaaaatagacacacagaccaatggaacagaatagaggcataaaaaaataatgggatcatgtcctttgcaggaatgtggatgcagctggaggccatagtcctaagcaaactaacacagaaacagaaaaccaaacactgcatgttcttacttataagtgggggctgactactgggttcacacagacataaagatggaaacaacagacgctaggaactctaaaaggaaggaaggagtggagaggacaagggctgaaaaacttcctatcggatactatgttcactatctgggtgacaggatcagcagaagcccaaacctcagtaccatgcaatatacccttgtaacaaacctgcacatgtaccctaaaataaaaatggaaacttaaataatacaaactgtgaaaaaatatttttaaaaaataatttccaaagaatatgaaatgctgatttacaattattaaatatttacacaacttcttcagaacacacctattgcataatgcaaagtacatatatatgatttaataaaaataatcctctacttggtagacaactaagtcatttgcatagaaacagtgaaaagcattctgattgaaagatctctcaatatagtgattacaaagaagacatacaaagggactcagactgtgtattataattggggtggagaaagtgatatggggacaactggaaagacaataaacaggcagtaaaaagttaaaggagtaggacaccttcaccagcatagaaacaacaagcaggtcagtactagagagaggttaaacaaaaagcccaatttaaaaatgggcaaagcagcaccgggcgcagtggctcaaaacctgtaatcccaacactttgggaagccaaggtgggtgaatcaaaaggtcaagagatcgagaccatcctggcaaacatggtgaaaccccgtctctactaaaaatacaaaaattagctgggcgtggtggcgcgcatctgtaatcccagctactcgggaggctgaggcaggagaatcgcttgaacctgggaggtggaggttgcagtgagccgagatcatgccactacactctagcctgggtgacagagcaaaactccgcctcaaaaaaaaaaaaaaaatgggcaaatgaattgaatagacagttcccaaaagatatacataatggataatggacaataagcatatgaaaagatgttcaatatcactagtcatcagagaaatgcagatcaaaatcacaatgagatgccacttcactcccattactatggccattagcaaagaaaaacaacagaaaataacaagtgctagcaggaacgtgaagaaactggaactcttgtacattggtggtaggaatgtaaaatggtacagctgctgtggaaaacagtatggaggttcctcaaaaaataaaacactcttgaattgatgattgtggatccagttcatggtagcattattcacaaaagccaaaaggaggaagaaacccaagtacccatcaacaaatgaatgaataaacaaaatatgctatatacatacaaagaaatattattcaggctttaaaaggaagcaaattctgacacattctatgacttgtataaattattgaaaacattaggctacataaaacacacacacacacaaaagaacaaatattgtttgattctacttatatgaaatatttagaacagtcaaactcatagagacaggaagtagaatactggttgcgaggggttggagcaagaggatatggagaattattgtttaatgggtacagggtttcagtttgagataattaaaaaatttctagaaatagtggtaatgattgcacaataatgtaaatgtactttatggcaatgaattgtatagagtactttaaaatggttaaaatgataaattttatgttatatattactcattaatcctaattataatcttaaattatgtaattatacttatactatataaatgttaatcttaaattatacataattattaatcttaaattttctttctctatttgaaagaagagaacatattatggggagtgtagtgagttgaaaaatggccatcctcagaagatatgtccacatcctaatctctgaaacctctaaatgttacacaatttgggggggaaaaatacaatttatgcagatataattaagttaagaatcttgaaagcagaagatcatcctggatcatctgagtgggccctaaatccaatgacaagtgcccttataagagaaaggcagagagaaatttgaggtagatagacaaaaaagaagacacagggctgggtgcagtggctcacacctgtaatcccagcactttgggaggccaaggcagacagactgcttaagctcaggagttcgagaccagactgggcaacatggtgaaccccatctccacaaaaaaaatataagatttagccagccatggtagcttgtgcctgtagtcccagctacttgcggggctgaggcgggaggattgcttgagcccaggaattcgaggctgcaatgagccatgttcacgccactccagcctgggtgacaaagcaagaccctgtgaaagaagaaagaagatgatgatgatgacacagacactcagaggaaaatgcaatatggagatgtaggcagagattagagtaagacaactacaatctaaggaaaacaggattgcaggcagccaccaagagctggaaaaagtgaaaaatagattatcctgtagagccccttgagggagtacagtcctgccaacactttgatttcagacttctggtttcccaggctaaatgaagatactcctctatgccattcaccactgtgttaaatccttgcaaggaatcttccaacaggtggtgtcagacaaacacaggtgcacatacactaagacatccaaggtatctacaaatacctacacagcagggactgggagatggaaggtgtgttaagtgtgttgggtgtggtattactcaagtctcaccactacagagaatcagttttccagaatttctcaagcaaattttattattaattgagcaggaaaggaggacatggatgcttttctcttttttggtgttgggtttttttaaatattaaaaaacggttaactaagtgttcactcttcacatgtggacataaccacattttttgtctctttttttaaaatcctttctttgtgaaaaaagtagtgccatgggatttccaatgggagagagctactgtgttttactttttgatatgcactataaagaatgatcttctaacccatgtctgtttttacgctgcctatactaaagcatttgttgcatctatttaaatgctatgtttctccaaaaagggaggtggaagccagttggaaaatatggtgggttaaggaaaagactcttcaggaaaggatagcattatttttgaaaacatcattcatcaaaaatgactccttatgtttgaaaatatctgcagggctcctttatttgtaagtaggtagtgtaaggacacagagatagagacctttttttaggctaaaataattctttttttttcatactttaagttttagggtacatgtgcacaatgtgcaggttagttacatatgtatacatgtgccatgcgggtgtgctgcacccattaactcgtcatttagcattaagtatatctcctaatgctatccctccccactccccgcaccccagaacagtccccagagtgtgatgttccccttcctttgtccatatgttctcattgttcaattcccatctatgagtgagaacatgtggtgtttggtttcttgttcttgcgatagtttactgagaatcatgatttccaacttcatccatgtccctacaaagaacatgaactcatcattttttatggctgcatatcattccatggtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatatacccagtaatgggatggctgggtcaaatggtatttctagtcctagatccctgaagaatcgccacactgacttccacaatggttgaactagtttacagtcccatcaacagtgcaaaagtgttcctatttctccacatcctctccagcacctgttgtttcctgactttttaatgattgccattctaactggtgtgagatggtgtctcattgtggttttggtttgcatttctctgatggccagtgatggtgagcattttttcatgtgttctttggttgcataaatgtcttctctgagaagtgtctgttcatgtccttcgcccactttttgatggggttgtttttttcttgtaaatttgtttgagttcattgtagattctggatattagccctttgtcagatgagtagattgcaaaaatttcctcccattgtgtaggctgcctgttcactctgatggtagtttcttctgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatggttttaggtctaacgtttaagtctttaatccatcttgaattaatttttgtataagttgtaaggaagggatacagtttcagctttctacatatggctagccagttttcccagcaccatttattaaatagggaatcctttccccattgcttgtttttctcaggtttctcaaagatcagatagttgtagatatgaagcattatttctgagggctctgctctgttccattgatctatatctctgttttggtaccagtaccatgctgttttggtaccagtaccatgctgttttggttactgtagccttgtagtttgaagtcaggtagtgtgatgcctccagctttgttcttttgggttaggattgactcggcaatgcgggctctttttgggttccatatgaactttaaaatagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcccaggtattttattctctttgaagcaattgtgaatgggagttcactcatgatttggctgtctgttattggtgtataagaatgcttgtgatttttgcacattgattttgtatcctgagactttgctgaagttgtttatcagctaagggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttatggagagtttttagcatgaagcattgttgaattttgtcaaaggccttttctgcatctattgagataatcatgtggtttttgtctttcgttctgtttacatgctggattacatttattgatttgcatatattgaaccagtcttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgtcaggctttggtatcaggatgacgctggcctcataaaatgagttagggaggattccctctttttctattgattggaatagtttcagaaggaatggtaccaattcctccttgtacctctggtagaattcggctgtgaatccatctggtcctggactctttttggttggtaagctattgactattgccacaatttcagagcctgctattggtctattcagagattcaacttcttcctggtttaatcttgggagggtgtatgtgtcgaggaatttatccatttcttctagattttctagtttatttgcatagaggtgtttgtagtattctctgatggtagtttgtatttctgtgggattggtggtgatttcacctttatcattttttattgtgtctatttgattcttctctcttttcttctttattagtcttgctagcggtctatcaattttgttgatcctttcagaaaaccagctcctggattcattaattttttgaagggttttttgtgtctctatttccttcagttctactctgattttagttacttcttgccttctgctagcttttgaatgtgtttgctcttgcttttctagttcttttaactgtgatgttagggtgtcaattttggatctttcctgctttctcttgtgggcatttaatgctataaatttcactctacacactgctttgaatgtgtcccagagattcttgtatattgtgtctttgctatcattggtttcaaagaacatccttatttctgccttcattttgttatgtacccagtagtcattcaggagcaggttgttcagtttccatgtagttgagtggttttgagtgagtttcttaatcctgagttctagtttgattgcactgtagtttgagagacagtttgttataatttctgttcttttacatttgctgaggagagctttacttcctgttccaaaatgtggtcaattttggaacaggtgtggtgcggtgctgaaaagaatgtatattctgttgatttggggtggagagttctgtagatgtctattaggtctgcttggtgcacagctgagttcaattcctggatatccttgctaactttctgtctggttgatctgtctaatgttgacagtggggtgttaaagtctcccattattattgtgtgggagtctaagtctctatgtaggtcactcaggacttgctttatgaatctgggtgctcctgtattgggtgcatatatatttaagacagttagctcttcttgttgaattgatcccttcaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattttgatgttagctggttattttgctcgttagttgatacagtttcttcctagcctcgatggtctttacaatttggcatgattttgcagtggctggtaccggttgttcctttccatgtttagtgcttccttcaggagctcttttagggcaggcctggtggtgacaaaatcactcagcatttgcttatctgcaaagtattttatttctccttcacttatgaagcttagtttggctggatatgaaattctgggttgaaaattcttttctttaagaatgttgaatattggcccccactgtcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacacagtgagatgaagatctggtcttttcacatagtcccatatttcttggaggctttgttcatttctttttgttctttttctctaaacttcccttctcgcttcatttcattcatttcgtcttccatcactgataccctttcttccagttgatcgcatcggctcctgaggcttctgcattcttcacgtagttctcgagccttggctttcagctccatcagctcctttaagcacttctctgtattggttattctagttatacattcttctaaatttttttcaaagttttcaacttctttgcctttggtttgaatttcctcctgtagcttggagtagtttgatcgtctgaagccttcttctctcaactcgtcaaagtcattctccgtccagctttgttccattgctggtgaggagctgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtgtgttggagtttgctagaggtccactccagactcggtttgcctgggtaccagcagcggtggctgcagaacagcggattttcatgaaccgcgaatgctgctgtctgatcgttcctctggaagttttgtctcagaggagtacccggccgtgtgaggtgtcagtctgcccctacttgggggtgcctcccagttaggctgctccggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcctccagaggtgaagcctacagaggcaggcaggcctccttgagctgtggtgggctctacccagttggagcttcccggctgctttgtttacctaagcaagcttgggtaatggcgggcgcccctcccccagcctcgctgccgccttgcagtttgatctcagactgctgtcctagcaatcagcgagactccgtgggcgtaggaccctctgatccaagtgcgggatataatctcctggtgagccgttttttaagcccctcggaaaagcgcagtattagggtgggagcgacccgattttccaggtgccgtctgtcacccctttctttgactaggaaagggaactccctgaccctttgcacttcccgagtgaggcaatgcctcgccctgcttcggctcgcgcacggtgcactgcatccactgtcctgcgcccactgtctggcactccctagtgagatgaacccagtacctcagatggaaatgcagaaatcacccgtcttctgcgtcgctcacgctgggagctgtagaccagagctgttcctattcggccatcttggctgcttccccaataaaatcaataattcttaatttactcttaaacagagattgtcatgctttatgtgagttaaatttccagaaagttgacaagtgcctccaattatctccttaaatcacatttgacataaatcttccaaaatacactatttatttacacatctttttttaaagttataaacattcagtattgcattgcatagaagtaaaaattcttggtttgatttctattttctttcctttgcctgattcaagaaatcatcaggtacttctcctgctgtccacagagtgatccatacagttctttccttacccctttccctatgctgaacaacaggtaagcaaacacaaagggtttttacaggttacgcctgtactcccaactactcaggaggctgaggcaggataattgcttgacccagggaggcgaagattgcagtgagcctagatggcgccactgcactccagcctgggtgacacagcgagaatccatcaaggaaaaaaatacaaaaatttgctgggtgtagtggtgtgcacctgtagttccaggtattcgagaggctgaggtgggaggattgcttgagcctgggaggttgagggctgcagtgagctgtgattgtgccactgcactccttcctgcctgggtgacacagtgagaccctgtcacatggatggaaggaagggagggagggagggagggaaaagaaaggaaaggaaaaaagtaaagagaaaagaaaagaaagagggaaggaaggacggaaggaaggaaatgatactatttattcatctcctgatttaaaatatatacatatatatacatacttcctaaggctgagtgcactggcttacgcctataatcccagtactttgggagaccgaggcaggtggatcacttgaggtcaggagttcaagatcagtctggccaacatggtgaaaccccgtcactactaaaaatacaaaaaattagcttggcatggtggtgcgcacttgtaatcccagctacttgggagactgagctgagacaggagaatcgcttgaaaccgggaggcagaggttgcagcaagccaagactgccaccgtactccagcccagacaacagagcgagactttgtctcaaaaaaaaatatatatatatatatatctatacacacacatatatatacacacacacactcacacacacacactctctctctctcacactcacttcctaaaggcctgagaaaaagagaagactgatctcctcaaaagtatgtggttaactgaattcaaaactaaatttttttaactattctatttatctaactgatcaaaattaatttggtggtttcatatttaactttataaaataaactgagttttaatttaaaaaaatttgtttcacttaacattctgattagacttactcccatttgccactactcactaattttaatctcatagctgaatataaatttataagcacttttatccctctcctgtttaaaagctttatatgtttcaatgtgtacatcatcatttccctttactaaacagataatcattactgtctaccacagtgaagattcggtttacatatactacaagtttctttggggggaagaaaaagttgtatggaaactaacaaatttggttaactccttgccatcaaacaaatccagtgtttttaatagttcttcttattagaaaatttctccttgaacatctatattccaaatattccttattctgcccaggaatgataaaagaaataatcaatctctgacaaactgataaactaaagcatataaaacaaatgacctcagacttaacacctttgaaagacccattctcaaataactgcaaatttccaatttaaccactttcattttctaatttagtgccatctttaagttcttcgtatccctcagactatgacaccctaaatatatgtcctacaaaaaccttaatcagtgaaaaacagtattaatttgtggccacttaaggagaagcaactccattctaaattatccaagctcaaggcatctctttttgcccctaatttttgctggcctaagcaatactactttacaaacaggcctggtacctaaacacggtaaaaggctgagaaaatgactgggaaaccaaatcccagttcactcagtctacaaggcagcaccactgttctggagtgttcctaattatatacagctagtgggcaggcatagtggaaagggctagaactctgtgaggatgaatgcaaggcatttcagaaagactggctagaatcctcactccaattaggcaataccaccagtggctgggcaccccactatagatggaggctggggaaactcacccaccacatcctaactttgtctctaactttgttctagatagccatgtatatgtagtaaattgtatcatttacttatattaaaataactatcaggttttttgcctgttatcagctgtggggtcttcatgtcaatcacatctttgtctcattgtggcaactttgtagattattgattacctcattagcctatatgtctaccaaaacatggctggaaaacaaaactttaaaaattgaaatcttacctaggttaccatatttcctgctactctggaaaacttagagggttcagattttaaatcagtaattataatattgtgattacatggttttaaaatgtcttatttttgttagccgctcctccacttgcactgagttgggatattaacacagaggatatttctttggtgtctaggcaaaaacacagaacaaactgagttcatatctcagttctgccactgacaagttatgtcatcttaaataacataatcttatccatttcatccaatccacccaatggaggataaaatatttatttcacaaaattactacagtacaaaaaaaaatgttggtaaaaaacttcaatatttcactcacttaccatagtgtcatatcctaccagctttctcatatcttaactaccactttatctcctctctaacctcctgagattctgatttaatctgtttagggtagggctccccacatgacggctatgcagcaagcatggagaacactacctattctttgatcaccccatttccttacactctctcttttctttccagactgtgccctgttagtaaccccttgaactgtctctcagcagcatccttaaattccctatagccccatccttctaagacactcattcattaaaacccaaaccctccatatcaaggccataatgcattctactgcacagcagagcacactaccataggaaggcccacaaaccaggattaattacactatactttcccaattaccaattttagctgggccctcaacaatttttctctcttggacagctctttctttcattgccctcactataccccccacaaaactactgtaaaccttgatgaaacagtaaagtttattaattctattaaatttctacacttgaatatgtatttttaatattctacattgacaaaatggaaaatatgcataaagcacttccccacatatcaaagaacaacaataatctgaaaaaaagcagttgtgtgactgagctgcaagctaaataaactacaaggctcttttcaaagaacatcatttttacttgaagaataactaacagaaaactaaggttacacagacttgggtatttgacagacattttctcaaaaaggaaccaagtgaacctgtcatttcaaggaaaacaaaaggcagtacttgttaccagtgataaaactatctgttacatgatctcaacagcttccaatacttgcagttcaatactctactttgtaagacagctcacaaacacaagaaaagttaaataatgatattatttaaataggaaataaactatattatgtttggaaatgcacgaggcaacacttgattaactgtccaaagaactggactgtgaagaaattgcctatatacaaaatatgaggaaaaagagaaatttacttgggcgatagctgtcaagaatggctctacacaggcataaaatccaagttgggacttgaaaaactggtaggatttagatttaaaaaaaaaaaaacagtgagcaaggcatcctaggaagtttgcaatacaggtatatttttttctaaaagaaatattattttcaggtatatttttaataatgtataatgtattcattcaaactctcaggtaatattagaagatccttaaaggaagaggccacatattacaattctctgctatctgagcacaggatcaaatttaacatgttgaactatttggttggaaaaataagatttacacagggaagaagcagaatagtaataatggaagtcctaagttaaatcccagctcttgtacttacctaggttgccttgggtaatttagtaaacctcactgattcaaactcaaatacacctactttgaggatcaccctacaaacatcctaactaaaagaaccacagataactaatgatcagagatgaaataagactttgtgttcctgtttttatgctgaccttgttgtttttcaagttattttcaaacaattgatgcatttttatctttcatttaccaaaaggaatttatatacaccaggaagatgatacatattgtatacaattacattactcaaagaactctaggctgggcacactgctgtaatcccagcactttgggaagctgaggtgggcggatcgcttgagcccagaagttggagaccagcctgggcaacatggcgacaccttgtctctacaaaaaattagttgggcatggtggtgcatacctatagtcccagctactctgcaggctgaggtgggaggatcacctgagcccaggaggtcgaggctcgagtgagccatgatcgcactactacaatccaggctgggtgacagagtgagaccttatctcaaaagaaaaaaaaaaaaaactctctttaaaatgtttcaatacagcagacagatttttaaatattttctgtataatacactgttacctatattatcgaaatttaacccacaatggcattataatatcagatgtaattccaatttattcttcttcagatattctaaaatatctgaatttttatgcattcttcctctttctatctatttacttcacattcctccagccaccatgatattatcttctcttttctacaaatacacacatacatacactcctcccctcattcctacatccttattgagataactacagccactagagggcaataagtatacaaagatcagtgtacctatttatgatgatgaacttatctatatgattcacatagtaataaacctaaaaagtatatcatcacaaaccctgaaacacaggcaattagacttgaatatgcaaaatatatatttcaaactcaaaaattatcctgcagagttcacagaagcatataatgatgttcaaaaaaggaattccattttctcagcatgcattcattaaaaaaaattagccgaattcctttatatgtgcatagtaatattagaaattaggattgcttaataccatcctcagaccaaagaagagaaaaggcagaaaaaaaaaaacacacagtaaggtataaatcacagagtgggtaaaaaagtgagaaatgattacttccaactctttcactaccacaatcaagaaaacaataaactgaagagcaaagaggatttaccaaccctttcttctattgaaaagcaagcaaaaattttacaagtatatttttgggggaggagaacagtgatggtagagatatacaaagccttcagttcttttctcacaattaagaatgcagaaggaagagaagttaacagttactaatctttaagaggtaattttaccatttttaaaaagaatacatttaaatgaacttatttagtttatatttacttacattgacattacaaaacggcaacacttatataaggctaacattttcagcaaaccataattttcttaccctcattggatgtatatcagcataaggaggttttccttcagccatttctatagaagtaatgccaagggaccagatgtcggccacacagttatagcctatttcttgaatcacctcaggagccatccaaaatggagttcctattacagtattgcgttttgccattgtatcctgcaataatgttacatagccataaatgctactacaaaagcacaaaggaaatctgtatgccaaacatacttttaaaaaatgttaaaacctccaatgccacagattatatcagaaattgactattttgctaaaatttcaactagttatgacatacttaggaattccgaattctgaaaataaccaagagtccacaggtaacttatccacactaccatcattaaacacagtcattaaagatagtgctacaatgataaaagctacagaaatgagctacgtagcttcccttttagaacatttaagcattttgattataagatatattttcacattcaatcaccctaaattataaattaaataatactcaaatttggctcaattatggttccttctccacaaaaattaaaaaactacacatttctttccattccccctcaaaaagtaattgaagtttagttataatcaaatctgaacaaattagccaagtgtttagaaaaccattaaagttaacttactgttaactgaccagccactccaaaatctgccaattttgcatgtccttctgtattgaggagaatatttccagcttttatatctctgtgtatttttctcataaagtgcaaatattctagtcctttcaatgtagatttaagaatggttgcaatttcatcttctattaactggaaagaaatatttttaaaaccataattaaaatgccacgttagataaaatcttacgaaagagcactagtaacaagtatgtctttccgtgtgtgtgtgtgtgtttttttttaagagaccccactctgttgcccaggctacagtgcagtggtgtgatgatagctcactgcagcctaaaattcctgggctcaaggcatgctcccacctcagcttcccgagtagctagaactacaggcacatgccaacccaataggctaacttatttttatttttgtagagatggggatctcgctatgttgcccgggctggtcttgaactctttgcttcaaacaattctccttcctcagcttcccaaagtgttgggattataggtgtgagccaccatgcctagccacaagtacttctttctaatgaccgctaaacctccaggaaaatgctaaaggggtaaataatcgagaacctcttcttcccacaataagctttcttattacacattttactaatgaaaggatgatcaaatttctctctttaagattatcagtatcagcagggcgtggtggctcacacctgtaatcccagcactttgggaggctgaggcgagcagatcacttgaggtcaggagttcaaaaccagcctggcccacatggtgaaacctcgtctctactaaaaatacaaaaattagccaggcgtgatggcgtgcacttgtaatcccagctactcaggaggctgaggcaggagagtcacttgaacctgggaggcagaggttgcagtgagctgagatcacatcactgcatgccagcctgggcgacacagcgagactccatctcaaaaaaaaaaaaaaattatcagtatcattcctaaagcaaacaacatatctcaagaatcagcctgatataaggaatcataatagtgatttcccacatcttctaatactgggagggcactatcacagctaatatctgttctgaaaaagtaaattcagatacttcccctgagatatttcagattcttgatgaaaatgaaaccaacagctttacataaaggaaagtaaatgagggagggaggcttgcaatgaatcttctgcgagaagctcctacaccaatgccactcctaacccttccaagttctggacttctgacctaatattgagaactcagaagaaaaaacgtcagagaaagattaggaaaatggaaacacaagcaaagactatcagaggagggaaaaaggggagagtagagaaggccgaggaagagacggatgggaaagaaagaaaatcttcttaacagttgtagcagtagagccactgctatctgtaccaggcaatgtgctaagagttatgcatgcattctctcatttattcttaaaacaaccttgtaaggtagtgtgatattatgaaatcacaggaaatatttggtctttgtaggttcttggcacaaaatctcctaagaccctgtgaattgactgagtgagtgagaagttgaatcaagatattttatctttgttttctcaccctctcacaagagtgagaggggctgtcttttgtcattcataataagctcctttcaaccataccagaatttatactgatcaggtgactcttggtgggagcctagatagcttcaggatgggagctggttgccgaaaaaaccaaccaagtgattagatgtttggaaatttctgcctgacccctgacttacgggagggctgcaaggagagagggggtagagatttagttaagcacaaatgtccaaagacttaatcaatcatgcctatgtaacagaatcaaccataaaaattctaaatgattagggactgctctcaagcttatattctatctataagcaacgggataatttgatagaaaataggataacacaggaaaatgtctgtgaaaattgctatgaggacaacaatagagagctactgatagagaacgactgagaagctactttagattgacattcaagaaggcccaaaagacattttactgaagtctaaatgatataatggggccaaccatgtgaatggctatctgggaacatacactccacaaaaaggaaaaaaaaagattaaaatatcttgattcaacttctcaaattttctaaaacactgaagaaaagagaacacttccacactcattttaagaggcattattctgatatcaaagccagacaaagttaccacaaaacaactaagaccaatatcccttatgaacattgatacaaaaatcctcaacaaaatatagcacactcacttcaacaggattgtaacaggttatacactatgaccaactggaatgtattcctggaatgcaaggttgattcaacatacaaaatcgaacaatgcaatacaccaccttaacagaatggagaagaaaccacatgatcatttcaaatgaaaacagaaaaagcatttgattaaatttaacttcttttcataaaacacacaactaatatgaatagaaggaaactatctcaccatagtaaaagccatatacaaaaaacccaaagtaaatgtcatactcaaagcagtaagactgaaagcttttccacaaagatcaggaacaatgaaaggatgctattaggttggtgcaaaagtaatcgcagtttttgccattttttttttaaagtaatggcaaaaaccgaaattacttttgcaccagcctaatacttctgttacatatagtactggaggttctagacagagcaattagggaagaaaaacaaataaaggcatccaaactggaaaaaaagaagtaaaattatctctgttcacagatgatatgatcatatatgtagaaaattctaaagattccacaaaaaaaacctattagaactaataaatagggatggagacaagacggctgaataggaacagctccagtctaaagctcccagcgtgagcattgcagaagacacatgatttctgcatttccaactgaggtaccagattcatctcactggggagtatcggaaagtgggtgcaagacagtgggtacagtgcactgagcatgagctgaagcagggcggggcatcacctcacctgggaagtgcaaggggtcagggaattccctttcctagtcaaagaaaggggtgacagatggcacctggaaaatcaggtcactcccaccctaatactgtgcttttccaatggtcttagcaaacggcacaccaggagattatatcccgcgcctggcttggagggtcctacacccatggagcctcgctcactgctagcacaacagtgtgagatcaaactgcaatgcggcagcgaggctgggggaggggcgcctgccattgcccaggcttgagtaggtaaacaaagcagccaggaagctcaaactgggtgcagcccaccacagctcaaggaggctggcctacctctgtagactccacctctgggggcagggcatagccaaacaaggcagcagaaacgtctgcagacttaaatgtccctgtctgacatctttgaagagagtagtggttctcccagcacacagctggagatctgagaacagacagactgcctcctcaagtgggtcactgacccccaagtagcctaactgggaggcagccccaagtaggggcagactgacacctcacacagcccggtactcctctgagacaaaacttccagaggaacgatcaggcagcaacatttgctgttcaccaatatccactgttctgcagcctccattgctcatacccaggcaaacagagtctggagtggacctccagcaaactccaacagacctgcagctgagggtcctgacagaaggaaaactaacaaacagaaaggacatccacaccaaaaccccatctgtacatcaccatcatcaaagaccaaaggtagataaaaccacaaagatgcagaaaaaacagagcagaaaaactggaaactctaaaaataagagtgcctctcctcctccaaaggaacacagctcctcaccagcaatggaacaaagctagacagagagtgactttgacaagctgagagaagaaggcttctgatgatcgaactactccgagctaaaggagaagtacgaacccaggcaaagaagttaaaaaccttgaaaaaaaaattagacaaatggctaactagaataaccaatgcagagaagtccttaaaggacctgatggagctgaaaaccaaggcacgagaactacgtgacaaatgcacaagcctcagtagccgattcaatcaactggaagaaagggtatcagtgatggaagatcaaatgaatgaaatgaagtgagaagagaagtttagagaaaaaagaataaaaagaaatgaacaaagcctccaagaaatatgggactaggtgaaaagaccaaatctatgtctgattggtgtacctgaaagtgatggggagaatgaaaccaagttggaaaacactccgcaggatatcatccaggagaacttcctcaacctaccaaggcaggctaccattgaaattcaggaaatacagagaacgccacaaagatactcctcaagaagagcaactccaagacacataattgtcagattcaccaaagttgaaatgaaggaaaaaatgttaacagtagccagagagaaaggtcgggttacccacaaagggaagcccatcagactgacagctgatctctcggcagaaactctacaagccagaagacaggggggccaatagtcaagattcttaaagaaaagaattttcaacccagaatttcatatccagccaaactaagcttcataagtgaaggagaaataaaatactttacagacaagcaaaggctgagagattttgtcaccaccaggcctgccctaaaagagctcttgaaggaagcaataaacatggaaaggaacaaccagtaccagccactgcaaaaacatgccaaattgtaagaccatgaatgctaggaagaaactgtatcaactaacgagcaaaataaccagctaacatcataatgacaggatcaaattcacacataacaatattaaccttaaacgtaaatggactaaatgctccaattaaaagacacagactggcaaaattggatacagagtcaagacccatcagtgtgctgtattcaggaaacccatctcacgagcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatcctaaatatatatgcacccaatacaggagcacccagattcataaagcaagtcctgactgacctacaaagagacttagactcccacacaataataatgggagactttaacaccccactgtcaacattagacagatcaacaagacagaaagttaacaaggatatccaggaattgaactcagctgtgcaccaagcggacctaatagacatctacagaactctccaccccaaatcaacagaatatacattcttttcagcaccacaccacacctattacaaaattgaccacatagttggaagtaaagcactcctcagcaaatgtaaaagaacagaaattataacaaactgtctctcagactacagtgcaatcaaactagaactcaggattaagaaactcactcaaaaccgctcaactacatggaaactgaacaacctgctcctaaatgactactgggtacataacgaaatgaaggcagaaataaagatgttctttgaaaccaacaagaacaaagacacaacataccagaatctccgggacacattcaaagcagtgtgtagagggaaatttatagcactaaatacccaaaagagaaagcaggaaagatctaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaattaatgaatctaggaactggttttttgaaaagagcaacaaaatagaccgctagcaagactaatagaaaagagagaagaatcaaatagaagcaataaaaaaatgataaaggtgatatcaccaccgatcccatagaaatacagactaccatcagagaatactataaacacctctacgcaaataaactagaaaatctagaagaaatggataaattccttgacacatacaccctcccaagactaaaccaggaagaagttgaatctctgaatagaacaataacaggctctgaaattgaggcaataattaatagcttaccaaccaaaaaaactccaggaccaaaaggattcacagctgaattctaccagaggtacaaggaggagctggtatcattccttctgaaactattccaatcaatagaaaaagagggaatcctccctaactcattttatgaggccagcatcatcctgataccaaagcctggcagagacacaacaaaaaaaaaagagaattttagaccaatatccctgatgaacatcgatgcaaaaatcctcaataaaatactgacaaaccgaatccagcagcacatcaaaaagcttatccaccatgatcaagttggattcatccctgggatgcaaggctggttcaacatacgcaaatgaataaacataatccagcatataaacagaaccaaagacaaaaaccacatgattatctcaatagatgcagaaaaggcctttgacaaaattcaacaacctacatgctacaaactctcaataaattaggtattgatgggatgtatctcaaaataataggagctatctatgacaaacccacagccagtatcatactgaatgggcaaaaactggaagcattccctttgaaaactggcacaagacagggatgccctctctcaccgctcctattcaacatagtgttgaaagttctggtcagggcaattaggcaggagaaggaaattaagggtattcaattaggaaaagaggaagtcaaattgcccctgtctgcagatgacatgattggatatctagaaaaccccatattgtctcagcccaaaatctccttaagccaacaggcaacttcagcaaagtctcaggatacaaagtcaatgtgcaaaaatcataagcatttttatacaccaataacagacaaacagagagacaaatcatgagtgaactaccattcacaattgcttcaaagagaataaaatgcctaggaatccaacttacaagggacatgaaggacctctttaaggagaactataaaccactgctcaatgaaataaaagaggatacaaacaaatgcaagaacattccatgctcatgggtaggaagaatcaatatcgtgaaaatggccatactgtccaaggtaatttatagattcaatgccatccccatcaagctaccaatgactttcttcacagaattggaaaaaactattttaaagttcatatggaacccaaaaagagcccgcactgccaagtcaatcctaagccaaaggaacaaagctggaggcatcacactacctgacttcaaatacactacaaggctatagtaaccaaaacagcatggtactggtaccaaaacagagaaacagaccaatggaacagaacagagccctcagaaataatgccgcatatctacaactacctgatctttgacaaacctgacaaaaacaacaaatggggaaaggattccctatttaataaatggtgctgggaaaactggccagccatatgaagaaagctgaaactggatcccttccttacaccttatacaaaaattaattcaagatggattaaagacttacatgttagacctaaaaccagaaaaaccctagaagaaaacctaggcaataccattcaggacataggcatgggtaaggacttcatgtctaaaacaccaaaagcaatggcaacgaaagccaaaattgacaaatgggatctaattaaactaaagagcttctgcacagcagaagaaactaccatcagagtgaacaggcaacctacagaatgggagaaaatttttgcaatctactcatctgacaaagggctaatatccagaatctacaatgaactcaaacaaatttacaagaaaaaaaaaacaaccccatcaaaaagtgggcaaaggatatgaacagacacttctcaaaagaagacacttatgcagccaaaagacccatgaaaacatgctcatcatcactgaccatcagagaaatgcaaatcaaaaccacaatgagataccatctcacaccagttagaatggcaatcattaaaaagtcaggaaacaacaagcgctggagaggatgtggagaaataggaacacttttacactgttgatgggactgtaaactagttcaaccattgtggaagtcggtgtggcgattcctcagggatctagaactagaaataccatttgacccagccatcccattactgggtatatacccaaaggattataaaacatactgctataaagacacatgcacacgtatgtttactgtggcactattcacaatagcaaagacttggaaccaacccaaatgtccaacaatgatagactggattaagaaaatgtggcgcatatacaccatggaatactatgcagccataaaaaatgatgagttcatgttctttgtagggacatggatgaagctggaaaccatcattctcagcaaactattgcaaggacaaaaaaaaacaaacaccgcatgttctcactcataggtggaaattgaacaatgagaacacatggacacaggaaggggaacatcacacaccggggcctgttgtggggtgtggggagtggggagcgatagcattaggagatatacttgacattaaatgatgagttaatgggtgcagtacactaacatggcacatgtatacatatgtaactaacctgcatgttgtgcacatgtaccctaaaacttaaagtataataaaaaaagaactaataaataaattcaacaaagtagcagtatacaaaatcaacccaagaaaatcagatatatttttatacattaccaatgagcaatctgaaaaggaaactacaaaaaaaattctatttacaatagaaatagaatttctttattttaaagaataaaatacttaggaattaatttcaccaaggaggtgaaatatctgtacaatgaaaactacaaaacactgctgaaaaaaaattttaggacattaataaataaaaacctatcatatcttcatagataagaaaatttaatgtttttaagatgcccatgctacccaaagcaacctacagattcaatgtaatccctatcaaaatcccaatgatgtttattgcagaaatagaaaaacttatcctaaaatttgtatgaaatctcaaggggccccaaaacaacactgaaaatagaagaacaaagctaaaattctcatagttcctgatttcaaaacttattacaaagctatagtaatcaaaacaatgtgatattggcataaacacagacagatagatgggaggaacagagtagaaaacccagaaataacccttgtatatataatcaaattattttcaacaagagtgtcaagaacattcaataggaaatgaacagtattttcaagaaacagtgctggcacaactggatatccgtgtgctaaagaataagtagaatccttacctagcaccatatacaaaaattaattgaaaatgaatcaaagacctaaacataagacctaaaactataccactcttgggaaaaaataaaacagggcaaaaacctcatgataccagatttggtaatgatttctcagatacgaccaaaaaggcacagagaacacaagaataaaacagacaaattggacttcatgaaaattaaaaaaaaaaacctgtgcatcccaagacaatatcaacagagtaaaaagacaacccacagaatgggagaaaacatttaaaaattacgtatctgataagacattaatatacagaatatatagagaactcctaaaacttaacaataaaaaaatcaaattcaaaaatgggtaaaggactcgtatggacatttctccaaaggtatacaaatggccaagaggcacgtggaaagatcctcaacatcaccaatcataagacaaatataaatcaaaaacataatgagataccacttcacacccattatgacggctattatcaaaagacagaaaagaacaaatgttggcaaagaagtagagaaattggaaactttgtgtatagctaatgggaatgtaaaatggtacagcctctgtggaaaatagtatgaagattcctttaaaagttaaacataaaattaccttttgacccagcaattccacttttgggtaaatactcaaaagaattaaatgcagggtctcaaagaggtgtttttgaacaagtttcacctcacgatgaacgtacacccatgttcatagtagcattattcacaatggctaaaaagtggaagcaacccaaatgtcattcgacagacaaatgaataagtaaaatgtggtagaaacatacaatggaattttattcagccttaaaagggaaggcaattctgcaatatgctacaacatggctgaaccttgagtacattatgctaaatgaagtaagtcggtcacaaaaaaaggcaactaatgtatgatcctgcttatatgaaatactcagagttaccaaaatcacacatctagatagacagtagaacagtggttgccaggggccgaggtagcacacaatggacagttagtgcttaatgggtacagagtttcagtcttacaagatgaaaagagttagggggatggataatggggatgcttacacaactttataaatgtatttaatgccactgaactgcacacttaaaaatggctaagatggcaaattttgtttatgtgtatcttggcacaataaaaataaaactgagggggggaaatgccttgattcaagaaaaagctcaccatatttgagttgaataaagaaggctgaagtttaatgcaccagaagactagctctagatgagatctgagagacaggcaaggaccagatcatgtaaggctttcctggccataggtaagcagtctggattatctgaaaattccggtacttccaggaatttattctctccttcagactagatggtctgacttgacagcgcagagaaagcaagcaccatactctaaagctgcaccatccaacagagtaaccactaaccacacatggctcctaaacatttgaaacgtgggtattctaatttcagttatgctataaatgtaaaatatacaccaaagatcaaggcttagtacaaaaagaatgcaagctattttgttaaaaattcacatactgattacccactaaatatttacatattatgttatgatattaatatattaatgttgaacatataaaatgttaatgtttaatatagtaagtattaaatatggtatttcatattatataatattgttatttattaatatgtgtgatacattatgaaagttaatttcactttttttaatgtggctactcaaaaatttaaaattacatgtggcttgtgtttcttttggacagtactgcactagaaagggtccacaagaatgttttgtgaacactttgttcactgatgtatccacaatgcttggaactatgcctggcgtacagatagcacttgataaataatgaatgaatgggtacagacttgtcgatacaaaaagaaaggagacaccttcatctgatgttcccaatctttctaagttagtggtgtgcagccaaatgtgggggagtgggaggtaggagtgtgtttagggccaccataatggaccactacagacggtgggcaaggtggtggtgctgtcatgtgcacctagcttttctcgtctgtcctcatcctccactctttgtataaagactaaaaagcttggggtgttaataaaggcagcatcagcccataaaattgtgtcttatttagttacttcagtacagacctttttagttacctagacttcaatttttatctcttaacattctatttccaaccaataagtcactaattttctattaactctgatttgttatctctgctcctgtaccctatatatcactgctctactaaagaatgttcagaattaaataaactgactgtacttcagggtcttaggatctgtctgattttaatgctataaagccactggacaaatccacagcaagtctaaaggaggattttccagggatattatactaattcatgaactgtctggctttgctcaatgacttgaaagggtcattccaactctatgattctatgttatcaaagtatcttcatgtagaggcaatcttcactaaataaaattctcactcatttgggcatcaatctatgtgttcatttagtaaatatattcttgactggctctaccacagcgctgatactcttcaaggtgctggatatacacggacagggaaactgataatcccagtcctaatgagcagacaagaatatctgagggcataacctgaatttggctctgaactgttaaaggtggagagtgcagatctgaagtttatacagcctctctttcattatgcttccctttggtaacaaatccctcccactacttcagagagtcaatgtcttcccattcgcttcatatcctccttaatcaaaaaatgatgcaatatccagtcattcatacaagtacatgaatagagcttaatttaaatttattttaacaacccaatttagtattaaggcttataagcagtatctgtactttaagacttttaaattcaattatgaaatgaaaggttcctatccctcaataaaatcactttaaacaacaataaacaggtggagaaatattttctagaacgtaaaggcatactgttgtcttaaatttttatatttatttacagtttataaaaagtattttatgtgatttctctacttaagtaagtaagcagaaacacttattattattccttttaacagacgaggaaacgaattcagagaaattaaatggactaccgaatgtcatacaactactaagtagcaaacctcacatttcttcaacaatcaatattacttccatcccaccactgccagatgtcacaaacataaatatatgaattagtctaatataagaaaaactggggccaggcacggtggctcacgcctgtaatcccagcactttggaaggccgaggcaggtggatcacaaggtcaggagatcgagaccatcctggctaacacagtgaaaccccgtctctaccaaaagtacaaaaaaattagccaggtgtggtggcaggcaccagtagtcccggctgctcgggaggctgaggcaggagaatggcatgaacccgggaggtggagcttgtagtgagcatagatcacaccactgcactccagcctgggtgacagagcgagactccgtctcaaaaaaaaaaaaaaaaaaagaaaaactgggggttttgagacttgttctaagtgtgatattcaaaatatctgacagtcattaaagcaaatgtctaattagaacagttgccaaccacaataccaaccaatcaaaacagctaccagtggtaaacaacagtaagaacagataccagccataaataggcagtaaaaaaaaatcatccctgaatatcagacagagtacctgccccagctcagcattcaaatttaaattattttcaatggtatgccagccaaacaaaacaaatatacctgttaatgaattgtagaagtaagcacactcacctggccaataatttttttgattcctttcaccctgagtacattaatgggtggctttatgagcattttattgaaaacagatgcttaattctgctaaaacaaatatataaatcaaagatttaaacattttaaaaatacttagaagaaaaccaaagtaagtttcaaatcactaagcaggaaagatagtttctaatcaaaaaaagcaaagaaagaattatgagaacttattagttttgtctacacaaaaacttaaaatacataagcttagaatacatacaaggttctacataaccttagaaaactcagaaaaatagccagttatggtggcacaggcctatagtctcagctacccagcagactgaggtgggaggatcacatgagcccaggagttcgttcaagtccaggctgggcaacatagtgaggcctcgtctctaaaaaaaactaaataaatttttaaaaagaaaaaaatagtcatagcaagatattaatatatataattatttatttagaacatagagctcatataaaaccttcagaaaaacaataaaatctcaataaataaacaggcctaagaaatgaatataaaattcacaaaactaaaaaaaagagctaattaacatacatggaaactactaaactgctctaattatcaaagaaaggcaaattaaaacaataaagtaccaaatataaaattaccccaggggttacaatattgctgtgaataacagcacatatataaccagaatgtaaaccagagtgtaaaagtgacataagaattcagaagtattttccaagaagcactaggaaacattgatccactgaaaaattatttattgagcacctactctagatttaatttttttttaaatctctaacctaacctcatggggctccaatctagcaggaaatacagacttagagactcataaatgatcataaaaagctctttcaaagtgaaacataaccaaaaaggagtgcaattaattaggaacagatagaggaagtggcattaaaatcaagctttaaataaaaaaagtagctcactatccagagaaaggaaagactactaatagagtaactcaaataatgaactaaagaatagaaatataacaattataaaatggcactcagaaaccaagtaaggcccagttttcttccttccactacaataagaaaaatgacaaaaagcgatagtccaaatttcagccttgtaccaaaacggagacaaatcttagcaaatttggaagataaatgtttacttggtctcttttaaatatcaatggtgccaaatgaactttggacaagagaaatatctgtatcaaggtttaaggtactctacaagtattgtgtgtcactaatggaaaaggaggagagtggaaggaaataagaacgtatacttagtggacaccatacagcaggttctgatctagatgtttatatcatgctcatttcatgtcatttggacatatgttaacctttttgttattaaaaaataaagaagttgacagtcattttcctagatagatggagttttgttttcaaataatctctagctgttttaacaaatttcattcacatataagcacagccaattaccaaaagtagctagatttttatttggcaacaaagagaactacttctttccattgtgacataaaatttaaagcagtacctttctcatatctgtaagacttttcatgaggctggataggtccatacccaactatttcaaaatggtcagatttatactgaaaacaccaagagggagaaaacacatgagagaggatctgcttcatatagaagaaggtaatgtaagaattcagctccaagatggaaaagcgttagatccattctcaaatcacagctagcacttccttcagtggtatctgttaagaatcccttaaaacaaacaaaaaaaaaattgtggacaccattgattggaatacaaaatattttatcaacagaatacttcatttgtggatttaattaggttatcctcaatacattacagatttcatttcatttaggtcactatacaaatggtgcgatgtcatttttaaatcctctgaatcacattttatagtctgttttgctgtatttttttaaagaagggtggtagagagataataaaccatgaatgaaatactcagcaatcagggataaaagtaagacatttatagctgagctaatacgttaaaagatggaagtctacatctggtttcaattggtatgaattcactggcaaatttaagaagaatttcattgtacgaaaacaaaaagatggttttgataggctttagtcctctggttacttttgtttctttagtcacatgattagtataataatatgatacatttaatatgtcactgtgtatatggttttgataaaaatacacccaccaacttgtctcaagggcacatgcacaaatggttttaaaatacatatactgccttaatgtttttagatcagtaaaaatgaattcaagtgaggttttaagttcacacaaaattaagaattttaattttctaataagtctttcgcaatgttagctaaacaccttttggacataattacttatgcatataaaatgacgcattaattctacatttaatacctattagatagtaaggatacaaaaaattagacatacgccccccttttcaaatgccataaatagataagtacaggtacttcatttaagttttactttcataggcacttgcataaggtcttaaaaattgatcgaaactcaccaatgtaatccttacacagtcttttaaggcctggatcaaactttgcctctttcaagaaatcaccctatattcctcgagtcaggattaatctatccagtgttaacaatggtgataacaataacagcttgcatttattgagttcttactagtcagccactccacaggtttcatttcatttaacacccaaacagaactgtagaaggtaggcactaacaaggatttactgaaagtctgttacatgatcactgtcttcatgacactcagaattttgtgggaagggaataggaacaattaattacaatactaagcgatgcctgcaacaacaggattagcaataggagcactccaggacagcagttcttaaagctgattatgcataagaaccagtactcttaaaatccaaaccatctaatacaacatttaaggccttgaatgatacaattcctgccagcctcgaccatctaccttaccattctaccactcaggaagggcttcacagagatgacttttgagctgactctaaaagagtgaacaaagtttatcaggtgaccaaagagggaaagatacataaggcatgtgcaaaggcactgagcataaaaatacataaagtgcattaccaatgaatagttctttgtgtttgaacatagtgtgtatggtaaaatagtgcaaaatgggaagtcagattagggccaaactgttttacacacccacatatttttaagtggaaagatgacatgatcatatctgaacttttaggaagaaaactctgacagcaggctctcagacaaagactaaaaggaggaaaacagaagtggagaatttaataataaaataattcgtaaaaataacagtagtagtagtaggagtaatagtaacaggtctataaccttgcttagaatcctaagagagacttgtgtggtagaattaatagtgaacaccttaagcaaaattattcagaagacgaagaagagtcagaccatgcagagaagccaaaaggtgccaaaagcaaaatccatctttcctaatttacgtaggtcttaaagactatctagagtcttttcccacaactgaaagtgccttagcactaaagaatcatatattgcttagttagcatcctctcagttctcccaaaaaattgttataaaaaatgaacatgtcctttgactcagtaattccatttcattaatacatccaatgaccacaacacaaatatgccaatacctatgtacaaaagttccctgcagctttgagtgtagcaataaaacattaaaaagttagaagtcactttcatccaggagactgaaaaaaatacattctgttacacacacataagacctatatgtactggtatgggaaggtatctaaaatatatcagaagttgaaaatgaaaaacggtaaggtataaaacatcacatatggtattaatcccttgtgtaaaacaagatatacatacatatgtggtgaaagaatccacaagaaattaactgacacaacctcaaggaagtaaaattgaagggtagatgtgaagacattaacttcctcttttgtacccttttgtattatttgaaatttttacaatgtgctcgtgttatgtttttctctataatttatataattaaaaggaatgaagcagttaaaagtacactctagttaaaagtacagataattatgcaacgcaattttagaagatctccatataatactgttaaaattagaaatttgccatccaaggaactaactttccatttcctggaatattaacttatatatatttcttgatttcctaagattaaacaaaagtaagataagacacaatgatcttttcatatgttttttctaatgctgaagaatatccactatttcaacaaacatcatacaattcttaaatcacttgtgatttaaaactaaataccactttttaaagtttttaccttaacagtaaaaagtggcaatttacatttgtatagaactttacaggttacagagtcctctgacacttaccatgtttttttcccacaagaaaacactgatgtaggtaaagcaagtaatatgatattagatcaatttcaggattaggaaactgaagctgagaggagttacacaatgtacccagggtcacagagctaataagtaacaacccaagcactgaagcttggtcttcctgctccacatccaaagggctttccactaaaccacatcactccaaataaccactgttacagcgtgctatggggtcaggcttctgacagggaagaagggctcactacagatctggcaatgacaggcagtctgcctgcagaggaatgtacaatacaaaaataaagtgtatgaaggtgggcctgactgacgaaagggaagtagaactgggagaaatgccaagaagaataacaaaggtgaaaactgggcaacttaccaataagggaagccaaggaaatacctttgtaaacttaatttacttagttaaggtagaagggatagtctatgtaggggactatatattataatgtggaaaaatcataaagtgtttataattcaatcaaaagatttagaaaagatgtaatgaagcgtgatgtgtatgctgtatttaatcagagattacaatgtggcagcacatgactgccatgaaaattttaatggtctaatcccacaatgcatatcctgttaatgttgtggcttagaactttaagaggcaagtgtgaagtacactcagaactcatactcactccatgggacacccgaaataaggagcaaaaagtatcactttctacacaaaagaactcattctcctaagattctagtacagcactgatcattagtacccactcagagtcagaaaatccttgtaagaacgggccagggacaccagaaataacaccaggatcaagccatcctggactaaagagaaccatgggtctttccactgagtactttccaggaaaatcctttagcaaacatttactgctgacctagcaggaacaggctccttgagaaacatcaaccttactgtcccttactgtgacagaaggaaaaaagagatgggacccaaaagctttgactcaatgtcaccagatgtatcttccacagtttaagattcattttgtgagctattttagagtttttaaattattgtcctttattcctggtgtgttttgaagtttagtaaatatatagaaacatctattattttttgccagtctagcactcatttgctcttctcctgctaaacatattctgatttccctctaggaaatcactacttctccattctcagaccatgtatttctggtagtcaagtctaccctagctccagattgaacatatgacctaggtctaagtcaattactaaatcacattgtaatggccacaatgatttgctcagagaagggcacatgacccacgcagaggcacaagattatcactcttttctgctggatttcaactagaaagatataacccagggaactgctggcagacatcttgtaactgagggaagagcttgtgtgagtgaggccaagaaagaggtatcagaacaaaaacatgaattcaagtaattcctctcaccctgaatcaagccatgcacaaactaactttgcaatgagcaagggttatgtgaacaaataaattccctctttggcttgagctggcttaggctgggttttctgtaacttataaccaaaagttgaaactgattcagtaaacttgaagtaaataccaaacaggagaagttcttggaaaagaggtttgtgtaaagcacaaaccactgactaactccagaaatgctagaggttattccagatgtataacagctttagatgtctgatctattttctactttctggcccatcaaaaaaagggatacaataattggcggaaagaaaagtagaataaacatattttttaaaaggaacatgcacagtcatttttttaaagtctcctgctgccttcattttcctactagcacctcccctagctagtttgtcattgtattcatttgcatttgatttctcattttacggaactctcagatgtttcagtttccattcatttttatggcataatcaactcacacaatagttaccaaaaccctttacagaaaaatcaatggtttcgagaaacttggtgaatatgtagcaatttctgaaatacttaaatctcaaaagtaatacttaagcttacatgtaagattttatctgatcattcatcaagcttcatattccaacttcttaacaaccaaaatttctccctgccccctcctcctctcctaggataaagaatacacacattaaattggggctcccaggtatcctggatgaggaaaatactctgggaaaaacagcacagctgttcagttaactcccttctaccctcacaaatctatttcattccacccccctaaagaagagacttgaaaatataaaatatccaaggttataaacaataaaaaaagttatggaatttgtccagaaaaacacaaatcttctgttcaacacaaagtacatacattaggaaaaataactagaatattttaaccattattcgagagggcagagagaggttgtctttcatgaaatctggattgcacatgtctggcaaggaaaaaaaagattaataatctatcacaaagccccacaactagtgattcaaaatgaaagctttcactacttacaccatatgtaaatatatatatatacaagctgcttataatcccttgatctgcagagaaagagaactgatactctactgtgaaaatggtcagtgggtacacattttaaaatcctttcccacatgaaaagattcctgaaaaagagatcagaagacaacagaaaagcactcaatatatatggagttgtaaatccagtatgaaccagtatctattacacaaaggaggaacatgcaacaaagtgattaggaaagtcaaacatgaattaatctaataacacaaaggtaaatataaaccccaaagagcactttattgaacagaaatccacacatatcaaaaagatgtctactattaacaatgacatatcaagcttttaaactccaaattaatcttaataatcaataatgcaaacttgatatgcccttaccaagaaaaaaaagtttgaagaagcacttaacatcaaggcagaacatatacatatttttaaaatataacaaaccaaatgtttaccataaaggctattacatgcaaggtattgattctaagggcacttggataaaatatgctagtatattttgaatagccactgcttgactcttttatttatttggttatttggttatttatgtatttatatgtttattgaggtggagtctcactctgtcacccatgctggagtgcagtggcgagatctaggctcactgcaacctctgcctcctgggttcaagtgattctcatgcctcagtctcccggcagctaggattacaggcgcatgccaacacaccaggccaatttttgtatttttagtagagacggggtttctctatgtcagccaggttggtctcaaactcctgagcccaagtgatctccccgcctcagcctcccaaagtgctgggattacaggtgtgagccacctcgcccagccaccaccgtttgattctattaaagaaactaacactgtacctaaaaatgtgaggtctatgttatggaatgtatactttcttcattaacaacaataattcaaagtaccaaagtaccaatggtgaatactaagattctatccttggttctatagttctctgcattcttctacccaaatacatctggtagatgatcatgtccaaaatgcaaagacacttttatctacctaagtgagatgataggataaggatgacaatgtcaaaagcaaatatatatagggccacttatgtgccaggtgttattctttaaatacatgtaatctttataacaactcatatcttgtcccatatatcagatgaagaaattaagtcacagagaagtttaaaaacttgcccaagttcagagaggtagtatgtagcagagccaggattcaaatcctggcagtctggctccacatttcatgttctcagctcaattctagtcttcagctataattccaatcctttctttccatatcactacttaacctccatatgtttccatttctcatctggaaaatgggtcattaatagttcttacctcatagagttctccaatcctcatgaggattaaatgccataatatacataatgtatttagaaaagtacctggcacataaaagtaatacatatttctgttgttattttatctaccaaatgtctgtcactggagttgagaaccattgttctaaaactgtaacagtgagaatttaccaagcagaatagtcttaatgtgcccttacactggtaactaaagaaaactggactttctcaattattttcaatataaaacaagtccaccaccagccttcaagaaaatatacaaatcatttaagagttgctatcttcagtctggaatttcttctccattattttgtgttccctcacacccacccaatattacagaaatagatctcatcctgataaaggtatatagtgaaaatgtctcttatatatcaaactgaatgtttatacaacttttaagacataaaggccaggtgtggtggctcatatctgtaatcccagcactttgcgaggccgaggtgggtggatcacctgaggtcaggagttcaagaccagcctggccacatggtgaaaccccatctctactaaaaatagaaaattagccaggcatagtggtgcatgcctgtaatcccagctacccgggaggctgaggcacgagaactgcttgaacatgggaagcagaggttgcagtgggccaagatagtgccactgcactccagcctgaacaacagggcaagactccgtctcaaaaaaaaaaaaaaaaaaaaaaacacctgtgtggtattttaatgtaattctcatctatacagctggatgctgggtactcttgaatcagaatactactcccagagtttggcttcacgaaagagctacaaagtgtgaagactgagggaactacaaccatcctttaacccagggactaacgctgatcgacatttaaatatgcttctattaatagttttctgttgtgacaacactcttgcacaggccccactatacaattgtgccaagatttctcaaaagtacagaaggaggaggaaaaccactggatagagcctagagtacatacatattcaacgacaggagattatcaaattactctttgaagtagttgtactaatttaaattcctaagagtatgatagcatatagagtatatataaggcacaagtgagtacaataaatttggaagcatttctatggagaaggtcataaccaagagcagacaaagaagtgatctaccaagtaaaccccagaaggactccaagcttagaaccatagggtagggagagcaagagggaaagggagttcactttttcacggaagctgtaaagaagaaaatggaacaagagttggctccttgaccccagtctgcccctgctcccatgtacatgcagattacatgaattctggcatttatccccagatcaaaaaaaaggggaaagggttcctctctaaagaaattcagggggccgggcgcagtggctcacgcctgcaatcctagcactttgggaggccgaggtgggaggatcacgaggtcaggagatcaagaccatcctggctaacatgatgaaactccgtctctactaaaaacaataccaaaaaattagccaggcgtggtggcagtagcctgtagtcccagctactcgggaggctgaggcaggagaatggtgtgaacccgggaggcagagcttgcagtaagccgagatggcgccactgcactccagcctgggcgacagagtgagactccgtctcaaaaaaaaaaaaaaaaaaaattcaataaaaacctgttgtaggccctttcccttaaaagctagctcccaacccattcaccctaatattatgcctgtcagtcaaaaggcattgtcccagtgcttacggtgagacctgagcagccttccagtcccaagggcaagaccagaataaataaaacaaggaaatccataaccctagaagaaacagaaatgattcaggaaacagacaatagcatttatttaaaaaacgtattattcttaaagcaatttcaaaagcttttctatccatgtcagcatcaatatgttatgaaaaaggaataatcaaaagagttcttgtaattaaaatataactgctaaaataaaaagttcagttagaaaagtcagaaaataaagcaaaataaagcaccccgcctcctccaaaaggcaaaaagacaaaaagagacggataatctaagaggaaaaacaaattcaggagattcaacctttcaataaagaaaatagaaattttccaaagctgaagacagacaattgtttatatattaaaaggaactactgaatgctgagcataactaataaaatggactcacatctaggcacattcttgtgaaatatcagaaacgtcaagataaaaagaaaactccagaaatttccagagggggaaaaaacctacaaataagtaagactctgacagccattagcaacactagatgttagaagataaatggaggaaagtctcaaagctctgagagaaaattattttcactgtaaaattctacgtaggctatcaaccaagcataaaagcaaaataaagacattttcagatatgcaaaggctcaaataataattgaccccttattcttgtatcatgaagaagacagtttaggaagaatacaaaacaaaggtaaaaaccaagaaaacaggaaatatcctttttttaatggtggcactaacccaagagtcaagtgaaaagaaattctaaggatacggctataaaacagacctcaaagcaataagtccacattagaacaagaaatcaggaagctccaaagaaatctcaaagaagaatcacatacatttcaggaaataaatacactgagtaagaagctcaaagatattaccaaagggataaaagatgcatacattgcttttttcaaaataacaaaaaaagaaaaaactcccagaaacagaaaattatataacaacatgatcctaacatagagccatcaacctaaaatgtggcaatgattttgagtaattaattgtgagaaaagtaaatccatttagaccacatgctgggaacattcttctttgggtaacctaggggtacaacactggatatttagagacagaaataaaatttgagcatatcattgtttcctcttccaagatgttctttgccctctcttctctgacttactcatttattcattcactctctcaatatttactgagcacccatcctaggagctaaagataaaacagtgaacgaaaaaagaaaaacacctgcccttttgaagcttatattcaataactcctattctttcaagaatctgctaaagcaggagtccccaacccctgggtactggtccatggcccgttgggaactgggccacatagcagcaggtgagtggcgggtgggcaagcattactgcctgagctccacctcctcctgtcagatcagcagcagcattagattctcataggagaataaaccctattgtgaactgcacatgcaaggaatctaggttatgcactccttatgagaatctaatacctgatgatctgaagtggaacagtttcatcctgaaactatcacccccatccgtagaaaaattgtcttccatgaaaccagtccctggtgccaaaaaggtcgaggaccactgtgctaacggattctctcaccaatgaaactttttctaaattgttaggctatgtgcatctccttttttcctcctaaagaactctaactctttgcaaaacagaatttggctttttacatacctattacctcatctagtgtgtgaagaatgcaagacagcaacatttattagttatttgtacttctagtgaacagcactgggcctaaatcaataaatgtgttttgaacctttccattcaaccaaaatgtaaataaaactgctgtattcatccactctcacactgctataaagaactacctgagactgggtaatttagaagaaaagagatttgattgactcacagttccacaggctgtacaggaggcatggctggggaggccatggagactcacaatcatgacggaagggcaaaggggaagcaaacaccgaattctcatggcacagcgggagagaggatgaagggggaagtgctacacactctcatgagaactcactatcacaagaacagccgggggaaatctgcacccatgatccaatcacctccaatccacctccatgatccaatcacctcccaccaggtccctccccgaacactggggattacaattcaacatgagatttgggtgggaacgtagagctaaaccatatcaactgacaagtaaaatgtaaagcactaggcaaatgttacttattacttaacagatgaggacactgaagtccttgtcagttgaatgatttgctacagaccacaagactagtctgtagaagaaccaaaactaaaacccatattgctgaaagcctgggttcatgccgtttctcctatactaggttgaatgaaaacaagtagtcaaatcaaaaaatgggcctaaatgggaaagaataaccttaggcattttcttagaatgtttttaagtatacaataaacatccaaaatatagactctatttcttccatatgtcaagacatagctttacaattatgtaaagatcatttggaaagcctctaatcaaaaatctaacctatcttttaagagcttcaatttcacagagttatgcatttctactctgcagtatatgtttgaaatgcataaatgtttcgagatgtttaacggcatttaatataatataaattggtttttaaaaaatttcttcatgggaaaccttcaaaacttactaccacaaatatactaaagtttttattcttttaaaacttgaaaacacttgactcctcaaaaaaaaaaagctcatattaccttacacaaacaacaacaaaaagctttttcatgagtcacagaaggcctatggttaaaattatcaagatacacatttttaaaattaagcaaaaaattaaacagacacatatataacttttgtaaaaatcagggaactaatgaaacattctggtatttcacacatgccaaggttactagtaagcatactttttatggcttgtctttggtatatgaccatatttgttcagcaatccacattattaataccgaatagtagccatgcaaattataacttatccacaaaaatataacactgaataaagaggtagggtaattttatattcacaggacaagaagccaaaaaattggctgtttcagctcaacatttatcaaaggcttgtaggtgccaaaagctattctaggcacttggaatatttcaagattaatatattaaaactcctgggcaactgcaactactcttctcccaaacactaaaagctgactaattaaatgtaactcccatatataggataccatgactgggttatctacaaagaagtttcatcaaacttaaaagatagtttaaaatactgtgaaaaaatcagttactgaatgtgaatgatacgaggacttgagctgtgtttgtgagtctgatcacaaaaatcagaaatttaagtcacatatactattttatagagccccaaatacttaaaaaccaaaaggactcaatgaatactaatcttacagtgatttttactcataatgtaaccagaagagtcagagaaacttttatcacccattagaatacaggagttttacctttttcctaattctagtaccactaccattaattaccacaattcgttaccagctcaagtgccaactctgtgatctggcccatgttgagtaagaatcagcacttaaatagacaaaatctctaccctttacaactcagactcagttacaatcactggaatatgtctaattaacccacaacttaattctatgccttcatcttttcctacatgtttcccaaaggaaaagtatagatcagattttgaaggtccttctttaatatctatgctgacaatcagataatttgttttatgacttttaaaatatgtgaagtactcatataactattagcaaactgtcaagcaataaaacataaaaaaaaggccaacagaaacaacaaacagcaaagaacaggcacaaaaagaacatgaaacagccaatacaaatatgaaaagatagcctacctaatagtcaaaataaacatcatcatcacagtaaaaatagcatttattgtgctttctttatgtaagagtgaatatgcaataaacacccaattaattaatcaatgaattactaaatagacaacaaactacctgagaaaataagcaaattttcaaataagaggtaacattttcagctgggccttcatggatgcaaatacactaggcaaagactgggggtagggataacactaaaagaagtgcagaggatgaggcaagggcatacatataatcaccaaaatatgaagccagttcttattctaggagccagttctcattgtaacactgaactggaaagtacctgataaaacagtgacaaggtatgaaactgtacaggaagaaaggaggtaatacataaactctgtttatacatcaggctaaaaaatttgaacttaaatgttttatttaaaagacatgtaacttaattggacttgctctttcctgtgccttttattttcaattttcaaggaaatatttgttcaaaaatagacaatagtcaataattcagaatcaagaacgctttacccctaataagatttctttcaaagacaagcacaattccacacacaaaataaatatgttacttaggtggttctccaagacttactactcttaaaacaaattaaaaatttagaatctattgtcaactccctaaatcatcacataattttgtttcttctctataataaatgaagctcactatatataaatatgtacaaatagaatatgcaaattatacatagacaatatccagaaagtttctaataatgtaatctaaactgtccattactctgagaaagcttactattaatgtggttaatatatgtagtatatacataatcaaatgaattataaagttaaggtctcacatcagaacaggattatgctgtcacaacaacatccatctgggtccacttgagcaccaatccaaccttgttctcaacctatattttatagtttttattaacaatttaaagataagcacaaaacaatttcagtaatcatgtttttatatctttttttagatttataaaggttaaagctgtcaataaagttttacatccacagatcatacatgaattcatttaagtgaatataataataagaaaagtcaattcaagggctctacctgacatacccaaatgaacaagagtaaaaagagatgcaagcaaatgagtaaaccagtatctgagatactcactccaaggaaaaggccccaaacataaagcatgagtttcaaggacaagataaaactcctaaaaagagattaagagaaataaatggggtactaggcaagaataatacaaaatgtcacacaggattattaactggattacaaaaaaggtacatgaatagaaaataaataagcaaatgactaattagtaaaatcaaggaacagggtcagaggagtaacaacggtaaaaactgctatggtgaataacaaaaatatatgagatacagcattcttagatactagcattagccgactagaaaatataacagcaacaaaagatcattcacattagcagtaaaaatgacaaagctcctagaagcaaatcaaatttaaaacgtatataattttctttttcttttttttttagatggagtttcactctttcgcctaggctagactgcagtggcgcaatctcagctcattgcaacctctgccccgcaggttcaagagattctcctgcctcagcctccagagtagctgggattataggcacctgccagcacacccagctaatttttttgtatttttagtagagacagagttttgccgtgttggccaggctggtctcaaactcctgacctcaggtgatccacctgccttggcctccagaagtgccaggattacaggcgtgagccaccgcacccggccgaatgattttcaagaggatttaaaaatgcatttaaatacaaaaaagaagaactgaacacaaagatattctatgatcatgcattggaaaatattagttaacacaaattatgagttaaatgtaattccaatcacaaacccagcaagactttttgtggagcttgacaacttattctaaaacttatgtgaggccagacacggtggctcatgcctctaatctcaacactttagatgaccgggtggatcaccccacgtcaggagttccagaccagcctggccaacgtggcgaaaccctatctctactaaaaatataaaaattagctgggtgtgatagtgggtgcttataatcccagctactagggaggatgaggcacaagaatcacttgaatctgggaggcggaagttgcagtgagccaagatcacgccattgcactccagcctggggaacaagaacgaaactccgactcaaaataaaataaaaaataaaataaataaataaataaaacttataagagagatcaaggaaaacaaagacaagggaattgcatcccaaacatcaagcacgccaccatataattaagaacatatttctggatccgggagccaagatggctgaataggaacagctctggtctacagctcccagcgtgagcgacgcagaagacgggtgatttctgcatttccatctgaggtaccaggttcatctcactagagagtgccagacagtgggcgcaggacagtgggtgcagcgcaccgtgtgcgagcctaagcagggcgaggcattgcctcactcgggaagcgcaaggggttcagggagttccctttcctagtcaaagaaaggggtgacagagggcacctggaaaatcgggtcactcccacccgaatactgcgcttttccgacgcgcttaaaaaacggttcaccaggagattatatcccacacctggctcggagggtcctacgcccaaggagtctcactgattgctagcacagcagtctgagatcaaactgcaaggcagcggcgaggctgggggaggggcgcccgccattgcccaagcttgcttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctgaccctggagcagcctaactgggaggcacccccaagtaggggcagactgacacctcacacggccgggtactcctctgagacaaaacttccagaggaacgatcagacagcagcattcgcggttcatgaaaatccgctgttctgcagccaccgctgctggtacccaggcaaacagagtctgtagtggacctctagcaaactccaacacacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacaatcaaactactccaagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagacgaaataaatgaaatgaagcgagaagggaagtttagagaaaaagaacaaaaagaaatgaacaaagcctccaagaaatatgggactatgtgaaaagaccagatcttcgtctcactggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttaaaatgaaggaaaaaatgttaagggcagccagagagaaaggtcgggttacccacaaagggaagcccatcagactaacagctgatctctcagcagaaactctacaagccagaagacagtgggggccaatattcaagattattaaagaaaagaatttttaaaccagaatttcatatccagccaaactaagcttcataagtgaaggagaaataaaatacttaacagacaagcaaaggctgagagattttgtcaccaccaggcgtgccctaaaagagctcctgaaggaagcaataaacatggaaaggaacaaccggtaccagccactgcaaaatcatgccaaattgtaaagaccatcgaggctaggaagaaacggtatcaactaatgagcaaaataaccagctaacatcataatgacaggatcaaattcacatataacaatattaactttaaatgtaaatggactaaatgctccaattaaaagatacagactggcaaattggataaagagtcaagacccatcagtgtgctgtattcaggaaacccatctcacaagcagagacacacaaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtagagggatcaattcaacaagaagagctaactatcctaaacatatatgcacccaatacaggagcacccagattcataaagcaagtcctgactgacctacatagagacttagactcccacacaataataatgggagactttaacaccccactgtcaacattagacagatcaaccagacagaaagttaacaaggatatccaggaattgaactcagctgtgtaccaagtggacctaatagacatctacagaactctccaccccaaatcaacagaatatacatttttttcagcaccacaccacacctgttccaaaattgaccacatagttggaagtaaagctctcctcagcaaatgtaaaagatcagaaattataacaaactgtctctcagaccacagtacaatcaaactagaactcaggattaagacactcactcaaaaccactcaactacatggaaactgaacaacctgctcctgaatgactactgggtacataatgaaacgaaggcagaaataaagatggtctttaaaaccaatgagaacaaagacacaacataccagaatcgctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcgaaccagaactgaaggaaatagagacacaaaagactaatgaatccaggagctggttttttgaaaggatcatcaaaattgatagactgctagcaagactaatgaagaaaagagagaagaatcaaatagaagcaataaaaaatgataaaggggatatcacgaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaacaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaattctcccaaactcattttatgaggccagcatcatcctgataccaaagccgggcagaaacacaaccaaaaaagagaattttagaccaatatccttgatgaacgttgatgcaaaaatgctcaataaaatactggcaaaacgaatccagcagcacatcaaaaagcttatccaccatgaccaagtgggattcatccctgggatgcaaggctggttcaacatacgcaaatcaataaacgtaatccatcacgtaaacagaaccaacgacaaaaaccatatgattatctcaatagatgcagaaaaggcctttgacaaaattcaacaacgcttcatgctaaaaactctcaataaattatgtatcgatgggacatatctcaaaataataagagctatctatgacaaacccacagccaatatcatactgaatgggcaaaaactggaagcattccctttgaaaactggcacaagacagggatgccctctcaccactcctattcaacacagtgttggaagttctggccagggcaattaggcaggagaaggaaatcaagggtattcaattaggaaaagaggaaggcaaattgtccctgtttgcagatgacatgattggatatctagaaaaccccattgtcttagcccaaaatctccttaagctgataagcaacttcagcaaagtctcaggatacaaaatcaatgtacaaaaatcacaagcattcttatacaccaataacagacaaacagagagccaaatcatgagtgaattcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtattttatagattcaatgccatccccatcaagctaccaatgactttcttcacagaattggacaaaagtactttaaagttcatatggaaaaaaaaaaaaaagagcccgcatcgccaagtcaatcctaagccaaaagaacaaagctggaggcatcatactacctgacttcaaactatactacaaggctacagtaaccaaaacagcatggtactggtaccaaaacagagatatagatcaatggaacagaacagagccctcagaaataatgcttcatatctacaactatctgatctttgacaaacctgagaaaaacaagcaatggggaaaggattccctatttaataaatggtgctgggaaaactggctagcgacatgtagaaagctgaaactggatcccttccttacactttatacaaaaattaattcaagatggattaaagacttaaacgttagacctaaaaccataacaaccctagaagaaaacctaggcattaccattcaggacataggcatgggcaaggacttcatgtctaaaacaccaaaagcaatggcaacaaaagccaaaattgacaaatgggatctaattaaactaaagaacttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaagtgggcgaaggacatgaacagacacttctcaaaagaagacatttatgcagccaaaaaacacatgagaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgggaatgtaaactagttcaaccattgtggaaggcagtgtggcgattcctcagggatctagaactagaaataccatttgacccagccatctcattactgggtatatacccaaaggactataaatcatgctgctataaagacacatgcacacgtatctttattgcagcactattcacagtagcaaagacttggaaccaacccaaatgtccaacaatgatagactggattaagaaaatgtggcacatatataccatggaatactatgcagccacaaaaaataatgagttcatgtcctttgtagggacatggatgaaattggaaatcatcattctcagtaaagtatcacaagaaccaaaaaaccaaacgctgcatattctcactcataggtgggaactgaacaatgagaacacatggacacaggaaggggaacatcgcactctggggactgttgtggggtggggggtggggggagggatagcattaggagatatacctaatgctaaatgacgagttaatgggtacagcacaccagcatggcacatgtatacatatgtaactaacctgcacattgtgcacatgtaccctaaaacttaaagtataataataattaaaaaaaacatatttctgttgcagaagcaggcaaataaatctctgctagaacagacagaccaaatatagagacaaatatatacataactttagtaggacaggcttataagccagttaaaaagggatagaaaattgtgttaggacaattagatttccacacagaaaaaaaaaaaagtgctgtatacccctatctcctatcatatacagaaataaactccagctagattaaagatgtaggtaaaaagccagcctattgcaagataagagtgacaccatttcaaagcaaaaccaccataatgacaggagtttggctccagcagcaaggtctttaaacaatgcctgtagcatagacaacccctcataaagatgtttatctaacctctccagtggtcatgagtagcaacaaagtctgaggtgtaaccagctgcatatgttttaccaaaaaagcttgctatataaaggatattttcgggagggtggatgtgggaatacaccacctcttggccacccaaaacattatttctgtttgttagtctgtaataaatgtttttttataagaaactggatttgtcagtgtctttcttcagctctcagctcccttagcctttgggggtagctttgcatatgtttgctcatagcagaacagaactgctaataacaaaacttgtactatttgaaagagttccacttctggtagtgataaactagataattcagaccactctcctgcttaaagaactaaaatgtctggagaaaatacatttaaaagtctatgttaaggctaatgaagacacacgagcagtgtattttgtctgaaaacaaaatattaaaaaaagaaaaaagaagaggtaagcctagcaataagggctgcttttccccaagaggcatctatcaattatggaacagaggccaagaggctaataagcagagcagaccttttgactgacttacaagatgagaaggtcaaagactggaaatcaaaacctaccgagaaactgagaagccctataatgccaaaggaccatatcctagatgtaaaggaggatcaaccctcaaaagtacagtcatgtgtcacctgacaacatggatacattctgaaagacatcattaggcaacttcatcattgtgtgaacatcacagagtgtgtttacacaaacctagatggtatagcctattgctcctaggctacaaacctgtgtagcatgttaccgtacagaatgctgtaggcagcagcaacacaatggtaagtattcgtgtatctaaacacatctaaacatagaaaaagtacagtaaaaatacgatactataatcttatgggaccacaattctacatgcagtccatcattgatagaaacatcattatgtagcacataactgtactgaagcccagattcaaattatctctaaccccaattgaattaagtgatccaggattgctagttctagccaccagatagaaacaaaaaccttaagtaaaatacgtcaacattcagaagttcaaataacctctatcacgttttacgcaatgtctagcactctatcaaagatcacaaggcacagacaaaaacaataaaaaacaagagaaacaatataaaatagaaagagacccacaggagattaacatttaaaagattagcagacagaattagactataattaatatgttctaggatatgagcctaggcagcgaagtgagaccctatctcttcaaaaaatcaaaaaaattagccaggcatggtaccacacgactgtggttccagctactcaggaggctgaagtgggaagatcacttgagcccaggaggccggggctatagtgagccatgatcacaccactgcactacagcctgagtgacagagcaagaccctgtctcaaaaataaaaataaaaaataaaaataaattatgttcttggatataaaatacaagatttctggataatatctttaaaaggctaaaaggaatcactaacctagaattctttacccagcaaatatactgttcagaagtgaagtgagggtcagacatggtggctcacatcagtaatcccagcactatgggaagccaaggcaggagaattgcttgagaccaggagttgaagaccagcctgggcaatatagccagaccccatctctacaaaataaaattgttttaattagccaggcatgatggcatgctcctgaagtcctagttactcaggaggctaaggctggaggatcgcttgagcccaggaattcaaggttgcagtgaactgtgatcacaccactgcattctagcctgggcaaaagagcgagaacctgtctcagaaaaaggaaaaaagaaaacatgaagtaaaataacaacattttcaccaaaaaaaaaaaaaaaaaagacattatcatcatacccaccacacataaggaaatactaacagatattcttcagacaactgagaaacacagaaagaaataaagaacaataaaaagcataaatatatgagtaaatataaacatttgcaatacaaaataagaataacaatataaaataacaagaattccatgtgctatttaaaatgtatacagaatttaaagaaacaaagcagatcacaaaaaaaacaacagaccatacaagctcttaaaaacaaattgccatattcttaggaaaagattgtttcatgaccatgaaaacaattactagagtgagttttacacctgtttaatcaaagacgactgttagactcgtcaaatttttgaaagccagtcagtcagtaatagtcatgcttctgaaattcagacaatcaagagttaacactctagtgaacaaaggcctacaacatccagatattttttaaataggatgttacgtatctttatattattaaccttaacaataatggtactctttttggataataaataaatgaagaaaaatgtccttgcactagaaaagaaagatacaaatattcttgagacttaataggagctgtcatcaaggcaacactcagaaacaatatacctacagctcctgatcaatctcttgtgcagctctgggttccttttcatatatggaaattagactcttaccatgccatcccagaacccagggtacctgttgtgtgagcgtaacaactatgttattccaagtgtacaactccccaacatgctcagtggactgtgtcttataacaaagaatatgaatggataaaatctttcctttgataactgacaaagagttttctgaagataatgatctgatccatacctatctttaagaactatagtatgtcttcacagttgtaattattggcaacaagcattaaacttcttggatcaaatacttcatatctactcaaaattgtaacattaacacttaaaactaagaaaatagagatgtttaaaattttccatttcacacactacttcatattcctacctgataactttaaataccaaatgcactgagtttagccctgaaatgagtttaaaacaattctctaactgggatataattactttccactgaagcatttttctgccactcaagaatcatctgatttacataaatgctagttaagcaccatagaaattctaaaatatatcattagcagaatgtcacagatcacttaatctactctgtcaaaacagggattatttcaacttctgtttcacttcccttaaaagaaatcctatttactttcttttctctaacagggaaaaaaaattagtaaaataaacttacagtgtacttcccaaatcaaactttaaaatgattctggttaactacaaattgactgaagtattttttctgaatgtattttactgaaacatggctgacaacatataataatgttactgctacagaattacaaattatttcactgattactcttcctattcaagaaaaaaaggtcactttggtccatacaaattgtccaaataaactagatgtattactagcttaaagtaaacaattttgtaaatagcacttctagttagagttaaaacataaccataaaaagcttttattaaacaatacatttcactaagctaaatttatagaaatatatatatttctatcactttcacacatcctgacaatatttgggaaaataaatacaaaaatgtttttttttaattcagaagtatataatttcttcaaatattccagccataaattataatacataaaatttaagatacgtaaataccatgaatattataaactttaaataaaattctagccataatttatgaaactcacattattaaacaacacacacacacgctgattccaaatgaagaagagaagtaccatggtagtttctctgtgacacaccaaaaattatcctaataaataaattaaacaatcatgtaattcctaaatttgttacagaaagatatgtggctggttctcacacctcctactagatatctttacaccacttaaaaccttttcttttttcatgctattattttctgtgtaacaaaataccaactagtcagattctaaaatatcaatctttagaaatgatattagcaaaacaattttaaaatacttactgtcttgtttcgtaatctaattatgtctgagacagagccagcgccacagtactccataacaatccagaggtctgtattcttaaaataactgccatagtactttacaacatatgggctaaaggaaaatacataaacaattaaatttagttaattcccaaagaaatttttttcttaatcccaatacaaagtattttcaacatttcatactgttccaataagttaaataagtaaatttctattgcacatcaaattctcaatatctggagttcaccaactatgcataattaggctttacttcatggacgaaatttaacaggattacaaaccagaagaggcccaaatgttttgagtgattctgaagaaaataagacttcattttggcaaagaacttactacttaacatgaggaacaaatgaaaatttttccctttaactaaagcattttaaatatgtcttctaaaggattttgcattcagtcaaatattaatcaactcgaaaataatctatatttccatgaggccaaaaagttattttaaattttctttcattctggcttttgaaaattctagagaaaaaaaattataaatttttctgcttaaatttatagaattaaaatattagcaatttaatttctaaactgaggtcttacgtcttccagagcagaataaactatgtttatagccaagctgtcttcaggaagatttagaaagggacaaatgaccatcagcaataatgtatattatggataaactacatatagtgatgtatgagaaatctaacctatctcaaagaggcagaatatcatattcaaaaaatgcatagagatagaaaatacaagacagcagaaactaaataggacacaactttaatgctacaagagctcaaatgaggaaataacattggaatcatccaaagagaactttgtggaagggagtgggatttgaatgagattttgaaagaaaagtttaaactccaaaatgtagatggagaagagggataagaaaattctagaaaagagaaagaccatgaataaaggtacacaaatagaaagggaaaaaccaagtatggcatgtaagaggacaacttgttcaaataaatacttctatctagtaatagctacaatcaaaaacagtagccattttgctgggcacaaatgtaagataaatatgacagaaaaacaaataagcaaaaaaaaaaaaaattgaaagtacaataaaagaacacgtagagactctatcaattgtggaggttaagagaagactgtcagggaagacttctcagtacagcctttaaaattttagctatgctctaacactgaggcagtaataaacagcctaccatccaaaaaaaaaaaccacccaggaccagatggacttagggccaaattctagcagatgtacaaagaagagctggtaccatccctgctgaaactatttcaaaaaattgaggagaaggaaatgctccctaactcatcctatgaagccagcatcattctgataccaaaacctggcagagatacaacaaaaaaagaaaactttaggccaatatccttgatgaacattgatgcaaaagtcgtcaacaaaacattagcaaaccaaatccagtggcacataaaaaacctaactcaccacagtcaagtaggctttctctttgggatgcaagattggttcaacatatacaaatcaataaatgtgattcatcatataaacagaactaaagacaaaaaccacatgattatctcaatagatacagaaaaggctttcgataaaatcagacatccattcatgttaaaaactctcaacaaactaggtattgaaggaacatacctcaaaataataagagccatatatgaaaaacccacagccaacaatcatactgaatgggcataagctggaagcattccccttgaaaagcggcattaagacaaggatggactctctcaccattcctgtttaacatagtattggaagtcctggcaagggcaatcaggcaagagaaagaaataaaggtcatccaaataggaagagaggaagtcaaactacccctgtttgcagatgacatgatcctgtatctagaaaaccccatagcctcagcccaaaagcttctcaggctgataagcaacttcagcaaagtctcaggatacaaaagcaatgtgcaaaaatccctagcattcctatataccaacaacagtcaagccgagagccaaatcgggaactaactcccattcacaactgccacaaaaagaataaactacataggaagacagcaaactagggaggtgaaagatctccacaaagagaactacaaaacactgctcaaagaaatcagagatgacataaagaaatgggaaaacattccatgctcagggatagaaataatcaatatcattaaaatgaggctgggcactgtggctcacgcctgtaaacccagcactttgagaggatcacttgaggtcaggagtttcagatcagcctggccaacacggtgaaacccccatctctactacaaatacaaaattagctgggcatggtggcgcatgcctgtaatcccagttacttaggagggtgaggcaggaaaatcacttgaactcaggaggcggaggttgcagtgagctgagattgtgtcactgcactccagcctgggcaacagagcaagactccatctcaaaaaaataataataaaaaataaaaaaataatatataaacacacacacacaaacacacatcattaaaatggccatactgcccaaagtaatttatagattcaatgctattcttactaaaactactatttgagattcggcacagaactagaaaaaactattttgaaattcatatggaaccaaaaaagagcccgaatagccaaggcaatcctaagcaaaaagaacaaagctggtggcatcacactacccgacttcaaaatacactacagggctacagtaaccaaaacagcatggttatgatacaaaaaaagacatacagacaaatgaaacagaataaagaactcagaaataagaccacacaactacaactatatgatctttgacaaacctgacaataacaggcaatggaaaggaaaaaggattccccattcaataaatggtgctgggataaccagctagccatatgcggaagattgaaactggacccctcccttattatcatgttcaaaaatttaactcaagatggattaaaggcctaaatgtaaaacccaaaaatataaaaaccctggaagacaacctaggcaataccatccaggacataggcaaagatttcacgacaaagacacccaaagcaatcacaacaaaagcaaaaattggcaaatgggatctagtaaaatcaaagagcttctgtacagcaaaagaaactatcaagagagtaaatagataacttacaaaatgaaagaacatttttgaacaaactatgcatccaataaaggtctaatatccagcagctataaggaacttaaacagatctacaagaaaaaaaaaacaaacaaccccattaaaaaatgggcaaaggacatgaacagatacttttcaaaagaagacctacatgtggccagcaagaatatgaaaaaaagttcaacatcactgatcattacagaaatgcaaatcaaaaccacaatgagataccatgttacaccagtcagaatgactattattaaaaagtcaaaaaaaaaaaaacagatgctggcaaggttgtgaagaaaaaggaatgcttatatactgttggtgggagtgtaaattagttcaaccattgtggaagatagtgtggcaattcctcaaagacctagagacctagagacagaaataccattcaacctagcaatctcattactggatatatacccaaaggaatataaattgttctattataaagacacatgcatgcttatgttctttgtaactagcactcttcataatagcaaagacatggcatcaacctaaatgcccatcaatgatagactggataatgaaaatgtggtacatatacacaatggaatactatgcagccacaaaaaagaacaaagtcatgtcctttgcagagacatggatggagctggaggctattgtccttagcaaactaacacaggaacagaaaaccaaatactgcatgttctcacttataactgggagctaaatgatgaggacacatggacacacagagtgaacaacacacactggggcctatcagaaggtggaaggtggaaggagggagaggatcaggaaaaataactaatgggtactaggcttaatacctgggtgataaaataatctgcacaacaaacccccatgacacaagtttacccatgtaacaaacctgcacatgtacctctgaacttaaaataaaagttaaaaataaataaataaataaataataaaaacatcagtcatctaaaaaacaaaagtttaaaattttcccattataattaaattttatattaaaaacaaaggcaataaatacaaaaaaaaataactatgtcttgaagtcaaaggtagaacagagtggttggagctgaagggcctgaattcaaacctgttttatccccactgctactccgttacctcttgcacagacttgctccccactggtctccttgtcttagttttctcccctgttctagtctatgctacatacagttgacaaggtaccttactttaaaacaaaagtaaaacaagctgatcatactgctctcctagttaaacaaaaatactctaacagctctccattacccaaaggaaaagctcttaactgcttcatatcgcatacaagttatttcagagtctaccttgttacccgtatctctgattactctccatctcataccttaaatttccagacacactcagctttgctaggtcttgggaattgaaagtatgtatttggagttcataaatgttcactgaaccatttaagaaaagtgcttgtttacaaacaaatgaaactaaatacagacttagaactgcaacatatgagaaacaaaaaaaaaaattctttacatgtactcctttaaggtatggcgcctatgtggaaacttttatagggagtagcgttcctacacctggctgtgcatgagagccacctgtgacccaagcccacactcctttgaggttctgattcagtaggtttttaaaagctctaccggtgactctgacatagacccagagttaagcttcactctaccagtgaatagactgtatatccttcaggggaaaaaaaaaaaactctctctctctctctttttttttctgaagcagaatctcattctgccacctaggctggagtgcagtggcaccatgtcggctcacagcaatgtctgcctcctgggttcgagtgattctcgtgcctcaacctcccaagtagctgggattacaggcctgtgtcaccacgcccagctaatttttgtagttttggtagagatggggttttgccatgttgaccaggcttgtcttgaactcctggcctcatgtgttctgcctgcctcagcttccaaaagtgctgagactataggtgtgaaccaccatgcccgccaaaaaaaaattctttaaatatgaatgttctcattcaaaattttgaaaagtgttaagtaacaatgaattgacgattatgttcactgaaaagcatacaaaaaaatgtacatttttcttgccatacacactaatcagcaatgctaagggtagaagtgacaactcatgaaaattaggaattctaacctgggcagccacctgaaaacacagccctatctctccataagagtaagtcaagagaaaactttggcaaaacgtaaaattctcttcaaaaaaataattcatggcccatctaacacccacgtaagtagatggatccaagtccaacacctctataacataaaacatggcctcactaactttaacccagcaaagtatttaagcaactagaactaaacagccacatgcattcactgaccctctactcgggccaggcatttcaccagatgttcagtatgcactagtgaaacacacattcacaatttggaccctcataccgaatacactagcatgaatatacaggaattaaggaagtaaactcacaaataaatatgattactaaccatggcaagaaaagaagaaagggtgctataagataaactggctgtgactttattttgtattcaccatttctgcaaataaaattgctcctagttcatatgaaggaatggaatgcattcatattccatggtagcctctgagacttggaaggcactggagtatgtgaaaaacctttgaaagcagataagtgagctttaacaataaaatgtcctttctccactgaactgctgtgaattacaaaatccacagattggaaaagaaagaaatgcttaaactccagagttcatatgtatacagtggccatcctctgacactttctaagtcagcaccttttatactgtaaagcacttattacatcctgcaaggactttgtcattgacttttatctgcctcccccagaagaacagaagctccataaagataggtaccaatctgtctcgctttccattttatcctcagtagctctcttctcctatatacaaactaaagaagcaggccgggcacggtggctcatgcctgtaatcccagcactttgggaggccgaggcaggcgaatcatgaggtcaagagatcgagaccatcctggccaacatggtgaaaccctgtctctactaaaaatacaaaaaaaattagctgggcgtggtggcaggggcctataatcccagctactcaggaggctggggcaggagaatcgcttgaacccgggaggcagaggttgcagagagacgagatcgtgccactgcactcctgcctggcagaagagtgaggctccgcctcaaaaaaaaaaagaaaaattaaaattaaaaaataaagaaagaaagaaaagaaccaacgaataaataaatcacacaaaaaactaagacaggacctaatttaggactctccaagggaataatatttaagctaagatgcaaaacttaacgagaagttagccagataactaagcactaagaactgccctgcaaaggccctgaaagacagaacaaatcacggtcaaagaactgaaagattagcgggcccaggataaagtgagtaaaggatacagtagaacataatggagttgcatatgtaggcagaagcctgaccatgaagggcctcaaaaccaaggtaaagagactgggctttatttgaaatacagaaaaaaaaatcagtgaagaattttaagcagacgaataacatgatgtaaagtttctgtggttgctgaatgaaagctagattgtagggaagcaaatgtgaatacagagagaccaattaaaaagtaatgttagtccatgcagagattatagtaagcatatctttttattttctgtattcttgatgctttggtatctgggaccttgctaaaactgaagcgactgcccctctcagggtaagctaattcctagagacagcaaactaactcccatggaaggatgtctttcatatgcacaccaacctatctaaagcccaaacctccaaccacctctatggttacactctagggtcaacttttcacctgcccaaattgccccagggccaggtaccagacaaccagagaaagccctatgccccagaacccactcaaaatactcaaagtagccaatcctaaacctgtttaccctatctcacctgtcccttcccagggaaaccacacaaacattcttgtccacttcttcccccctctttctctgcctcctaactgactctggtacttccccgtggagcccctgtgacacagcacgcctccttctcttgtgagctgtatatataacaatatatcttttccatagcaatagtctcttgatctgttggcctcatgatatgtgagtaataataaagcatactttttttttttgagacagagtctcgctctgtcgcccaggctagagtgcattggcgcgatctcggctcactgcaacctctgcctcccgggttcaagcgattcgcctgcctcagcctcctgagtagctgggattacaggcacccgccaccatgcccggctaatttttgtatttagtagagatggggtttcaccaggtcaggagttcgagaccagcctgaccaacatggtgaaaccctgtctctactaaagatataaaaaattagccgggcctggtggcatgcacctgtaatcccagctactcaggaggctgaggcaggagaatctcttgaacccgggaggcagaggttgcagtgagccgaggtcgcgccattgcattccagcctgggcaacagggcgagactccatctcaaagaaaaaaaaaaaaaaaaaagcctaccaataggctcagacagttcaagacctgagacttctaaactcaagtctatttccattaacacagatatgcattcaaattcacatttatttatctttttttttaagtaattcaaacaacaaatattcactgaacaagcctactagcagaagctagggagaaaaatggaaaaacattagactagtgacaaagaagaaagggcagtccaggcaatggggaacccctgaagaaatttatataaggaaataatacaatcaaactagcatttaaacattatcctgagcaggattgtcaaggatcaaacatgatgttgttcattctagccagcaagttaactaactacaattatttagatgttctaacatctgtttttaaaccagcatgttgattattaaaggttagggaagaaggggagagagtttcactcaaaacactgtaacactctagtgttatatacaggcaaatctataagatattgcaggtttgattccagaccacctggataaagcaaatatcacaatacagtgagtcacacaaatttttgttttccagaaagaaaccttggatcaggcagattcatagctgaattttgctaaacgtataaagatgagctggtaccaatcctactgaaactattgcaagaaagctgaggaagagagactcctccctaactcattctacgaggccagcatcattctgataccaaaatgtggcagagacaaaatgaaaaagaaaacttcagaccaatatctctgatggacataaatgcaaaaattctcaataaaagacctgcagaccaaatgcagcagtacatcaaaaaactaatccaccacgatcaagtaggctttattgctgggatgtaaggttggttcaatatacacaaatgaataaatgtgatttgccacataaacagaggagattttgcaaaattcttgagggtcctaagatttttggaatgggcaatgaacactggcttcaacttaaagtcatgagaggcatcagcccctaacaagagagtcagcctgtcctttgaagctaagcagtgacttctctctagctaggaaagtcctagatggcatctccttccagtagaaggctgtttcgtctacattgaaaatctgttgcttaatgtagccaccttcatcaattatctcagctacatcttctggataacttgctgcagcttctatttcagcacttgctgcttcatcttgcacttttatgttatggagacagcttctttgtttaagcctcatgaaccaacctctgctagcttcaaacttttgttgcttcctcacgtctctcaaccttcatagaattgaagacagtaagggcattgctcgagattaggctttggcttaagagaatgctgtggctggtttgaacttctatccagaccactcaaactgtctccatatcagcaatgaggctcttccactttcttaccactcatgtgctcactggagtagcacttctaatttccttcaacaacctgtcctttgcattcaagcttggctagctgtttggcacaagaaccctagctttcagcttatttcggctttcaacctgtcttcctcactaagctaaatcatttctagcttttttatttaaagtgagagttgtgtgactctccctttcacttgaacccttacggaccattgtagaattactaattggcctaatttcaatattgtgtctcaaggaataggaaagcctgaggaaaggaagggagatggggcccacggcctagcagtgggacagtcagaacacacacgacatttatcaatttagttcaccatcttacaaaggtgcagttcgtggcacctcaaaacaattacaacagtaacatcaaagatcactgatcacagatcaccataacagatataataataatgaaaacgtctgaaatatgggaaggattaccaaaacatgacatagagacatgaagcaagcacaaactattggaaaaatggtgctgacggacttgatttgctcagtacagttgccacaaaccttcaattaaaaaaaaaaaatgcagcatctgcaaagtgaagaagtacaacagagtaaggtatacctgtatataaattttaagcaatgcagaaagttttaattcagccatatgcctaagaattttgactaagccagtatatggacttgcaggttgtatcagaacccagcaattctatacacagtcatccctcaatatccatggcgaactggttccaggaaccccacagataccaaaatccatgaatgcacaagttccttatattaaatggcacagtatttgcatataactacatacatcctccagtatactttaaatcatgtctagattacttattacacctaatacaatgtaaatgctatccaaataattgttatactgcattggtttttttttttattgtttttttctattgctttttttctcccaatatttccaacatgcagttagctgaatctgtggatgcagaacaagcaggatacagagggctaactgtagttttgttacattttttatttttattttttaagagacagggtatcactctgtcacccacgctagagtgcagtggcacaatcatagctcactgtagcttcaaactcttgggctcaagtgatccttccacctcagcttcccaagtaaccgcaactataaacatgcacacacccggactaattttttttattttttgtacagacagggtctcactacgttatccaggctgctctcaaattcctggcttcaagtgaccctcctgctttggcctcccaaagcactggaattacaggcgtgagccactgtgcctggctagttttgtctcttttaaagaggagtaagcagctatgtctttgaaaatttcactgggtggaagaaccaggaaaacacaaaggaaattacagactacaccaggaagcagaggtgaaatatgatgccttaataactagcatgccaatcatgagccacattctatgcctttctcttatgcatcttctctccatttcatcctcctgtctcattaattttttccttcccctatttaacgccttcaatccaataaaatgacgtatcttgttctcgttttcttttttttgagggggtggggggcttctgggcttcctctcatctcatacctaatgatcacatcctttccatttccatcttcactttacagctccctacactctttatcctaatggtcctcctctagtatcacaactcaaaatagaaagagtattaaaaaaaaatgagaaaaaccaaaggggaaaaatggaaaaaggactacatactcctatctaattgtaccttacttaaacactatgcatgatacaaattatacggactgaatcattacgtttaagcttcttataaaaatccaaatgttctattcataacacccaaaatatggaatcaatctaagtgtccatcaacaacatcatataattaaataaagaaaatggaatactatttgaaaatactgcttgaaaggtgactttttctttttttttttttttgagacagggtctggctctatcacccaggctggagtgcagtggcatgatctcaggtcattgtaacctctgcttcctgggctcaagcaatcctcccaacctcagcctcccaagtagctgggactacaggcacgtgccaccatgcctggtgaatttttgtattttttttagagagagagttttgccatgttgttcaggctggtcttgaactcctgagttcaagcaatctgcccacctcggcctcccaaagtgcaaggattataggcatgagccaccacatacaatcaaaaggtgactttttaaatagtaacttgaatttcattctaattgaagaaaaccatatatagctaaaggtatactttttaaaagtcttcctaatatgagcatgtgataattaaaatactaaagaaatggctatttttaattacatcattttcatcaacatcttactataatcttagtagtgttctataacttagtatggtaatacagtgtttttacaaaggcaatgtggatattctattaaaactgagctgtttccagcataaatctcaatcacacagcaatttatttcttggcccacccaaaactgaatatacaaattgccaaagttcaaattgctgatacaaattgccaaagttcatcaataatcctccaacatggtgattttgaaacttttgattttttatttatttatttatttatttatttgcctcagaaacagtgttcaaatggaatcttatctagaaacatgaggaaatagaacaggtaagaatgtagaatactctggtagaagccaaggggtgctcagtgacaccctgaacaggccagctgaaaatgctctatttcaccataagagttatctcttctctttgcccagcaaatctaactcatcaatcaggactcagctgaggtatgacctccctgggaaaactttccctgaacctccaaacatgaggtgttagatatctcttccaacccacatacttccccatatctatcccatcacagctgttaccacactgtgtactgaaacagcctacccattcgtctgtttcttccagctgagtgaaagtctctctaaagcctcaaacccattcttttttgtttcttttttttgttttgttttgtttttgagatggagtctcactctgtcacccagactggagtgcaatggcacagtcttggctcactgcaacctctacctctcgggttcaagtgattctcctgcctcagcctccccagtagctgggattacaggtgcctgccaccacgctcagctaatttttgtatttttagtagagacggggtttcaccatgtttgccaggctggtctcaaacttctgaccttgtgatccacccgcctcagcctcccaaagtgctgggattacaggcgtgagccatggcacccggccgagacccattctttgttgtatctcttgtgagagcacatcaggcctacacttaggagtaggtggtactcaatacatactagttgaacaggtaaaaaggggataagtgtgtgccctgattcataacaacatatttatctttgtttagatatgaaaagttccttctctgcatataagcaccaggagggtagggactatgtcagttgtgattaccttgtgtacatattacctgccacatagtattgctaaccagctgttgcctctactcctaggaatgccttgagagtgcttcactttgaactgttggaatctttttacaggcattgctttcttcaacactggccctgaagtagggtaaatgtgggttcttattgcatctcagtcactaactagcagtgtgattttgggcaattcatgtaaaagctctaggtctcattttctgtatctgcaaaattgtttttaaatatgctttagcactagaagacttttcctcaaataaaaatttcaaaagagtcccatatataaaaaagataaaagcaataatgaggttctcattctactcaattcttcagtgaagaaaatgcccctagaagtaccttcttagagcagggtatgatttgaaaacactaaactagctgacccacagaagttgaatctagcactaatattctatgatttatccatttaataaatactcattaaatgtatactctgtacctggtactgaactaggcactgcacattcagcaataaacaaagcagatgggctccctgagatatttatgctaacatgtagtattcagcccattattaaatattcacttaaaatgaacaaaaaaagattaaaacaccacctctggtccttttatagagtatagaaaacaagacaatttaccaaattcacaaatagctgaatgtattaagaaaatagttaaatttcagaaatgcatatctcattttccctatcaaaatttcagtgtattatttgggaatttttcaattcatactgttttcttccaatcatttttatgctaatttcttaataacacatttacattaatactagttattggtagctaaaatctaagtttctccctgtcatttcctaattgtttttctttttcttttttttttctttttgagacagagtctcactctgtcacccaggctggagttcagtggtacaatctcagctcactgcaccttccgccttccaggttaaagtgattctcctgcctcagcctcccaagtagttagaattacagtcacctgccaccacgtccagctaatttttatatctatttagtagaaatggagttttgccatgttggccaggctggtgttgaactcctgacctcagatgatccacccacctccgcctcccaaagtgctgagattacaggcgtgagccaccatgcccggccctaatttattttttactagtcctatcttttagcattttaggatcttttaaccaactaattttttgatccttcgcaacttcatacttacaatatgaatttgacagtaaaatcttaaaaggcagaaaccatttttcatcaatatttgcctcagcatttatttcattcaacaaatatttgagaagtacctactatgtgcaaggcattctgctataaagtggtacaaaagttctagaattctataacatttccttctcattgtattctttacttttctttccctttaaaagcttaaagtgcataacaagaataagtacctgatttccctggggttccctcaatctgtaatgctcttccttgtactcctcatacataccacaccctttcattcattcatcaaaaagtatactgctaggcgctgaacaggtgctaataaagaaaaatatatggttcctttccttaaggaatgaagagaagaataaagatagtgatgacatttcagaaggaaaatctacaagactcagtatcatctgaagtatcataaaaaggaataaagatgattctcagccttgctaaaagactaagtagatgatgatgcctttgatacacaggaatttgaaaggcttgtctggaatgtttaaaactggttttagaatgttaaatgtgtaattccctctggatagtctagttgagttgcccaaacagaaattattaaatagaagtactcattagtatctgagtaaccattatgtggcaggatccaaggacactgagtaaaatacaatccccgaactcaaggaacttaagacttagatgatagagaatacaagtaaacaggcacttaaaagagaaactcaggtaagagactggaggtgtaagcactagatggaacatgaaggaccttgtatgccactcttaggagactggatttctcgaggcaatggggaaccatgggttttaaacagggaatgcttgattacatttgcattttggaaagaacgctctagcttcaaggaagataatgggttggaggaggcaaacaaagtgaacaaataagatgctgttgcagaaatctgaacaagatttgagggaagagatatgtaatagtaatatttgagaccctgactttcctagacaacactcaaagtacaatgctaatccttgaactatttttaaccataataacaaaataatactcgcatcaggcaagtataaagcatacctggtggccgagcactatgctatctcatctcttattctatatcaaattgtgggaaccacagttgaggaatgtatctttttttttcctataaccacttgaatttcacatgctatgggaaatatgtaacataatttaaatatacagcatattctaaagaaaagcaaaattgaacagatccaagcagcaaagttcctctaggattatgcaatcacttcattagccaaaaagcttacaatctatagatcctatgtattgttaggagtgaaagctttccataaatctctaattacagggccctgaattgataaggggagacaatgtgcccagactaccctgtgtcaccagctctaagtcacacgagacaatttttacaaataagactgaagttgaaggtttctgggaaagccccttccctgcttcttcttttcttcctcctgcctggaatgtagacataaagctggggctgtagcagccctgttgtagccatgagataataagcatgaggacaaagcacatgctaacgatgagagagtacaagaaaagaagactgagacatggctgttcctttgttgctgctgtactagcagactttttgttaagggagaataataaatccctctgtggttaagtaactttaggctaaacatagtcataatttatatactctgaatcccttatagaataaagcctaggctacttcacattgcataagatgcttctcaccatcagctccatttaactatccaacctcatttcattctgttctctgtcccatactttccattccaataattctaaatcttgtcagatgagcacaccccaatgagttgtttttacctttctacctgtcatccccttgactctcccttatcactccatttcttcacccaattaactcttcgtcagcattccagatttcctggctccactggctgaggaagatgccctgccttcttcttttcacattaccccatgcaccagtcactacaatgagtgtgctatattacagctatttatttatatatttgtcttcccaactacactactgacccctcaaaaagaaaaaagtatcttagttcttttggcattcttagatcctggcacagtaccgggtcaactggggatgctcagtgaatgttgaatgaattagatttacataaaacatgacttcttaattagtaaaagtgattacataatacagactgttaaatgacccctttaacatcaaaaactcattctcatccataaatttgtcctaaaaaagtccaggctatagtgcagtgctgcaatcatagctaactgtggccctgaactcctgggctcaaacaatcctcccgcctcagcttcccaagtagctagaactacaagtccaagctaccacctggataattttttcttttttggtagagaaagggtctcactatgttgctcagactggccttgaactcctgggctcctttaccctcgatgctctggcctctctaagggttgagattacaggcgtgatctaccacatccagcctcatttctgcttttaagcagaaaagctgcaaagagctgtaagtcctaaagacacttgacaaagccatcctcatctgccttaaaggattaatctcacttccaatgggaagtcagaaatgaaaactaggccaggcatggtagctcacgcctgtaatcccagcactttgggaggccaaggcgggtggatcacctgaggtcaggagttcgagatcagcctgaccaacatggagaaacccatctctactaaaaatacaaaattagccaggcatggtggcacatgactgtaatcccagatactcagggggctgaggcaggagaatcgcttgaacccagaaagcggaggttgtggtgagccgagatggcgccattgcactccagcctgggcaacaacggcaaaaccctgtctcaaaaaaaagaaaagaaaaagaaatgaaaactaaacagatgatcaaagaataaattttgttatattttattagcaaaactcgtcaaaacaagggtaagcaaagaaataaaatctcttcatacctgtcacattgctgcattatggaaatttctttgattatttcctgaagatctgattcaacaggtacttgtttaattgcgacaacttgaccggattccttgtgtattgctttaaatacacttccataagacctaaaagaaaccaagacattatttttttcctatcaaacatcgtaactataagattaaaagtctactatgagttttctgtggatagtcttttctagtttaaaacactatttaaatgattaaaaaatcaaagtaaacaagtaacaattttaaaaggtaatgaattatatcttagctttattgcttcaactacagacttaaaatagtcaagttaacatataatgagtagctatttttcttatgaatgaaagaaacagacttgcgtttggtcaactcaaacaaatgcagcattaagaagatataaatggaaattaaaagaatgaaatgtagattaaaaatagccaaagcctcaaattaggagaaaaggctgatctcaaggaaaatgacccccagaatatcaaaaagtcacacttctgttcagagtaccttaacagttaaaaccctcagctggggaccatattaacatcaaagttagagaagcaaggaatctgcagccatctgcttctacctgatttacagatccaaggtctctttttaaaaagttcctttcattaccttttcctcaagagaaaaactacaaactcacaggtaaataaaatgaggaacagggtctaatagtcacttgcccaaaacctgtctctgctacaactcctgaaactttgccaactgaatattcacgtgttttaaaaagcaaaaacaaagaaggaagaagccatttgtaccttagtatgaacttaaaaacgaggttaaacactactatgtactgagttcttactataaaccaggtcctatgctaggtgttttacatgcattatgaaattcaaccctcacaatcataaggaaaaacactattatcgtcattaaaagatgagaaacagaccagtagggccagaattcaaacacattcccaccccaaaaatcaggtttttctcaccatatttttctacagaagagaaacaagagcaagccaatggaaaacatcgaatgtttcctaatattagaaatctatgcagaagcccttccaaatttataatcttttaaaataagtgaaaaagagacaaataagtgataacgcggctacttcaataaaatacattttatcctctcctctgtttctttgggctctctgaagtcatttaatttggtttggtacccaaagtcacattgggctgggtgtgggggaatgtatgtgtgtgtatctccccttgaaagccatatgtgtgtatgtgtgtatattccctcaaaagctaacatagaattcagtgctagatcatctactgtcaattaggcaacaccatcactcctttctaaggactcctcagcactacgaaagagaagctgcaatccccacttcccagaatccccttccctgaatggttcctcattaaaagtctgccagtgagaaaaacacgtatgtgtgaatgacgaaaggagaaaccatttttctccagatacagttgtagcagatggactgacagatatgaagtgcacagcagcttcctgctgagcttccaacagccaccactgctgcagactgaggtagttggtgggagtttctcaagactgcaggattccagcagattcccagagagcttttgagaaacacccacttcagtgcttcaggctgagatcttcaatgctgacttcgaccttcaacctttggcaacagttttcatgaactttgcatccctggcccctccacaattcatttgagctcctaacttcattactaaattcttcatatctatagagtacatacagtagcttatcttttccttgatagcaatatagtttttggtagaagaagtgtttccaagggaaagaatcttaaagatgagaatcttgaattagttctttcttagatgttgatatggtttggctatgtcccacccgaatctcatcttgtagctcccataattcccacctgttgtggtagggactcagtgggagatgactgaatcatgggggcaggtctttcccatgctgttctcatgatagtgaatgggtctcacaagatctgatggttttaaaaatgggagtttgtctgcacaagctctctctttgcccgctgccatccatgtacgatgtgacctgatcttccttgccttccaccatgattgtgaggcctccctacccacgtggaactataagtcaattaaacctctttctttcgtaaattgcccagtcccaggtatgtctttaccaacagtgtgaaaacagactaatacagatgtgtagacagtaatgacttcaatacaagtaacaaatagtatactgatggtctatggcattcagtggcaaacagttatttaaattatcacccttagttgcctggagtctaagcaaagctttaaaagaccaagtagctgtatcaatacaatgtatggtgaaaataaagtataaggactatagaatgggctgctgcctctgcctgcactggaaaagttatagaacaaacacagcaagctaaaggcttaaatgtccagctcaagactgagagaaccagaaaacttctgaatttcttaattcttacagaaacagggttgagatttctgaaaaacaaactctaggtatagtcttactggaagttgaattacatttcaagttgaattcacatcagcaccaggtctgttatgttaaagttaaggtatctaacaataaagagaagtacctagagaactggtattaggacatttagatagattctcattaatctgagtaccttgaatccccaaatcctatcaagcctcccttgataccaaaagcaactctgccctcctgtctgagaaaattaaccttacaatgcctgaagactctatctacctcctgaggcagtcacttttcagcagcatgcagtggtcctccagaccactccaccaccacttattgcttccagacccaaagttatactcaactcccatagacaccagggagacaagtataaaatttaacccaagcagctactattcacactaaaaaagttgcaagattttgccaatttttatcagaaccctaaagaatatgtgtgagaacaaattctaagatttccagagaggaagaaatgtactgatatggatgcaagaccagaaattccagactcagcatgttagctcaaacagttgggggtgtccctaacagttgctcagccagttaactgaaacctggactcaaaagtggcccatattaagtgagatgctaagtgagcctcagtacacaccaaaggaagcatatcaaaggctcaaggaaatgggatactagaatggatatatattataagtgccatgctcacatactccctaactatgttgacaaaaagggtccagaggataccagcatcgaccaaagctctattagtgcaggggaaagatgacaaatatgccaacagtgaaactggctccttgagtttaatagataacaggatcccagcacaagagaagtggcaacagctattcacctgagacaaagtgggaacagttaccataatgagtaacaaagcaaggctgaattacagttttcttttattgtacatttaggtcttgatattaaagttacactagcttcatttaaaaaaaaactataattaactgtcctttaaacactgtataaaacagtgtttaatacagtggaacctttctggaggggaggaggtgaaatacacacaacataaaattcactgttttaaagtgtatgattcaatggcatttagtgcattcacaatgctgtacaaccattatctgtatgtagttccaaaatatatagaatctgctttctgtctctacagatttatctattctagatacttcatataaatgaaatcatacaatatgtgaccttttatatctggcttcttccttcacttagcataatattttgtaggtccaactacactgtaaaatgtaccagtacttcactactttttatggctaaaaggtcactgtacagacatatcacgttttgtttattcacctgggatagcagatggacatttgagttgtttccacattttggctattgtaaataatatgctatgagttggtacctttataattaacagttatttaatcatttctctatcactggctatatcttccttcttattccaaatcttctgtattttctattttctttagtcaacattgtaagaggtttaattattttactgatctcttcaaaagcttttatatatacaaacatatacgtatctttttttttttgagacagagtcatgctgtgtcacccaggccagagtgcaatggcacaatctcggctcactgcaacctccgcctcctgggttcaagcaattctcctgtctcagccttccaagtagctgggattacaggcacatgccaccacgcccggctaatttttgtatttttagtagagatggctactctactaaatgacaatatggtttcaccatattggtcaagctggtctcgaactcctgacctcaagtgatccacccacctcggcctcccaaaatgctgggattacagcgtgtaagccactgcacctggcccatatttatcatttctaattttttttctatctcattaatttcagctttttctttaattcaatcttcagtttcttttggtatgtttcataatttttctaagttctttaagtaagcactaagtttattttttgcctttctttgttagtctaatgaaagaatttagaactaaaacttttaattagttttgctatattccatagatactggcacaatgtgttctccttttcattgttttataatttataatatcctcttcaatcaatgggttacttcagattatgtttcctaatttctagttggtgtggattttgtcatattataattacttatttctaatttagtgagtataatcagtgatatggtttgcatatttgtcttctccaaatctcattttgaaatgtaatccctaatgttggagatggaacctgttaggagacgtttgggtcacaggggcagtttcctcatggcttggtgctgtccttgagatggtgagttttcacaggatgtgcttatttaaagcggtgtggcaggccgggtgcagtggctcgtgcctgtcatcccaacactttgggaggccgaggtgggaagatcacctgaggtcaggagttcaagaccagcctggccaacattgtgaaacctcatctctactaaaaatatgaaaattagctgggcgtggtggcaggcacctgtaatcccagctactcgggaggttgaggcaacagaatcccttgaacccgggagaaggatgcagtgagccacgatcacgccattgcactccaggctggatgacgagagtgaaactctgtctcaaaaaaattttaaaataaaaaaaaataaaactgcgtggcacctcccctgccctatcttgctcctgctctcaccatgtgagacatctgctccccctttgccttcttccatgactataaccttcctgaagccctcaccagaagcggatgccggcaccgtgctttttgcagtgtctgcagaaccgtgagccaattaaatttttctttataaattacccagcctaaggtatttttcttataacaacacaagaacagcttaatacaatcagaaaatgtgacctgtaaaaatctcttattttttagaatttgtaacttttcttttatcaatggtcctttgaacatacaccagaaaagcaggtctgcaagaatatatatgcatagttatatagacatacaggtactttatatatttttactttatatatatttacatttctataaaatcaagtgtattcatcataatgtttaatccctctatgtcctttctcttttttctattatatctgtccaattctaaaagagatacattgaaatctcccatgcaattatacttttattagatgcctctgacatcactaatagcttttctgtcataaatttagctgccatgttgtctgacatgttttgttataaattgtccttgatattgctacctaatatatctctttatttagttgaaaccttttaaactttaatgtatctaatataaatattgctactattactttctgtttttttatttgtatgtttatctataatatttttataagaaatatccttataggctatgcacagtggcccacacctataatcctaacaatttgggaggccaaggaaggaggatcacttgaggccaggagttgaagaccagcctgggtaacatagcaagatcccatctctattaataataaataaatagccttatatttccattatttgttttacttgcatctcctataaacagaatataggtagatttcgcatgttcatttactctaacagtttgtcttttaatgggaaaattaacatttactgaaaagtacacttgattttattccttccatcatgttcagcttatttttattttttatttatttatttatttatttatttattttttgagacggagcttcgcttgtgttgtccaggctagagtgcaatggcgtgatctcagctcaccacaaccttcaccttccgggttcaagcgattctcctgcctcagcttcccgaatagctgggattacaggcacccgctaccacgcccagctaatttagtatttttagtagacatggggtttctccatgttggtcaagctggtcttgaacttccgacctcaagtgatccacccacctcagcctcccaaagtgctggaattacaggcgtgagccaccgcgaccggcctagcttattattttaccttttcattttctctatttccttgtccttgttcttgctgatctataagcttcttttaattctgttttgtacctttattattttggaaattctcctatactttgccattccattaaatgctccctacctttctctctgctcaaaccggcacgtttctctactgttattttgaaatcatgtcaactattcttctgcctatataaactgtttccctcactaagatattcttgtcatatcaagacaaagactacttaccttttccaaaataaaatgagcctcaagatctaaaaggatggccttatggtcacttgcctaacaaagtcaaaaccttcaaacgtattaataagaatgccgtaagggatgaactaacaaaactcttaaacatcatttcacagcacatttcttgcttttcccttatatatatatatggcctactttctctgaaaaaacactattaccagatttagcacaaactaatctttaaaattcagtatcacctgccaagtttaattactattaaatactattcaattcatacgaatatactctagttgaaagattaacatcatataatattttttaaattgttctgaaattatttacatgctttcatactttttgtacttacccttctccaagcttctctaatacatcaaaaacttcttcaggctgcttagtcaaactgtcttcactcagcttttttagtttactgatttaaaaaagaaagaagaaagaaaatattttctttaaagaccttttacaaaatttttaatttttaaaattttaccaagtttttaattttattttaatatattcagaagactcaaacaatataaaaacatacatagtaaacattctcctttcaagccctgttcctcatgtgcccagcaacacctccaaaaataatcacttttattagttttttgtgaaacctttatataaatatgaatacatattcttaattcctcccctttgaatatataagaagcatatacacacccttctgtataaatattgtcatgttgtctactgttttctcttgacaaaactatgttagagatctttccatacaggttaatcatccataatccaaaaatctgaaatccaaaatgctccaagatctgaaattttttgagcaccaacatgatacccacaatggaaaatgccacacctgacctcatgtaatgagtcacagtcaaactgtaagcacataacacaatttaaggaaaaaagatcctccccagcccccttcagctctgacatatcttttccatgcatgcacagattctcccacccaagcacatccaaagaagggtaataaaatggcacaggtacacgccagacgcaccaatgataggttccccacgatgccccacacggagccaagactgtgcattactcactgtgggtttttttgcttattctctgctttgttggataaagacaatgttgaaaatctgagtaagtgacagaaaaagaggaagcatttatgcttatctctagccaaaaagtcaagctgctggataaactggaaagcagtatgggaaatgtcttacaaaagagcatggtgttggaatgaccaccatatacaacctgaagaaacagaaggataaattgttgaagttctatgctgaagtgtcaatgaacagaagttaatgaaaaatttttcttaattgcagaaaaccaaatgaagatctcaaatgtgtactgaaagagtaaatctgtcagcacggcagagaaaacatactacttaatggtatggtgctcatgaaacaagcaaagatatatcatgatgaactgaaaattgaagggaactatgaatattcaacaggctgattgcagaaatttaagaaaagacacattaatttttcaaagatttgtggtgaataaagcaactgctgatcatgaagaagcagaaaaattcattgacaagtctgccaaggccatcactgatgaaaatctgacaccagaacaagtctataatgctgatgaaacatcacagtttagtgttagttccccagaaagactctgactacagcccctacaggataagaatgccatggacagagtaactgtcctgggaggtgctaatgcagaaggcacactaagtgtaaacctgctgtgtgggaaagattgggttcattattagactaacaaaaaggcatgggtcactagggacatcttttctgattggtttcacaaacattttgtagcagtggttcaggtttgctgcagggaagctggactggatgatggctacaagattttgttattccttgacaactgttctgctcatcctccagctgaaaaatctcattaaatataatgtttattccatgtacttttccccaaatgtgacttcattaattcagcaagtgagcagggtatcctcagatcaataaagaataaaaataaaaacactttcttgaacagcctacttgcagcagtgaacagaaatatgagcgtggaaggttttcaaaagcagttcagcatttagaatgctgtatatgctattgtcgatgactggaacacagtatctaaagacacagttgtgcatacctggcacaatctctagcttgcaactatgttcagtaacgatgatgaacaaggcaatgactttgaaggattctgtatgtcaagataaaaaaaaaaaaaaataggccaggagcggtggctcacgcctgtaatcccagcactttggaaggccgaggcggtggatcacgaggtcaggagaccgagaccatcctggctaacacggtgaaaccccgtctctactaaaaatacgaaaaataagccaggcatggtggcgggtacctgtagtcccagctacttgcgaggctgaggcaggagaatggcgtgaacccaggaggcggagcttgccgtgagccgagatcgcgccgctgcactccagcctgggcgacagagcaagactccgtctcaaaaaaaaaaaattaattaaaaattttaaaaataaataaataaaaataaaaaggtgtttgacttccttacatatacaaaaaaataccttcagagtctgtcagtaagttggaagaaatggatatcaaataagtttttaacattgataatgagtctccagttgctcattcattgaccaatggtaaaatagcagaaatgggctgggcacggtggctcacgcctgtattccagcactttgggaggccgaggtaggcgtatcctttgagctcaggagttcgagaccagcccgggcaaacggcggaaccctgtctctattaaaaaatacaaaacgtttggtgggcatgatggcacatgcctgtggtcccagctacttgggagactgagcctgggagatggaggttgcagtgagccgagatcacgccactgcactccagcctgggtggcagagttagaccctatctcaaaaaaagaaaaaagaaatagcagaaatggttctgaatcaaggttatggtagtagtaatgacaatgaagatgatgttaacattgcagaaaaagtgccggaagacaacatggtgtgatgggcttattttaggactagagtgcattcttaacagaataggaaatcacgtcactttataacatcaaagagagacttctaagacaaaagccactgttaatgaggcagacgattctcgaggaaacattttaaaaagccatccaagcaatggggaaaggattccctatttaataaatggtgctgggaaaactggctagccatatgtagaaagctgaaactggatcccttccttacaccttatacaaaaattaattcaagatggattaaagatttacatgttagacctaaaaccagaaaaaccctagaagaaaacctaggcaataccattcaggacataggcatgggtaaggacttcatgtctaaaacactaaaagcaatggcaacgaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacgatgaactcaaacaaatttacaagaaaaaaacaaacaaccccatcaaaaagtgggcaaaggatatgaacacacacttctcaaaagaagacatttatgcagccaaaagacacatgaaaacatgctcatcatcactgaccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccgtttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctgagcaaactatcacaaggacaaaaaaccaaacaccgcatgttctcactcataggtgggaattgaacgatgagaacacatggacacaggaaggggaacatcgcacaccggggacggttgtggggtgggtggagcgggcagggatagcattaggagatatacctaatgctaaatgacgagttaatgggtgcagcacaccaacatggcacatgtatacatatgtaacaaacctgcacattgtgcacatgtaccctaaaacttaaagtataataataataaaataaaataaaataaaataaaaaagccatccagcagaatgtttccttatccctagcagacctatttcctggcccctcagctgcttctgatgtttcttctcaactaaaaaaaaaaccacacagtgtataatagtaacctttcaatcaaaaatcagcatcataggtgaaaactaaaagcctgccgttgtttgttgttcctgttgtttaaaagctgatagaggtattctggtaatgccactgtgctgcttcattaccctgaacatattttttttccactgtattaatgttatgccatattttttgcagttaagtacttatgcatgagcaagtataagaaaatgattgcttatcagtagcatgtaaattcagagtcagaaatgaaggtgatgccaaacaactccacagactgtccacatgggtggctgagatagtgacacctttcctttctgatggttcaatgtatgcaaactttgtttcatgcagaaaattacttaaaatattgtataacattacctacaggctatgtgtataaggtagatacaaaaatttcatgtttggccttgggtcccagccccaaaatatctcattatgtatatgcaaatactccaaaaaacaaaacaaaacaaaattcagaaatctgaaacatttatggtcccaagcatctcagataagggattctcaacctgaataaagcatcaatgttcttttttacagctgcatcctattcaattacagagatatagcatatcttacttgcccagtcttttgcttatggacatccaggttctcttttgatatgataaacaatgctgcactgagtaaccttatatataagtcaatgaatgaatgaatgaatgaatgaatgaatgaatatatataaacttatatataagtcaatgaatgaataagtcatgtgctagtatatatgtggaataaattcccagaaatgaaactgagaatacagacacattcacacacacataaatataaaagtagatatgctgacaaataagtatataatcatgtaataatataattttaataatgtagtataacataagatcactattgtcataactatatggtaattattaaaattattgattacattatggtatattttacctattataattatatgttatataaatatatatacatatacactgatttcagcaagttgtcctccatagagtttgtactaatttattctccaacaagtaatatatgagagcccttctttcccacagttccatcaatagggtatttaatgaaattatttggattttagccaatctgtgatgaaaacttattagctcagtgtagacttaacttgtattattatgagtgaagttgaccatcttttcatatgattaagaagctaaatcacctacttgttctttgctcatttttccactgggttttcggtccttttcttatgtgtatacaaaggaaactagcccttttttcgagattataaacattttcatttggattttgacttcacttataagcttttagttttgcagtctatttgattttttgccatataaaaaatgtcattattttatttttgcaaatgagtggatggtaatgccatttactaaggtaagaaacacaggggaaaaaaaaaacagtctggaggggaacaagatgggctcaattctagtcatctaaaagtagatttccggtaagcaactggatttacaaatctcaggagagatttgaactagaaatataatttttggtgtcatcagcacattgcttaaagctttcagaagagacaaaatcatcaagaaaatgtctaagaaaaaataagagtcaaacacaaaacacatatcaaggaaacaccaatatttaagaaatgaggtcatgaagcacaagaaggtaatatttggctacatcaaaagctaccaaaagtgcaagcagcttgaaagtttaagtatccattgtagaacttccacttctagccaccaggtttatgacaggaagcagaattatctgtcagctgcaaatagctacaaaactcaacaaaatgtaagaaactattttcagatgctggctatcaggcattccagaactggatatactgaggtccccaagagaaggagaagaaataagatgagccctgccatcgcccaggctttagatctagagactatgtcagactgtagcacaggaaaagaagaactcaaagagaaccaagtaattttgctgagttgaagaaatagagcttagagtttggtgaggaatcaaggcaaatggaaattccattacagagtatcgggagaagggagctatgcagggaaaaggttcagcaatctatctagaggtttccatgaaatgccaatctgtgcatgcttacaaaacactcctcaaagcccagcaaaaccagtttcttaaggcgaaaaaaaatgaccagggaggaataaaaagcaaaattcccagacaaggcaatttatcacaaaatatcacaaggcagggaatctttcccactatccagagttgaaagaactccacgaatacaaaggtcattcagaaaagaactcagaacagcattattttagaaaggagattatattaccaaaagataaaggatattccagattctccctagaggagcttaaaaactaacctcaaaagcatcaagccaaaccacaagacaacttgcttaactgcctaccagaacgagtctgtaacttcttaagcaaagcaaaattcaacattcacaaatgtaaaattaacaatgtcaaaaaaataaaaaaaaaaattattaaacctatgagtaatcaggaactataactcataaagagaaaaattagccaataaaacagacccagaaacgaggtggtgaaattgataaaaatcttaagaaaacctcttatgaatatactttcacatactcacagatgttaaaggaaatggaaggtagggggaaagataaatggaaatttaagagataaaaaataaaatatttgctttcgttgctgcagcagacgctgtgagtattttcaatgcttcagaagaggcttgcctctagtgtcctccgctgtggcaaaaagaagatctggctggacaccaatgagaccaatgaaattggccatgccaactcctgtcagcagatccagaagctgatcaaagatgggctgattatccataagcctgcgactgtccgttcctgggctcactgccaaaaaagcaccttggcctgccagaagggcaggtacatggtcataggtaaacaaaaagggtacagccaatactcaaatgccagagaaggtaacctgggtgaggagaataggaattctgcatcagctgctcaaagatactgtgaatctaaaaagactgatcgccacatgtatcacagcctgtacctgaaggtaaaggggagtgtgttcaaaaacaggtggattctcatggaacacatccacctgctgaaggcacacagacccacaagatgctcctggctgaccaggcagaggcctgctggtctaagaccaaggaagcatgcaagtaccatgaagagcgcctccaggccaagaaggaagagagcatcaagactttgtccaaggaggaagagacgaggaaataaagctccccttctcttgtctgtacatagtggtcttggtgattatacagatcaatcattaaaataaaacaagcctttatctgctaaaaaaaaaaaaaaatctgaaatataaattttgttgaataagattaaaaggagattagacagtgcagcacaaaagatgaaatcatttgaaaaggaaaaagtgttatttaaataaaggaagaaacaaaaagcctgagtcccacatgaaaaagaaacaaatgggatgggaagtaaggaaagaaaagtaaggaaaggaaggagggaaataaggagaaacattttccaaattttatgtaaaccataaacccacacagatgcatcaaattcaacaaatttgaaaagataaaacacacaaagagagaaagaaggagagggagagagagagagagagagagaaccaaaatatattatgatcaaattgctgaacatcagtgagaaagaatactaaaagtagtcacaggaaagacatataggcatatctcagagatactgcaggttcagttccataccgcaacaataaagcaaataccacaataaagcaaataacacaaaaatgtttgttttcccaggatatataaatgtttacactatactgtagtctattatgtgtacaatagcattatgtctgaaaaaacaacgtacataccttaatataaaaataatgtttgaggtgaaggatacccactatgccctgatgattgttatgcattatatgcctgtatcaaaatatctcatgtacccaatatatacacctactatgtacccataaaaattaaaaataaaaaagattttaaacactttattgctaaaaatgccaatgatcatctgagcctacaacgagtcaaaatctttttgctggtggagaatcttgcctctatgttgatagcttctgcctgatcagggtggtggttgcaaaaggttgggttagctgtggaaatttcttaaaataagacaacaatgaagtttgccacatcaattaattcttccttcccaaaagatttctctatagcatgtgatgctgtttgatgcatcttactcacaagtagaactttcaaaattggaatcaatcctctcaaaccctgccactgctttctcaattaagattatggaatattctaaatccttttttatttccaagatggcagattagaggcttttagtgggcctcattcacttggaaatagcaagatagtgtacaaaggccaactctgagagctttaattcacaaaggaaaacaggaatccactggaatcgtgacagacacctcagatccaaggaagacacacaaacacaaacagcccctattatggcatccaattgataaaagtgagggaagcccaagtatgcaagacagtcagaaagcctccctctgtgactcacttttccactggagatctgagcaacccaggtcaagaaagagcactttgtttcttctaagccctggatctaacttggggacaagctgatttggagatgctgtgagggacagacactcggaaaagctactggcatttcccagacccaggatggagagcaggacactattttaaatgtgggtgcatgcaagtcaaccattctttggcaacccagtagcatggccacataggcttctggctctggagcaggacagaggtcttcacagccacactgtagttagtgcctcagcagtaggtgctgggattgtgctctcctccactgcaggtcaaggatgagagaagagctgctacagctattgtttctcctggacaaccagacttcaagccagatccagcttagcaacctggaactggtctgcatgtgccatgattggttgccacagcctgttcccctgtggtgcagcagggccctctctgctctactccctggcaaaaatccaggcatttggagcaactgtttgcctggacaagcaggctgaaccacctcacccttcatggatatagatcatggcacagtggaggcctctctgctccacatgcaggcagatctagagctattcagagcaccccctcacctgcaaccgcagtctgagttgccttacccttcctgtgtgtgcatagattgtggtacagtggggccctctccactccacatggagacagatacccaggcatctaatgcacctgctcacatggactagcagattgagttgccccacttttcctgtgcagagattctgtgcaggggggccctctctgctccatgcccaggcaaatctccaggcattcagagcatctgctcacctgaatcagcagcctgacttgcctcacccttcctgtgcagagatcctagtgtagggaggccctctctgcttcacactcagacagatctcccaggcattcagagcacccactcacctggatcagcagcctgaactgctccatccttctatacatagattatggtgcagcaaggcccttccactccattgcccaagaagatctccagatattcaaagtacctatttgcccaaattggcatattgggccatgccactcttcctatgaagagatctgggtacaggcaggccctccctgcttcatgcccaggcataactccaggcattcagagcacctgcttgcctggttcagcagcctacatcaccccaaccctcctccgcagaaatcttagtggtggtggggtggcagggggaccctttccacttcatatccaggcagatgtccagccatctggagcacctactcttcaggattaggagtttaagctgccacccatccctgtgcagagaacttagggccaaggaggtctcccagcttcatacccaggtacacctctgggtgcttggtgactacccactggattctccctatgcgctgacacttgtgcttgccactggagggtctggcggtgagcctgcccagtccagccctgcatatctttccctctgccccctcagggctgagcaggaaactcagactactgtacactccacaaatcagcccactgcctgaggcaacggagagctgctcccagtaaacaaggatcaaatatatacccagtcacactggcaacacctggctcttacccataagcttataggccaaactacacagcccaatataaaacctgccaactgaagtgcataggactataaaaacaaagccaaaagactctacacagcattatttccactcacaacccctaaggagtaggggaaagggaaagaagaaaaaaacaacattgtaagacaagaaagaaaaaatcctaccagtacgaaaataattacacaaattagcagtgccagtgtctccagatgggaagaaaccagtacaagaatactggcaccatgaaaaaatctgaatgtagtgccaccacagaaggatcacactagctctccagcaatggtccccaaccaacaaggacactcagaaatgacaaagaactcaaagcatgggttgcaaggaagctcagagatccaagacaagattgaaaatcaatactaaaaaacttcaaaggaaatccaggaaataagaggtaaagatttttaaaagaaatcaatcagagcttctggaaatgaaaaaggtttacttaagaaatttcaaaatataactgaaagctttatcaatagactggaccaagcaaaagaaagaatttcaggccaggcatggtggctcatgcctataatcccaacacttgaggaggctgacgtaggaagaccatttgagccaagtagcttgagaccatcctggaaaacataaagagaccgtgtctttccaaagaaatttaaaaattagctgggcatgatggtttgcacctatcgttctagctacttgggaggctggggtgaaaggatcacctgagcctgggagttcaaggctgcagtgagccatgatcacatcactgcaaaacagatgaacaaaaggaaaaaagaagaaaggaatgaaagctgatcttttgaactaacccagtcaacaaaaatagaggaaaatgaacttttaaaattgaacaaagtctttaagaaatacaggattatgtaaagcgatcaaacctataaattattagcattcatgatacagaaagagaaaaagcaaacaacctggaaaatatatttgaggaactaactcaaaaaaatttccctaatcttgctagagtagtagacatccagatacaacaaatccagacaacaactgtgagataatatacaaatccagacaacacttgtgagataacatacaaaatgaacatcaccaaggcatatactcaccaggccgtccaaggtcaatgtggtgcggtggctcacgcctgtaatcccagcactttgagaggccaagacgggcagatcaagaggtcaggagatcgagaccttcctggccaacatggtgaaaccccgtctctactaaaaatacaaaaattagcttggtgtggtggtgcatgcctgtagtcccagctactcgggaggctgaggcagaagaatcacttgaacccaggagctggaggttgcagtgagctgaggtcgcaccactgcactccaatctggcaacagagcgagactccacctcaaaaaaaaaaaaaaaaaaaaaaaaaaacaagaactgaaggaagagatatttaatgaaatagatagcataaataaaaaaacttcaggaaacaatggacacatttacagaaatgcaaaatgctctggagagtctcagcaatagaatcaaacaagcagaagaacgaacttgagagctcaaagacaaggtttttgaattaacccaatccaacaaagacaaaggaaaaagaataagaaaatatggacaaagcctccaagaagtctgggattatgttaaacgaccaaacctaagaataatcagcattcctgagaaagaagataaatctaaaagtctggaaaatatatttgggggaataattgaggaaaacttcccagccttgatagagacccagacatccaaatacaagaagctcaaagaacacctggggaattcatcacaaaaagatcatcgcctagacacactgtcatcaaattatctaaagttaagacaaagaaaagagtcttaagagccatgaggaaaaagcaccaggtaacctttaaaggaaaacctatcagattagcagcagatttctcagcaaaaactttacaagctagaagggattgcagccctgtcttcagcctcctcaaacaaaacaattatcagccaagaattttgcacccagcgaaactaagctacataaatgtcggaaagatacagtctttttcagacaaacaaatgctgagagaatttgccactaccaagccagcattacaaaaactgctaaaaggagctctaaatcttgaaacaaagccagaaaacacatcaaaacagaacccctttaaagcataaatctcacaggacctacaaaacaaaaatacaatttaaaaaacaaaacaaaacaagaaaaccaaggtatacaggcaacaaatcgcataatgaatggaatgatacctcacatctcaataccaacgttgaatgtaaatagcctaaacattccacttaaaagatacagaactggccgggcatggtggctcacgggggtaatctcaatactgggaggccgaggcaggcagatcacaaggccaggagttcgagaccagcctggacaacatggtgaaaccctgtttctactaaaaatacaaaaattagccgggcgtggtggtgcgcgcctgtaatcccagctactcaggaggctgagacaggagaactgcttgaacccaggaggcggaagttgcagtgagccctgattataccactgcactccagcctgggtgatggagtaagactccatctcagaaaaaacaaacaaacaaacaaacaaaaaaaaaaatacatatataattgcagaacggataagaattcaccaaccatctgctgccttcaagaaacacacctaacacataaggactcacataaacttaagctaaaggggtggaaaaagacattccatgcaaatggacaccaaaagcgagtaggaatagctattcttataccagacaaaacaaactttaaagcaacagccattaaaaaagacaaagagagtcataaaaggccttgtccaacaggaaaatatcacaatcctaaatatatatgcacctaacactggagctcccaaatttataaaacaattactaatagacttaagaaatgagacagcaactataatagtgggggacatcaacactccactgacagcactagacaggtcatcaacacagaaagtcaacaaagaaacaatggatttaaactataccctggaacaaatggacttaacagattatacagaacattctactcaacaactgcagaatatacattctattcaacagcacatggaactttctccaagatagaccatatgagaggccacaaaacgagcctcaataaatttaagaaaactgaaataatatcaagtactctctcagaccacagtggaataaaatggaaaatcaactctaaaaggaaacttcaaaatcatgcaaatacatggaaattaaataacctgcttttaaatgatcattgggtcaaaaatgaaatcaagatggaaatttaaaaattcttcgaactgaacaacaatagtgacccaacctatcaaaacctctgggatacagcaaggcagtgcttagaggaaagtttataaccctaaatgcctacatcaaaaagtctgaaagagcacagacaatctaaggccacacctcaaggacctagagaaccaagaacaaaccaaacccaaacccagtataagaaaggaaataaccaagatcagagcagaaataaattaaattgaaacaaaaaaaatacaaaagataaatgaaacaaaaagctggttctttgaaaagataaaataaaattaatagaacattaacaagattaccaagaaaagaagaaagaaaatccaaataagctcaattagaaccgaaaagggagatattacaactgataccaaggaaatacaaaagatcattcaaggctactatgaacccctttatgtgcataaactagaaaacctagaggagatagataaattcctggaaagataaaaccttcctggcttaaatcaggaagaattagataccctgaacagatcgacagcaagcagcaagattgaaatgataatttaaaaattacaaacaaggcacctgggaggccgaggcaggtggatcacctgagatcaggagttcaagaccagcctgcccaacatggtgaaaccctgtctctacttaaaatagaaaaaagtagctgggcgtggtggtaagcagctgtagtcccagctactcgggaggctgaggcaggagaattgcttgaacccgggaggcagaggttgcaatgaggcgaaatcgcgccattgcactccagactgggggacaagaaggagacttcatctcaaaaaaaaaaaaaaaaaaagtccaggactagagagattcacagcagaagcagaagtctaccagacattcaaagaagaattggtgccaatcctactgaaactataccacaagacagaaaaagaaggaaccctcccgaaatcattctatgaagccagtatcaccctaataccaaaaccaggaaaggatgtaaccaaaaaagaaaactacagaccaatatccctgattaacatataagttaaaatccttaacaaaatactagctaaccaaatccgacaacatatcaaaaagataatccaccatgatcaagtgggtttcataccagggatgcagtgatggtttaacatacacaatgtgatgatacaccacgtaaacagaatcgaacacgaaaatcacatgatcgtctcaacagatgcagaaaagcattcaacaaactccaacatccctctatgattaaaactcagcaaaatcagcatacaagggacatacctcaatgtaataaaagacatctatgacaaacccacagccaatgtaatactgaataggaaaaagctgaaagcactccctctgagaactggaacaagacaaggatgcccactctcaccactcctcttcaacatagtactggaagtcctagacagaccacttagacaagagaaagaaataaagggcatctaagccgggtgtggtggctcacgcctgtaaccccagcactttgggaggctgaggcaggtggatcacgaggtcaggagttcgagatcagcctggccaacatagtgaaaccccgtctctactaaaaatacaaaaacttagttgggcatggtggcaggcgcctgtaatcccagctacttgggaggctgaggcaggagaatcacttgaaccccagaggcagaggttgcagtgagctgagatcgcgccattgcactccagcctgggggacagggtgagactccgtctcaaaaaaaaaaaaaaggcattcaaatcggttaagaggaagtcaagctgttgctgtttgctgatgatatgattgtttacctagaaaaccctaaagactcccacagaaagctcctagaactgataaaagaattcagcaaagtttccagatacaacattaatgtacacaatcagtatctcttctatacaccaacagcgaccaagctgagaatcaaatcaagaacttaactcctcttacaatagctgcaaaaataaataaaatacttaggaatacacctaaccaaggaggtaaaagacctctacaatgaaaactacaaaacactgctgaaagaaatcatagatgacacaaacaaatggaaacacatcccatgctcattgatgggtagaatcaatattgtgataatgaccatactgccaaaagcaatctacaaattcaatgcaattcccatcaaaataccaccatcattcttcacagaattagaaaaaacaatcctaaaactcatatggaaccaaaaaagagcccacatagccaaagcaagactaagcaaaaagaacaaatctggaggcatcgcattacctgatttcaaactatactctaaggccacagtcaccaaaacagcatggtactggtataaaaataggcacatggaccaatggaacagaaagaacccagaaataagcccaaatacttacagccaactgatattcgacaaagcaaacaaaaacaaagtggggaaaggtcaccctattcaacaaatggtgctaggacaactgacaagccacatgtaggagaatgaaactggatcctcatctctcaccttataaaaaatcagctcaagatggatcagggacttaaatctaagacctgaaactataaaaattctggaagataacattggaaaaactcttctagacattggcttagtcaatgatttcatgaccaagaacccaaaagcaaatgcaataaaaacaaagataaatagctgggacttaaactaaagagcttttgcacgacaaaagaacggtcagcagagtaaacagacaacccatagagtgggagaaaatcttcacaatctatacatctgacaaaggactaatatccagaatctaaaacaaacacaaacaaattaagaaaaaacaaacaatcccatcaaaaagtgggctaaggacatgaatagacaattctcaaaagaagatatacgaatggccaacaaacataggaaaaaatgctcaacatcactaatagatcaagaaatgcaaatcaaaaccaaaatgcgattccaccttacttctgcaacaatggccataatcaaaaaataattgatgttgtcggggatggagtgaacagggaacacttctgcactgctagtgggaatgtaactagtacaaccactatggaaaacagtgtggagattccttaaagaactaaaagtagggctgggagcagtggctcacgcctgtgatcccgacactttgggaggccgaggtgggcagatcacctgaggttgggagttcgagaccaggctgaccaacatggagaaaccccgcccctactaaaaaaaaatacaaaattagctgggcatggtggcgcatgcctgtaatcccagctacttggaagactgaggcaggagaaatcactttaacccaggaagtggatgttgcggtgagctgagattgcaccattgcactccagcctgggcaacaacagtaaaactccgtctcaaagaaaaaaaagaactaaaagtaaaactaccatttgctccagcaatcccactcctgggtatctacccagaggaaaagaagtcattataagaaaaagacacttgcacgcaagtttatagcagcacagttcgcaattgcaaaaatgtggaaccaacctaaatgcccatcaatcaacaactggataaagagactgtatgtgtgtgtgtgtgtgtgtgtgtgtgtgtattacatatgtgtgtacatatatgtgtatgtgtgtgtgtatgtatatatatgatggaatactactcagccataaaaaggaatgaattaatggcattcacagcaacctagaggagattggagactattattctaagtgaagtaactctggaatagaaaaccaaacatcatatgttctcactgatatgtgggagctaagctatgaggacgcaaaggcataagaatgacacaatggactttggagactcagggggaaagggtgggaagcggataagggataaaagacgacaaattgggtacagtgtatactgctcaggtgatgggtgcaacaaaatctcacaaatcaccactgaagaacttactcctgtaaccaaacaccacctgttccccaataacttatggaaattaaaaaaaaattttaataaaaaaatggagaaaccccatctctacaaaaaatacaaaaaattagccagatgtggcggcacaagcctgcagccccagctactcaggaagctgagatgggagaatcacctgaatctgggaggttggagccgaaattgtaccactgcactccagtctgggcaatcagagtgagacagtctcaaaacaaacaagcaaacaaatacttctagacctaggaaaagacttaaacaaccatacataataatgggagacttcaacagcccactgactaatgcattagcctgaccactgaggcagaaaactaacaaagaaattctggacttaaattcaacacatgatgaattggacctaacagacatctgcagactacttcatccatcaaccactgaagatacactgttctcgtctgcacatggaagatactacgagatcaaccacatgctcggccataaaacatgtctcaattaattcaaaaaaaaaacaaaatcataccaaccatactctcagaccacagtgtaataaaaataaaaatcaataccatgaagatctctcagaaccacataattacatggaaattaaacaacttactcctgaatgacttttgggtaaacaattaaattaaagcagaaatcaaaaagttctttgaaataaatgaaaacagagtatcaaaatctctgggaagcagcaaaaaagtataaacaggaaagtttacaacactaaacacctacctcaaaaaatcagaaaaatctcaaatcaacaatctattatatctagaggaactagaaacaaaagaacaaactaaccataaagacagcagaagaaataaaagcaaagaactaaatcaaattaagaccaaaaatacaaaggatcgatgaaacaaaaagttggttttctaagaggaaaaacaagaccgacagactgcaagctagattaacaaaagaaaaaagagagagaagatccaaataagcacaatcaaaatgacaaaggtgacaagcaaccaatgccacaaaaatacaaaagttccttagggacaattatgaacactcctatttacgcaaactagaaaacctagagaaaatggataaattcttggaaacccacaatctcccaagattgaatcaggaagaaatagaaaccctgagcagacatcagtattgaattctgaaattgaatcaataattaaaaacttatcaaccaaaaaaatccctggaccacatggatttacagccgaattctatcagatgtacaaagaagggctggtatcaatccttctgaaactattccaaaaatcaaggaggaactcactgcaactcattcgaaggatgcatcaccctgatacgaaaacctggcaaagacacaaagaaaaaagaaaactacaaaccaatatccctgatgaacataagacacaaaaatcctcagtaaaataactagtaaaccaaggctcggcacagtggctcacgcctgtaatcccagcactttgggagcctaaggcaggtgggtcacctgaggttgggagttcgagaccagcctgaccaacatggagaaaccccggctctactaaaaaacccaagttagccaggcgtggtggtgcatgcctgtaatcccagctactccagaggcttgaggcaggagaatggcttgaacccgggaggcaggggttgctgtgagacgagatcgcgccattgcactccagcctgcgcaacaagagccagacaagagcaaaactccgtcgcaaaaaaaaaaaaaaaaaaaaaaaaatatatatatatatatatatatatatacatactagtacaccaaatccagcagcacatcaaaaacttaattcactgtggtcaagtaagtttcattcctgggatgcaaggttggttcaacatatgcaaatcaataaatgtgatccaccacataaacagaatttaaaataaaagtcatatgaccatcccaacagacatggaaaaagctttcaataaaatccaacatcccttcatgataaaaaaaaaaaaaaaaaacctcttgaacaaactagacatcaaaggaacatacctcaaaacagtaagagccatctatgacaactccacagccaacatcatactgaataagcaaaaaatggaagcattccccttgagaactggaataagacaaggatgcccactcttagcacccctattgaacacagtactggaagtccttgccagaacaataaggcaaaagaaagaaataaaaggcatccaaatagaaaaaggagaaggcaaacaatatctcttcacggaaaatatggttctatacctagaaaacctgaaaggctccaccaaaggctcctggaactgataaactacttgagtaacgtttcaggatacaaaatgaacaaaaaccagtagcatttctatacaccagtaacgttccagctgagagccaagtcaagaacacgatcccatttacaatggccacaaaatacaatacaatacaatacaatacaatacaatacaatacaatacaatacaatacaatacaatacaatacctaggaatacatctaaccaaggggatgaaggatctctacaaggagaactataaaacactgctgaaagaaatcagagatgacacaaacaaatggaaaaacatttcatgttcatgaagtggaaaaatcaatatcattaaaaataaaaaacatttcatgttcatgaagtggaaaaatcaacatcattaaaatggccacacagcccaaaggaatacacagattcaacactattcctatcaagctaccaacatcattttggacaaaactagaaaaaaactattctaaaattcatatggaaccaaaaaagggcctgaacagccaaggcaactgtaagtaaaaaggacaaagtcagagatatcacattacccaacttcaaactatactataaggctactttaaccaaaaaatcatggtactggtaccaaaacagacacatagaccaatggaactgaaaagagaacccagaaataaagctgcacacctacagccatctgatcttcaacaaaattgacaaaagcaatagggaaaggactccttaattcaataaatggtgctgggatagctgactagccatacgcaaaagaatgaaactggacccctaactcaagatagattaaagatttaaacagaagacctcaaactgtaggaatcccagaagaaaaaagaggaaacaccattctggacatcagccttgggaaagaatttatgactaaaagcaattgcaaccaaaaaactgacaagtgggacctaattaacctaaagagctgcttttgtgcagcaaaagaaactctcaacagagtaaacagacaatctacagaataggagaaaatatttgcaaactatgcagccgtcaaaggtctaatatctagaatctgtaagaaacttaaatcaaaaagtaaaaagcaaataatcccattttaaaaatcggcaaaagacatgaacaaactttcatcaaaagaagacatacaagtagccaaacatatgaaaaaatgctcaacatgactaatcataagagaaatgcaaatcaaaaccacaataatataccatttgtaccagtcagaatgacaattattaaaaagtcaggcctcggatttctggactgatagtgagcactggcttcaacttaaagtcaccaacctcaccagtccctaacaagaaagtcagcctgtactttgaagttttgaagccagccactgacatcttttccctagctatgacagtcctagatgacaccatcttccagtagaaagctgtttcatctacattgaaactctgttgtttacagcagctacactcatcgattaccttaactagatcttctgataacttattgcagcttctatatcagcatttgctgctagtgggtggtttcttggcccacctgaagggcagacagcttttgcttctacttgcccatcagaaacatgattttttgcctggagtcagaatgaaaaatattcctatccttcccccatcagcagatggcttttccttctctctctctcccttaggacaagtatatcatgtgcaaggattggaagacaatatttttaaactcaatcctccccagtttgagcttagatcaaggcaataagaatcaaaatcccagaagcctttctggtatgtcattacacatcactttgaaaggtgcatgccaaaactgagagaaagtaagataactgactgcaaaggaacacaacacaactttttgaggtggtagaaatgttctaaatcttgatttgggtgagttacaggattatacacactttgtcaaaactcatcaaactgcacacttagagaacatgaactttattatataaaaatattaatgatcctatcttttaaaacttcagccagtttttctagtagaaattgacaagctggcaatcttagagtttgtgtattttcttcaatgctgctcagaactctgacagtagaatttgtccagagttagcattttccaggcagatgccacagaacaacaatgatataagggagttaaagatattagcaaaagaatggttgatgaaatagaccgagcagagaaagaaattttaaaagagggaggggaactaatgagcagggagaggaataaagtagaaacattttgtgaacgattaaagagcatattcctatagaaagagaagcaatcttttttaaaaattgacaattgtgccttagaaatcaaagagacttcaccttcatggctaagctcaagatgaagccatccacatgatacagcaatagaggcagcactatactaacaaatctcattaatattaaaccaaacaagtaatctaatggctacattattctccaggagtaaaaagtttgcttcaaggcagctcataatctggctcactttaaacaaataagtcaaagatcccccaaatgaatccagtaaacacgagaattttctatatttctatatttctatgtcaatataaaatacacatacaacacaattttctattttcctgacttggcaaacacaatataatgtacagagtttcatctgtctttgacatattgtgaattttaacacctcagaatatcatcataaaggtaatgtttttaatcaaaggcccccaaaaacgttattcttgactgagtggctttagagcatgtactcttctagttgcttgggaattttgtggagaacaagttacccacaaagtacctctcctggaagttaaaacagaggatttcttatatgcttaggcagacatactctagaatcatctttttaaaataagcaactagcaaatgcaatctggttttcctattgctatgttttggatatgtcccctccaaaattcaggtgctgaatctaaacggtcaatgtcatgtattaaaaggtggggtactttcagaagtttgaggttatagtgagctatgatcatgccaccacactccaacctaggcaacagagcaagaccctttaaaaaaaatcaggcctttaagaggtaattaggtcatgagggctcctcacctcgtgaatgggattaagaccctaatgaaagagatttcacccctgtcctttcacaatgtgaaaacacagcattcctcaccaccagaggatatagcaacaagacactatcttggaggcagagagcagcccttattggacaaccaaacctgctggcagcttgatcttggacttcccagtctttagaaccatgagtaaataaatttctcttctttataaattacccagtctatggcattttgttacagcagcacaaacagacttaagacatctatcatttgactatctcattaagtttaggcaagagcataatctcctattatactggcaatggaaatatactgaatcaaagataaaagcaatcatttttaaacattagtattacatgcagtgcaaaaacccaaagtgacggcagtcttacattgccaaagccatcaaaaggggaaggagagggaagaacagcagcataagctgctggcagaggcagggaaagacaagcagaaaggaaagagagaaagagacaaagtcagagagacacaggggaagagacagagagaaaaagagggagtcacagagaaagagagagacaacaaagaagtcaaaaagaaagggagatagaattagtaaagaaaaaagcagtgtaccctattcctttaaaagccagggtaaggttctgtctacccagccaaggtatattcttcttatgtggaatgtctacctatatctgcctccccactaactggaccggcacctgcaccttagtctttccaagttccaacattaacattgccccaggaaatcagaccctatcagtacccctcaaagctcaagtccatcagcacagagccatacaactaatacccctacttaatagggttaggaatggctactgctacaggaaccggaagagccagtttatctacttcattatcctactaccacacactctcaaaggatttttcagacagttttcaagaaataatgaaatctatccttactctacaatcccaaatagactctttagcagcagtgactctccaaaactgccgaggcctagacctcctcactgctgagaaaggaggactctgcaccttcctaggggaagagtgttgtttttacactaatcagccagggatagtacaagatgccacccagcgtttacaggaaaaggcttctgaaatcagacgcctttcaaattcttataccaacctctggagttgggcaacatggcttctcccctttctaggtcccgtggcagccatcttgccgctactcgcctttggaccctatatttttaacctccttgttttgtttcctctagaattgaggccaccaagctacagatggtcttacaaatggaacctcaaatgagttcaactaacaacttctaccgaggacccctggaccgacctgctggcactttcaatggcctagagagctcccctctggaggacactacaactgcagggccccttcaaagcccctatccagcaggaagtagttagagcggtcatcggccaaattcccaacagcagttggggtgtcctgtttagaggggggattgagaggtaacaacgtgctagcagccctcactcactctcagcacctcctcggcctcggtgtccactctggccacgcttgaggagcccttcagcctgccgctgcactgtgggagcccctctctgggctggccaaggccggagccggctccctctgcttgcgggaaggtgtggagggagaagcgtgggcaggaaccaggactgcgcgcagcactcatgggccagcacgagttccgggtgggtgtgggcttgatgggccccgcactcagagtggccagctgatgccgccagccctgggcagtgaagggcttagcacccgggccagcagctgcggaaggggcaccgggtaccccagcactgccggccctcccgcgctgagctcgaattcttgccaggcctcagccacctccccacagggcagggctcaggacctgcagccccccatgccagagccccccccaccaaggtgggctcccgtgcagccggagcctccccaacaggcgctggcccctgctccacggcgtccggtcccataaaccgcccaagggctgaggagtgcaggcgcacagtgcgggactggcaggcagctccacccgtggccctggcatgggattcactaggcgaagccagctgggttcctgtgttgggtggggacttggagaacttttatatctagccaaaggattgtatatgcaccaatcagcactctgtgtctagctcaaggtttgtaaacacaccaaccagcactctgtgtctagctagaggattgtaaatacaccaattagcactctgtctagctcagggattgtaaacgcaccaatcagcaccctatcaaaacagaccaatcagctctctataaaatggaccaatcagttctctgtgaaatgggccaatcagcaggatgtgggtggggtcagataagggaataaaagcaagctgcccaagccagcagtggtaacccgctcggtccccttccacactgtggaagctttgttctttcgctctttgcaataaatgttattgctgctcactctttgggtctgcactgcctttatgagctgtaacactcacctcgaaggtctgcagcttcactcctgaggccagcgagaccatgaacccaccgggaggaatgaacaactccagacacactgctttaagagctgtaacagtcaccgcaacggtctgtagcttcactcctgaagccagcaagaccacgaacccaccagaaggaagaaactccaaacgtgtccgaacatcagagggaacaaactccggacacaccatctttaagaactgtaacactcaccacaagggtccacagcttcattcttaagtcagtgagaccaagaacccaccaattccagacacattaggatatgccttttttttttcagtgacatccaaattctctagcacttcaaaacagtaagcttgttgtatctcatttttgttgtttcctgttcaatgtaagaatttccagccagaaacagtggctcatacctgcaattccagcactttggaaggtcgaggtgaaatgactgcttgaggccaggaattcaaaactagcctgggcaatgtagcaagatcctgtctctacaaaacattttaaaattagccaggcatagtaatgggtgcctgtagtcctagctattgaggaggctgaggcaggagaatcccttgagcccaggagtatgaggttatagtgagctatgactgtgccactgcactccagcctggactacagagcaagaccctgtctcttaaaaaaataaaaaaggaaaaaataattctgtcaaaatttttcctagctctcaatacaaagttttctaaatcttgaggggaggtgaagattctgtatagaatagtctccattttctccaaattcttcctaattttttataatttcaagaataagttacatttcaaattataccacagataatgctaatatggtgataaattatttaatattcttatcatttagagatgcatgctacaagttaagaacatatctaagattaacttcaaaataataaaggatgcagtatatataggggaatatattatgtaagattggccaaggaattaataattgttgaaactgggtgatgaatacatataggttcactttctcaactttgctaaactatgtttaaagttctccctaataaaaagatttttaaagagtaaacaataggtattaaatctaattaaattgttcttagaaataattagacacaaaaaacagtattaattgtaaattatttataacaaaatttagaaggaaattaaatgtccaaacataaaatattaattagttatagaacactcattccatgagataccaagtagccactaaaaatcatgttgcagaaaactcattgatataaaaagaattcacaatatacttctaagagaaaaaaaggcaggttacaaaataatatgtacagaattgaaccattttttaaatgtgagcatctgtgtgtgtatgtgcgtgtttgcatatgtgtgtatttctgccaaatactgacagactttgtttcattcactgctttatccccagcacaaaaaactgtacctggaacataataagaacaatacatacttgttgcaggtaaaggttttagaattccagacaacagggtttcccttggggtatgattctctctacgcttttgtttcatacggtttctcaaataaacattcagttttttctgttattgggggaaaacctttaaaattgtatctcacataacaaaattaaaatttatttgcctgattcaataattacttcatgaaatgcattcaataaaatcatcttatacactgaaaaaagaaaggcctcttctatactttgaatgaataaactggccacggcaatcagaaatagtaaaaacaggccaggcatggtggctcacgcctgtaatcccagcactttgggaggccaaagcaggcagatcacgaggtcaggagatggagaccagcatcctagctaacatggtgaaaccccgtctctactaaaaatacaaaaaattagccgggcatggtaggggacgcctgtagtcccagctactcgggaggctaaggtaggagaatgacatgaacccaggaggcggagcttgcagtgagccaagatcgcgccactgcactccagcctgggcaacagagtgagactctgtttcaaaaaaaaaaaaaaagaaaaaaaaagaaaagaaatagtaaaaacaataacctgttaatcagtcttatccctgtgagtgaattctgctgctgagcaataacataaccttactatctttaggaaactaatacttctaaaatgaatctttaaaacgggtacaaaaaattataaaatcagttttaaaaaattagtccattatattcattcaatacacacttactgaatttgtagacaataagttacctgctagggtaatccaaagaaaattaagttgtagcccttgataaccaagaggctcccaatctagtgggaaagatagatgaataaaagctaaatgaaacataataataaaggtagctgacatttattaggttctttttttggcattgtgctgacacttaacaagcattttctttcttttttttttgagacagagtctcactctgttgcctaggctggagtgcagtggtgcaatcttggctctctgcaacctccgcctcccaggttcaagcaatcctcccaactcagcctcccaagtagctgggattacaggtgtacaccaccacgcctggctaatttttgtatttttagtagagatggggtttcaacattttggtcaggctagtcttgaactcctggcctcaagtgatccgcccacctcggcctcccaaagtgctgggattacaggcgtgagccaccacacctggccaaacaagcattttcttatttaatccctataacaatctttttggtagttactacgatattctcagtttttagataagaaaacgttaagacttaaatgacttcctcagtcacttgagtaataaatggcaaaacagaatcaaaccaaataaaccctgtcccagatacaatatagtgtctctcattattaggatgctagtaaacaccaaagtggactctatcagttccatcagttactatcaagtataacacaatagtcaccttttttaaggtagatatccttttggaagtcttcccaagaatttcttatcttcaactcaactagttatctccactttgaaatacactattacaaccattaacctatgagcctctagagcacaggattcagtagtttctcttctcccagtgctatacaatgtatgcactcaagaaatattaaacagatgaacttttagcttcttttatgcttcctaaattccaaatcactatgccatattacataatagttggtctaggtcaatagcaatttcatttatgttattaggaaaatgtggtatgagagaatcagagaataaaattctgaagtgctaaattatggtggttatgctaatggcggaacactgctgactgtataagatgaaccaagatactcttcctccagggacttcttcctaatcttctaaatgtcctataagccaaattttataagagaactggaaatgtgcaaaactagggggtagttttgtttcttgcaaaaatctggtgataaagatctgagctaaaaatagcgagaatgatgggaaataattcaagagatatttcaaaagcagaatcatttctcactacatgcaagacaaaactcataactaactgcggaacctaagaccttctcagtcatctcatttctgtttcctacagcctagccagagtgaactacttcttaaaggtcctgaattctcacataacattttaaaactcccacaataactgtaatataggccgggcgcggtggctcacgcctgtaatcccagcactttgggaggccgaggcgggcagatcacttgaggtcaggagttccagcctggccaaaatggtgaaaccccgtctccactaaaaatacaaaaattagccaggcatggtggcgggtgcctgtaatcccagctactcgggaggctaaggcaggagaattgcttgaacccaggaggcagagttgcagtgagccaagatcatgccactgcactctagcctgggcgacaagagcaaaactccatctccaaaaaataataataataataataataataactgtaatataaaaagcagatagtgtgcagtcacttgtatgttacataagaaatagacagtagaacacaggaatgggaaaggcattcaaattttgtgttggaaaatgaatgaatgaagataatgcaggagaccttcataactgatttgagaagggactagcagctatctcttcatgatgagataatacaggccctacctctatatcaccattttctcttacaacatgatcttccccttctctctgcctgtcaaaattaaccacctccttaaagacacaatcaaaaattttctctgggaagtttaaagaaatcacctcctcacttctaccactgtccccacccatccacacaagcacacacacatacacaaagaactagtcccactgtctactatggtcccacagcacttggcacctgcctcattgtagtacttagtacagtgattcattattcctttcattattatgtactgtatgagaatatcactagagctagaatatgaattccataaagatatggatcatgtcttatctagcctatttccattaaatacctaccacagaacctcacacactactgtttaaataacatatctaataaataaatgaataaacaaatgaaaacaaatttgctaactcctggagacctaaaggaacctcaaaatgtctgtgacttaaaacatgcctttatgggaaaaaaaaaatatatcttcctatataaacgcttatggctaaccatgacctgcttcaacttaaatcagttttgctaccacagcaataaaaaatacacatatatggctagaagtcgatgcaaaggccaaaagcatccctaccagggctgaaatggccaatggggatattccaaattttatggttgcaaaatgacccaattaatcttagatttcagcaaagtatacatgctaactgaacaaagacaaaagtcactggagctcaagtcattattccaagtgactctaagctgttagtccctgtgttaatggagcctgttaaacaacccagtattagaaaacactggagctcagagggagcatgctaccccatgcacatttcccaagtatcctcacaataaacttctattactgaagataatctatgtacttctctaccttgagtcttaagagacctaagtaacagtaaataatataggaaaccaagcagaggaaagaatcacacaccaaatgtgaactggaaaaagtgacaacgccaattagtaaagattaggtgggctgaacacggtaagattaggtgggctgagcacggtggctcacgcctgtaatcccaacactttgggaggccaaggcaggcggatcacaaggtcaggagatcgaaaccatcctggctaacacagcgaaaccccgtctctactagaaatacaaaaatttagccaggcgtggtggcgggcacctgtagtcccagccacttgggaggctgaggcaggaaaatgccgcaaacccaggaggtagagcttgcagtgagccaagatcgtgccactgcactccagcctgggcgacaagcgagactccgtctcaaaaaaaaaaaaaaaaaaaggattaggtagaaggtgaggattcagttctgaacataatgcctttaaggagacagtaatcaaatatttgggtttttggttttgggggtttctgttttgttttggagacagagtctcattctgttgcccaggctggagtgcaatggcatgatcttggctcactgcaacatctgcctcctgagtccaaacaattcttgtgccccagcctcccgaggagctgggattacagaagcacactaccatgctcggttaattttttgtatttttagtagggatggggtttcgccatgttggccaggctggtctcaaactcctggcctcaagagatccagccacctctggctcccaaagtactgggattacaggtgtgagccactgtacccgaccagtaatcaaatgttatttaggagactggaaatagtgaataagactgagtacaaaaattccaagtctcaaaagtatttgtgggtcatttcaatcaaattgaagccattagagtagataaactcaccaaggaaataactatgcaaaataaataaataaaggaggaaaagatagaaaatgcaaagtcactgtcaattatgcactgtgaagatcagttcataaccgaacataaagcaggcagagaaacagaggcaacaggagaatcaaaatgccagagaaaacttcaagaaacagatatgaggaatgttaagaacagagaaaaagtttctggtcttgccaaaacaataactaatttgcaacctagagtagtttcattaataaacaaggcctgaccatgttggaaggctgaaacagaatacactcgtagaaacagatttttaaactggggggcaaaagtgtgattacaggaataaagtcctaagagctatgaaaagggacatgttcaaaggtcagataaaaggaagaagagaaaaaattgtcgtgtgacagaagcaaaaattatgtagaacaataatcaaatgaaattaagatgaaagtacataaggcagcacctcttcctaacagccactgtatttcaatcttctctaagaagtagcagaaagcatctgtgttaaattatatgaaaacatgagggcaggacaggaaagaaagtgtgaagtgagaggactggagctgtttctgaaaagtctgcaaacaccaaaacacatgaaacagctcagtcagtcataaaaggccttacggcagaaaaaatgaagggactatatttggtcctctttctttattttctctgtttccaaccttggaacagcagtttgcaagtttgtggacaggttgtaacttctgctaaggatgtctcttcagttttgaagagactcaggaaaagttcagaagaaaggagagagctgtttatgattggctaaaggcttttttttattattgtggcagaatatacacaacataaagtttactattttaacatgtacaattcagtgatccatacattcagctcttgtgcaacaattactgttatccatttcccaaactttttcatcatctataatatggtgatctagtaagaaattcctggcacactgcccctaaaacctttggaatttcccgaatgataagggtggaagaattatcttttgctattcataataagtccctttcaaacatatttgagcttatgctaaagagatgactcttggtaggcccctacaaagctgcaggggagtgggtagggaagctggtcacccaagaaatcaatcatgtgattacatagtcagaactttcagccccacctccagggaggggagaaggactagagactgacctaatcaccaatgaccaataatttaatcaatcatgcctacagggtgaagcctccataaaaaccctaaatgatgggactcagagaatttcttctggatcgatgaacacatccacgtgctgaaagagtgatgcaccccaactccatggagacataagctcctgcactggggacccttccagacctcaccctatgtgccttttcatctgtatatcctttataataaactggtaatagtaagtaaagtgtttccctgcattcaatgaatcattgtagccaatgactgaacttgatttgtagccaagtcagaagtaccagaggcctggggcttgcaactggcatctgaagtggtggaagtcttatacaactcagtccttaacctgtggtgtctgacactcactccagggagatagtatcaaaattgaattaaatgctaggacagagaactgagagctgtagggagaaaaccccatgtatttggtgtcagaagtcttataagtgtagaaaaagttttttatcatctccaaccaaaattctatacccattaaataactttccattttccacttccccatagtcccgtgtaaccactattctactttctgtttctatgactttgactattctagtggaatcatacaaatttgtccttttgtgtgtactttgcttcagttagcataatgttttcaaggttcatccatgttgtaacatgtatcagaattttatccctttttaaggctgaataatattccattgtatatatatataccacattttgtttatccattcatccgctggtggacacgtgagttgcttccacctttgggctgttgtacataatgctgctatgaatataggcacacaaatatcttgagaccctgctttcaattcttttgggtattgcattaatccgttctggcgctgctataaagaaatacctgagactcggtaatgcataaagaaaagaggtttaattggctcatggttctgcaggctatacaggaagcatagcagcttctgctctgcttttggggaagcctcaggaagcttccaaccatggtggaaggcaaagggggagtagcacttcacatggccacgtggccagagcaggaggaagagagagagatggggaggtgctacacacttagaaacaaccagatctcgtgagaaccctatcacaagaccagcactgtgggatggtgctaaaccattcatgagaaactgctctcatgatccaatcacctcccaccaggtcccacctccaacactggagattacaatttgacatgagatttgggcagggatacagatccaaagcatatcaggtatatacccagaagtggaattactgagtcacagggtaattctatgtttataatttcttgaggaattgctacactgtttcccacagtgggtgcactatttcactctcctaccagcaatgcacaagggctccaattgctccacatcctcaccaacacctgtgattttctgctgtttttttttttaataatagtcatcctaaagactatgaggtggcatctcattgtagtttccattgcatttccctgattactagtgatgtcaagcatcttttcatgtgcttattggccaatgtatacattttctttggagaaatctctaagttccttgcccactttttatttgggttatttgttttggagaaaagcttttaaagagagacacagaggaaagctttctgtacaatcagatctagctctctagtcaaaaataattggtgatatagtttgcatgtttgtcccctccaaatctcatgttgaaatgtgattcccaatgatggaggtggggcctagtaggaagtgtttgggtcatgggggaggatccttcatgaatggcttggtgttgtccctggcgatgagtgagttctcactctattaattcacaagaaagctggctgtttaaagagcctggcacctcctcttctctcttggtccctctctcttcccatgtgacacacctgctcccccatgccttctgccatgaataaaatcttcctgaagtgtcaccagaaactaagctgatgctgctgccatgcttgtacaacctgcagaaccatgggccaagtaaatctttcttcattaattacccagtctcaggcattcctttatactagcaacacaaaacagactaatacaattggtatctgccctctagatcttttaggaaactaatcatggagaagaggcactggcaagagtgctaacccagcagaagagaaaaaacttccacccctgagaacagagatttctttttcataaagtgccttctacctgatttcagctctgtaactgtcaatctctttttctcttctggcagatttccctatccactagagcataggttttaatgaccacactgctggtagctgtatcactactaatagtagctacttaatgagtcataagtgttactgctatgtgctaggcatgatccttcatctcatatgtgaaatctcatttaaaattaagtcctactaatgatgccgagaagattatcatggttcttacacaaggatgatatgcaaattcattaagtgttccatttaagaaaagaaaaaagaaaaaaaaaaaaaacctcttgtaccctagcagtttcatcttgaatactgttaaaaaaaaaaaaaaatacatctttaaaacacatgaaaggttttcatcctttagtccttcaatgtaacattattaaacgatgtcaaaaagtctcaaagttagcgttaaataacaagcattttctaaattatacattgaggagtctgatcttgaatccacaaaataaaacatcttttctacatcaactacaggaagtacatttttacctcaaactagtaaaatgaaaggttttgttgttgttttttgagacgaagtcttggtctgtcacccaggctggagtgcagtggcactgcagcctccgcctcccaagttcaagcaattctcctgcctcagcctcccaagtagctgggattataggtatgggacaccatacccagctaatttttgtatttgtagtagagacagggtttcaccatgttggccaggctgttctcgaacttctgatctcaagtgatctggccacctcaacctaccaaagtggtgggattacaggggtgagccaccatgcctggccattttttttttcaatcctgctcccttttgccttttaaaagctcaacattttataaatatttagcaaatgtttagctctgaagtaataaagttgatttttcttaaaaaattcaactagaactagaagtgaacatcgtctttttatactcttagaaagttatgtgtttctcatgaaaaaatgttcaccatcactggccatcagagaaatgcaaatcaaaaccacaatgtgataccatctcacaccagtttgaatggcaatcattaaaaagtcaggaaacaacaggtgctggagaggaagtggagaaataagaaaacttttacactgttggtgggactataaactagttcaaccattgtggaagactgtgtggcaattcctcaaggatctagaactagaagtaccatttgacccagccatcccattactgggtatatacccaaaggtttataaatcatgctgctataaagacatgcacacatatgtttactgtggcacaattcacaatagcgaagacttggaaccaacccagatgtccatcaatgacagactggattaagaaaatgtggcacatatacaccatggaatactatgcagccataaaaaagggtgagtttatgtcctttgtagggacatggatgaagctggaaaacaccattctgagcaaactatcacaaggacagaaaagcaaacaccgcatgttctcactcataggtgggaattgaacaatgagaacacttggacactgggtggggaacatcacacaccagggcctgttgtagggtggggggagtgaggagggatagcattaggagatatacctaatgtaaatgacaagttaatgggtgcagcataccaacatggcacatgtatacatatgtaacaaacctgcacgttgtgcacatgtaccctagaacttaaagcacaataaaaaaaaaaaaaagaaagtgatgtgtttcttcaaaagatgctgacgacgtcagacacactttttaaacagtttggaagctgtcttcagagacaaatgctttacaatcaatatttcatttaatcttcacaaaactcaaggagaaggtagtatataacttccattttacgagtaaattcagacagaaaagctaaataacttgcccaccactgcatttcagtaaatggcagagctgagattagagccaacatctatcggactctaaagcaccagctcttaattgcttcactttctatcattgttttgatagcaaaatagatgtaatctgatgatctcatagtgtatttacttttataaaacagtattaaatttatgggggtttaattaattattggcaccataaagacctgaaaccacctaagaaaataaatgctctgcaatagacagaagagcttttttaattatatgaaagtcttgtttttcaactctatcataccatttcctcttaagttgggctctttgcccaaaagtactctaaaattataattttctggcaaggagttttaaaagaagctgaaattttctcttcttccttcacccttggactctaatttttattatctaagaattttctccacttatcataaactggaaagtgatatgatttctttacatttcttgtaacaaacctatacaaaattaacaaacactgcaacatactccctatccctaagacatgttattacattcgctttcttaattactaattactcaaaaatcacaaattcagaaaatatagacaaatttgaaaatgctctaacatattcacgtcctattaaaataaatttgaaaattccctaacatattcatgttctagtaaaataaaaattaaaaataattttattagaaatatggacacctataaggctcatacattttaatccagttcgttgtaagtattctgaaataaccatacctagatttgagaactaaaaaaggcaactgaatctttaattgatttttttcttctttttgagacggagtctcactctgtcgcccaggcaggagtgcagtggcatgatctcagttcactgcaacctccacctcctgggttgaagcaattctgcctcagcctcccgagtagctgggactacaggtatctgccaccatacctggctaattttttttgtatttttagtagagacagggtttcaccatgttggtcaggctggtctcgaactcctgacctcaggtgatccacctgcctcaacctcccaaagttctgggattacagccgtgagccaccgcgcccagcattttttttttttttttttgtcacccaagcgcagtccaagctggaatgaagtggtataattacaagtcactgcagcacaacctcctaggctcaagcaatcctccaacctcagcctcccaagtcactgggacaaaggcatgcgccaccacgcccagctaattttttgtttgttgtagagacagggtctcaccaggtcacccaagctggagtgcagtggtacaatcacagcctgctgcagccacaaccccccaggctcaggcaatccttccacatcagcctcccatgtagatgggactacaagcgtgaaacaccacacctggcaaattttttttatttttagtttactttagtttgagacagggtctcactctgtagcccaggctggggtgcggtggcatgatcatcgctcactggaacctcaacgtcccaggctcaggtgatgctcccacctcagcctcctggctgtgaccacaggtgtgcaccaccatgcccagctaatttttgtatttttttgtagaaaccaggttttgccatgttgcccaggctggtcttgaactcctagactaaagcaatctgcctgcctcggcctcccaggtgctgggattagtgcatgagctactgcacccagcctaaaatctgctcttatcaacagtggtgttatttgtcttggattattttattttctatctttttcatttaaaatgacactaggtcatctgaaatatttagtggtgagaaaaaagtaagactgggtattaggattatagtgggtcaaagagcaaccagagcaaataggaagaacataaagataaaagtctgctctgaatagtctatatcacgtaatttgaatttatatatgcccaatttctgactcaaacttagaaaataaatgtgtagtggagagactatccagagaaaagagctcaaaaccaccagtgtcatcacttttggcagaatatccatagtttgaaagaaaaaatcagttatcctatctatgaataaaatgctattaaaaataacaggatattagttattaggatattagtctccaggttaggatcttgaaatatcatttcttactaagagaaaccacggctttttggagaaatggatgattccagatctaggacaagaagtatacaagatgggccccaaatatcacagcagacaacaaggaaactatcaaaaaccactagggtcatgttatctcctgaagagactcccactaaccaaaggtgagacaatttgcgcttcagtgaaagtgattccaatggattaaatccatcaagtatgtttaaatccatcttctcataatggcatttaaaagaaaaaaaaatggccacctttggagaaagacagggaactaattcgttatcttgaaaacttgtaaataaaaggaaagaatcaaacatttatcctgtctttcctttatcaacagtaccactgggtaactaaacagaagatgaggggaagttactttttataaaaacattccaattaataaatgaaagcaaaatgatgtatttagaatttcattatattgcaacacccactaaccatccacagccgctaacatcacaaaaaagaaagacaattagacattatgatattcccatggtcttgccaaaccccatctatatatatatatatatcacaatgcctaagggatcgaacttgagtctgctccatctctggatccagctgcacgtttgcagaaaatacagaagacaaaggaacatgttgaactgacctatattaagcaatcagcaaaatccaactctgggaaactagtacaaacaacctgggttctccaacaggaaaaggaaaaggatggaggactaaactaaagattaaaagtgacaactcatatcaaaactgctttttgggctgggtgctgtagctcatgcctataatcccaacacttggggaggccaaggcaagaccacttgagcccaggagttcaagaccagcctaagcaacatggcaagaccccatgtctacaaatacacaaattacctgggcatggtggccaatgcctatagtcccagctcctcagaaggctgaggcaggaggatcccttgagcccaggagggtcaggctgtagtgagctgagattgcactactgcactccagcctcagtgacagggcaagatcctgtctcaaaaaacaaacaaacaaacaaacaaacaaaacacaacctagagacagtgtttccctcttgttgcccaggctagagtgcaatggtgcaatctcagctcactgcaacctccacctcctgggttcaagggattctcctgcctcagcctcccgagtagctgggattacaggtgcctgccaccatgcctagctaatttttgtatttttagtagagatggggttttgccatgttggtcaggctggtcttgatctcctgacctcaggtgatctacccacctcggcctcccacagtgctgggattacaggtgtgagccaccgtgtctggccaaaacttactatttcttaatcatcaagactaacctacagtatctagcaatgcacatttgggttattactacacaagtcaggaaaatgattacttatagggaaaggccactgtgatctatttctcaacctgaggggtgattacaaaggtatctgccttataataattcaccaagccatacatgtgttctgtactaatgttttattttgcaataaaaagattttttttaaaatagcaggttaccagcacacctgaacatgtcaacacctaaaaacggctagatatgttttccattctctactctaactgagtgaaaacaataggataaaaatagaaatcaggccgggcatggcggctcatgcctttaatcccagcactttgggaagccgaggtgggtggatcacctgaggtcagtagttcgagaccagacaggccaatatggtgaaaccccatctctactaaaaatacaaaaattagctgggtgtggtggcacacgcccgtagtcccagcggcttgggaggctgaggcaggagaattgcttgaacctataaggcggaggttgcagtgagccaagattgcaccattgcattccagcctgggcgacagagcaagactccatctcaaaaaaaaaaaaaaaatagaaatcagtgtgcatcatttcctccctacccacttcctcttctaaaggaaccacttaatatcacattttaggccaatcagattcactttcttgggattatgaaattccaagaaagagactatagatatccaaacctgttctcccggtctttcctcattccccaagttgtttcaattcaaaacataggagccaggattgattctttttttcccctcattccccacatctagtctatcagcaagtccttcatttataactccaaaatatcgcaaatctctcaacttctatctccactgactctaccatctcaaatcacaaactattcaaatagtttcctaacttgtttctcttttattcttaaccctctacaatctactctacccaaagcagccaaaaggatgttttaaaaacataaactgcttaaaaacctttaatgacagcacacagagctctgacttaaatccaaattcctttccatggccggcatcattgaatccgtgcccatctctctgagctcatctctagccactgtcctcttctccaatccaggcacactggtgtcatttcaattcctcccacacattaagctctttcccacctccaggccttctcatagctttcccccctgcctggaatacttttcccttgctactcacatggataacttctcaatgtcaggttacaacttaaatatcaccttctcagagaagcctctgccaactgccctattaagcaggtttcaccatctttctctacacactacttatatctttcatagctcaagctacaacaagagtgtatgttatatgagggcaaagaacccacctgtttcattcaccaatgagcatctggaatgtggaaaacaattaataattactgaatgtatgaataaatgaggaaatgaatgaagtaaaggccgaatgccaattttgccatgagtagtgatcagtaagtaaagaaagccagttttcagaaagaacagagcaacacaacagagaacaggagactatgtggcttggttccataaacagagtcaagaaaattagctgccaattataaattataaatgtgtgtgtgtgtgtgtgtgtgtgtgtgtgtgtgtatcaagatagcagaaacatctgaaaaatttactcaattcacctctatactaagatgtctggtattatataaatctataaactaattcagaactcaaaataatactacctaaactaattatcattaatgttaacactttgtaattctcattttgctatgagtcatttttcaagatatactcctatgatgtactttcagaaattcaaggtaatcttcatgtcgatattcacggtatgtatgcaaacaatgaattttttttgttgtttttttgagacggagtctctgtcgcccaggctggagttcggtggcgcaatctcggctcactgcaagctccgcctcccaagttcacacgattctcctgcctcagcctcccaagtagctgggactacagatgcccgccaccatgcccggctaattttttgtattttgtttagtagagacagggtttcaccatgttagccaggatggtctcgatctcctgacctcatgatctgcccacctcagcctcccaaagtgctgggattacaggcgtgagccaccgtgcccagcccaatgaacgtttttgagacagggtcttgctctgttgcccaggatggaatgcatccacacaatcatggctcattgcagcctcaatctcctgagctcaagcaattgtcccacctctacctcccatttatgtaaatgtgtgggtctgtactgagtctcagtatcaatgaatttttttttttaaatgttgaaagccagtaatatatgatggcctgaagtgttcctagagtcaactaaagactgagtttctctagttgacatgcaacagaagtttgtttaccggaagtattgcaaattttattgtcgcactccctctctccaagaaggaagagccaactgactattcccatcagcacggcctaaagcaatcctaatcaagttaatgccaccctaaattaaccaagaaaagccaaagggaagacagcagatgctttagggaccaagttgttaattcagagatgctcctgtttggttggttcttttccccttggactaactactttgaatattttgtccacttgcctacctctagaattggaaattttccctagggccttcctctgagtctgctggggtttttttaagagttcttagagttcatcttctcaaagacaactccagctctctatttagtcaatctctctgatatacacacaattttactttccaacattccaaggaaacataaattagaaatatacacataaaatgacatccacccctcttctccctgcaataatatctttgtgatattcctactatctacttaactggtgtgttgctttctctcacccacttccattcataagcgctgagagttatctgctatctctctccattcctaattcctggcctgagatccgggctacagatgctacaagttgatgtgggctcttcatgctgaagaattcatgagtactttctgcttaactcctctatattctcaacccgatccctttgctttttctttccataataatctgttttctgatgggtaatccatccaaacactcatttgcccttatgaaattagtgttttctagctttccatttgcgtgaaggacccctaacatatgacttcaaccttcaattttatttcccccaaactaccctttcacactattaaaaataataataaaaaattgccacagaatccaactatagcttaaattaaagaactcacctgtcttgagagtaagtatgcttcaatagcttattcttttactatccttttagtgttttcattgttcaatgctaacctgccctccaaccataccttaatcaacgaattacacattttaaataactactaacactataacctatttgaggaacaagcctatctggtaaagtgtctcactccagcagtgatattctgtcctctctttgacaagtattaaatatattttcatgctgcccacctgtctatcatagagacccacctcccttctatgaaggttccacctggtgaagagcccatgttttctggtcatttacctttctacctatcaaagctggactattatgtggtcatttttctctcagctagcagttcccctataaaaaatccaataaattcggctgcgcggtaactcaagcctgtaatcccagcactttgggaggccaaggcgggtggatcacgaggtcatgagatcgagaccatcctggctaacacggtaaaaccccatctctactaaaaatacaaaaaagttaacctggtgtggtggcaggcgcctgcagtcccagctactcaggagggtgaggcaggataatggcgtgaacctgggaggcggagctcgcagtgagccgagattgtgccactgcactccagcctgggcaacagagcaagattccacctcaaaaaaaataataaaataataaaataaatccaacaaattccatctaaccaaaatgctaattaatgatcatttaataaaggagtccccaactcctttacagcacaatacagtggaccagtactggtccatggcctgttaggaaccaggcaacacagcaggaggtgagctatacgcgagcattaccgcccttgctctgggctccagctcctgtcagatcatcagtagcattagattctcataggagtgcgaaccctattgtgctgtgcatgcaaggaatctaggttgcacgctccttatgataatctaactattgcctgatgatctgaggtggaagtttcatcctgaaaccatttcgcccccaaccaaaccatctgtgcaaaaattgtttcccacgagactggtccctggtgccaaaatggttggggatctatgatttaatgaatttcccttcccagagggaaatccttttaataacgactttggccagcttgggcaacatggcaagacctcatctctacaaattaaaaaaaaaaaaaattaggtatggtggtgcgtgcttgtggtcccagctaatcagggaggctgaggtgagaggatcacctgagcacagggaggtcaaggctgcagtgagccatgattgtgccactgcactccagccagggcgatagagtaagacccaatctcaaaaaaaaaaaaaaagttaaaaagaaaaaaaaggacttctgaagacctcagtgacaagtatgttaacgaaatctaaggaatctaaaaactactctggtacctcaagttggtgacatgggtgaccacatctattgcctatgtttaacacaaaccttgttaaggagaccaaatcaatgaatatgagggtgagaggtgccttaaaaatcatctaggtctctgagtcatgattcttgaactgggctacacactggaatctccaactcccagaggagaagaagatgcccaaagaagcaaatttcaaagtcagtgacaaggccaggcctaatacccatgcctaacattatgtgttgatatgtgtacatacatacatatatatatacacacacatacatacacacacacacatacacacacacatatatatgtaacatactaaaaatataaaggcatgtatgggaaggacaaatatccaattcatgtcagtgattaccttttgggggatgggaagggagtgtaattgagaagaaatacacatggtggcttcaaatgtattggtaatatttttattaatatttcttaaactggatggtaatacctaagtatctattaaattaggctctgttcttttttctttttgttttgtttttatttttatttttgtttctttgagacagggtctcactttgtcatccaggatagagtgcagtggcacaatcatagctcactgaaacctcccactgctgggctcaagcaatcctcccacctcagccccacaaagtgctgagattacaaggcgtgcaccatcgcagtaggccctcattatcttctggatatctaaaattttgtaataaaatagaataaaaagatggtatataatcaaatgtatatcacattaggaattcagtgaaatatctcaggctagaaagtactcagaaaacatacttgatgaggtaggctttgatggaagaataaaacatagattattcttcaggcaaaaagtaacacaaacttttctaaaggaaaaatgtgaataaaggtaaagctgggagtacccacagcctataacataaataaagaacaacgggggccaggcacggtggttcatgcctgtaatcccagcactttaggtggccgaggcaggtggatcatctgaggtctggagttggagaccagcctggccaacatggcgaaacgttgtctctactaaaacacaaaaatgagctgggcgtggtggcgcccgcctgtaatcccagcctctcaggaggctgagggacgagaatcgcttgaatcaggatgccagaggttgcagtgagccgagattgtacccctccatctcaaaacaaaacaaaatagttttgaaaaccactggactaaagcgtccagctagaaggtactgctgcaattcaaaagtgagggtcataaaaccatggaatgggttttatggggtagtactcttgagaaagaaaacagaaaaaattaatccaccaactttttaatagaaaatttgataggctatagtgacaaactagatgggataatgaaagagtaagacctacctgaaaaaataaaaaatgccaactgagcagcagcttctagtcatacttgaacatcaacgacatcgataaggccatgtaaaagtcagcactaaggaagtgttattcaaggcagaaaagcaaaatggcacttttataaggattaagagcagaataagcaacagagaccaggagattacagaaaaagaggaccactacatcatggaatgataagaaagagagtttcaaaaagagccatcactgtatacaacaagagggtgcacagcctttgtagccaatcagatgcagaattctggcactttctccacttgaccaagttatttaacgtctttgagcctcatataataaggaaaacataagttaacaactaacactgttgaacacataggggcttcaaatatatttgtcaaattttatttcttaagctcagtcgtgatacataaatatttattaaattagtccccattatcttttgttgtttttgttttgtttttgtttttttgagacagggtctcgctctgtcccaagtgctttacatatcacctcatttaatccccacaatacatttcacagatgaagaaattaaacttagaactagcataataagtagcagagccaggattactatttcttaggatttaaataatgtatacttaaatttcctggcaaacaggatgacctcaaaacgagtagctatatttcattattaggagataataatcaataggggcaaaactgccagtaattcctgtcatagccttccatgtggcaaactctctcaacatcctcatctataaattaggattaatgcctataatccaatctactccatagggttgctgtgaggattaaatattatgaatatgaaaattctataaaaaatgttgagacattcaaatatcagggattgctgtcacatatctttcgccttcaaaaatgcttttgcggcatttttgttcactacttcaaaataagactctgaataagctaaaaataagtctgttaaaagtgcaaccaccactttgaaaagtataaatcaccacagaattgctgcctacacctgcccctgactcctccaggttctctaatgtctccacaagggcaaggattctcttacacctataatgaaactctgataacttacagtacagctaatcaatagagagctgcacttcaattcagagttgttcaaactggactactgtgttttctcagaggtgctccttccagttcttccagaaaagaaaaaagtgcccaattctcttatattgtattaaaacggtgcccaatgagtagaatgcaggtaacttacaaaatgctagaaaagaatctatcaattgacttgctcaagtgctctgacagcaggtcccttttggaaactccttcacgaccccccctttttttcacctgaacagatggcttccaggcttcaaggctcacatgtctagtcacacaattcacaatagctcccaaagttcctaacttttcaattatcccatgttcttgaacacacctttcatctaaagatctctagctgtcaaagcatacgaactctttaatcttcacaacagcactatctgagagattactatccttattttataagttaaaaatgaaagactgaggttaaatattttagcaacatcaaacaattcgttaattcattcttggggagagaggaatacatattatgaacttctgtcaatggacaacctagatttggcttcctaagatcattgcaaatattagctcaaacacatcccactcttgtatgcatacatttccaacacaggtgtcaaagattaaatataaactattaataacagtaaataccataccaaagcagcactatttttacacgcaaaactatattgggggagggggttctaatttaaacttcccactgtcttgcatccataaatacttttgaacttgagggggaagggggaagaacacctgtcagagcagcacatccacaatgttttacagactgtgtagctattaatatttaattcctcccgccccgggaggtcaggccgcagggagcccggcgctgcccacccgactttccacgcgccaggcctgccggccgcaggggaggctccggctcccgctcccctcaggtcccctcgcccgtggacagacgcggcgggacactcggacccgcctcccgacctcagcgcgcccggctcggggcccggcgggcggggagaggctcgcagcagggcctggcctagccacccccgccccgcggccgccggcgccgcttccctccttcttcccgctccccgattcgttacctcttaggcgccggcggctgctccatggcggccggggacagagagagggacctggtggacggcgaaggccgaaaggaggaaaggagccggggcaccggccggccgagcctagggcaccacagagggaaactctgggaactcggaccaactttcccgtaactccgcgg

SEQ ID NO: 253 - DNA, 487941 bp, Homo sapiens
tatgctgggtggcacagtgaaatttatttgtctttatgatttacacataataattaaacacacaaaagaaaaaacactgtcaagatggccatatgtagcttaggaaatgactggtcccaatgcaatcatataaatgttcattcagcgtaaaaatgagtttctttttaatggttttaatcttttttttttcagtccccaaggcttgtaccactcagtacaaatgtttttgctactgggttatcatcaggaacatgatgtttaccaattcccaggaaatgaataaaatcaacagaaacatcctgtgacaacagagcacattttcatagaaatgaaattgatgagcttattacagtttgaatcagttcagctattagatctacacataaaacatgaaacaatattaacaaattacatttgtattaagtttttatttaaaaatatttatcacacttttttgtgcaagggttccattgatttctttggttttaaacacgatagatctattttacctaaatatatatagttctatttgtaccaaacatcaaaaatcaaaaaaacaaaatttcaaagggtaaaaatggaattattgcttcaatataaaaaaggcctagcccatttgagaactactgccattattgctttcctatttgaaaaactatcctggaaatcaaggaatgtaccccatagctccctgcagaaagtataaattggttgcacattatcatcatattaatatgaccctaccttcaccaaagctatcctgatcttgtccttaaaaaatgaaacaaagcaaaatagcataaataaataagtttacctaaggggatacaataaatagcctagtatactagataggaataaagaatattgtaacataaagcccttcagtgctgtacaatgcaacaatagctttggattttcaaggtttagagaccttgaaaatccatttcataacagttttattactggtatgcagctgacagaacaagagaatacacttcttttgttctcctcatcttagagtgaatgcacagcagatacaactgtcaattctgccttttgggaatttacctgggcatgtaccattgtcactttttgacctctgcctaattgtagggcaaaatcttaggattaaaaatatccaaatattccttcaattcctagtggtttcttggtctccagaatagttaaaaacagagaggaaattagactcaaaagttttgctgccttcttttctttgcatccatcgcatccagaatgggctgtcttttcgcagtgtatctctgacgaagttcttctatctcccgttccatcatggggtccagtgcttttaaccgcatctgtagttcttctaaacttagatttttcaactagatacagaaagaaagataccaatacaatgaaattatccacattatccacaatcaatacaatgaaattagactttaatgtctaatgagttttaacataaatatttcagcaaattctttacatcatctttgaagtatagttcaacaattaaaacaggaatttcttccttgaagaactcagaggtcatatcttgcaagaacctccagtaatctgcaatgaagcaatccgatcctctgcctttaataaagggcaaatgagaaaaatacgctgatggaatttgtaaaaaggtacaaagacaaatccaccactgccaacaaacagattttcagaatatgttccaggtatattcactctaactttttacatctttgccagctactgagtgctacaataatcatgaacacttgcagagatcactcaagaatgtgacaagactgaataaaggttaaattaaccattctatcctccattttactaaatgcttaataaagaagatgactgtggtagggggcgggaagtaaggctgaataggcctggtggggccccaaaagcaggaagccatgatcaattctggagtaggacagttatgtaagagtaatccagatttggttttcttttcttcttcttcttcttcttattttttttgacacaaggtctcaaacttctgggctcaagagatcctcctgccttgacctcctcagtagctgggatgtgccactgcacccagctcaggcttggttttaaaatgataaaacttgcaacttactttttgttttaagaagataattgcctttggttattttatgagtcaagctaggaaaaatactcattacttatagtcatccaaagtagcatttctcagcagatccttttactcgccatccctggccctatcgtgacttctgcttccaaaaaccaaattcactcttagctgaaaaagactctgaggatactgaaaagaatgagtcatagactctctgaaggaaattcaaaaaaggagttccaaaaatattttgagaaatgacagtgttatggagaagagtatgcaggcttccatgatgatgactttgaaggtgaatgccactcacttcggtgcataagaagttctggtatgtatattaataatcagccctgttattttgtagtcatatgtcatgaaagaacctagcttttaatattatgccataaaacatacatttatatatcatatgtagtattatacactttcttcattgatttttaatccaagtagtgatcttgcatctgttacatgctcagtgctgttcaaatcactgtggagatacagaataagacaaacagggaaactccaaactttgaactgtacacatcggtaatggccacattgaaaggccaatgtataccacacaaccacatttcccaagaaagacatgcccaactatgtctatgtaggatccagttccacttctgtgttcttcaacatcatctctatttcagcccatgttaatctttcccatttctaaatttctatgtaacactcataatttaaacaacacaatttagtatttgattctaaatcatgtactattttataattgatttttatgcatgagtttcatgtccctagatattccaaaaaatacttagactttagagactgtacatacaccaagaaactatcctactatactgcaaataacatgacgtaaacgtagatagataaatatgaataagaatatatgacccaaaggagtgggttactctaagatcagaagaactaacatattatataaagcaaacaattatcattactttaattctgaattaagatattcctgtaaatatcttgtactacttttactggggcaaactgccaataggtttataaatattgtattgcagtaatagactgaactcagaaaaagaagctacttagaagaaaaattttcttcctttaacagatttttatattatcaatgcgtaaaatttgtgaaaaacaggtctgtgatattagagaaacattatctaacattattaaggaattaggtgttcatgtaagtaaattaatgaagtacctaaatcttagttctttaagtgataaaactttgtctcaatatcacatacacacacatatacacacacacacacacacacatgtgcacacacacatgtatttacatatgctcttttttggttctatgtgacttttaggatttttttctaattttgtgaaaaatgatgttggtattttgataggaaatgcactgaatctgtagactgctttgggcagtaaggtctttttcataatattgattcttccaatccatgagcatgggatgtatttccatttgtgtcatgcatgatttctttcaacagtgttttgtagttctccctgtagggatcttttaccttcttggctaagtatattcctaggtaatttattgctattactattattattattaattattttacagctattgtaaaaggggttgagttcttgatttgattctcagcttggtcactgttggtatataatagtgctactgatttgtaccactgattttgtaacctaagactttactgatatggtttggctgtgtccccacccaaatctcatcatgaattgtaatcctcataatccccatgtgtctagggagacacctggtgggaggtgattggatcatgggggcagtttccctccatgctgttctagtgatagtgagtgagttctcacaatatctgatggttttataaggggcccttccttcttcaatctcactctgctctcccctctcaccacgtgagaaggtccaggcttgcttcaccttcaccttccaccatgattgtaaatttcctgaggcctccccagtcacatggaactgtgaatcaatacacctctttcctttgtaaattacccagtcttgggtatttctttatagtagtgtgaaaatggactaacacagttaactggcactgaggtagtggggcgctgctataaagatacttgaaatgtggaagcaactttggaactgggtaatgggcagaggttggaatagtttggagggctcagaagaagttaagaagatgtgggaaagtttggaacttcctagagacttgttgaatggttttggccaaaatgctgttagtgatatggacaatgaagccgtggctgaagtggtctcagacgaacatgagaaactcactggcaactggagcaaagatcactcttgctatgctttagcaaagggactggtggcattttgcccctgccctagagatctgtgaaactttgaacttgaaagagatgatagggtatctgggggaataaatttctaagcagcaaagtgttcaagatgtgacatgggtgctcttaaaagcattcagttttatggattcacaaatagatggtttgaaattggaacttatgtttaaaagggaagcagagcataaaagtttggaaaatttgcagcctgatgatgtgatggaaaagaaaaacctgttttctgggggagaaattcgagcctgcagcagaaatctgcgttaagtaataaggagccgagacaatggggaaaatgtctccagggcatgtcagagatcttgccagcagccccatttcatcacaggcatggaggcctaggaggaaaattagtttcatgggccaggcccaggggccctgctactctgtgcagccttgagacatggcaccctgcatcccagccatttcagttccagtcatggctaaaaggggccaaggtacagctcgggccatggcttcagctcaagccttggtggcttccacatggtgttgggcctgcgagtgcacagaagtcaagaattgaggcttgggaacctctacctagacttcagaggatgtaatggaaatgactggatgtccagtcagaagtttgctgcaggagcagagccctcaaagagaacttctggtagggcagtgtggaagggaaatgtggggttggagaccccataaagagtccccactggggtgctccctagtggagctgtgagaagacagccactctcctccagaacacagaatggtagatccattgacagcttgcaccatatgcctggaaaagctgcagacactcaataccagcctgtgaaagcagctgagaggagggctgtaacctgcaaagccacaggggtagtgctacccaagaccatgggagcccacctcttgcatcaatgtgacccggatgtgagacatggagtcaaaggagatcattttggaactttaaaatttaatggctaccctgctgggtttcagatttgcatggggcctttagcccctttgttttggccaatttctcccatttggaataagagcatttatccaatgcctgtacccccattgtgtcttggaagtcactaacttgcttttgattttataggctcttaggtggaagggacttgccttgtctcagattagactttggacttggacttttgggttaatgctggaatgagttaacacgttggggaactattgaaaaggcatgattgtattttgaaacgtaaggacatgagatttgggaggagccaggggcagaatgatatggtttggctgtgtccccactcaaatctcatcttgaagtgtaatctccataatcttggtttgtaatccccatgtgtctagagagagacctggtgggaggtgactggatcatgggggcagtttcctccatgctgttctcatgataatgagtgaattctcacaagatctgatgggtttatgaggggctctttctccttcactctctactctctcctgccaccatgtaagaaggtccaagcttgcttcaccttcaccatctgccatgattataagtttcctgaggcctccccaggcacgcagaactatgaatcaactcgatttttaaaaacatattgagacttgttttaggcctatcatatggtttatcttggagaatgtttaattttggataagaagaatgtatattctgcaattcttgggtagaatgttctgtaaatatttgttatgtccatttgttctacagtgaagtttaagtcctgtcttcattgactttctgcctcgatgatctgtctagtgctgccagtggagtggtgaagtcccccactattactgggttgcacctatctcttttcttagatttaagagtaattgttttatgaatctcagagctcaagagttaggtgcatatttatttaggactatatcttcttgttggattgatccttttatcattacataatgtcattctttgtcttttttttttactgatgttgctttaaattctgttttatctgaaataagaatagctacccctgctcacttttactttccatttgcatagaatatcttcttctacccctttgagtctatacaaatccttatgtgttgggtaagtctcttgaagacagcagatatgtggtttgtaattttttatcaattctgccaaccagtatcttttaagtggagcatttagaccatttacattcaacattaatactgaaatgtgaggtactgttccagtcatcacgttggttgttttctagatactctgttttcttcattgtgttattgtattacaggccttgtgagttttacgctttcaagaggttctattctggtgcatatctacctttcgtttcatgattcagaactccttttagcatttctcgtagggatgctctggtagtgacaaattctctcagcatttgcttgtctgaaaaagaatttatttctccttcatttatggaacagttttgctggatacaaaattcttagttaacggttttctgtttaaggaggttaaagataggaccccagtcccttctggcttgtaaggtttgtgctgagaaatctgctgttagtctgataggttttcctttacaggttacataacgcttttgtctcactgctcttggtgacatcttttttgcaacgaatctcctagaagttcttttttaattaaaacactttttttttttgtgggtgcataccgggtacctgaaatgttttgatactggcatgcaattgtgaaataagcacctcattgagaatggggtatccatcccctcaagcatttatcctttgaatacgatccaataacactcttcaagttattttaaaatgtacaattaagttattattaactatagtaaccctgttgtgctatcaaatagtaggtcttattcattctttttattttttattttttttgacagagtctactctgtcacgcaagctggagtgcagtggtgtgatctcggctcaccgcaactgatgagaaagcaaaaaatgtccatcaaaatatgaatggataaagaaaatatggtacatatacacaatggagtacattcgtgtgccatatctgtttctactcatgctgttttccttctctatcctatttcccattttatcatcttactcatccttcagtgagttagctgtgcatgggcctatcttgccagctagattgcaatcttgttgtgggagatagagtgttttactcatctccgaacctactatgctgtatttattttaaaaatatctgatttcagttttgtggttgtatgaggttgagtttacaggaaatctgacttctgcataagctacatatatcgctaggtcttcaggtgggctgtcagagaacttcaaagtactcactgacatatttattgagatttttctatggaccaagcatagtagaatgaattttcattcacatcttgaatagtttttcaaacttctttatgttgtttttcacctttctctcgtatctcctttggtagcttaataatcaaccttttgaattctttataaaaagatatttcaaagatttcatcttggtttagatcaattgctggagagctaatgtgatcttttcaggggtgttatagaaccctgttatgtcatattgccagaattgtttttctggttccttctcatttaggtagaaatatatggaatgcttcacgaatttgcatgtgagccttgcacaggggccatgctaatcttcactgtatcattccaattttagtatatgtgctgctgaagtgagcaccgtctcaattgttttgaacagaaaatctttataaagtgttccacagaatatactgccttctaagcagaggacatagaacctaaaacagtttccttgatatgagttatcattatttttattatggatggatgaatattgtttttagttaaattaaaaagtcaaaactactttttaatatgagtcaacactttgtttgtaaattgatatggtttggtacatgagtgacagcttaaataagaaattcattttgttagtgatagcccttgataattacatttcattcaggagatgaaagatcaatatacaaaactatgacatttctcagtatttctaaaaaaaaaaccaagtaaaagatacgcaaattaataactcagttactagctcttgtataaaacaggagcataaaaaactcagtgatatgagaagttagggtggaaaataagattaaatcaattcactgataattctgacatttcaaacctttaataattagaattatttctgaactctacaagaagtattgaaagtctgcttattactgatcagaaagagttgtcagtaaaattagaacttcctttaagtttacatatctagtctactataaaaacctaaaatatcacagtcaagtgataaaacttacttcataaaataattcatcttaaaatctctggggaaaaacactaagatttctatataattttgttttgtcaaaaatagtcgtaattacatgagcgatttttaagaagtcaaatctcaaatagcagaaacgggaatatgaaggttttgaatacatcaatgtaataacatttcaagacctaatgattctatgagttgctggaacaatcagtctgtcaaaataaatgagacactactacaatgaagcaaatggtcttacatgttaatgttaacacatttagtcaaacagtcaatcaagagaatcctaaggtttgctgtgtttactgggaaaacaaactcttcctagcaactgtttaaataaatcttgcagatgctacagaccttattagtggcctttgattaaaaaaatatgggttgctaatactgtatcctgactcatctattttcccatctgctagcaattctaacaatatgaactatcaacagaatggctaacaacaagaattttctatggcagttttgatgctgaattgcctatagcatttttaagatttaccagtgcatgtctcagactgttttgagtttcttgtggcctggagcaacatactcttttttcccttaatattccattttagctgaaatttttactgtgttgaacagaatcttgtttggttttagaaaacactgttgatggaggctgccacacatttaactaacaatgagaacaggaaacacaacaaagcactagtaaaaatccagtcaggtccactgattggtttagatatacataaacaggcaaggggccttttgcccataaggctgagccacagggataacaggtagtacttaaagttaaaaaaaaaaaaaaaaaaaaaaaagaaagaaagaaagaaaaaaaaagaaaagaaaacattcatatattaaggcattttcctgatttaattcctggcactgagaagcatacaaaaaaggagcattctagtcaatccaaactactatgaagcctgtttaaagaaaaccctacatatacatttaaaatatgcatttacaaaaataagatagtgataatttcaggcacttgataacactatagaagaaaagctgaattcctcactgtaaaaatgtgatcttaaaagctgcattaacatcaaatctactggcagaccccccttccccaaacagacattatttatcctgttctgagctgagaggcccaggtcttcagctgactgaataactaaaaatattctgggattacaattggaaactaccatgaatcattctgttttggctgtttaacttcagagcacctagaagaaacttaggattctagattttcattcccaaagaaaaggaagaatacggtttctcatgaatatcaatgaaggagtaggagaaagtgccaattactgattatttacaatgtgctgaatactatcctaaggtcctgtacactaagtcattgaagcctagcaatcaccttagggggcagatattaccaaccccgtttgacaggtgaggatgcttagagagatcaaatgatccaccctaggtctctcagctagaggtgcttatgtaggccctcaaaggcaacatctaacccacataaatttgaactgcagtctactgatagctgtttcatgggtttcccatgaactacaaaagcactacaaaatccaatgatcatgtgaaacagttttttcacaaattgtttataggttaaaaatagaaaaaattacttaaaaatcccaactttcctgtcagattgtacctggtgaagcattttacttataagctattcatgtattttagccatcactggccatatgaaataagtgcatatgtgttaattaagcatttttctatttaaccagctctttagccaaagaaacacatttctacatagccctttgggatagatttcctaatgttatcaataaatgtaacagagataccctgacaaaaccaataaaacatgtctccttcacattccagtgagactttgcctatgtctgttcagactgttccacagttggtttggtgctgtgtttaccttgaatctagtgcaggagttacaaactgatgagcattactataattatcttgtcttagagaaatctcggccacccatttaaaaaaggaatgatgaaattttcgttgcattcctcaatggcagctgagcacccatttcttatgtgcattttccgtttctggtaagtagctttgcttattaaaaatatcaggaaatacttaatttgggcacacttctgatatattgtaagcagctctaacattctaggcccaggacaacaaaatttaagtaactcaaaagcaaccagtaattaaatctttctggatctattaagggcagatgaaaaattgtattacctttgatttcttatctcagcgattctgattagcactttgaatagtttaaaacaccaatgaagccgtaaataagaggttaacaaattaagtgattaattttctttttatacttcaatttaagaaaaacattatatgagaaatatttgttatggaagatcacaaacattacaaaaacaacagtggttaaagtatatctgtaactagcttactgggtagtcaaacctctgtggagcaataatataaacttaaagtaatttaatttttctccaattacactctttcggctatgcaaagtcaaatttccttgacatatcccacagtaaatcttgggatgatttcactgatttctggtcacttttacttattaaaagtccagaccaaatataaacttcaatctcttattaagtgcaaattttgtcccttcccttagcatgagcttgcaccaatttacagtggggaaggatgatgtctatatctagaaccttctcgccgtctctttctaaggtctggttcctctagtgctgggagcaggaaggagaccggatgttattatgtaaatggtgacttgtcagtgaggtatgtttccctggtcttgctctggtttgtttgattactagtggtttgtgcacagaaagcgtgtgtatgtatttcctgatgttgtggttagtattatcctagtgcccaccccttttatagaggggctgcccaacatcttttctgagttagatattgtctcctctgacctgaaagccacctgggcagcattatgacttctgacctcctcttttggagtaaagagatcatggaagttctctacactctccagggactagtgggacccaaggaaggtaagggtcactactccaatggcccttagttatcccgcaggcctcggctctacctacagaagtctcctacctacaaaaatctttgggagagaagcagatatcagtgtctatgctaatataccttccaaacttccaggaactaaaggctctgcctttagtggcacaccagtgggtctacagattcagctagctcagtaagcaccttgctggggtaccaggtaaccgtatccctttcctgcaggcaccaccattctctgtgaatggatctctggaaggctccttatttgactttaggtaaggagagaactattttcttcccctcccaccaggttataaattccatttggatagggcctttgtctagtaaacagctacatctctagtgcctagaacactgcttgaaacatagtaggtgcttaatcaatatttattgaatgaatgaaaaatggtgggtctcttagtaatcgctggagggaggcggctggcttcagttgttggtggcatgctttagaatatcgggtacttaacacctgctgttttcagctgtggactctactaacaattttgtggtaacagaaagtcccttttgatgtcatagtacacatctattaactctatttaaaaaatgtgtgtgtgtgtgtgtgtgtgtgtgtggcatcaagttggtaaatttgcagttgaagtaaagcaaaaagagtatctgtgaagatgagggtattttttcagcatgtttaattaatattactacaggatagtttcatgctccactacatgtttattctgcatgtctgatgatacatttatttcaataataaggggctcatccttttcttagaataatggcttctctcaaaaaattctccaaaacaataataaataccatagttgactctttgaggaaacatgcatggagtgaagtgtgctggaagagcatcattcttactaatgtcacaattttctgcttcactgacatcacaatacttagtctaacaatttaaattatactatcttcatatcataaaaatgtaaatatttgtttcttgaaaatctataaagtagttttaaaatgaaagaggttagctaaaacccacaaatcatgcaatttagattgtaatagataatttttaatagtgaagcaacatctagaaataaacaagagtctcatattttagtttcgaagcatctaaatccacagttcatttaaaacagttcagaataagaatcgtggtctgttaactatttttaaaacaataaaactcaaaatatgccaaaatgtttctaaaacacttcaaaagaaaaaataaattcgatcatagttctgcattctcacttgccacatgggccttagaagataaaatgtaccaaaaaggaaacattttagcattctcaattttagaatggcatggtttgtggctgaaacaatatttaattttcccagctactgacagacaaatgtacaaattaaactaaaacacccatgaagagattcagatatttgtaaggacacaagaaaaaaggataggaggctcttatgaaaatgtttaaaaagcaaaattgattttgtctaccttaataataaataagctgtcttgtgcaaacttaaaagcaaaatcgtcgcctgaatgaaactgagattctattgttttttcattaatatttgttttaaaatatgctcacaaatgctatgaatttaaggtaaaagaaggtagagaatgagaataaatgaacataagtcctgctagttattaacttagatgtgtctcatgggggaagaatcaactttcaaatgtaaatgtttcaaatcttcaactttctgaattggggaaaggacaacagtgtttgtgggttatgtcagcattttagactgcgcaactaatatgcagaaatcacagaaaataaagatgagagccgggcatggtggctaacgcctgtaatcccagcactttgggaggctgaggcaggcggatcacgaggtcaagagatcgagaccatcctggacaacatggtgaaaccctgtctctactaaaaatacaaaaattagctgggcgaggtggcgggtgcctgtagtcccagctactcgggaggctgaggcagcagaatcgcttgaacctgggaggcgggggttgcagtgagctaggatcgtgccactgcacttcagcctggtgacagagtgagactccatctttaaaaaaaaaaagaaagaaaagaaagatgagaaagtaatatgccaccattacttccaaaaggctgagtaaacattgattacaaactaaaattttcacacttagatgattataatacacgaatggtccaaaaaggcttttctttgcgggggcgggggggcggtctgagaatggcgccaaattagatttttagaaactgtttttcggtatcaactaatttaatagagaacatggcatcaaaattttatctctaataataccttgcaaaatgagtgtgttcccaaatgttcctgcaagtcttcagcgctggggctggaccaagctgcacctcttgcaaaggcagcaaggctttggttttatcctcccttgagccagacacctgccttctgagtggcctcactactaatgtggacatggaagcagaggcagagaactgaggttgggggacagcacaaagaatggctgatcttactttacatctactgggaagccgggagactgtggtcatgagtggaaatttggggatcagaatttcagctctggtttgaataatatacattaatatggagtagttttgctagtaaatcttcacatttttattttacaagatgaaatttcagttcagtcttaaaaagtccattttaataaggataaaaggaaaaatgcatctttaattattgaccatatgaaagacatattgttggtttacctcctgtggaaaaagtaataacacagctatgtggctgctgaattcaatgtgctcttgaggaactttccaaaaaatattagtaactgactgacatacactgttattcaaggaagagcttatccactggataattattctgaaactggtttatattcacatacaatatatgtaactctcaatctgaaataaatgacccagcagacctagtgctgagctgctagtacctggtactaacagatcctagaattctccaaagcattcttagacaagaacaccgtgagtgaactttccattattagagtcagagtagcggtgcaataccagaaatgatcaactaattttgaaaaataccacatgcaaagaaattaccttcaaactgccaaaaacactgcaagctggtccacacaacactgcccatttctggatacccatgatttacctaagttcttctagcctattttcagttaggaatgcccatttgaatgaacctcctcctgctacagttctcttaaccacagtgcatgatcttgtgactctgtcaggtccaccctagccctgccaccgccaacccacagatctcttctaattaccccagttgtgagagacagtcatagtcttaatcattttcttttcacaggggtgttcactgcctcatctcacccgtactcagtacaaggccttttaagtaggccaccctcactctcacagttgtttctatagtcagaatagtcagctgtgctggaccaagctgtcaaaagaagggagagataactcttaaatactgaggaaattgcagattctgctagctattttttaatttttcaatgaccagaaactgtctttcattggtctttagtgagtgtcatccttaattatatcaactaattttaaagatgacatttttcctagacaattttgctagggtgacagcataagcttccccaacccttggtaaatctctgctctaagtataaaaaacaagacactgtttactgactcttaagaggtgtgggtttttaatcttgcagggtgaccaagtgttgaatatttggtaacaatttcgtaaaatcttttatatcccacttagaaattaactgatagaacacctgagggagagtggtaaaagtggaagcagtacaacagaataaaattaaatgatcctaaatcaactgcaatgtaccaaagccttctgaataggcaggtggcttctgaaaagggtaagggtgaatgaagttacagcttgactggctcagagagtttataggtttgtagaggatgagtggcttacagctcgatcactggctcctgaaaagttaggaagctgggccactatcagatcaatggtatcggaaactgagaaacatgaagtcactgagctctacagatatgaatagtggcatccactgaacccgctcataagggcaagatttcaacctctaagagagggctaagtcgctggctatacagtaccctctggtggccagatttgacactgcagatttttctgccttttaagaaaagaggcctggtttttttccttttcttttttttttttttttaatgcatagacttaccattgggttacgtcttgataaagccatcataaactaaaaatatctgcatttagtacagctaacctaccaaacatcatggcttaacctagcctaccttaaacatgctcagaataattaacattagccttcagttgggcaaaatcatctaacgcaaagcctattttataataaagtgttgaatatttcatgtaatttattgaatactgtactgaacgtgaaaaagagtggctatacgactactccaagtaccgtttctactgaatgtgtatcactttcatatcaccaaaaaactttaagtggaaccatcatatacctgggactgtctgtaattcaaaatctttctagacaaggaaggaatcaccagtagcactgctgggctatgggtaggtgggcaactacctactaggtgtaaatctgtcaaccaaaaaagtaaattatggtggctttaagggagaaaatgttcctctgaatgtgtttaaaatcccatgggtgtagctacttaaatgaagaaatctggtgagtacttagctatttaaaatttaattctttgcaggtacttactttacaagaagtattcttatatagagagattcatattgctataaatatgtacataatagctaacatgcgcttaccactggcagacactatgctgttatttaataggcaataatcctatgaattagtattattagtatcaccatttttcagaatttaagttttcagaggcaccaagagtttgaactttaagacatttagctaataaaaaaatgtggccaggatttgaatccaagggaactgaattttggagctggcactcttaaacactatacaatgcagttaaatatatgtagtttactgcccataataaatttttccaaaaaagagatggcttcttaaaaattttaaattagattcagattagtatagacacttgcaagtcaatgatgcttaaaaactaaactaaaaccctatgccagttgagtgtttatttcctggaatgtttactcacatacaccttatggtggagaggggagtttataattggccacagagcctgagacctaatatttttgaaatcataatatattttacagtacttcacaatttacaaagcatatttacatacattgtatcacatgaacctcaaaataatgctgtgaaatggggcagataattctgtaaacaggcattattcttaactttatagatgattaatgaggcttacaatgataagtcatttccttaaataacacaattctctcaaaatctaagatgttccaaatgactgaatgcattatgaattagcctatcataggctttatcatctgtcacataacatttaaaaaaagatttctcacaataaaccaaaataaaattttactttattttatttctgctttatctacaataaatattataattcaacagtaattactattgttgaactagcaaaacccacataacaaaataaaaatcagaacatgaaaagctatagtaaggagaatgagaacaagtatggatcataaaatccagaattaggagcgaaatggtccaaaaattatgagattaagatcaatgattacataaagcactcagcatttttgtaattacttaaatttgtaaagtgccttcaaaaatttgttactcttttataatccctaagagatcactgagagacaataatagcctttacacagcagatgaagaacattttgaaagtactatgaaattcagttattatttttgtttaaaagaaaacatcttgtgattctaaatcacaagagcccgaaattctttctgaatataagcaatgccatttacaaacattcctgctgcacccatcttctacaccccctgttgtaatgaattcgcatacctgcctccgattacaggctggattgccccaaagtagtcttctcagaaacctatctacacagttagcttctttctcttgtgcatcttcaaactctctttgtctttagcatcaacatgatatactttctgatatttcccatcttaaacttttattgttttttcttatctcaagaaaaccctgccttgactcacggccattcctccagttgtcacaattccatccctcttctcctttagaaagtcaaacttctcaaagtatggagaaaacaataaccatattttaaattggcaatcaaacttcaacttgctccatactggcttctgatcccctaatgctctccaaattcctcttgttaggtcgccaaagttaaatgaattctttttagtttctatcttatttggcccctccagctgtacttgatactttgtccacacctttccttcttgaaacctccctctcttggctcctacaacaccatgctctcttttctcctaaatttatggccatttctcaatctcctttattggcttcttctcaactactaaatgttagaactactcaggactctgggcttttactatatactccatttcctaggcagtctcatacatgccctgggctttaaataccatctatctgatagtatctctaatatagatctgtcttctgagttccagaacttagcaattctattagatgtctcctgggtattgcaatactcagtaagttcatatctgacagagaccttctaaactgtttatcttttaacctttcctatttcactaaatggctcttccaccatccaactagttgcaaatgctaagaacctaccatattcaaatgttgccatgccttgtggtgttcatactacttaccaagatatgtcaaatcgatgtcctcctcttcatctgctgtcatctccccagtcaaagccctcttatcttgagcacactgtttcaatagcttcctaactagtttccttctatctttgctcccctccaattcactctccatacagcagccagaattattgtttaaaaatgtatactgggtcatgtcctgcccctaagatacggaaatggctctttcttgcatatgaaatccaaatgcggccttgcctgaatctaatcctgcctaggtctgcagcttcagcttgtgctactctagccattactcctatgtttccatcatgactgattctctttcagtttctcagattcaccaagctctttgcatgtgaattgggagtaaaatcgtccaaaaattaagaggttaggattaaatgattacatgcctttcctttgcttagaatgttgttccacactccccactttggcttcaagactttgttaacacagttctgtctactgagagtgtcctttccctcatctctgcctgatgaagttctattcatctttaggactgatcttaaatgtcatcttcataaagtcttcctggtcaaattttccctgtaagcatactgagttacttttttctccatatacctaaagataattttgcatatgtctctgttataacatttatcaccgtactgcaatcattttttaaatttctgccacattagaactgtacaatatgagatacgtgaatataggactgggccttctttagatccccaaatttagcaggtgcctaacatcatccaatctgtcacccattaatattgctttaagaataagagccatcttacatggcaacaaccactagtgaagattgtatttattaacttgttagtgtttgtcatcacggtgacatacacatattcagaaaaatgagtcaatattaataattaaagacgttactgtgatgaagtttcctgaaatctgagctcatctgtatacccatatccaatgacttgaatgtctcaatcaattcattggctagcacaattctcaagccttattagggaccataatttctatggttgacatcttaatgctgagtaggagccggaagctttgtggactctcaggttcatgcacctgaaagtcctgtgcttaagtgtgtgcatgatcttgctcagaagcaccaagaacaggggtgagaagagagaatgtagaacatccattgttatacaagaggcagtgacaacagagatggcctatttaacttacttcaaaagcctttaattctcaagcaccaggaaaacaattttagagctgactacaatagatcttttgctagactgttctgaagactagttttttagaaagtaaaaccatattaccagaatattaatccacaataaggttgaatacaatttgttaaagaacagactccatgtactattacaaaaatgaggtctgacctgaaacaccatccatttgaaatatttaaaaataaaaatagacaactctcttaaggaggttttttaaagcatcatctgatatctacgctatgataaaagtcagcatcaagtttaaagaagtgaaacaaaacactgtcaccatgcccctatgagctaaaactttgagaattataaatggcggatttaacaatgataacctttccattcttttgccagacgcgaaacaaattatgctagttcctcctctagaatttcttgctttttctgcctatgaccttctcagctcacccacaagcagcaccattcattgactgaactgttatttgacagtttgtcataatcaaatacggtaagcagagtatcacgatgttctagttcactttaaagcaaactatttaggactataaattccatctaggccttagatacacttcaaggcaaaggtagggatactgggcagagaaaacaccaagatttgacttttactccaacatgtacctaagtgtagactggaagtttgtattcaaaacattgggggagaaaagtttaatgttacctgtgtattcaacatataatatcctctgttttatccagataattcatcaaaatcagaggcatgcaaggaaggtgagaatcaggctgtgatttgcttacagatatgaaatcttgggagcaactcagtccagtgaagagacttttattgccccacaaactctaatattgggcagacttgggtttttactggttaggtgatgaaaagtccaaggtaattatcaggactaattagaattacaaaggacactgacacggggtcactgtaataaagttatactttatatttaccagcagtcttagacggctatgggtaaatgttctggctctgcggccccctgaaaagcaggattttcattccaacagaaaaaggaaaaaaactgattccaggtggaaccaatgttgcttccccacccttttttcagttcagagttgacaatcatgttataaaatgaaaaaggcaaatgcatgaacagattttagtgttgcataaaacaaaacttaccacaaaactaatgtggctttgttaatgatatgaataatagattctgggtaaatggtaattattcataattaatttcatttcaaaaacagccatagccaaaattatttttacacagtcaactcaaaatgtttccaaattctctaacatctataaattaaatcactcttgatgatttccactacaaccatgcaaggcttaatacttttacaacaaaggaatttagaatatgtcaccccaaaatacattactctggcatactgactattttgagtaaaaggtacttgaaaaacagcaactgcaagaactctctgacctttcttcttcataaaagcaggaaatgaaattcccgtgtgaaagacagcctccctctaccagaaggaaagcatcattcttatcatcaaggacgggaagctgagaccgaggaaaatctgtacaaacaaaccttgttaagctaacccttatcttcctcgttacttctctgcccaattacctactctgcccaagctcctctgccttgtcacagtttcacaatttactactctttcgccaaaagagtagtaaattcagtatataagttttcaattctaactgcatctgtgggtcttcatttccttacaaaggctccttgccatgtaaaattcataagaaataaatttctatgtttttctcctgttgatctatctatgtcaatctaattcttaggcctagctgaaataccccaaaaactggtaaaggtacaatttcacctcacctacaacacatacatatcctttaaaaacatctttctcaaccccaactccctagcagccatggtgcaccctcaatgtccgtgtttgagaattaagggttcctgagcttttctcctctgcaaatcccactcatgggtccttcaccaaatgtccattagcaattcattcagccatttcctatctcagtctccaccagaaagggccacccctgcagctctgaaatgcttgaggggcttgggaagctgaaattctgtggtataaggtttcaatggctagcctcgcataatcatcacacttggcggggggggggggggtgggcgggggggggccctaatgaaggcaagggagagggaagggaaaggacacagagaaaagccttcaggagtctgtttcagggcatctcagtcttggcactaatgaacgtttggtggggtcaggggtaattcttggttgtgaggggctgtcctgtgctttgtaggatgtttagcagcatccccagcgtctattcacaagatgccagtagctttccccaagtttggacaacccaaataaatcacccctggttgagaaccagcagtctactctagagtcttgagcatagagaggtataggaagaaaattaaacagaggaaagaacctgaattcagacagacccctgggctatgtgtagaagaagcaagtggctcttggtcacatgctgctctttgtgaacatgactcaatgtagcggaaatttgagagtgagcacaaggacaagaggaatggaagtcaggaaatgagaggaatctgtaaggaagaattccaacccaaatactctgcccctcactcacaaggtgatccctatgtatctactgaagagtactcaaactctttttcttaaggcgctggtttataaaggccatcaggaagcagactgagatttgggggtggggtggaagaaggggagttgggaggtagagaagggtttcccctacctaaactaagcttgggcttaagatccatcgagttcgcctcccgagcagagcaaagaactgaaacatgcgagagggttgctgtgaagcattttagccaacttttccaagccagatgcctggagttctcactgaggaagctggcagaacctagaaaaatccttattactccctcaaatttgcagagggacttcagatgactaaaactagctgcaggaaagaaaaaagacattttcttttctgcctagccatttataaagttttttaacttgcagaaaatcactgaagttctttcagtttcggagcctctaaaataaagtggaaatactataaacacatgtcacagagatgttctgaagattacatgagaccacagatgttaaagggcctagcacaaaggtggcataggtggctccctaccctctgtctctccttcatttttagttttctttgggctcatgcaccacatgcccacatctgtgccaccagagctttctctatctgctcttatacactatatttacgagcttctgtcgttatcttgttctgcgattttcctctctccctatgttcctgatgaggtggcagtggtacttgctgctaaatacatctaagtcctttcatcactggtgacaagagttcatgtgagaggtagcagtggagaagatgcaggaaaaagaatgccatagtgaggatgacatacttcatcactgttttacccttggcagctctcactccacctgcatgaagacatgaaaaaatctctttctgcgtgatagtgcaggtgtgtagtttagcaggaaacttgacaggcagttaaaagacaaagaagcggccgggtgcggtggctcacacctgcaatcccagcactttgggaggccaaggtggggcggatcatgaggtcaggagttagagaccagcctggccaacatggtgaaaccctgtctctactaaaaatacaaaaattagctgggtgtggcagtgggtgcctgtaatcccagtgactcgggaggctgaggcagcagaattgcttgagtccgggaggtggaggttgccgtgagccaagatcctgccactgcactccagcctgggtgacagagcaacactccgtctcggggggggggggggggcgggaaaggtgaagaagcatatcaggagttcagcttttgctaggtcagagaaagttcttaacagactaactcttttgcagataataaactgtggacaaaacacaaaaaccaactactgaagtctctaaagaatgaacaaaaacacattcttccccctccacaagaaaacatttacaatgtctgggatgtaatccaaaattacttgacatatgaagaatctggaaaatgcaatccacccccaatggaaaagacaatcaacagaagccaaccttgatacgacccagatatcagaaataacaagactttaaagcagctataattactgctgaggtaagagaagacatgctcattatggatgaaaagaatgggaaatctcagcagagaaactagaaatataacaacaacaaaaacaaataggagctttaaaacttgaaaaattcaatatctgaaataaaaagcttactggataggcttaatagcagaatgaagatgacaaaaaattgattggaaaaaggtcagtgaaaattacccaatctgaagaggagagagaaaaaaatttaaaaagaaagtgtttcaggaccctctgaagtcccagaaggtggggaatgagagaaagtggtgggaaaaaacatcagcataaattatagctaaaaacagtcctaaatttggcaagagataaatttataaattcaagaagctcatgaactgtaaagaagattaaaaacaacatcaatcacaaaaataaatgcctaggttgatagaaaccaaaaataaaaaagttgtgaaaggagacagagagaaaaaaacatatacagggcaacaattggaatcatcggacttctctttagaaaatatgaagtccagaagacacctggaacaatattttaaactttctgagataggagaagcacacttcactttaaatataaaggcacagacaggttaaagtaaatggatgtaaaaagagcatgcaaacagtgaatgattatcgtactaatattggagggggaagcatatcacctgcctagctgccacagtatgatttcaaaaaaaacaagaacattcaccaagaacaaacaaaaaaacctcttcaaatagaccatggaactgaattcaaacttgtatctgataacagcgatgacaatatctctctataacaatcctgaccagcatatatcacaattactacagaggctactgacaagaaatccaaccttggtatgctgtacacgactgtcctcccaccctcccagtgaaatcaaacaaaattaataatagtctactacatcagagggactccatttgggggaaagtttcaggctatgctcttgcctcaaaattggtggggaaaacacatagacatatacatacacacaaagcaaatacagcaaaatgttcaaaattgttgaatctaagtagtaaatgttaagtgtttattgtactatttttcagctttttgaatatattaaaattttttatactgaaaaaagagaaaaattagccagaagagctttattcaaaataccttcccctctctttccttcacattttgatatattcttgttggggaggtgtatcaggatattaactgtatcttttgatacgaaaaaaagtcacatgattctggtatatttcaaccactgctagaaaatccacatggataaatgctagaatgagggctaggactttttctagtttgtccattactgcatctagtatattttcaaggaaaaaatgttcaatgaataaatgaaaaatagctaccctagatgtttaataaaaaagacatctgcacttgtatgtttactgtggcacaattcacagtcgcaaagatatggaattaacctaagtgctcatctacagatgagtggataaagaaaatgtgttatatctatatcatggaatactactcagccataaaaagtaacatcttttgtagcaacttggatggaactggaggccattatcctaagtgaagtaactcaggaaaggaaaaccaaatactgcatgtttttacttataagtgggagctaagctacggatatgcaaaggcatgcagagtggtataatggacattggagactcagaatggggatgtgggactgaaaaaatcacctactgggtacactattcgggtgatgggtacactagcagcccagcttcactattatacaacttgcccatgcaaccaaaaaccactagtatccctaaagctattgaaaaaaaaaaaaaaaacttagtaagcctcctagactttataatctcaagacacgactttttaacataaattctgaacattatctggaaaaactgttgactggaatacgtttgtttggtattttttcaaggatagaatgatgttttgataatcagacttctcctttacttgtcacttagtaaccttctatactaaaaaaatttagtcattgaagtgtaacatgtattcaactgaagctagttgaattctcacgtttctcacactccccttgagctggcatcaaagattaacttaaaaggtcatgaaggaattcaaattcaaggaattcaaatttccagcatgcccatcttgacactttgaaataaatataaacacatcctgatgtcacttcattacagcattcccttcccaaggagctctaaaaagaaaataacctgcaggtgaatttttgacatgcaagtcttgaagataaaacaatatagcattcttccagatcagttatatgctttaaaagcattatttctccctgaataaaaatgaatccaaaggctgtgattcctaagaacaactgaagttaaagctaaatgttctcaaaacaattttacatagctcattctaaatgttctttaccaacttttaaataagaatgacaaataagagacagtcaaatgtttttatggatcttctgaataaactacgtaaagataaaaaatacatgtaagtataaaatacaatttgtaaatgagggccgggattagcaatgccaggatggataaagacatgttttctcgcatttaggtaactttgtcccctatgagatgaccctcagaagttgtctcgacgtttgctcagcagtgatttgattcaatgaccaatattcaaacagcactcccttagagactctacgcatgacctctgactgcttggtgcctaactctccacatatgtcaaacagagggaagaataattgctagctacctcccagcaattctagaagatttaatgaggcagggagccagacctccatggtgagtcaattattccctgggtagaagttatgttatttgtgaggtgccgtatttctaaggataacagagtattgtacaagcattacaaataggtatttctcgattcctcaaagtgttgacattaaatctttcagaataatatactcacctagtaacaaatagtctaatattttataaaacagtttgaatttgatggaatgaaagcatacggattttataatgttgtttcttttctgattattagtgagagagaacaatcttttaggacaaatgggtttaaaggaatagacagataagggagaagctctctaactgaatccagacctattaaaatggcgaccaggtaccatgacctatgtatttcattgagctggggccaagtccagagtccactaatttcagcttgctcaagtcaaggctaggatgctgccgtgatagaaaagatatggaactgctgaagaaatgtaattcaattcttataaagaaatggggcccaatattaacttacatgattaatataacacacataaataaaggcagtaacaaacacttaattttggattagtgatgtcacaggatctttaaatagttcatacaggatggtcatgctctcataagttaaaatggagaaaattgattttttacaccagattagccacacaatattaatcatataaaatgtttccctgaaagtcttggcataaaaatgggccaatgtgctctgttttgcctttttccccaaagtaaatttagatgggggtgaggagggaaaactttagaaagcaatcacaaatttcaaaatcaataaattcaaattgtttttaaggcagtaaatacatagtcctgccaaatgctgcaggaaattgatgtacaatctgtctggcagttggaccatgtgaaaaaattttaaaaagaccttaaaataaccaagattctgaaggctcaacaaactttgttttagtaagacaattttcctggtccataaaaaagataaggaagtaaaaggtgggataaccaatttaacttagggtgtggtgaattatcttgggtatcttaaattggtacttaatttggtctgggctcagaagaaatggtttaccatggtgattaagaccagctgctaggtgtcatagatttaaattatacaacagaacacaggagtgtgtttgaacacagacgggtaggacagtctccaaaaagctaagagtgccacctctgttcagtgaaaattaagtcagttttttactaccctttaagagctgcctccactgatttggccttgaacatagactgaatgagaagatttagtttcccaacacatgtgccaccatgacttaaagacttaatactaagtctttaagtattaaagacttaatactaagtccactaagtagacttagactaaagtccactttagtctaagtcccacaatttttcagaaagaccaggaggccatttaaacaaagaaaataatttctttcctacaaaaatcaggggaaatactaacctttgtcattcaaaatagttttagtttgataccaaagtatccttattaacactttgagcagggacaccaacatattttattttattgttcacttagaagttataaaagtagtctacattaaatgaaaaaattcaaacaataccaatataaaaatgtactaaatagtgtaagttcacttttgactctgaacccccagctaccaaactcaccagggaaaactactgtgatttgttgaagtgaagggagcgaagagtccacattaaattagaatataacagtacaagtttatggactttttacatcaatatatgtactttcaatgtgactaaacgatttcaccatttactatgctttttctttttcaaagtaactataaagacaggtacctttggggaagaaaaaagaaaagaaaaaaagtaaatataaagaaaacactggaactagattttcaatggtgcagttaataaggattagaaaatactatatataatagaaaatataagatttaaaattttaagatcttcttgttatgacaaataatatctatatgcataatacacatatgtacatgtgtatacatacatatacacaaactacatattacagcatacaaaatactgagtaacacaatgaatatgatctttttggatattcttgaaaaaagtaaacttcatcatttgatttatctagaagaattttattggccgggtacggtggctcacgcctgtaatctcagcactttgggaggctgaggtgggccgatcacctgagatcaggagttcaagatcagcctagccaacatggtgaaaccccatctctactaaaaatacaaaaaattagccaggcgtggtggcacacacctataatcccagccacttgggaggctgaggcaggagaatcacttgaacccaggaggcagaggttgcagtgagccgagattgtgccattgcactccagcctgggcaaaatgagggaaactgcgtctcaaaaaaaaaaaatgtatttataaatctaatgctttagtggcagaccaggagacaacccacatacaagtggtcaatttgaattttatctagaaccattactgttgccctgaaagccagattcactttagtcagctaaattttatggagtgtgttttataaacaaagcattgtatgaagctctagaaaatagtcagcagaagacagtccttcttctcaaaggctttccaacacattatcaagaacatacacagtcacaagcaattacaatttgaaagtagcacacagataaagaaattaattaccactggtggggctggagaccgtttaacagaacagataggtttaagctgggtaagatttcaactagcaacacaggaatgaagggtgcttgaaaacagcacagaaaggcacaaggaaatagtacagacaattgtacaagtaaagacaaagaagtaggaggctgccatgtacatgtgaaggataatgaagtggcagggcaagactagagttcgggggcacagagaaggcaggaatagaagatgagcctggagaagtagatgggggcagattttggagcctattagctataaaccaaaaaatttagcatttatattacagaagtagggggccatgaaagtctcaaagtgaatgacatgatcagaataatgatgcatgagttaaaatggaaaagaacagttaggcagagtacgacccatgacaaagctccaaagaagaggtaatgttgcgtagattaaggacagtagcaatgaaaactggataaaggaaacagaccgaaagacacattctgaaggcaagttgacataaggaaaagatcttaggccccaggctaaagatttgaattctggctcctccaactatttgccttttggcgttgggcatgtttcttagctcctttaacatatagtttccttatctataaaacaggaataatgcacttgcctgtgtgtgggggaaaaaaaactgtgagaaaaatacagaaagttgtctagataattcatgtcaacacacttatttattcaacatcatataatgataaaaagaataaaacgtagccccaatctggttggggaaacagacatacaaacaactaaagtgacaatgatctgatgtaactggacctatattaggagtaagatccaacagaaacacagaggataaggtgtgtgtaaagccactaaagaccgtgtaaaagtgctgaaaaggttcaatgaagttccacagaggtgatgtgtgaaccaggctactcacaacttttaatgtttcttattttcacatcaaatcaccaggtccttcaccacataaattatagtacacaaccccctaggacccagtggtatcatttgaattctggagtgtgaaagtccaaaggaaatggtggaggaaaaaaggggaggtgaggggagaggaagaaagattagaggagtatgaatgaattttaggcaaataacttctcaggaaacaatacttgaaagaaagccagataatacttagattctcagtgtgatacaatattaaggcagcaaaactcaaatgaaagaatgtaatgagttccaggtgtcgtttagtagatttttttcagtaggtgaagttgagttgaggtggctactgtcagtgtcaatgccctgtctgaacaagttttaatttaacttcaagcaatacataggcttttgtttagactgtttgcatatatttgtctactgctgctaagaggcaaaataacctctttctcgagaaagtgagataaaactatgattgcaaaaatgtttattttttaatcttttcatgaatcaagtaattttatctaatttattcaacaaatatttattgaatagttactgtgcataaggcccagtggggaatatgagagaatataatatgatatagattttatcaccaagaaggtctgagtctcataagttcactataaagtagaaggtaataaattcaatgagaagtatacagataaagtgccacacagtataaaggaaggagattactttgagctgggaggataaggatttggcactggcactaggacagaggggactatgttgtgttactcatgcaacaaacatttactgagcacatacaatgtgcatgcacttacctaaatgcaatgagactttgaggtgatttagtccaattccttcacttaattcactagaaaatgaaaactcggaaacctaaatagctaattcaaggccaagatacaatttgaattgatatctccagtctgcaagtccaataatttctactacttaccctgtcacctccaaaactcagtctaaattttttgtcaggtacaatcattatttcaaaaggcattccattccacttataaattaatttgttataaaatgtgttttctaacatttagttaaaagttgccttcatttttaactaaaaatgaagtggctctagtggctccccctgtagttacacagaacaaatagaatcctgtggccatgtgatcatccttcacatatatgaagacaatcctcacgtcccccactctagtaggcactcagtaatcactatagttggggaataagctccggaattagatgggcctggatgtgaatctcagcttcaacattcacttggtgtgtgatcatgagccaagttacttaatttagataatctgtgtgtttatttagacaatgggaatgtttatgtccttcatgccttccattcaacgtaatggccaataactatgatcaagaattggcacaacttttggtgtaactgtcagaacactagagtttctctatacacattaagctggcactgaatcataagaggaaaagttgcaaaactgaaaaagatggcagcacctgtctttctctcccacttctcttcctctctggcataactagtctgtgagtgacagctgtgaaatactaaagactgggcgacatggcttttccagataacctgtgaagaatggtgaagcatggcttcatcaaatgacctgtgctaatagagctgctggcaaaagtgcagtcattttattgagataaaacattgaaaataattttcataaaataaggcacagatgctttaattagaaaaaaatgtccttgagggtgggattcagatgcagttttataacttgtacggtgccttaaatgcattaaaagatagacaatggtacaaggactattctccctagtggtaacaaaactgtttcctagttactagggtagggtagggaggaaatgaaaggaagaagagaaaatctagagtttattcttttcctgcttctaatgttataagccaatgctaatgtttagtagtcacaacctcgtctgctaggcactgcaactaatttcccgtatttgggtagaaaaaaatgcatcatgtctcaaagaatgaactactgacagaaatttagtgactgatactaaaggtagatacgtagctgcagggtatgagaaagaggagacacagtcctaaaaataacagcaaaactaagatgaaaatgcagagaagtggtatggtacattggtagctatcccctaatatctattctacctttcttccatagaaatatcgttttagccaggcatacagtcattcggaataaaagcaacactttcggtctctattgcaactacatgtagccctatgaccaagtactgacccgcattatatggacgtttctgggcacctttctcaaaagatggctggggcatgcccatttcacccctttctccaaccagctgcctgaagtggagatgcctccacctttgaccatgaaactgagagcctcaccctaggcatggtgagtggtgagctggaaggagtggggctctcgatgcagaaactgatttttccatttttgttaaacaatgctgtcaaaaaggccctaaaaactatcttttgcacatatctatttccttagattacattcctagaagtgagtgagaggatatgaaaacataatctgtcatggaactagagttaaaaaaaaaaagaatatgaaaacattctaaagctcccaacacatatggtgaaattgttcttctgaaagtttaaatttacatgttctctacatgccttcccagcccaatgtcaggagttaattttatcattaattggtaagagctctcttatattaagggtgtgaataccatgttataaatacctcttcccaattaatttacctttcaatttagttactatttttgttgttgtgcagtaacttaaaatctttatgtaataaacctttttaaaaagtggtttctgcccttactattatatagtaaaaagtcttcccacgtatcaagattatgtacatatccacctatattttttctattacctttttgctttcacttaacctttaatccacatgaaatttatttttccacacatttagccgattgtaccaacaccaagattccacacattcaataatagatgctattgaatataactattcctaataactgaaaattccacttttatttattctgatatcttgaattagtattattagactgttttaattattgtggctttagaaaaaaattttatactcacttatgcaattaattcacattatttcttttttttacaaaagtgtgtttggtttacacctctaagtgaactttagaaacacattgtcaggtttggcaaaaagaaaaaaacacctgaaattttaactggaattgtattaatgatcaatagagagcaattggggtagggaatgcataactttaaaacattaactctccccattattcccacaaatatgagatgtttccccatttcttaaactgtttttatgtcccttatgttctatagtttatttcttatagttagtcgtagagtttacttgcttaaacttgaggcaagtttccttagttacagatcttttatttatatttgtgctattataagtaggatctttaaacacatacttgtctgtgctggtatagaggaaacactaatttctgaatttattttgtaattgaccatcatcttactggtatgtttttaataatgctcataagtgttagttgattatcttgggttttctagttagataactgtattttcaatttcaaataatgatgacacttctcacttcctttgcaatatttaaacttcattttcttgtcttattgcattagacaaaactttcaaaacaatattaaataatagaggtaatagctgacactcttttttccacccctgactttacttcttaggacattttcctattttaacccataaaacagctgcatcgtatcagtctttcatctgtttttacactggtcccaacccccaatccctaactatactgtaagttccttgaaggcaaaaactgtgttttgctaattttttaaatcactgtagcatccagcacagtgtctggcacagagaaaataaatcattaaacggatggttctcaaaactggtgagtcactggaattacatgggagcctttgaaaaaaaccaactgcaagtttcacaaaccatttacaagtcagaaattccctgttcgtgggggtgcgaatctagacgtgtcaaaagcttcttagatgatttctgacggcccacaggtttgagaaccactagtctagtatttttatcactcccggagattctgtttcagagtcaggggcctgatttttagtaaatcttcctgagatgattcagatagaagcaggtttggaaactactgggttagacagtaattcaaagaagggatcagagttttatttttttcctttatgttgtctgtatatttttcacatacaaaagtggaaaagatagcaagatatataaagaaaaggccaatctctcctacctctatcttctaaaagtagccatttattactgtgtagtggcatccttccatccctcttttcttgcttacacaaaataaacacgagagagagagagagagagagagagagagagagagagacagagagagagagagaagtactctttctgtttttattaaaacaatcagacacttattttgtaatttggtagtatttaaaaaaatgttatttcaaataaatgatgatgaaaccaatatctgttctcttgtctatatagatttaaatttagcgatgagtataaaaacattttcatttcatttttaattctttagcaggtataggaacaatttgggaagattcacctaggaaattttttttttttttgcgggggtggggcagggacgaagtctcactctgtagcccaagttagagtgcagtggcacgatctcagctcactgcaacctccacctcccgggttcaagcaattctcctgcctcagcctcctgagtagctggaattacaagcgtgtgccactgcacccggctaatttttatagtagagatggggtttcaccatgttggccaggctggtcttgaacgcccaacctcatcacctaggaaattctaaaactatcagttaatatactaaaggatatgggttcataggtcaaacagcatcttaaaaaccaggaggacagtattaatacaggaaggctaaaaatggcatataaagccttcttttctatacttataataaagtaattaaaagctacaaaaagaaaaccttttatgttacttatgcttagctattactcattttttagataaaagatatttttaatacaaaagcaaaactaaggcacaactgatctccacttacatgctttaacaaaacataaaaggcagcactcaaatgtacaccagaaataaaaattctaaaatagaactactaataaaaggaatgtaaattactggctaagacagaaacatcatattttagaagactaagccatgattttggtgaaatcagtacatcattcgtttgttattattaaattttcataaagcatctccaaaaagctcaatgacacacactaataattgttaaataatgcaaatgaatacttctaaattctccagtactgtaaattagcagacagtgtgggagttgcagagaacaatgagagagagaagtaaaaacaaagcaagcagtaatatgatatcttaaattaagttgcaatttctgatttactccaaaaggatctttctgggcaggcaggatttaaagagttttaagaaatgatgtctttctgcctgtcaggagtgtgttagaagtatatttaattctgtgaagttggaataggaaagagaacatgggggagaactaagttaatctagaagaggtgtgaaattggagaaaggcctaaaaatcaaatgcaaatatgctgaagatagtaataattttaaaaaggaaatagtttaaagaaagggaacaacattcagtgtggtaaagaagtggtattaaaaatagtgttttgtatttttttttggcaggaatggaatggattttatggttagataaatcaagaagacctacaatggcagttaagatttgaaattgctagatatttggcaagagaactgataaaaagagaggggagtaattatcaggtgtcacccacaccctgaaggctgcacccactcttatcctctaattcctttgacccagagtaacacttctccctcttcctgtccagatgtggtttctctactagtgctctaggtcccatcccctcctctttccttaggaacttcattccattgactatcttcagtcaatcctccaattcctgccattagctctttcagcatataaaaatcatcaagtatgccaggcatggtggctcacacctgtaatcccagcactttgggaggccaaggcgggaggattgcctgagcccaggagtttgagaccggcctgggtaacatagtgagacccaactctacatttttttttttttaatttgccaggcatggtagtgtgcacctgtagtcccagctacttgggaggatgaggcaggagaattgcttgagcccaggaggtcgaagctgcagtgaactgtgtctgtgccactgcatttccatcctgggcaatagagcaagaccctgtctcaaaaaaaaaaaaaaaaatcatcaagcgtttcatatctaaaagcaatataaaataaaataaaaagtttctttaatcttatgttctcctttaactattatatctcttcttttcacaagcaacttctaggaagaagtctacttcttccctccttgattcacttcccgctctgaagcagtctggctttaggcgtcaccatctcatggaggctgcttcacttaaaagcaacattgatctccttaacaccttatccaatcttcgggttttagctctcctatgattcgatcttgctgaagctttttacacattcatttcctctttcttgaaatgttctcctccctcagtatctaagatgtcacattcctttctctgttgttgctccacagggacccatctcagtctaatattattctccctctatactgatgacttgaactataccaattaaaagatgactcacaatccagaaatctctagcccagatctctgtggaactccaattctggttatgtctaagaagcatctctttctgaatgtctgatggtacttatataaccaaaatgaattcatcatattccaccttaaaaagtcactattccttaaattgaatggatccaccaacccctcttctctccttcacctagttattcaggtaatctgggacttatctgagatcttccttttctcttacttcccagatctaatcactaaggactagagattctctcaaaactgtcccctaatatcaatttcattgcttttgttcatttctcatttggactatgtcatattgcaacaatccccttaatgatttctctacttccaatctcaattttttgcaattctgtttcaagaggtcagcttgctgtaatttttcaatggctttcagttatccataagcccaactcccaacctccttgtaaggtataaacgctgctgcctactctccagcctcatttctaccactttccaactcaatttcatgctctagcaacactgaacatgctttcttatggctagtccttctgtaaatactgcagcaccattttttccacttgtctatctggtacattcttactcattcttaggtatctgtttaaatgctaacttctctaacagcatcccttttctctcaggtgaactttggtgttccttatatattcctaactgtagttttgaagactcttccattaaacaatgatcttattgcattataattgtttgcatgggcatcttaacttcttaactggcttagattagggaattaaaatagacattggctgggcacagtggctcacacctgtaatcccagcactttgggaggctaaggtgggtggatcacttaagaccaggagttcaaggctgcagtgagctataatggtgccactgcacactagtctaggtgacagagtgagaccctgtctcaaaaaaaaaaaaaaaaaaaaaaaaaagagagagagagattatgaaaacatttactgggagacctaacccattttttgcttcaggaaaccaatcttaaacagtgccaagaaaggcaagccaaagacagtggatgaagacagtggtggtgatgctggaaaagcccaggcaaactgaagcacagctactgtggaagagagaacagcaggaaaaaactggagagacaccaggagcccaactgtgaagggactgctaagagaaggttcagctttgtgcttccagtcactgattcaaactttcttcatgaatccaaccactaaattaaacaccagctttctaaaagctgcacattctcatactataaaagaaaatatatttcaaataaaatactttccaggctttccagaagaaaaaatccatcccatgtcacccactgtgactaagcacggaggaaacagattaaattagggatattttgcccgtacatctccaggctgcatgaaatgaaaacaaatgagagtcaggactctcaaaagtttcacagttctaaccatcaacgcaatgtgccaagcaacatagtaaatgttcacgtttcaaacaggaggaatacattttaccttttctatctgggatagaagattagattctaatcttttttggttttccactcagatgagcaccttaagtgggatcatatttctatattacaggtacttttttttttcctgaaagtctgtgaatacttaattcaaaggccatggacagcaacctagaggagctctgaccatgaaaaatgttttataaatagttccatgtgcactgttcatctggagtctcactagagatggataatgaccttgtattttgtactcatttactctgaattagccaaaccttctgtttttaattacatacttaattcacctagcatggtctaattacataaaacaaaacatcatttaaacaaaaggtggccttgaacttaatctatcaaaacaccagttagtttttaaagtttttagttcttaacaaactgccaagacatgcaatagcaattttccaaatgtgatcatatgcttttatagcaacagatttactacataatcaaacatctgtatatacttttgtctcactattaatgcaaatatgcttaagttttgatagacttaaaaatcttaaagctgaagttcatactacacaataatttttaaatatccatagtcattttggccttgaaatgacaagttatcataaccatggctacttatttacaaaatggtccagaactttgtaaaaactcatgttcagaattttccttaattcttcacagtgtaaattagtagcccttctctgtgttatcatagcaccttatatattttcaatcacagtatttataatgctgaatagttattggtttaaagatctgacccccaactagattgcaaacttcatgaaagcagagtttatgccttttatctctatcttgccaacatggagcacagtgcctagcacagagcaggtcctcaatatatatttgctgaattaatgtattaaaatacaatgttgtaaaactatctcaatttatgaatatgatcttatatgtagaaaatcataaggaattcaccaaaaaattattagaactaataaacaagttccaaaaggttgcaggatacaagatcaatatataaatatcaattgtatttctatgcagcagcaatgagcaaacaaaaatgaaattaagaaaaccaattccatttacaatcaaaaccgttaaaatattttgtaataaatttaacaaaagaaatatacaacctatactctgaaaaccataatcctcaaattgatctacagaatctagagatccaatgcaatccctatggaatcccagctgacttctttgcagaaattgacaagctaaacctaaaattcatatggaaattaaaggaattcaaaatagtaaaagcatataatggaatcctattcggccttaaaaaaggaacaaaatttgtcacactacaatattgatgaaccttgaggatattatgctaagtagaataaaccagtcacaaaagataatactgtattactccatttatatgaggtatctaaaatggttaaattcatagaaacagaaagtataatggtggttgccaggggctgatgggaaaggggagctgttatttagtgggtttaaagtttcagatttgtaagatgaaaaagttctggagatctgtctcataacaatgtgaatatacttactatttaactgtacacttaaaaatgatgaaaatggcaaattttatggttttttttaaccaaaataaaaaaaatttttaaagccaaaacagtcttgaaaaagaacaaagttggtggacacacacttttcaacttcaaaacttactacggagctacagcaatcaagacagtgtggtagtggcatgaagatagacatatagatcagtggaacacaattgagggtccaaaaataaatcttcatatttagagtcaattgattttctagcagggtaccaagataactcaatgagggaaagaataatcttcaacaaatggtgttggaacaactgaatattgacatgcaacagaacaaagttacttctatctaacaccatatacaaatattaactcaaaatagatcaaagacctatatgtaacagctaaaactataagactcttggacgaacatgtaagtgtaaagctttgtgacctggagctacacaataattttcttagctatgataccaaaagcactagtaaaaaaaaagaaaaaaggaaactggactttatcaaaatttaaaaatgtgcttcaaaggacaccatcaagacagtgaaaatacagcccacagaatgggagaaaatagttgcaaataaaatatctgataaggaacttgtatgtagagtatatacagagctcttacaactcaataataaaaagactaataaccaatttaaaaatgagcaaagggtctgaatagacatttctccaaagacaatgtgcaaatggacaataagcacacaaaaagatgctcaacatcatcagctattaggtaaatgcaaatcaaaaccagaacgagataccacttcatactcactaggatgactataatcaagaagatagacaatagcaagtgttgcgaggatgtagagaaattggaaccctcatacactgctgacaggaatgtaaaatggtgcagtcactttgaaaaacaacctgacagttcctcaacagagcatttccatattattcagcaattcttctcctaggtatactcaagaaaaaggaaaacgatgtccacacaaaaacttgtacaaaattgttcacaacagcattattcataatagtgaaaggaataaagtgttatctgcacttcatccttacacggcctcatagtattccatattatgtatgaacacaccacattttgtttatctgttcatcaattgatggatatctgggttgtttctacctttttttttttaaaagctattatgaataatgctgcaaacttttctgtctttaaatcctgacatgaagatctgggctgaggcaggggtagaggggtagagaaaatgcctatcatcaagttcttccctatgtctatggcctagatggggtgggtgtcggatggtgctgaggcaggaagaggagaggagaactctcagtaagttgctaatgagaagagatcccagaagctagttcctgtgttccattctgcagtaacatgtcctctctaccatgagtgatacaataggagaatgggtgaacactcccactgtggtagatcctaagcaaagcatgacatggccctgccctccaagaaattttgtccataagataagtcactatttcatgttactgtaataatttttgtcattatctggagcaaaaaggaggatcttttgcaacaaaagagtttatgaacctaaattgctcttgtcaagatcaccaatgacctccttgttgctaaatatccaatagtaaattataagtcctcatctttcttgggcattaacaaaatctgaaccagctgatccctctttttagaacactttcttctcttggcttccagaatatcacactctactagttattttcctacttcgctgatttgttccttatctgtcccctttgctgattcctcgtcttctccccaatctctcaatgttagagtgccctggggatcagtccttaaaccatgcagtgagctgaataatggtcccttgagataccatgtcctaatccctagaatctctgaatgttacctcatatggcaaagactttgcaaatgtgattaaattaagtctcttatgatcctaagaatggggagataattctgaataacttggatgggccctaaatgcaatcataaatgttcttttaagagggcaggataggaattcaaacagaaaaagacaaccttggaagcagaatcagagggaaaagatgctacactgctggctttgaaaatggagaaaagggctatgaaccaaggaatgcaaggaatacagatctagatactaaaaagggcaagaaactctagattctcccttaacagtctccagagcaagtgtggccctgctgaaaccctgatttagccccataagacttagtttggatttctggtccacataactataaaagaataaatttctgttgttttaagccaccaagtaagtctgtcataatttgttatagcagccataggaaactaatacagattttggagcctggaagtggggtggtacaaaaacaaaaacctaaaactatgaaagtggctttggacttgacagtaggcagaggctagaaggagtgggaggtgcatgatagaaaatactcagattgcctaaaacagatttttggtagaaatttgaacattaaaggcactgctggtaacagctcagaagaaagtgaggagcatggtagagaaatcctaattcatcttggagaacacatatatcatcataagcagaatgttggtagaaatataaacacagtaaagatggtactggtgagggctcagaaggagatgagcaacattttattagaaactgtaggaaaggagatttgtcatatagtggcagaaagcttagctgatgtgtgtcctacaattatatacaatgatgaacttagatttagatgatttggatgagatcttggacttttgagctgattatatttaggtgagattttgggttgaaactgaaatgggttgaggcttctggagatactgggatggggtgaatattttgcatgtgagatagatgtaaatccttggagacaagagggcagactgtggtaagctcctcaagatattcatgccctgatgcctggaacctgaaaatgctacctcatatggcaaagactttgcaagtgtgattaacttaagcatcttgagatatggagattatcttggattatctcagtgggccctcaatacagtcacaagtgtccttagaagaggggaggcagagaggttttacacaaaagaaaaaggtcatgtgaccaaaaaaaaagaaaacaaaaagaaacagataagagagaaaagatgctatatcactggctttgaaaatggaaaaagaaggctggtgtggtggcttttacctgtaatcccagcactttgggaggccgaggcaggtggatcatccgaggtcaggggtttgagaccagcctggccaacttggtgaaaccccatctctactattttttttatactttaagttctagggtacatgtgcacaacgtgcaggtttgttacataggtatacatgtgccatgttggtttgctgctcccattaacttgtcatttacattaggtatttctcctaatgctatctctacccctgccccctaccccatgacaggcccccatgtgtgatgttccccgccctgtgtccaagtgttctcactgttcaattccaacctatggtggtttttgttgccactgcttttggtgctttagtcataacctatgagtgagaacatgtggtgtttgattttccgtccttgtgacagtttgctcagaatgatggtttccagcttcatccatgtccctacaaaggacatgaactcatcccttttttatggctgcatagtattccatggtgtatacgtgccacatctttgtaatccagtctatcagtgatggacgtttgggttggttccaagcttttgctattgtgaatagtgccacaataaacatacgtgtacatgtgtctttatagtagcatgatttataatcctttgggtatatatccagtaatgggatctctgggtcaaatggtatttctagttctagatccttgaggaatcgccacactgtcttccacaatggttgaactagtttacactcccagcaacagtgtaaaagcgttcctatttctctacatcctctccagcatctgttgtttcctgactttttaatgatcgccattctaaccggcatgagatggtatctcattgtggctttgatttgcgtttctctaatgaccagcaatgatgagtattttttcatgtgtctgctggctgcataaatgtcttcttttgagaagtgtctgttcatatcctttgcccactttttgatggttttttttttcttgtcaatttgtttaagttctttgcagattctgggtatcagccctttgtcagatgggtagattgtaaaaattttcttccactctgtagattgcctgttcactctgatagtattttcttttgctgtgcagaagctctttaatttaattagatcccatttgtctattttggtttttgttgccattgcttttggtgttttagtcataaagttcttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctagccagttttcctagcaccatttattaaatagggaatcctttcccgatttcttgttttcatcaggtttgccaaagatcagatggttgtagatgtgtgttgttatttctgaggcctctgttctgttccattggtctatttctctgttttggtactggtaccatgctgtttcagttactgtagccttgtagtatagtttgaagtcaggtagcgtgatgcctccagctttgttctttttgcttaggattgtattgcctatgcaggcttttttttggttccatatgaaccttaaggtagttttttccaattctgtgaagaaaggcattggtagcttgacggcgatggcattgaatctataaattactttgagcagtatggccattttcacaatattgatgcctcctatccatgagcaaggaatgttcttccatttgtttgtgtcctcttttatttcgttgagcagtggtttgtaattctccttgaaaaggtccttcatatcccttgtaagttggattcctaggtattttattctcttagtagcaattgtgaatgggagttcactcatgatttggctctctgtttgtctgttattggtgtataggaatgcttgtgatttttgcacattgattttgtatcctgagattttgctgaagttgcttatcagcttaaggagattttgggctgagacaatggggttttctaaatatacaatcatgtcgtctgcaaacagggacaatttgacttcctcttttcctacttgaataccctttatttctttctcttgcctgattgccctgaccagaacttccaacactatgttgaataggagtggtaagagagggcatccctgtcttgtgcaagttttcaaagggaatgcttccagtttttgcccattcagtatgatattggctgtaggtttgtcataaatagcttattattttgagatacgtcccatcaatacctagtttattgagagtttttagcatgaagcgctgttgaactttgtcaaacgccttttctgcatctattgagataatcatgtggtttttgtcattgattctgtttatatactggattacgtttattgatttgcatatgttgaaccagccttgcatcccagggatgaagctgacttgatcatggtggataagctttttgatgtgttgctggattcggtttcccagtattttattgagaattttcgcattgatgttcataaggaatattggtctaaaattctctttttttgtgtgtctctgccaggctttggtatcaggatgatgctggcctcataaaattagttacggagaattccctctttttctattgattacaatagtttcagaaggaatggtaccagctcttctttgtacctctggtagaattaggctgtgaatctgtctggtcctggactttttttggttggtaggctattaattattgcctcaatttcagagcgtgttattggtctattcagagattcaacttcttcctggttttttggtcttgggagcatgtatgtgtccagtaatttatccatttcttctagattttctagtttgtttgcgtagaggtgtttatagtattctctgatggtagtttgtatttctatgggatcggtggtgatatctcctttatcatttttttactgagtctatttgtttcttctttttcttctttactagtcttgctagcagtctattttattgatcttttcagaaaaaccagcttggggattcactgattttttgaagggttttttgtgtctctatctccttcagttctgctctcatcttagttatttcttgccttctgctagcttttgaatttgtttgctcttgcttctctagttcttttaattgtgatgttagggtgttgattttagatcgttcctgctttctcttgtgggcatttagtgctataaatttccctctacaaactgctttaaatgtgccccagagaatctggtacgttgtgtctttgttctcattggtttcaaagaacatctttatttctgccttcatttcgttatgtacccagtactcattcaggagcaggttgttccgtttctgtgtagttgtgcagttttgagtgagtttcttaatcctgagttctagtctgattgcactgtggtctgagagacagtttgttgtgatttctgttcttttacatttgctgaggaatggtttacttccaactatgtggtcaattttggaataagtgtgatgtggtgctgagaagaatgtatattctgttgatttgggatggagagttctgtagatgtctattaggtctgcttggtgcagagctgagttcaagtcctggatatcctgtcttgttgatctaatattgacagtggggtgctaaagtctcccattattactgtgtgggagtctaagtctctttgtaggtctctaaggacttgctttatgaatctaggtgcccctgcattgggtggtacatacatatttaggatagttagctcttcttgttgaattgatccctttaccattatgtaatggccttctttgtctcttttgatctttgttggtttaaagtctgttttatcagagactaggattgcaacccctgcttttttttgctttccatttgcttggtagatcttcctccatccttttattttgagcctatgtgtgtctctgcatgtgagatgggtctcctgaatacagcacattgatgggtcttgacgctttatccaatttgctagtctgtgtcttttaattggggcatttagcccatttacatttaaggttactattgttacgtgtgaatttgatcctgtcattatgatgttagctggtcattttgcccgttagttgatgcagtttcttcctagcattgacagtctttacaatttggcatgtttttgcagtggctggtaccagttgttcctttccatgtttagtgctttctttaggagctcttgtaaggcaggcctggtggtgacaaaatctctcagcatttgcttgtttgtaatggattttatttctccttcacttatgaagcttagtttggctagataggaaattctgggttgaaaattcatttctttaagaatgttgaatactggcccccactgtctactggcttgtagagtttctgcccagagttccactgttggtctgatgggcttccctttgtgggtaactcgatctttctctctggctgccctgaatattttttccttcatttcaaccttggtgaatctgacaattatgtgtcttggggttgctcctcttgaggaatatctttgtggtgttctctatatttcctgaatttgaatgttggtccaccttgctaggttggggaagttctcctggataatatcctgaaaagtgttttccaatttggttccattctccccatcactttcaggcacaccaatcaaatgtagatttggtcttttcacatagtcccatgtttcttggaggttttgttcatttatttttactcttttttctctaaccttgtcctctcactttatttcattaatttgatcttcagtcactgataccctttcttccacttgatcgaataggctattgaagcttgtgcatgtgtcacgtagttctcctgccatggttttcagttccatcaggtcatttaaggtcttctctacatgtttattctagttagccattagtctaatcttttttcaacgcttttagcttccttgcaatgggttcgaacatcctcctttagctcagagaagtttgttattaccaaccttctgaagcctacttctgtcagctcatcaaagtcattctctgtccagttttgttccattgctggtgaggagctgccatccttttggggagaagaggtgctcttgtttttaggattttcagctttctgctctggtttctccttatctttgtggtttttatctaccttttgtctttgatgctggtgacctaccgatggggttttggtgtagatgacctttatgttgatgttgatgctattcctttctgtttgttagttttccttctaagaatcaggtccctcagctgcaggtctgttggagtctgctggaggaccactccagactctgtttgcctgggtatcaccagtggaggctgcagaacagcaaatattgctgcctgatccttcctctagaagcttcatcccagaggggcatctggctgtgtgaggtgtcagttggcccctactgggaggtgtctcccagttaggctacacaggggtcagggacccacttgaggaggcagtctgtctgttctcagagctcgaacaccatgctgggagaaccactactctcttcagagctgtcagacaaggacgtttaagtctgcagaagtttctgctgccttttgttcagctatgccctgcccccagaggtggggtctatagagtcagcaggccttgcagagctgcagtgggctccacccagtttgagcttcccaggctgctttgtttacctactcaagcctcagcaatggcggatgcccctccccctgccaggttgctgccttgcaggttgatctcagactgctgcactagcagtgagcaaggctccgtgggcatgagacccgccaagccaggcatgggatataatctcctggtgtgccttctgctaagaccactggaaaatcacagtatttaggtggaggcatcccgtttttccaggtacagtctgtcacggcttcccttggctaggaaagggaaatcccctgaccccttgtgcttcctgggtgaggtgatgccctgccctgcttcagcttgccctccgtgggctgcacccactgtccaaccagtcccagtgagatgaaccaggtacctcaattggaaatgcagaaatcaccgtcttctgcgtcaatcacactgggagctgcagaccggagctgttcctatttggccatcttggaatggaatccatgtctctactaataataaaattagccaggtgaagtggcagatgcccataatcccagctacttgggaggctgaggcaagagaactgcttgaacccaggaggcagaggttgcagtgagctgagattgcaccacactgcactccagcctaggcgacagagcaagactccatcaaaagaaaaaaaaaagaaagaaaatggagaaagaaccaaagactcaacgaatgcagctccagatactgaaaagtaaaagagattctctgctagagtatttggagggattgtagccctgctgatagcatgatttagcctcataacacttagttcaaatttccccagagaaggtgtggccctgctacaactcaggtttagccccgttaagatttagtttggattcctggctccagaactgtaaaacaacacatttctactgttttaagccactcaatttgtggtaatttgttacagcagccatgggaaatgaatacagaccccttcccttctctacatatactcatttctttgttacagcagccatgggaaatgaatacagaccccttttcttctctatatatactcatttctttggagagtcctttgaagatcccattcagtctcatggttttaaataccatctatatactgattaccacaaattccagcctagaactctcccttgaactcccaatttggacacacaatcgtatatttggtatgcccacctggatgcagaagaacttcccagccaacaagttccacccacagtcttccccagttcagttataggcaacaccatcctggctgttcaaacaaaaaaccttggaattatcccggatctttcattctcatattcagtcagttatacaattttgttgcctatatattaaaaagttatcaggaacctgaccagttcttactgtctctggtgctctttgcccggatgactgcttctacccttgccccactcaatcaattctgaaatgtggtcagagtaaactttttaaagtcagtcagttagagatcaagttatttctctatggctacatatttcttttagaacaaatgcccaaatctttacaataccttcagaagcctaccatctggtgcaccctaccacttccctatcctgctctccaacttcatcttcttatgttctggccctcactcattcagctgcccaaaatcaatgtatcactttagtgttcccccaacacaccaaaggaagcttccacttcagagtctttgctggtccctctacttggaatgttcttccttcagatatccggatggctcactccctgcttggtcctttacctccttcaagtctttattcaattgtcactttctcaatgaagccttctccaaccattctactcaatattgcaagccctttaccccaacaccggcctcattaccttacgtggttcttttttctctccaaagtacttatcgtcttttagcaaactgtatactttactaatttattatggttattgactgttttctccattacagtatatgctttgtgaaggtagagatttttgtctggtttatttgttgctatatcatgaatatctagaacagtgccaggcatgtattacatataactgatttctagtatataggaagtagactgcactaccctagtatttaaggtcctgatgaatccattacaaatattttatttcagacttcaagtttttatctatactgcttcaggaaacactttatgttaactattatcataggtggcaaattcctaagttacagcaatattacagtcaccctgctgtaataatcacctatctactagaaaggtagaaggaatagttgtggctcatattgtatgattctacttacacaaaatgtcaagacaggcaaatccacagagacaagaagtagaccagtggctgcctaggactagaaaaagaaaagggtgttgggaggaaatgggaagtgactactagtgggtacagggtttctttttgggataatgatgaaaatattctgaaatggattatagtgccagctacaaaactgtatatgtactaaacaaccattgaattacatactttaaatgggtgagttatatggtgtgtgaattatatctcaataaagtttttattaaaaatttttatgtggctgtggctggttatgttttggattgcttaagaaataaaacaattttggggaaaattatgggaaaacaaatttaaaataaagttcttaacaatttaggactaacaattactatcacaatttgacagtaattaattaaagtaagcaaaattattaggattctaaaaactttcaaataaatattttaactgcatagccttgttctatttaatgacacaaaagatttaggaaaggtcaaggtaagaactaatgatgtattcttacataccttataaattgagtaaacaaaaactcagggaaactcatctaaaaaaataaaaaggttttcaaaactcgacccacatttgcccaatcaggtactaactagtctttccccaaccatctttttttttcatctgaaaagtttaatgatctaacctgctagagattcagcatatgatgaaagggagcttgcagaaggcaaaataattatacgaacaaaatatctttccttttcttaacttggacaaaatatatttagacagaattaaatggcagtttcttgggtggttctttaaagttttcctaggcactcttaagattggtataacaatataaattttattatatctttaagcatctcagaaattacacttataatttatgctcataattataaatagatgtgtctatgtaaaatgtacagtgtactcatttaaaaatctagattcacagcattaaaatacttaggctgttttatataaactacaaacaaaaatacaagttttacttagatgactattgtgcagattattaagagactggtaagtttaatgaaaacatcctaatggaattattttattaaggagaattactttgacatttaaatttttacttgaaagaatcctacctagtaatcgaatagctttttaagaacagtgtataaaataaactataccataaacttaagcctagagttcatcacagattaaaacttttaaactttaaactaatcataaattaaagtatacactgaggaataagacatatacagaaagagaagtactatggccaacagctttttaacaagactgtaaataaaccttattttaccaatattaaaggattcacctaccatattctattaaaaattctatttttctactcataagttacctcaataacaaagatgtgaaaatctaatacttttctaaaacttactaacattttatttaaagtataatatctaatgcttattgacatttattcaaatcacttctttttaaataaaaacaagttctctattttgaaattttgtaggactcaatatcaggtattttgttaaatggtaacttagaataaattcaaaagaaaggtttaaaaaagaaaagttctaagcttttaaatgatcctatcaatattggtgtccgggttacacacaactataaatcaaagcagaaactggcaaaataaaagaatgatgttgacatacattattctaatacgtaatggatttctgtaaagaagaattactagagacaatagatgccccttttgttatgctgctattaagtattattgaacagtcacatttagtttaatgcctaatccagaggcatgccacaaatatgcaagtcctatttttgtctatgtctgaagacggttatgtgtgttctttttctccttccaatttcctaatcagttttgcaaatagttacaaaatttttaccaggccaaacagccccctgctccctaccctcacccatatatttgccttcattttcagcccctgtaacatcagagggtttttttttaaaactgtaaataaatcctgactaattatgatttattcacagctgctctcaatgatattatgaactagtatccttttccactattaataatttctataaaatatttaaatgcagtttttttttacaactagaattctcatttgaacaaacaagaaaatgtcatactgaaggtaaatacatcaatttaaaaatttctcttataaataagtatgttttaagtttaataaagtagctagcacagctgggaacaggaaaaatgctgtttgcttcaattttgcaagcatttgatttgattggatggcaaaatcagcttgactgtgttagaccttaaagcctaacggtgacataaaataggtaaaataggataccctgtgagtaaggtgggtgaagtaattgataatacagagatattttgcaagtggctcccttgactgcattactttctaaagggaggtgaaaggcacatagaagtcactgaaaatacttttgttgaacaaacgaacattaaaaactaaaaaggagttttgttagtgtgttattctagaaaaaaatataaaattagaacattaaatattaatttatacttaaaccaagtaatcctaaatcggtctcaaaaaatatgaataataacatattctaacctcaatgtgtataccttattaatattttctcatgttctggaaaattaattaaaacaaaagtggttcttattaaataaatgaataaaatctattgagacaaatgcttattcatattttttgaatttgaatcacttcaaatggaatatctaataattcagtatttacatatcccataactttaaaaatataacaatgtaagatactgaatcttaaacatacaagtagctactacatgttttgcacacctataatttgcatctattaaggattaaaaatattaaatttctttttattctaaaattcaaaaaaagactatattttaaatatagtcatacctaagtattttagaacattttcgcttaaaggagagctaattgatgctaccctaaatacaagaagctaaatatattaagtacatcaatatgaaatggagtatgaactggtatgtttcctgaatgccttctcttacattgttactaattcattttataatttaccatgaattaaaataatagtttcctaaaaatgactcatggaaatatatgggtgtataaataccatccactttctcctggaaatgtattatcaatctgaacacagaacacagaacctgaagagagaagctcaagtgttttaaaaatatttcgcctctcctcagcagctgatttttccatgcttgttttaaatattaatataaaacaggttttccttaaattacaaaataaaggtaactttaaagaaatattcatttaagttagaggttatgtattaaattgttgccagtgatactgttttaatgttttagttacgaaacagaaactgaagtgaaaaaaatcccacttgcataattttttttttaaattttttaattattattacactttaagttttagggtacatgtgcacaatgtgcaggtttgttacatatgtatacatgtgtcatgttggtgtgctgcacccattaactcgtcatttaacattaggtatatctcctaatgctatccctccctcctccccccaccacacaacaggctccggattgtgatgttccccctcctgtgtccatgtgttctcattgttcaattcccacctatgagtgagaacattgcataatgttttaaaacaacctttagcttgtaatctagatgtaatttgtttttaactttcagaacaataaaacaataaatagagactatagtaattgattggtctgaattgttctaagttccttagtatgaattctgtttcacagttaagccttagactcaacttgtttaaggcaaatagacaaagtataaaatattactttggagatacaagataagtataatttttgaagaagtctcagtttagaattttagatgacataaagaattaatacataaacaatatgtgccacatgtgagcagtatgcacttaataaaatatttgtatgaagctaaaaatttcttaccaaaaagttagtaaaaatagacattattattattccttccttgaaaaaacctaaaactaaatctttaagtaaatgatctataagaattcttagtctggtccatgtgattacatggtcctatgtacccagggccactggaaattctgtaagcttagatagcatgaattctgaatgttagacattgctgttcaataaaaaataacttgtattaaaatttcgtattttcactttcatggttttatttccaagtctggttattttcactacaacctgattttccagatcagtggtgtctggtcaatttatctatgggtaaaataattaagtgttcatatgtctatacccaaatgctcctccagagcagcaatttgcttaagttggcagtgcctaccgcttggcatgcaacaaggctgtcacaaaaaaatgtttactgaataaatgatgaatgaaggaaaaaataaactaaaatatttctgtagagaaagaaacatgaaatgctctaaaatgtcagtcatgtcagtaatgtttatttttacagaagaatgctgactgaaagtgtttaactgtcccctgaattgtgagactaaggctcacaacaaagacaaaaataatgtacaagcaccacctatcttgaagacagccaccaaccaaatggggccaaatcgccaaccttgagtttactcagaggttgaatgagccccaccactcccaaatcatcacccagcctacataagagggcaagggtacatcaggagcactggggtgcagtttttgtcataggagcttcctcactcaagccaagttgcacagcaccaagatattacatcaaagacacgttgtggtttcctgcaagaagaggagactggcatctcactttccagctggactgaatactgaataaagaacctgcaaacttgccctggtgctgccagtggagtagaatttagcctgctgaagtgttcatagatgacctggcatatgtccctagaagttggggaaaatatattggcctagaaacttgtctacttcttatctagagatttctgaagatgggaggcttgggtagagcagcctgcagcagcagacctaatagggccacagaaatagtatacctgggtggggcgggggagaagtggagagtacctctcacatttcccctatctacccactaattctctgagaccctagaaaaagaacaccactgactcccatggctcatatgagagaaccaggactggggaagaagcaagggctgctggtcaaacacatcaatgccccatctagagagaggggaggagtttgaacttatgaaacagaaaggagatatagctacccatctctgaggaagagctcagtgataaaggaagccaagataaagctatcatcccaagaaaaccacatattccaaccacatgaacatcatattgtcagagacattttgcagcacttagaaccagattatgccagagtgagacccactatcttcagataaccacgttcactcagatgatgacctctgcctctcttgtccttcctccatgctgcctccttcccctctctctccaagaattagacctaggaggggagaaagcatgccaacagtcttaggccacttaggtggtcttctctaagatgtagggtggggaaggatcaagtgagacttaaatcaaatttgagattaaaatcttaaactacccagacttttactaaatgaaagtgaccaaaaagttgtagcatttgtccaaaggcatagttaagagtcagaaaagggagattagaaagagcatgcttcaaagtatgttttttaaaaaaagtaatttcagatatattgccaatgagttgtaactgtttaaaagttatttacaccctgtggtaggatgaatgctcaaaaaactgctaacaaaaaacttgatagctaaaactattctttaagttcaagcatagactgatacctgcccccacactccccctacctccccacaaaaaaaaaaaacagtgaaatcctactcatggtaaattctcaggtgacagctgtaatcggcctacatttaagcttggttcaatatatccatgggtagatagagccagcctctgctcactgttcctgccccactcaccttacatttgggataccctagaaatccatttttggtaatcatctctcttcaagggtctctctggttgatctcatatacttttttccatgccaaatagtcccaaattcatggttccattctgtactttcaactatctaatagatttatatgtcctccagacactgaaaactctatacatccataacatatcttgttagcttatcctccacacacacccagtctctaaaatctgttcttccctttttctattctttatctcaaacaatagcaaaaccatcaatctaattatctaaatcagaaaccttcttcttcaccctaatcctctatataaaactgatgatcagatccagatgattctaaatgatctaatctagatgatttcttgaatgtagactctcttctctaattccactatctttgccttaatccacttttaacaatttcaacagtctttaatccagttatcctaggtctccagggtctccagttcctctctatgcttcactttgacaccaaaaaacaagtttgataagagttttcccctcataaaaattttttattagctatccattactcataggattacggctaaacctagaagcctcagcttggcagttaaagcctttaccacctaggttactactgcatcatatccaatactagtctgttcagcagacatggttgcctttaggacctgttctctgacccagctgaaatgtgcaaaaaagcattctgtgttgctggctaagccaactcagtctgcaccccgcacctcggcctgctccatgtctgtattcctactttattcgaatgggcttcagttttgctactacccagagtttggattcagtgctatgatttatgcatctcctctttctcttgactgatggctttacttctggctcaggctaacctcttcactaaaggcttagtgatagtatcattgttaaatagtacaaagtaaactcttaagtcagatttcctgggttcaaatttttgctctaccacctacaagctatgagattttgaccactgaacttaatctctccaggcattagtttcttcagtttttttttttattcttgcagcttttatgaaagttttcttttttaaaattttattattattatactttaagttttagggtacatgtgcacaatgtgcaggtttgttacatatgtatacatgtgccatgtttaaaggataataatagtaccttctgtaaaggatctcctgcattgtcaggaaagtgctttaaaaagtactcactacatactaagatctcaatatgtgtcagctgctgtttttcccaatacttattagtttattagccaaaacaaaaggacaggacaccctctgagccataaaattatatatgtagataaacttcacacaccattttcaatataaagactggctacttagaaaaacaatttcagatgctgaagtttccaacttaaaacagcctcctatcatgagtcatagcaaaatgtggcatagttgcccaaattaatagaagcctaatagtttaaatatggcgtcaagaggaaaaaaaagtataaatgaccatagacaaggaagaaattcttacaggtgagagtaactgatatacaatatggaaagacaccacaggttgactaattctggaaaattctttaaaaaatgacaacaaaaaagatgaatttccacatatcgaaagagctgctactaaatgatgactactagacacccaagggttacagatacttaataatcttcttcagttatttgaagaatattttttctagaagaatatacctctaattttataataaaagatggaagatagaatttatttgcagacttgagctataattcactgttccacaaagcaaggggaaattatctgcactttatttctattgtgccttatacagatatgctaaggggaaagtattttaatgttcataatcaaaacaaaaatgattaaatggtcaaaaccaaaagcaacgcaatttcaggaattctgtactatcactgaagttctaatgaattagtatatttcttttcatcaaagaatataggcattaaaatgacaattttagatctttcattagcaaagataatccagaactcgctagtcgttccactggactagttagtacaagaatatggccgataattaactttttatatatttatatatttgtagccttggctattaggtagtttcatttgcattctcaaattaagatagagagttaaaaactaaactgaaggtctgtgagaatgaaacttgatactctaacccaggttactgagccttttataagatgccttaataattaataatactatactgcatatcaaatttcaacatgcaccattactgaattcatgaagaaaaaaaggtctgttgagaaccatgtaaatgtgtcttcaaaataaatcagtaaggtatcttttttccaaaatactttcatctgctatgagaaacaacattagtttgaatgcccctatcactcatttatctccttaaggtctgtctatcgttctggaaaggtgtttcaacaactgatgaacacaattacaaaacaagactactttggttttgaatcaagacaactagattctggatttttaaaaaaagtctattatttactgaaaagtcttccaacatgaagaaaccaacctaatgagggctttctatttttatgaatgagaggtactatggaaaaggctaccaacctaatggcaggaaggaggaaaaggtgtcagcattaattcaagtaggccaacaaatatgataggcccccaaacaatgatgtgcatacttctaactgtggaagatagacatgagaagtatgatggaagtcagttatagaaagatttctgatagtgaactactatgcatactcagaaaacctgaattaagtataaaattacaaaaataattttagatttaaagaaatttcatgacagttcaagtacaaaactattccatcatcaaaacacaacctgatatatgcattactagtttcctcaatcaatttttaaaacttttttgaaatcgaatgctttatttatttcaaaaggtaaacactgttgggctatcagtcttaaattagaagatcataaattacattgtccactctttgatcctaaattccactattggttaacatctcttttgatgtaatcaccccaatagtccccagtgcttactgactaaacatccaaaattgggttatgaatagaaagcccacatagtcaaaataacttccttagacatcaacattagccacaacatatgcttggagtacaatatcttgttttaaaatgtagagtagtcaatttttcaatgtaatcttctaaataaatgacattttaaaaagagcaaactactatgaggagagtttgtgcttcttggagctctttttgtaagtcatttttcttttgccatgtgctttaaacatcttaataaattataacatgttgacaagaaaccacatactgcacctgtgctttctatcttaattaatccaataagtacaggcctgctcacttaaatttgtaagggaaatgatgatataatgagttttaacttaaggtattaattacctaaataagcagaattagcttaatgtttcagtagactttgcctagacacaaccaccaaataaaaatttcagaaattatggaagccttaaacagcaccattaggaataagaaagtgaaacgctcattctacctcagatagccaagtggattaaattctactaaagaaaaaaattttaaaaaccagtgcagcagttcagagacactaaaatctttgttgcttttaccgaagaatcaattaaatctagtttagctgcccagtgactaaattattattttctacttgtacataaacacttttctttgaagcaggtcactttcctttcaaaacaaaggttatgactatcttaaatgcctcagcagacggatggtcaaaacctcataaaaattctacatggacctagacaatcacatgacacaactgtgcacacgccacaccatctgttggatatgactgccagcacagatttcgtgagctggcaaaggactgaaatagtcaagaattctgcaactatttcaaagtgcaggcttctcattaattttaatttcctgttggctctacaaggaatgactgagtagtgaaagcacaatatgccacatacacttgagttcatgccacatgtacacctgtaatcataaactcttatccaaagctatccactggaacatttgggattttgtgtgtttatttcttctttaccctagaagaaataaatctgaaatatctatagttgtcttttcatactttgttaatactcttgcaaacatctggaaatacttgacaataatcatttaattaatgcaaaggtaatcgatgacaatatgcttaaatacttcactcaactgaagtggtttcctcagtccacagaactaaggactgtagagaacaagcagttctttgactaaggagtacactacaaggaaaactatagccaatatctcttttaaaaccagaaacattacctgcatttaaacaaagcagataacatgctgctatactggtaaaacaaacaaacaaacaaacaaacaaaaaactggtagatgctgctggcttaagtttttaccttaagctgtctacagggtctgtgttgctgagggcttactaaaggggtggccctgctcctctttttcggggctactctagtttctttatcactccttcacagttgctggctatagaggagggtgaaaagaccctgagaaagaaacatttctccagaacaagtgaagattcctaaaatgtccatgggcagctccagcagcagggttggtactttctctgccaaccctttactgttttctgcattttgcaacagtgacttttgttttgtttccctgtaatcatactcacttgctaatgcaggcaacaaaggtaggactgcggaaaaactaggaaagccccaggcaactttatacttggggagcaaagttagtttttttcccttctctgccacaatttttgggactttttcttcagtgtggccctggaggattcttgtgtcccttagctcaaaagaacaccaccaactgaataaatatttaagaatcagagtaattaagaaatgttaacttactattcagtatgagtcacaaccaaaaatggttgatttacctaatttctcttatactagtaattactgtcaatccaatttctttcttttttaaaatttggaaccaatgtagtgggttaacagatggcttttgaagtttttgttcttattccaaaatctttacattacccaaaatatatctatttaaatatgatactgtaatttctgcaaaacattatctacatgctctctatttaacactaaacaatctggatgttaaggctgtttggaaataattctaacaaaaactgaaacattagactagtgctataataaacagacttgccttttacatttgttttagaaatcttcataagcacatcctaaacataacttttttccggtagggttaaaaataattcaattagcccaaatatattttatctcctatctttttatgataatccccaatttggtgacatcataaattcttttatcatctccttacattcaggaacataacataagaaaatccatagaaaatcccaaagacaaatgctaacgatttaaaaggaagtacacaaattctattgcatacaggctttaagacaaggaatgcttcctaccctgcacatctgtctagcaggtgcctttccgaataagttttgtcctttaggaatctgctctgagtacctcaaaagacaataaagtgttctctttcatttttttttcttagaacccattttcctcaaggcagaaggatgaagccttctctgtcctgaaaatatggtcaaaacaactttggcttattttaagcaacttctatcaaatagacttaggaattatataaaatacagttctcttctagaaggcggcctcgagatgcatcatgaagagggaagataaacacataaaccttagtatgctttatactttaatgagtcatattttttaacattctgtaactaatagatgagggaatgaataagaccagatttccctcattaacagctggtatctttgcttttagtccacttccccattttgtgagcaaagcagtccaccaaatcacttacgctgtgctccacctatgcttcttcttttaaccattctctctttgcccctcttacacccttttccttgtcttttgccatactcactactactcttggcaattatttgttcatcttctggcaatgcttcctttattcatctcttatttatttccatttccattccgctcagtggcgattacaaacattttccactttcctcaaagtgatgagagggttgagcagttccagttgacaggtgtaataaatgttgagaaaggaagaactgttctagtcactccgtccctcctgcaattccctttttaaggctatctgccctatataagtcaaaaataaataactctgcaaaaattggatccagtcatatgatctcttgatatccctttccaactgtgagaacatcttcctttattatttttttttggtactgtcaccatttatcatttggttcctcaccttaactaatcaaaatagtactcttcaatctagtatttcagctatttctgttaatctttcctcctcattcttgtttttcttttcaattttattcctatattattttaagcttgtgccacataaccgatttcccctaccctgagtctcttcctatcaatccttcatgctatcttcaatattaatattcttaagatacttttcatcatgtcatcctccaacttaaaaccttcagtggctttccactgtctattaaataaatattcagactctgtaaccttgcaagctttcaccctctgatctggatctacttttccattttatctctcgtatttttccagattaactaccacagacttgaaggtctctatttcattgccacccaacacagattatgctttcctactgctaagctttttattacacatcattccttgtagttcctgccttctctctttctgctatccatttatcaatgcttagacaaagtcctcttccacattataatttcatatacaactccagccttcatcaaatctccctcttattcaaaaccacatggcaatgtctgagttattgttctggattacaatttaccacttcattaactcataccttgtcctcttaataaatcagtataatttatttttacccacagtgcctagcacaatccaaagtaaaatatttgttaaattagcttaatgttttctaacaaattttggaatttccagatagaatgactacaaaatctatgaggggctaaaaatgtttccaaaagttactttcaggagttagccattggaaaaatagattcacaaaactaaaatgagtctaagacagacagtagaaggctacatgtcaaaaattgtgtgtatgtgaaaaatctgaaagtagagtactgcaatggtcattatcaaaatcattaatgaactctgatttcctaaattcaacattctaatttctgttgaattttaattaacaccctttctattagattgtctgcaaagtatactgtaataattccttccatctcatagcaccctttgccatgtaactttgctgttccttccatcatgaggtgaaatttatttccatatcttatgaattaggactagacttctgacatattttgacaacagactatgacaacagtgacactgtgcaaattctttcccctcttctcttatgcattttttatgcaaaaaaatgcataacacaaaattaaccattttcaagtgttcagttaagtggcattatttacattcacactctcatacaagcatcactaccatccacttctggaacgtttttcatcttgcaaaacggaaactctgtacccatcaaacaataactccctatttctcacccgtgagaaccaacattttattttccatctcgatgaatttgactattataggtaactcatataagtagaatcatatagcatttgtccttttgtgacctggcttatttcacttagcataatgtcttcagtgcttatccatgttgtagcatattgcacaatttctttcctaaggctgaacaatattccattttatgtattacaacatttttttaatccattcatccatcaatggacacttgggttgcttctacctttttgtcattgtgaataatgctgccatgaaaaagggtgtacaactacctctttgagaccctgctttcacttctttggtacatacccagaggtagaattgctggattatatgataatgctatgttagtttttttgaggaaccaccatactgcttcccatagtgactacaacatacttccaccagcaggtgcacaaggaaaggttccaatttctctacgtcttcagaaacacttgttattttatgtgtttgtgttttgataatagtcatttgaatgggtgtgtagtatcttattgtagttttgatatgcatttctctaatgattaatgataattattgaatcttttcatgtgtttattagccatgcttatcttctttggaggaatatctatttaagtcctttgccctttttttttttttttttgagacagagtctcgctctgtcacccaggctggagtgcaatggcacgatctcggctcactgcaacctccatctcctgggttcaagtgattctcctgcctcagcctcccaagtagctggaattacaagcatgcaccaccacaccccagctaattttgtatttttagtacaggtggggtttcgccttgttggtcaggctggtctcaaactcctgacctcaggtgatccacccgcctcagcctcccaaagtgctgggattacaggcatgagccaccatgcccagcccctttgcccatttctgaaatggactgtttgggttttttttttgttgctgttgagttgtaggagttcattatacattatgaatattaacctcttatcagatatatgatttacaaatgttttctctcattccattggttgccctccactctgttgatagtgtcttgtgatgcacacaagttttccattttgatgtagtccaatttatctattttttgttacttgtttttagtgtcatagcctagaaatcactgctaaatccaatgtcacgaagtttttctcatatgtatttcctactaattttttagttttatttcttactgtaagatctttggcccattttgaattaatttttgtatatggtgtaaagtaagactccaacttcattcttttgcatgtggatatccagttttcccagcacgatttgctgaaatgcctcttctttgcccccactgaatggtcttggcatccttgccgaaaatcatttgaccatagatgtgaaaagtttacttctcagctctctattccattggtctacatgtctgtctttctgacagtaccacactgttttgatttcagtagcttggtagtaagttttgaaatcaggaaacatgagatcttcaattttgtttttctttttcaagattgttttgactaattagggtcccttgagaatccatatgaattttaggatgagtttttttctagttttgtaaaaaatatcattaggattttgacagagatgacaatgactctgtagattgctttaggcaatattaacatcctaacaatattaaagcttataatctatgaatatgtcttttcatgtattgatatctaatttctttcacccatatttttgcagttttcagtgtacaagtcttttacctacttggttaagattattcctaagtatctcattctttttgatgctattatcaatggacactgtgcagatcctacgctgatgtcaagaggccttacaaccttgttttcaccttcttggaaggctactactgccacatacaaactccaggcttgcctgatgagatcatatgacctagccaatagttagcacaattgccaacacatttgggaagtaattttagagagagtgttcagccccattcaagtcagcagatgactgcagtcacttaagaaaccccaggtaagcccagcagaagaaacacttagataaacctagacaaactattaacctacaaaattgtggttttgatgaaagtaaaatagttgttattttaagccattaaattttggggtggtagaaagattaactgaagcaaagttaaatcattttatttgccatttcttaaccatgataatttattcattactttgtagctcatttcaaagtgtttctcagagcccattaagatgtattccatactactcagccataaaaaagaataaaatcttatcttttgaagcaacatggatggaactggtagctattatcttaagtgaaacaactcagaaacagcaaagtcaaatactgcatgttctcacgtataagtaggagctaaacaatgtgtacacacggacacagagtgcggaataatagactatggaaacttggaagggtgagaggggaagaagggagtcagggatgagaaattacctaaagggtacaatgcacattatttgggtaatggttatactaaaagtccagacttcaccatgatgcaatatatccatgtaaatttaaaaaacagcaatcgtacccttaaatttatgccaaaaaaaaaaaaaagatttattccaactgacacaagacaactctttgaggctaaatactctacattattcattatattcatgaataatttaaagcttaaatgtcagcattctaaataatttataattttaaaaaagtagataggttaaaatgaaatcttattaggactaaagatgtattgattttatttttctaactgcttactacaatattgaaaaaatattaagtagacattgcaatgatgtttgcaagctaacctgtgaattatactgctaatatttgctagcaattagtactaaatttattggggatagattttgaaactttattatctgattatttaaaaactcaatcacaatattgaggaaaaaagtacttaaaatatttataattgcaaagcatttagagtcatgttgtctaagcaaaatggtttattattacttaaaaattcttaaatttaaaaaatgtacatatttatatttatctaaaattgtatttacttatccatacgtttattaataaataaaactataaaggattataaagttattttgtttgggaaaaaaaatcttccagaacaatatgcaaaagtaacattattatttaaaatgtggttaagtaaaaatttactccataaaattttcactccattaaataactcattttgagaatttactctctcaagttctggaaacagttactttaaaatagttcatctgtattttatgtattctttaaaagaagtaagaagaaccagggtagaagaaataatgagaaaatgtaacaaaataggtgataaggcagttttatactgaagtttatatgctcctaggtacagaataggactattatttctgagaaaccaagtggaattaacacttactcaaatagaaaccaactcatatactttaaaaattgaagcaaattctcaaactctatgtcataaatacctttgcttcattaattttggcaactgagtttactgaatgtcagaagtatctcatatttgcattattgaaaacatcttttaaaatagttgtcattttagttttaaggagtcctgaatatttatttaaatttgagctatgatttatttaactataaaaaagtatttctctgcaagtacatttctataagcaagctacagtttcacaatttctctaaccatgtatatggctgtataatgaatattaacatatggtctataattgtatatacatacacacagttcatatacatatgaactatgcttctcaatttgatgataaaatatagaaggagaaaacataaattgaagaattaaaatgtacttacaaagtcaaagtctccatcttgaggaactttccagttatcaggaaaaacgtttttggacatagggaagggttcatgcatgttctgattacagttttcgtgactcttattcttgaagtcttgcttatcaaagtagtccatgaaagatggtctttgtacttgtggtgaggttgcatttccttaggtaaacaaagaacataaggaaggtataagttcttacatttaaggaagtattttctttgaagtatgatttttttatgaagccatataataaatttgcactggtcagattcaaggccaacataattaatttcataaagaacaaagtgaaataaaataagaattaaaaaatacccagaccaaataaaaattaagctgatgattaggcaaaggtctggaatgtttagattgtagaaacatttcagaagtttagtaaaatcattatcagaattttattaaaaatcatttcagctttatttcaaatttctcaaagaaagtaaattttaaaaactcaggtgtttttggtgggctttttttctttgcatttaagcctgcattgctattgttattgtacattttcagctgtaagaaattatgaggacttggctaggcatggtggcctgtaacctcagaactttgggaggctaaggtggaagggatgcttgagcccaggagttcaagaccagcctaagcaacatagtgaaactctgtctctataaaaaatacaaaaaattagccaggtgtggtggcacctatctgtagtcccagctactttggggacagaggcgggaggatcacttgagcctgggaggtcaaggctgcagtgagctatgattgtgccactgcactccagcctgggcaacagagcaagaccctgttcaaattaaaaaatatatatatatgaaatacataaactttaaaaaaattaaaaaaaatcataagaacttactcagtttcctcttatatttatcaaactgcttcctcagtctttctgattccctctgtccctggacttccatggcttcgcctgccacacttacatccatgtctcccaacactacttctctagcccagactttgcgcctaagttccataactaactttgctagctattagacaacttaatctgaggtgagttgccaattaatttaccagttctaaaactaaattcaagatctttcccttcaaacctacagctcccccgacatattctatctccactaaagtcaaccttatttactcaatccccaaaataataaagttgagaattaattcagactcctcccttcccaccatagcaaactgattattaggtcttttaattctacttctcagtacagttaactataaccccttttctctacttatcattgcaactgtcttagtttagcttctaatcacttcttgcttaggccattgtagcagcctccaaactagtctccttgcttccaatatcacagttttgattttaatttccatattgtcaaagtggtgacctttctaaatacaaaccaaaagatgtcattctgctcagaatctttcaatggctcttcattttttatactgaatgactaaataggaaataaatatttggaataactagatttttaatctggctatattggtcttgatcagtggttttcaaattggatccttaaagccccagggctccaaataaatgtcccagagaccaccaagaaggcatttcccatataattctccaaatagaaagtaagctactttcctttttcttttctttttttttgagatggagtttcgctcttgttgtgcaggctggagtgcaatggcacgaactcagctcattgcaacctccgcctcctgagttcaagcaattctcctgcctcagcctcccaagtagctgggattacaggcatgcgccaccatgcccggctaattttgtatttttagtagagatggggtttctccatgttggtcaggcagtaagctactttcttaagaattttttgtggggagtacacctccccacaagggaccctgatgggcaactgtaagttacaaaaagtatttttaaaacgtaaaattgaaatctttccttccgtaatttacactcatgttccaaataaattactctttcgtataattgtccctcaaatatctgaagacagaggtaatggctcctgtcttggctgtctatttttaatataaaacatccccagttcctttcataggatatatgtttcagattcatcatcaacttgtttacttgcctatggagacattctagtctactgttcctctaaaaagaaacataatattcataacagttatctgaccaacctagattgcatttgtaatagtcctagcacagttgaaaactacagttactactatgacaactaagtaacaatgttagttgggacgagctttaaggtcattttggtcaaaagaaagcatgttaagacttatttttagtctttaaaaatatgagggaagcctaaatcgatgcctactttatgtggcaaatcagagagtccggaattcttaatcaaacttcaaaaaacaaaagggggggggacggagattgaactgacaggtaaacgtcctatctcctctttcctttctccctacttttggatctctatgtgtgttatttgacagattggaagcctaggtgaggcggcttaggtgaggttataagagagagtggtaatggtgatatttattcatcaaaagaattctgtctcattgccttaaaataaaatggtttgccatatcaaaacagaggttttattgacttcaccttatgtgttttaaaaaaatttttataagataaaatttaccatcttacttctgggtatatatccggaactgaaagccaggtcttgaagagataactgtaaccccatgtctattgcagcattattcataacagctaaaacatggaagcaagccaagtgcccattagcaaaatgtgaggaaggaaattctgacacatgctacaacatggatgaaccttgaggacattatgctatgtgaaataagctagtaacaaaagaacaaaatactgtatgattccacttatgtcaggtatttagagtagtcaacatcatagagacagaaaacagaatggtggttgctagggactaagaggagtgggaaatggggagtcggcgtttaacaggtacagcagttgagttttacaagatgaaaagagttatggaaattgatggtggtgatggctgcacaactttatggaagtgcttaagattaatactattgaactagatacaggcatatttcgcagttattgcaggtttggttccagaccactgcaataatgagaatatcgcaataatgtaagtcacataaattttttggtttcccagtgcacataaaagttatgtttgtttgtttgccttcacaacgtcaattttcttaaaaatttctttttaacttttaaggtcaggggtacatgtgcagatttgttacataggtaaacttgtgtcatgggggtttgttttacagattatttcatcacccacgtattaagcctagtacccatttgttttttctgatcctctccctcctcccagcctccactctctgaaaagtcccagtgtgtgttgttccccagatgtggccatgtattctcatcatttagcttccacttgtaagtgagaacatgcggtatttggttttctaaaagttatgtttaggagtgacatcagaaagatggctgacaagagaggcctggtgctagtccactctcaacaaaaaaagaccgaggcaacagataaatagctaagatttgactggagtgtcagtgggagaaccctggagaataacgagagagtgcagaggcacctgtgctgcttagaagtccagtttggggtggctgtagtgtttcttaaataataccgcagtgaagtttgctgtatcagttaactcttcctttcacaaaatgtttctctgtagcatgagatgctgtttcgtaacattttacccacagcacagtgtctctcaaaattgtagtcaatcctctcaaactctaccactgctttatcaactgagtttatggaaaattctaagtcctttgttgtcatttcaacaatgttcacagcatcttcacaaggagtagattccatcgcaagaaaccactttctttgctcatccataagaagcaactcttcatctgttcaagtttaatcatgagattgcagcaatgcaggcacatcttcaggctgtacttccaagtctagttctttcgctattaccatcacacttgcagttacttcctccactgaagtctttaaccccttaaagtcatccatgagggttggaatggacttcttccaacctcctgttaatgctgatctttttacttcctcctatgaatcacaaatgttcttaataacatgaagaatgatgaatcctttccagaaggttttcaacttacttgatccagatccatcaaagcaatcattatttatggcagatattgccttataaaatgtatttcttaataataagacttgaaagtctaaaatactcatggatctatgggctacaaaatggatgttgtgttagcaggcatgaaaacaacattaatttccttgcatatttccatcagaccccttgggtgaccaggtgcattctcactgagcagtaacagtccaaagataatctttttttctcagcagtaggtctcaacagtgggcttaaaatattcagcaaaccatagtgcaaacaaatgtgctgccatccaggcttcattattccatttatagagcacaggcagagcagaatgagcataatttttaagggccctaggattttcaaaacagtaaatgaacattggcttcaacttagtcaccaccaccagcctgtcctttgaagctctgaagccaggcattgacttctcctctgtagctaggaaagtcttagatgacatcttccaatagaagacttgtttattctatattgaaattctgttgtttagggtagccaccttcatcaattatcttagctacatcttctggataacttgctgcagcttctccatcagtacttgctgcttcactttgtacttgtatggtctggagatagcttctttccttaaacgtcatgaaccaacctatgctagcttcaaacttttcttctgcagcttccttacctctttcagccttccagaattaaacagagttagagccttgctctgggttagactttggcttaaggaaatgttgtgactggtttaatcttctatccacaccactcaaactttctccatatcagaaagagaaaggctgtttcactttcttatcattcatgtgttcactggagtagaacttttaatttcctttaagaagtttttctttgcattcacaacttggctgtttggtgcaagaggcctagctttcacccagtctcagctttcaatatgccttcctcactaagtttaatcatttctagcttttgatttaaagtgagagatgtgtgactcttcctttcactttagcacatagaggccattgcagggttatcaatgggcctaatttcaatattgtgatgtctcagagaaaagggaggcctgaggagagagacagagacaaggtaatggcctgctggtggggcagtcagaacacatactacatttatcaattaaattcgccatcttatataggcgcagtttgttgtaccccaaaacaattacaatagtagcaccaaagaccactgatcacagatcagtgtaacagacataataatgatgaaaaggtttgaaatattgtgaaaagtaccaaactatgacacagaaatacaaagtgagcacataacattggaaaaacagtgccaatagacttgcttgacacaaggttgccacaaaccttcaatctgtaaaacacagaatgtctgtgaagcacaaaaaagcaaattgcaataatgaggtatgcttatgtttaaaaatggttaagatggtgaattttaggttatatgtattttaccacaataaaaaaaatttttttaattaccatcaaaaatgtgccattcagtagcatgaagtattgtgtgaccaatcttcaccttgcaaaatggagactcttgtacccaatgaacaacttgccattttcccctacctctagcaaccaccattttacttcctgtttttatgaatcttactactctggatatgtcatataagtataatccattaaagtggtatttttttgtttttctttgttttttttatgactggcttatttcatttaacataatgacctcaaggttcattcatgttgtggcatgtgtcagcatttccttccttttcaagaataaataacattcaactctatgtatatactacattttgcttatccatttgtctgtcaatgaacacttgggtttttctacttttgttgaataatgctcctatgaatattgttgaataatgctcctatgaacatgagtatagaaatacatcttagagatcctgctaattatgtggctttgtgttatttactcttttttaaataagtttttctctatgtgcagatctttagttgcaagtaatcttattttttaatatctatccagaggccttttttgctttctaatgggtgttttgatggttgagcctaatctctgattaaatgaatgattacaatacaatgtaaacatgtgaataatataattattggtaaaagtaatttttatttttaccctatgagtatgttgtatgtatgtatgtatggatggatgggtgggtggactgactgatttgattgcctgacagggtctctccttctgtctcccatgctggagtgcagtggcatgatctccgcccactgaaggcttgaccttctgggctcaagcgattttcccatctcagcctcctgagtagctaggactacaggcatgcaccgccacactcggttaatttttgtttactttttgtagagatgaggtcttactatgttgcccaggctggtttcaaactcctggactcaagcaatcctcccattttggcctcccaaagtgctggcatcacaggtgtgggccaccatacctcgctgagttatgtcttttaaatgtgtttccatctttacttttcattaaaccgtaagttccctaatgtagaattccaaatcctttacctaaataatttcacagataactctattaatttgtgtttttgactgtctacccagatgttgaatacctatgaacaacagcaggagccatggtttttcatcattacttttgaattagtagatgctatatgtatttcattactagcattggtgcactgctgataatgtatttgagaaagtattgtgactactacaattattattaggctggtgcaagtaataacagaatgatctatcccagtagagtcagaaagaacctgattttcagaatatacatgtattagtggaaaaatagaaaaagactctcaacacaactgtttatctaaggaccaatcctctaattacagctgttccagctttagatggctagaaaatgtgacaagacatctgggacccaaatggtacccactgtaaagatattgagacattctatgaaatttaagatagtataaaacaccaatatttgtggtaaacctttagaacttagaacactctcatatctcacattcaaagctcatgaaaaagaaactccttagagacagttcagcatgaaaacagccaaagctgcctttagatttcctgtcataacagactttacaagtatgttaaaaatgaacaaaatatatagaagagaaggtgtaatatttcaacgatcaataaatatgctaaaaataaagatatggtgtctatggtgttcatcttcaactttgttccctgaaatcaacaacaaaaatagaaattggttaatttgatgggttacattactgacatttagacaggacacatacattccattaacattttcagcagatttttagtacctttgatttgtctctaggcttcatcattacaagacgtatttctctatattcagaattgaaactcggttcccatggtaacctcttatactaaaatagagtctaggaatttaacctgttattctccatttctgccccattttgtaagtttaaaaaaattacaagtgtagctcaacttacacatattttttataaaccaattgagtaaatcaaaccataaagctgggagaagggggataatcccttaaagaaattctttgctcaatattctttttgtttctttttctttttaaagggaagattaattctgtaatagaattatatatttagttgtaagttctgttttcatcaagaagtcttaaaatgtgtcacacacataaatacatctgaaaactttaacattcagtattatataataagggttatcaagtttgtcaaggaaagtcagaatcagggaggagagaaaaaatggtttctttagaaactaactgctggaaaagtaagaaactcctaaaccaccattatcaactgcatttgataatgaaaagaaaggtttcactgaagcgtatttctagatagcattctttaaaaagtaaatttagtatttgtaggtgctttggtaagaacaaaacaaaaacaatagaaactacaaaaagcatgcattgtagcactactaatccagtgaagacaacagcactctgtgacctatgttcctccccagatcatcttcctctctccacaccaagccaggaccacattgctttcattaattttttttttttttttcatccagcactggcttcactgctgaggctctcgttatggtcttgttttctcctcaactgggagataagaaactcttcatcccagaatctttacaaactccccagtgctgtaataaacagtcagggttctcttgatataccactgactcttactttggacctctatctgagaaaattcacccaaaccattattggagtaaattaaaaactaatcttttcctaccagaaactaacatttatagagcacctattctaatatgacctacatattaagagtagcagcatacactgggaaggagaaggagaaaaataaaatctcagaagttgcttttttcactacaaagaacagagtgggggaaattttaatcttctataaaaaccttcaaaacagaaagatgggctgagcaggcatttcctttagaaatgaggagagtaagaaaaaggctgaaggaaagacaatgttcttttctgcaatgagtcagagaagaaacagtttgattagagagaagtggtagcaacagaaaggggagaagcagactactccttggtgttgactaaataaagaaaggaaattactaggaaatttcattccaggaatctactcttccaaccccaacagccttgtgcgtgctcctgacaacatcccaatcaggagcttctaactgaagtcacataagccaccaccaatgttgtagtgtctcaaagtgaaaaatttgcctccctaatatctataatccctagcttcctgactaggggtgagaaagtatctatctcattggaaaaagtggccatgtaatacaattctggctaatgacacataaaaataagggtttaggccaggtatggtggctcatacctctaatcccagcattttgggaggttgaggcaggaggattgcttgaggccaggagtttgaagctgcaataagctatgggctatgatcacaaacaccatattccagtctagatgacagagtgagacccttctcttaaaaaaaaatcaagtaaggttttctaggaaagttctgttttcttgatataggcacaatcctttctgttttttgctcttttctactgcctggaatacagacttgatggctagagatcctacatttactctgcaggcaggagaacaagcataataccctaaaagatggtgtcacagaaatgatttctaatgacatcatgaactcactctgccagtgccggatactctgcttttggatttctcatcaaatgagaaaagaaattaatcttattttgtttaaatcactgttatttgggtttattggtacatacagtcaaattcagtccttaactgatacatttctattcccaaatggaggatgtagggagaagcagaaggagcagcaatctgcagtttcactgcagaaacatcccaatttcaaacttgaagtccactattatacagagtagtttaaatatcactacgtctcagatacattatagttttaaaggtttttttacaggctgacctaaaaaacctatggcaaaatgccttttggcttccatactcaaaaattttaaaaataacccactcctaagataaaaataaacattcttacagagttaacaaaagttttaaaagcaacttaaataaaagaaggagtctattctgtcagatttttctttttggatgatttaataacaagatactattaaccaagatatgtttacacttaattttttattcaaatgtataatgtatgtgcttatacttctaaatattttccattgcttaatttaaaacctagtattaacatttagagtatctctttgtcatacacacaaaaaaagattaaaaaacaatttttaaaaaattttaaagaggaaaacaggttaggtttgttttaaaagttaatgggagggggcagctgcaattgcccagtaatgtttaactacacaatatgaaacacatgccacaatgcgcagctgagtctccagggagatacatgttcacagaagtgggacagagaggatgatgtttctgacttacaatttattaaaaaaaatactaggctcttcaatgagaaaataaagcaggaaatctcaagatagtaaccactgtcatatgtgatgtggttgctatggcaaatactttttttaagcacaaaaagaataatcatataaaattgacatcaatttctccagctgcagccgaattctgaccccagcttacaaaaacattttattttaacaataattttaacgttcagaattacctagttcctcaattttggccctaattccttcaactagttgctcatggaactaaaaacctattagcaataaagaataaagtaactatcattcattctctttgtggataagaaattttaaagaaaaaggttgcttttcatctccttcatgcatccccaaaacatttacaagtaaactaaattgtgagaaatataataccgtagaaaatacgtcagtccacccacaattattcattaagtttcctaatttgcacatcttctaaacaagtaaaaagtcctcataaaaatttaaatatataaagtaatttttaaaaatactttaacaaaataatttaatttttaacttcttagcatgattatgacaaagatattcaagtttagagaataaaataacaatcataactttagtaaagtatgtgtcaacatcaaaaagatttatgaagattacctaatttgttcttctaaaaatattttaagatgtgggtggttccacctcattaatggccttcgaaatgtgtcctttaatttgctgccaagagtatagtgaatacatataaaaaccaggatgttaacacagaagctactgacatcagttttttcctgaacttcaccatactgtattttaaaacaaagaaggataaacataacatggagaaggtccacagactattcataaaagattaaaaagcttagaaaataatacctgcacaaaggttaaagagactgaaattattcagccaagaaaagtcaagtctgagaaagaacttaataagtatccaagtatttatgaagggttctttgcacagaaaatagtgaccagctgttttcaatctccaatgaagtcagaatagaaggaaacaaaaattgaagcccaaagattttagttaaataaaaggaaggagttcctgtgcgagtaatgaatattgtaatggtcactgtatctatgaaaatgctttcttccaaggcctgtacaggaaagatattttcatttttacagggaagactaatatttacatccttgtgtgtgttttgtgctaataaaagaggtatcctacaaccaaaatgcatacaccagcaggtctgagctgggttatacttcgttaaacgtcccacggaccaagagcacacagaatagtagactatactcagtgcccacagggaactccaaaccactgcagccacaccttacctggattcctcgtacttttgtaaaggaaaatgaatgatttctaattgcccagaaatatgatgggtatttgcacccagctgcaagagggacctgtagtttactgctgtcacctttattgtcatatcccgggcaacattaacctcctaagttaaagaggaatggaacagtttttcataaaagaatggtaagtgagaaagtagttcccctacacattctcctacccttgccaattatttcttggcatctcaaattccatccttagtgatttactcctttggctcaaggctgtacgattctgggagaaaatgtatttcatgagcattaaacattattaggcattttattcctgtgtatctggtctctttccaaaacagattttgggggaaaaaagggaggaaggaaaggatatgagaaccgagagaaagatattactaagcaaagaatacggcatggaagtagatgctcagaacaaaacaaattgcctcatacttcacgattttgtctaggaacaatggatgaaccagggagtagagtcagtcttctcttcttggtatctctcctcaactgacactaatatctagtatcgtttccagagtaactcctaaaaagctaaagcagaacttcatttgctttctcttactaattaagtaaaactgcatatatgtgctgtccaaaataaactctgaaattttcaaaatcaacaaatactatatgcatatacaggtaagacatttttaaaatgtatatttagtaaatattatttaacccagtatttaagaaatgataaacatttatgaaaggttaatataagtaaataatatacaacctaaacataaccggttatttctccacccattcttttttgtttttctgagatagagtcttgctctgtcgcccaggctggagtgctgttgcgggatctcagctcactgcagcctctgcctcctgggttccagcgattctcctgcctcagcctcctgggtagctgggattacaggtgcatgccaccatgcccagctaatttttgtatttttagtagagacggggtttcaccgtgttggccaggctggtctcgaactcctgaccttaggtgatccccctgccttggcttcccaaagtgctgggattacaggcgtgagccactgcgcccggcctctccacccattcttaatacaacatggtctccacctacatcgccatccagctgcctctctgttcaatgtgctccagtgtatctccagccttcttaaatactccaggtaagttctaaacacaatactccaggtgagttctggctcctgagagcagagggaagctgtttatttccttgttctaaaaagtggttatctgtcctagctgcacctcagaagcacttgtagagtttttaaattttaaaaaacgtattttaaaagcagagatgcccaagccctgctctagtcttcagaccagcatctctgaagagcgactgttacaatacatacttgtgaggctggttatttggacccaaaagcagggtttatcttgtaaatcaagcccactgctccagcctgtggtgatcttttaggatcctcgttctatcctataacatatttttattttgttccacttcatgttatttgcaattctgatggaccttcaccttatagcttcatccaagtttctatgaaaaattttgagctagccagggctggaggccgaggtcctgtatcacaaaatgagaaatcttccggtaaacaatttattatttaacattgtagtcgactgaaatttagcaaccactgccgtgtgcccctggtgagcctttgtatcatagaggctagagagctgaacaccacatttctcagaattccttgcaactagagttctgggtaagtgcactctttcgcaactggggtggtgggggcggtggggggaagcaaacagaagctatatgcctgctagtttagttatttccttcttacaagccctgtcatagaggcttgattatttacagcagcattctagcatctagtcaccagtttcacaggtactgaggagtggttgcagtaatatttagtagctttctaatccctaaatagcagtgagggttgatttcaatctgtattactgaactcagcggcgccagcggtagcctctggattgctattcctcgttgtggcagtagtagttgttccttatatgctcacttttgtggtgttgtgggagtcactcttgaagcctatgctacacagccttctcctctaggctttccattgattttcttaacttctacatctttaatatggcttggctctatgcccccacctaaatctcacgttgaattttaattcccagtgctggaggggggactggtgggagatgattggatcacgggggtagtttctaacggtttagcaccatccccctagtgctgtctcgtggctgagttctcacaggatctggttgtttaaaagtgtatagccccacccgctttgctctttctcccgttcagccatgtaggacgtgccagcttccccgtccccttccaccatgattgcaggtttcctgaggcctccctagccatgcttcctgtacagcctgcagaaccataagcaaattataccccttttctttatatattacccagtctcacatagttctttatagcaatatgagaacacattaatacaatctctgacttaaattgctttgtgtgtggaatacctggagtagattctgtttcctccaataaactctcactgatataagcacatttgagtataactgttgcactctcataacaggaccaccagctaggtcacactacatagtgtctacaagggtatcatgaaagaccttgtcaaatactttcctaatatcctaagatacaatattcaaactctgcattttctctgaccttgaagtttagcaatgctgtcaaaaaaggaaattatattattctgatacgatttcttctcagtaatctatgctgacttataacgatcctgatctttcctaaaggactcttaaatgttctagaatcctgcccaagagggacattgagctcactggccccagagtagtgatgtgattctagtgtcaaccctgtgtctatatactggtttcatcacttacttgctaggaaatcttgaacagcattcccaagtctcagtttccttagtgctaaatggtagtgaaatgctattttataggatccttgtgaggagtaaataagataacatatacaaaatcctaagcacagtgtttggcctgtagtaggagctcaattagtaacagctataacctgagaaattcacctttttctccatttccaaaaataaaataaaataaaatgtaaatgtacttttatacttccatgacactctcctcattttctcaaagagatgtcaaatttcacaaacagtggaaaacagttctctcatctcaagtcgtatcaatagatattatcaaacacactctcggtcaggagatgccaagtgcgctgagtacttctctagcatttgctcatcttgccattcaaacccctcttattcatgttgatgctactcagttcattttggagatcatcattctctatagaagcccctttgactagcttactaaaaaaaagagagatggagcaaggtcttggaggaggcagggaaaggtggaggcaagaatttgccgtgggaagaacagagttgctcgatagctcagcatctctggtcccaggaagatatgatttttatcaccgcatgggaagcagggctgacaatgcccagggcttcccggatgctccctcttatcaagttgttggaaggataaattaatagggtggacagatgaatattatcctttattgattatcaactatatttaaaacactgctaggcatgttttgaatttacctaatacacacacctgcacatatacacacaacagagagacaaatatttatcactgaaactcagacagaattaagcaacacaattactaaatgatttggcttcacatcccatgctcttcactataccacatcatttgttcagaaaacatttcatgaactcttaccaagtgctaggtattgtattaggtatcaaaaatacagtgggaaataaacaaaagcacacgctcacaataaagcatgacagtgctgtaagagtgaaagcttggggtgagatgggagcctattagaggggcacttattcctaacctggggttgatagaggaagcaacctcttaactgagcctgagtgaatgaatatgatttagcaaaagaagcataaatcccacaggaggatttaggcattgcaagtggccaaaggtaaaaaagctctgtaagagctgagaagctggaagaaggatgaagagggaatagaaaggtaagtaggaaccagagcatatactgcttcttaactggtgttgagctttagcctataagcaattggtagtcactgggagggcataagcagaagagaaatgtgctgaaatctgtatggtggggagggaatgaagattggaggcagaggatcagtttagaagcctcacaagtgagaaactatgaggacttgcactaaagaaatgcaagcagagatcatgagaagagaatagggatatttagggggcagaactgatgagatgttacttccatgaagggtgaaggaagaaacggaaattaagaatgactcaatttttcaaccttattccaaagaccacatttaaaacacctatacagcttctctaggtacttgcatgataacatttcactttttttctgtaaagtagggagcaacgtcatctactgaaactgagatgggaggcaggaagaagagatctagtgaagatctaaactagccactctgtagaatgaggaattgctgaacagagaaacacaggcctccaggaaagttgagggcccaaatgggggagaaggtcttgatctggcagccctcatctgtgcagatggaagattatctccagcagcactcaatagccagggtaaagatgcagagaagatgaacactgagactggaccatatcaaagttttccaggagaggcagaaaagacaagacattagggcagtggagtttagaatataagagagtggcagaagcaatgaaatatagcctctaagaggagtttagaacataagagagtggcagaagcaatgaaataatgaaatatagcctctaagaggagtttagaacatacgagagtggcagaagcaacgaaataatgaaatatagcctctaagctggatatagaagtgaagggagggtgtgctaataaaaagaaagcagactaggaactagggtcagggaactagagggctctcatgatagcatttcccaaaatgtgtttctcagatgcttattacacaggatgttaatcactgatacgttcctcattaaaagcttttcatggtcaaataagtgaaggaaagtttgggtaatgtaatttttaaactgtttccttcctgtactatttgtatttaataagttaataatatatactgtagttctctaataatttatctctaggataaatatgcatttcccaaataattctgattactgtatattatttatctatatttatcagagaatttcactgaatgggtatcttaaggaacacattttcagagggtctgctctgtgaaatgagaagcagggatggtagaacacttgaaaagaaagtatcttaccaaggcaggaggtttacctgaaagttctcttagcttccagagctatgtatctttaattctactataacacacacacacacacacacacacacacacacacacacacacacacagcttgactctgactctactgtaattagtattcattcatgaaaccaatattccaagagcatgtactattatgtggcagaggagatttatacagcattcttaccaggacaaacttcgtgacttatctggagaaacaacagatacacacatgaaaaataaaaacctggctggaaaatatggctcttcctcagatacccataagacatagtttccctccagggcaactagtgctaccaatctagccacagctctgtaagatcagaaagttcctccataaaaacagagctaactgagtagatctgagctgaacaaactaaaaagccccagtctttctttgctgaagctactactctcccagagtcacccatgatgaaataatctctcctaccccatcagtttgatgacatagattcttgacctggtcctaatctactccaggataataaatcctaaattgattttcttgaatgacaaccaacctgcttttacccagtgtcaagcattcagaattccaactggcacagactagtatggataaaacataatccataaggaagaagtagagatccacatgtaaataatggctagtgccagactgtgaaggatcttggtgacacagctgaagcctggacattccatggggaatgaggaggccttagggatatctgaataggaagactgggagcgggagggtaaaagtaatgccatcattgctaaaaacaggtttagaaagttattcttgggacatgcccatagggtccacgtccattttttaaaaggcagatcaaattttaaaatactttttgtcatttttctccacttcccttcaaagggtctgtgggtaattttcctttctagaggtaaggaaaataggcccataatttctagcttcatggttaaaggtataaaagagtaagtgtaaacataatttaaactgacaaggatgttaaatcaggcaactcacttgaaactccaatggaaaaagagatgaaattctaaatcttcagtacacattgtagagattttagaaaaccaaaaataatatactgctatcatcttattagggaacaaaaatgctaaagacacattagcaaatgtggctttgactgatgtgacataagctgagacctcataccaactaatttaagaagttttaaagatttagatcacgagaaaaacaaaactacaataattatatggtttcagaaaaagtaagtcttccctcaataacttcttcacatactttactactgctatactacaatatgacaatccctaggggttatactaacatcacttgattagaattttggaaacactgaagtctcacattacagaatgatgtctaacttgtaaaaacaaaaaacacagaaagttggctcatgggatttaaaatttgctgaggtccataaaacaactgcagctataaaaaccacttatctgttcaacttcaaaattggttttcactaaaatctctgtgacaaaaagtcatacctatacaatcagttataacaaaattataacatgtattgatttttgtggatgtcaaatctaaaagtcactatacaaaatgtcagaaatctgtggtataaagtatgatgtcggaaacatcatcattagtctctcttccttgaaatataatacactgcaatctaaatgaattagattctataaagactcatttttcttaactattatatatatgctgatgttcaactatatgactgcatgaaaagttgttcatatagtttcataaggagctcagtaactccctaaagacacaaaaaagcactcaatgatctaattgatctgttaagaatcataaaatttgagttaaaaattatatcagcttatggaaaattgatattacatgttgatgaaaaatgtgttaactgttttaccacagagtctttgtgatccacttgtaccccaacactagctggttctggaggccataagaccatcctctgcagtggagtgaggcacgttatggatgcagaaaacttactctagtcagatgcccagctaggaatttcaggaaatccaagatgtaggctgctttccaggaaaaaggcacagaagacccaccaatggcaggagatagaaaattcatactccacccccaggattatggcaatatagcaatctattacattttgtgcttcatgatcctctctatccaaagtacatatgcaaccatagtgggctacacagaactagggaatgtgaagaaagcagcagtactgagccacgtgacttgaagttatgggtcagacctcatggcggagtagcaaaaagaaaagggtgggcaaaaaggaaatggaagtatctgagagaaaattctggtatccattttgcagtaccagcaaatcacttgaatatttacaattttctaggttctacaatgctagaagtcatgtaattctgctgttctgccatggagaggcaatactcttcagtggaaagcagcctagtgcttgcttagactttgacactaaccacacaggactagggtaggagcatgacaggaagaaaaaggtcagttggtgctaagagaaaattcatttttgcctataactgtgaaatcacaatgacctacgatgttaactgcagtatcttaaaaaactgtttttaaaaaagagaagtgctagtctgtgaaagcattcctattgtcatcactttgtaagcaacagaggtcagagagaatgtttgatcatcattttagccactgcagcacccccagcactgtgcctcacatatgataagcagcagtaaatattcatgcaactgaatcttctgtatgagcatccctgtctcttaatccttctttctagtgcttcttattttcccaccttatttcttcccatagctcgcactgctctttgtggtttaactgataatttggacaacataaaataatagtctgttgaatttactggaagataattttaggttcacttttttaattgggaaagtaaatgttaggaacactatctttttctctctaaaatactttgcaaattaagccgtgggttagcaaccttcaacagaaaaaagttccataactctaagttgaagatgtgttgttttctgctatattaaaatacaattttaaaaaggtgacttgtgccatactcttttttactgttacataaatctaagaaacaaaattttccacagttggctataaaaagtaacacagaactagcctggttcctataaaagtatcctttcgaattagaaaactaatatttaatgtaaaaaagccacatacttttcatagttccatcttcttcttcctcatcctcactgtttatcaccatggtccccaagtcggattccaacatcgtgctattatgttcaatcatggtctgggccccttcactcatcgtgcttgtggcccgcatggtgcccacactctccacactagtcttcaccatggtgtgggaatccagctcatcttcatcctgcaagcaaaatactgcaatgagggaagacttttctatgacagctggatttcttaattcttaacaagagaatgaatatattatagttttaatacttattaaaaatactattagtactgattttaatataaatacatacatacaaatgttattttaagagtgaaaattattcaaaataacctaaagctttaggtaattacagatcaagcaacagaaactgatgaagtagaaggctgctagttgcttttaaaataaggattaagataggtaaactatcagcaaatgcataacaaagaatatggtgacaaaacaactaaatatatatgagagcacctttaagacagaacacattgacactttgtattataatgggcataatgatgtctataaccttgtaaaacagccattagctttttcttttaaattatggcaaaatatacaaatacatatatataaaattcaccattttagcaatttttaagtgtataactctgtagcactaagtatatttacaatgttgtgcaaccaccaccattatatgtttacagaactcttcattccccctttccccagccctggcaacctctattgtacttacaagaggtatctagaataggcaaattcatgagtactactattcataccatagtactaattcataattactattatacttatgaatttgcctattctagatacctcatgtaagtggaatcatacaatatattttgctgagcctaatgcattcaagattcatgcatattgtggtagaaaaatttcattcctttttaaggctgaatgatattccattgtatgaatacaccacattttgtttccctatttatctgttgatggccatttggattgttgacacctttggctactgtgaatagtgctaatgtgaacactgacctacaagtatctgtttgaatccctattttcagtttggttgggtatctacctagaagtacaattgctggatcacatggtaacttcatatttaattttttaagtgcccaaactgttttccacagtggctataccattttacactcccaccagcaatgcacaggattccaacttctccacatccttggcaacacttgttattttccatttttaaaaaataatagccatcctaatgaacatgaagtgttatcacattgtagtttgatctgcatctccctaatgactactgatgttgagcaatcttttcgcacgcttattagccatttgtatatcttctttggagaaatatccatttacccattttaaaatgggttgtttggtttttctgttgttattacaaattctggatattaattccttaccagagatataatttgcaaatattttctcccattctgtgtgctttttacttcatttatagcgtcttttgatgtaagtttttaattttgatgaagtctgatttatcaattttttgcttttgttgacaaatctcagcttttaaatgtttcacagaagaatcaagtcagtaataaaagtacaaattaaaagtgctctttagaacattcaccaaagatatactggaatagggtcataaaaataaattaacaaatcctgtttgaaagaccaactgataatcacagtgctttgggaggtcagggcagaaggccaggagtttgagaccagcctaggcaatgcagcaagaccttgcctccacaaaaaatttaaaaattagctgaacacggtggtgtgcctgtagtcctagctacttgatgggctgaggctggaagactgcctgagctcaagagtttgaggctacagtgagctatgatggtgccactgctctccagccggggtgacagagcaagaccccatttcaaaaagaaagaaaggaccaaagaatctgctatttagaaaaacttgattacgcacggaaattcatttatatttattccatttttagtagaaacatataagcaaaatctagttctggcagaggtcaaaatgcaaatctgagaacatcaatgttgagtttcagcaacttgggttgtataatataacaacagttggacagctgtttgatacctttcctcttcctaaacctacatgctaagcttgggcattaggtctcaaagtcgtttgcacttctttcatgatcctttctcttttagaagacctcttcattctcatgccttcaactatctaataagttgaggagtctcaaatcctgaaatcttcctatgtctttacttattacgtaaatacttaaagatgtctaaaatttgacagtcccaaatcagatattatttcatttatctctccagtctctcctatctgtctccatccccaacaaccaccacaaagcatggtaatcttcacttgctacataaaacttcaatgtcttcttacatttattttctctttcattccctatatatgcatcagtcaactagttctttaaataattctctcttagctccatctcttcttttccattcccactgctactgggtataatcctcactacatcataggtggtttactgcagctaatgcttcctgactgaggactctcccatctaactttctagagtcagacagacattagttcaaatcctggctcaaatcacttatgaggcataggatccttgtctccaaagattgatgattaaataaaaaggtaagcaaaatgcctgcatgctacctggaacaaggtagtttcacaccttcctcaaagtacacggcattatactaacctttcttgaatactatttctatcattctaatgaagaatctacaatggctcccagttcctgccttcattaaagctaaacatttctgcctaaatttcaatgtcttctatggaccaatcctattttcccattgttcatataacctccaatacaggcaggctggactttaactgaatctctttgccataactccatatgatgctatgttcattaaagacttcctttgtgtacgtcttattctctatccagaaggtccttcccctctatccatttaactaaatcatacctagtttcagatcaagtatctactacttccatggctaattcagtctttgttaattattctcttttctaaacttccatagaatttacaaccggcattagacacttctgtattcaatttatgatctcatattgcaagcaattgttttgcaaaatcttttataaatgtaagtaccctatggacaagaatgtcttagagtacctctgaatccactaaagtgcttcattcagtattcaaaacacagtaagggtttgtgaaagttgtcagaatcaaaatgaagtcatttctgtttaaaacaacaaaaaaacaaacaaaaaccaaccctgacaaatggagcaagggaaagccataaagagatggtcctcatgcataaatgcctgatagcgaaagctatcacaaaagactgccagaaccactatcttgcacaaaggccattgcaatcttacatgaaaaatactgcgaggacatctacccagcaactgcctatccaaccacagactggcgcacaaggataagcacttcaaaacaattaggcagttctccccatttttcctttaaaaacctttgtcttcctttaccccccgaatatgcacattgttttgtatagcacctttactcgcactgccctattctaaaataaatgttactttcttttagagagtctttgctatttaggttgacacgttcaatacatattgactttttcatggaattataaaatcaaggacctttacagttagagagaaactaattcaaaccatcattttatatctgaaaacactgaggtccacagaaaataagagacttccctaaggtcacacacctacttaaaagtaggtctgggactaagaaacaagttcttttatttcttagcccattattctactatatacatgtacctgaattatgtttaaatttttctctactcaaatgcttaagttggagatgtaagctcacaatttttaaaagcttatatcaccaccttctattcccagagtcccatataaattattccatccattctagtccaagccaccatcttctcccacttggagcatgaaaatagcctactgactgttcttattgtttccatttttgccccttttagtctcactcacataggcagattgatcccttcagaagacaaatgacatgttactctcctgctaagaactctgcatttggcctcctatcacacttagaataagatccaaaacctttatcatgtccaaatgtgatctggcctatcccatctagtaatatctgccaatcccatctcctatcacattccttcttgctcaccaagctctaaccaagctgacctcctttgctgtttcttgagcattctaaacatgttcttccttttgagcctttaaattggctgatctctcagactggaatgctcatccataaatcagtttgataatttatttaactcaggtatctatttagctgtgacctcttcggtgaagctttttctgaccaccaatctaaactaaagcctccatcattttccattcttctgtattcttcacagtctatatctggcctttacgaccactagaatgtaagtctgatgaagacaagagactgttttaacctctgaatcctcattattaaaacacctagcatacagtaggtacttgataaatatttatttaatgaataaatcaatttatattttcacttattaatcatccaacaagcatttattgtacatcaagtagtacaccagacattggagatgaataagatagtttaattccatttcagtttttagggagtttgagatctaagggaaatctactaccatgtgaacaataagttacaggacaatctattaagtgctacaagaaaagtgttgacagtaaaatgggaataccaagagtagagcctctaactctgcctttagaaagtgaagaaggtctcacagaggaggctgaacttgagtcagctcttaaaagatgagtagactatatatttaacatacaacagatacatttgggtggagtgttttacaactttttacattagaactacactcagacacattccttctcagctcagacaccccaagattgaattaggtgtcatgcctctgtattcccatagtactctgtgcttatgctgattttacagtactgtaattgtctattcacttaccttgtctaaatcccccattagactctcaaatctataagggcagtaaccacatcttgtttacagttgtattcctgatgtctggtaaaaagcaatgttcttattatgtaatttattgaatgaatgttaaatgcctcattatgaggtaatgccaaaacacagaatgaaggacaattttatgaggttctagtaacatgttcttattataaaacatagaatagctattaaagatattatactttgggacaggaaataatgccattaactacaattattcagttgatcatttatttaataatgaaaaaacacttatcaatgagttagaagcactatgctaaggtctttttaattctctttcggctgggcatgggggctcacgcctttaatctcgacactttgggaggccgaggtggttggatcacctgatggcaggatttcaagaccagcctggccaacatagtgaaactccatctctactaaaaatacaaaaaattagccaggcatggtggcacgttcctgtaatcccagctacttagaaggctgatgcaggagaatcatttgaacccgggaggcagaggttgcagtgaaccaagatggcacctgggagacagagtgagactccatcccaaagggaaaaaaaaaaaaagtctcttattaaccctcagaggtgctattattcctcttaggcaaaggaacctgaggctcaaataggtttcataatttgtccaaggtcatacaacaaataagtagagaagcaagaattctaggcaggtctaattctaaagcctaagacctaccttctaattatgtaaggcttttaaactatctacagcatttctcaagccccatttaactcatactacaggtttgcaagaacatgtttcattttccgaagtaaagagatgaagatgattttctatcagttccttttttcaaatctgctggttgaatatcttattttgtcacggttgcaaccagtttattcccaaaacactaactctattttaacacgtgtgagtcatttttctcttatccttgtgagattcaatgctgtgaccattaaacttaacaagaaacataacatctgattggtataaaatagtccttagcctccctatattctacattagagttgaatctacaaagggacaataaagcctgaacctctggattcacacaattggcttagataaaattgtaaaaacattgaattaagtttggaagggattgatcttactgcatattatttttacttacgtagtcaatttgctaaagaatgctaatctaatttacaaattgacagtaaaaaatagcaataaaaatagcatgaacactcaattcactaatgagagggtgacacacaaatagaaattaataaagtacagatggaatgataactagttaaacgaaattagaaaactcacttataatttggtgatggtgttgaaaacttttaagccacagcttttactttttaaaattcttaacttattcttgatattttagattagtattataatttcatttgatactttttatatttttataatgaaacatttatgttttttcaaaattatatttcacttacatatactctgttattcctcacaaaagaaaagcagaagaaaaacatgttgatacttcatagaaaaaggtctgcagaacagatgcttccccactgtagaaagcagccaattccagtaaggaatacaatagcattttcaatcagtggccatcatgtgccaggaatgcaaaacacagtactgatgataatccagtttatgaatcataaaatccacatggaatacaaatatttgaaaacattattaggaaatcctactccactgctaagacatgcttatgctaaaacagcctgagaaataatcagagattttgcattatctactagtagatatttgtaatatctactaccttaaagcattttctaaatactcagtaattgactgaattaaggataaaaagtatttatcacttgtgagactaatttgtcattagtgtcacaaaagacaaatactttagaatataaaattgtttctatattctcaaaatgtttagaatataaaaatagaatatttctcagttaggatacctgtttagtgagacagttagactactccttaaacaggtgtcctaaacggaaaatattctaattttatttttcttcttaaaatgacattaaacacttctttattgcacatgcaatcacataacagcatagtatcagtatcagagcagtgatcttaatggctttcattcaactggacaattctaacgagtatgcattctgctatagcatgaaaaaaatattcttcagaaaaaaacgtgtaaaatatatacttgaaacaattatacaaaaagttgcattatagtggtctaaatatttttaaaacctcttaaaggtgctaattaaacagcaaacaataaatgtaacaaacatactacaaatacatagctgagttttcaagatagtaagggctcaaaacggagctatggtaataagccaaatctaacttgaaggcttctttagaggcatgtgatgatgggggtgggggattagtggttaaataaggtttatattttaacagataaaagggaaaagggaagtatttggattctttccaaagtagaaatgaaacctccacttaaaattgggaattttgaaagtctacatcctcagcaaaaggataggcaagaaacaatttacccagtggcaaaggagatgacaagtcttacctgagctaggtaaggtaggggacagggattgggaagcctccctaaggtaggggacagggattgggaagcctccctttagaatttataaccatggtttaggccttcaattttacatcactcacacgctctaggggaacctcaaactgagaagttaaccaaatatagccccagtaaggtagcaccccaggtgcctgatagaaacaaatacaaatccatattacagggacgcatactgaaccctcaactcacaccattctcagagataaaatctagccaaacgtgaactcactatcccaaagataaatacatgagtaaacaagccactgagaatgggtagaaagaacaaacaacagaattaagatgcccttgctccttagaattaatttagtccccttagaaagctggatcttggggtaaaattagggaagaatagacagtggcattctaaactgcagaaataaccgagaacaaaagtagaaatattccagctagaatggaaagcaatgagtaagtttgattgaattagggaatgtcctacagctcatggatgctttcaacactgggagcccagcataagttgcttggcaaaggagtgataggaaccttgggaactaaaagatgatttggagaagggaaagactggagaaagactagaatcagacggttattactagaatccagatttgaggataattaattagagcctgtactaaaaagggtcatatagtaacagaaatgacaagctgaatctgaaagaaatcaccaaagaggaattaacattttctagaaagtttctaggcagtcaaatataatggatcaacaataactccaatattcagaacctaaagagatcaaactgaatctaaagagaaagttgagagagattttaatttgaataaaataggtaacaccagttatttgtaatcaaaaaatgacttactatactttgtcacttgaccatatgatcaaggaaatgaaatctaattattcattttcccatcaagtaagaaatcaacaaggcatgtccaatgcaactgcaagatgagcacaaaactggggaaaactagggtaagaatctttcacttctttcctcatgcataacggaattcgggggctggtgactgcttgatgctaacatgttaacctaggtcgataaatatattttaatcactgagttagaaaggcaaaaatcaaagggtactatcgtacatttgcttgtatgtctcgaatcatgtaagattcctactaaactaaaaacactctttcctatagcaaggtgaaactactgatgtgaccaacagagcattaccttgaaactgtacttccaactctggtaaaggatagcagttatcccattgtccttgttattaatacacaaggttgtacctgtttgttgtttctgtgttccaagtgaaattgcccacagtagatcaactggtaactctgatccaactgagctaaaaattactgagaaaacatcaaaaatagtctctttcaaatagccgcccttaagtgccacttcaatgtctgacgggctgaaaaaagtaacaaattggtattcacccattaaaaactaagatttacagtatctgaaaatctataaaaagaattaattgtcttctcactgctgtaagtaggtggtctttccctttcactacgaaatcagcttaatagcttatacagctgctgtctttgacatacctgtctttagcaaacagaaacttcatggatcctaactttttgcacattcacaggcatgttttaaagttacatcaaagctttcaggatctccaaacgtcataaaagacttattcatcagtataacaagcctaattggtgaaaaggcatgtgggcaggacttcagaggctccatgatgcaagactgtacaagtttttggcattataggagaagtttccaaacaaaagattaccttacatctcctgtgcacaatactaatatacaatagagtaaattaaaagtaaaagcaaccttaaccgtgacatttcttttttctttcacagccaaaagcatgtcaaaggattgacaaatataaagaaacttataaaatcaaatattttaaaataagaatgacacctttaaaaactgttgtgttcttacaagcagtttataaaacatccacaagagggaaccaaagacaaaagactaaaattccactatttggagatttacacaaataggtttataaaataggttattacattaactaacataccatcaatagctttcagaaataggctaatggtttcttgatacatttttaagcagtgatatatttaaaaatactgtaaccactgtcatgttgatacctttatataagcaatgtttatgttcctcaaggacaacaaatgtctttcacattcagtaacctccacttgcatataatagcatgaactcaatgaacaggtggtgattccacaaaatttatagaagtatacaaaagtaaataatgaatattcatattaatttatcaaaacttcattctaaattgcttttatatgaaaagatttatgattgtatatatcttatgttcttagaacaaatacaactaagggctaaagggtctttaaaaagatttttttcttttcttcattctttctttctctcattccttttctcttccattatgatagtatttttaagagttagcagaaattttgttgttgttctttttggtttgttggtagtaaacagaaattttaatacataaattgtatttttattgtttaaattttaacaacagaaatatcacctacataaacttagatataattttgtaaaataattttagaaaatttccaaaacatacaattcaaaagaagactacttgaaacatgctaaagtaacaatattgattttaacatacagtttacatcactgaacttcctgataaaaatgaaattctggggcagaaaaatgtcagggcaacaaaaaacaatctcccccacaacccaaatatttttcacacatttgacttaagcattgctgaagaaatacttcatgtgcaagtatacaccttattaattattaaatgcaaatacattctgtgttgatgattttgtggctggcactatccttaatgatgagtaaaagtcaggcaaaacctgtttaaaacagttttatacacgtgtttcttgatttgataagtatttaccaattaaatatttatgtaataaatgtttgctgtgtgccaggcaagtgtgttaaggtataatcttttccttgagaaatgtatagtttaatggggagttacaaaatagacaaacacagtgagataaatattctcagagctaaacgcagtattccatggtgaacacagaggagcacttgccaaactgaagcctggaggagccccatgaaaggcttcctctttccagaggaggcaatggctaggatgtcaagacaaaagcagcaacctacacttttctttaaccactttttgagcaatccaatctatgctcatggtttaactaccaactgcggaaagcactgatttcctaatttgcctgagttctcccttgggattcagaccgctgtatccaactgcctgctacacaaaatgacttaaatgacctatggacatcgcaaattaaataactgctaaagtgatctcatcttacacagaaatacgccttggagagaatactgctggagaatacttcagccacagtgtaagtgcaaagtgaaaaaacaaaggctctgactatgctatcaagaagtttagttgtaaataatttgttgttttttcccttattttttaaatggtcaaaggataactatattttgaatgaggaaaaagggcccagaagaaagggataatgtagctgactaaagaaacaagcagagaaggggccttttgagggaagtaaaaagaaaaccaagagcaataaaacaattactgttcatgcatacctctatcacagtacttgctacattgcattatgatcagttatcagtttatttgtctcactcattagattgcaatcttcttataggcaattaccatgtcttatttttcttccatatccatatttataaatgggaaaaatatataacctctgaaccagggagacaaggaaacatagtgaggatacagaaacatattaaagttaaaagaaaactgaggtctagttagtacaataagaaaaaagttataaagattggaaagaaactatctatatttgcagatgacatcattgtctgtgtagaaaatttcacagaatctacaaaaaactcctagaactaataaaaattagtgtgtgtggcaacgtcacaggatacaagggcaatacacaaaagtcaattgctttcttacataccagcaataaatgactgaaatttgaaattaaaaaaaatttcaacagaaaaaaaacccacttaggtctaacatattaaaacatgtacaggatctgtatacactgatgcaaaaaataaaagatgatctaaataaattgagaaacaccccatgttcatgaatttgaagactcaatactgttaaaatgccatttcttcctaacttgatgtatagatttcattcaatcccaataagaattccaggaagttaatttagaaatgttgacaaaatgatcctttctatggaaatgcaaaaggcctagaacagccaaggcaatactgaatcagaaaaacaaaatttggccaggagaagaggctcacacctgtaatcccagcactttaggaggctgaagtgggtggattgcttgagcccaggagtttgagaccggcctgggcaacacagcaagacaccatctctataaaaaatacaaaaattagccacatgtggcagcatgcgcctacagtcccagctacttgggaggctgatgtgagaaaatcacttgagcccaggaggtcaaggctgcagtgagccgtgattgctgtcactgtactccaacctggttaacaaagcaagatgccgtgtccaaaaaagaaaagaaaaggaaaaagaaaattggaagattcagtgtccaatcttaaaacttctataacactacagtaatcaaaacagcacagtactggcaaaagaatacacacatatatcaatgatgtatcattgaaacagaataaagagctcagaaacagacctacacaaatatagtcaacagatttttgaaaatgacacaaaggcaactcattggagaaagaacagtcttttaatcaaatggtgctagaacaaccggatatccatacggaaaaaaaaaaaaaggacccagatatagaccttacagctttctcaaaaattaactcaaaatgcttcaaagacccatataacatgcaaaaccataaaacctatagaagaaaactcaggagaaaatctatgggaccttgagtttggtagtgaatttatagacaccaaaagcatgatccatggaaaaaagctggtatcatcataataaaactaaacacttcagctgggcatggtggctcatgcctggtaatcccagtacttcaggaggctgaggcaggaggattgtagtttgaggctacagtgagctatgatcatccactgcactcagcttgtgcgaaagaatgagaccctgtctctaaaaaaacaaaaggcaaaaactaaaaactagaaatctctgctctgtgaaagacactattaaagaatgaaaaggcaaatcaaaaatgggagaaaatatttgttaaatacttactttataaaggactcgtatccaaaatacacaaactcttaaaaattcacaataagaaaacagacaacacaatttaaaaatggggaaaaatattgaacatacactttgccaaagatatataaatggcaaataagcatataaaaagatgcccgacatcttcatcactaaggaattgcaaattaaaacgagataccactaaacaccttttagaatggttaaaatgcaaaaacaaacaaacaaaaaccctgaccatacaaactactggtgcgcagcaacagaaactctcattccttggttagtaggaatataaaatgatacaactttggaaaagagtttggcagtttcttactaagctgaacataccataagatccagcaactatgatcctagatacttactcaatgtacctgaaaacttatatccatacaaaagccagcatatgaatgtatacagcagctttatttattgataactgccccaaactaataagtaactattgaagatggccttcaataagttaatggataaatgaactgtcatgtatctctgcaatgtaatactattcagtgataaaatgggctattaagccacaaaaaaaaccatggatgactgttacaaaaaacgtagtgttaaatgaaaaaagccagtctgaaaaggctacataatatatgattccaattatatgatattctggaaaagccaaaactataaatggtaaacagatcagcggttgaaagggggttgggggagagttgattatgtgaagcacaatggattttttttaagggtgatgaaactgttctgtttgacagtacagtgtatcatgtgtatcgttttgatgcctaataccatgcgtttgtcaaaactttacatcataaagagtgaacctactgaggcaggaggatccctcgagaccaggagttctagaccagcctgagcaatatagtaagactcccatctccacaaaaaatgaaaaaaaaaaaaaaaaaaaaaaaaaaaagtcaggcctggtggtgcatgcctgtagtcccagctacttgggaggttgaggcaggaggatcgcttcagcccaaaagttcaagacagtgagctatgtttgtgccactgaactgtagcttgggtgaaagagagagacccagtctcaaaagcaacaacaacaacaataacaaaaagagtgaacccaatgtatgcaaaattaaaaaaaaaaatttaggaggtcaggggatcccagggtgaaatgtagaatgtggcaaaaaaaaaaaaagtaactgtattaaaaatatattgaaacaaattcactgaaggaggtgagaagaaaaggtactaacctaagtaactttggagtaagtgaactgtgaattctgttagactaaagacaaaagaaatgatacataagcagtgtaactgataatgttgttttccatgttttccacatgggttaagaattctgaaaccactatacatgtatactggagttgagaaacttagtaaatgaatgataggagccaggtttctcaccattggagttgtaggttataaacaagcaagaggacccatctagaataataatggattagagtcagacacaacagtataaattaatgtttagtttaatacagatacagatgtatacacatacatatatatacacacacacacgtgcctacatatatagttataaatgtgtatatacataggctagtatacacacatatatctccttgcctcataagctgagagggcacagaagcaacaacatcccacagtacaaaaaagtccccctggaatccaaacttgatttcctacagttttccagtaaaaggaagtaggctccttattctagtactggaacaggaaatatacaagatgagcctagaatatcttatagtgtcagagagtaaggaagagctaaaaacaaaacaaaaccgcacaatgatggggatatgtcatagggacaaaggagtcaaaacaaaaggttcccaatggccaaagctggaacaatttaagcaaaataaataaataaataaacatagtagtattggattataatccaaaatataaactaataaccatgagtcaatattgatgcgaatgactgaataaatggggagaagagacaaatctcctgtgtagaaaaaattctaaatactccatcctcaagaaagtggagaataaccccccacttcttaaatgtgagctgtgtactgtgacttccttccaaagagtacagtatgaaaagaaagaaagaataattttactgtaaagaaacatgacatgctacctcagtcatgtgatcctggttaacatcaacagtggtaagtcatgttgacagaataatttactcttgatgtgatgagacttatatttatctctgggtcttttcaaaaaccaataagcctcgtctcatcattagaaaaaaaaatcccaattgaaggacattctacaaaatgtctaaccattattacccaaaactctcaaggtcaccaaaaacaaggacattccgagaggctgcgacatcatgaaccctttctgtgcctggcttatatcatttaacgtcctccaggtaaatacgtgcttgccacaaatgacaaaatttcattcatttttatggtatatacataccatgtgaaattagccaagcacagaaagactaaagaagctgatctcatggaagtagagagtagaaatggtggtttccagaggtaggggaggcttgtagaggctaggggtggtagggagagattggtcaataaatacaaaattacagttaggaggaataagttctggtgttctgttgcatagtacagtgactgtggtcaacaatactgtatatttcaaaatggcagaagattttgaatgttcttaccacaaagaaatgataaatgcatgaggtgatggaaatgctaaatattctgatttgatttttacacaatgtatacatgtatcaaaatatcacactttaccctgtaaatatgtataatcgttatatatcaattttttttaaaaaagagaagcctaaggagacatgatgactaaatgtaatatggtaacttgatgggtcctaaaacacaaaaagaacattaggtaaaaactaagtaaatctgaaaagaataggcactttagtttcaaatctgtattaatattggttcattatttagacaaatgtatcatacgaatataagatattaataacagggaagactgaatgtgggtggtatatggaaactctctaaactatttttctatttcttctataaacctaaaactattcaaaaataaaaagttaacttaaaaaattgagaaaatcctttgctttttaatttgagcaaatatttattatctgttttatcacaaggcccaacactacaacccataagtcagtggttctcacccaggccacacattggaatctgttaggaaggtttttaaaaaaatcctgatgcctaggccctagcctacaaaaattaaatgagaaatttcccagaataaaaatcaagcattgttttttgtttgctttttccaaaagccaccactaccacaaagagaaagctcaaatgatatagcaatttattaaatattttacatactatatcgagtatcacaaatcccaaagaatcatgtttctattagaggtaataaagcatataaactctaagtgattaatgtctacaatttttatattgacaagaactctgtattccattacttcaccaaaaactttttgcagtttcttttcagagtatttttaaaatattttacaaatttcaatatgtatatgcttttaaaaaatgcacttaagtacattctattttcaaaatagcatcatttattcaataatatattttaaactttcatatggcagagacaattcccataaatttgctttatatcatacacaacactaccgtagaatgctccttggtaacaacaaaatgttgcattttgaagctttattgcatagaaagaccaattttgttaatacatactctttaaaggtggacttgccataagcaattcaagtgtttacagtaaatatgaacaaacagatatattatttaatcaactcatgctaaagatttgggaatatcttccactaatatccagaaaacgaattcttactatgtaatacagttgacccatctcaacacctaatttacatcacatactcagaaatgccaaaagaagatctttgtcatatttaacaacacttaaactaacacaaaaactttgatattggattaaccttctacagaaatctctgtttgcaatttgtttaattttagaaatctgtacaattacctcagcacctatcaaaacatgtcaatttgtcaagatacattctcatcagacaagctttttctataataggtataaaaatcaaattcataaggcactatttccaatcatgctccatacttttcttgaataaaaaatattttaaaagatttgtttataatagttacccagggcacaggtgtatgcactaaaattttaaaaaccaacatatcttgtaatggttatcatataccatttcctttttaaaagccacattataaattgatgaaaatggcaatttaattttaggcccctaatttttccccaactgcaataagccaaactagatagaagtaaattaaatttggaaatttttctttatattgttataacccatacattttctgaaaattatgttaagaatgcaggatccacacacaatagacccaagtatcaatacttgatgtgaaatataaatctctcccttaatgtagcagcgaatttcagttctgaaattctgaaatcagagaaaaaatttgatctacattatctaaaaagttagttttatgaaatttttcaatggtccaatgctaaacttgctctgtgtcattatttgctccaccactgcttaaggaccaatccagagtctggactggaaacagctacagtaaaagctgccagagaatacaggtcctctgggctgaaaataaatcagaagcaaaagttggcaatacagatctctcaccatgctgaaaagacctttcatccatgaaataatcaaaaaggagaaaaaagaatggagaaaaatttcactgaaaacaactgggacaccaaaatatccatctaaaactttccgccatatcctaaaagaaagtcagttccccagtaccaaaactaagtaggtaatggccaaatgaatccctcaaactaaagcaaaagaaaaaaagaaaagaaccagaaagtttcatgggccaaaggtaaccaagctaagctgtgaacacaaacaagaggttgcaatgcaacaaccttgacttaacagatacacatgttaagtcaagcacagtatcaattagataacaaggggtccaagcttgtactttcgttccataacctagacaaaattattgtaaaagacacagtggttaagaaaaagaaaaatatcatttatgtctattctttttgttgtgttgttgagacagggtctagctctgcagtggcgcaaagtcgactcaatgcaaccttagcctcctgggctcaagcaatccttccacctcagcctcctgagtagctgggactacaggtgagcaccaccatgcctggctaatttttgaatttttggtagagatggggttttgccatgttgctcaggctggtcttgaactcctgagcttaagctatccacctgccttggcctctgaaagtgctaggattacaggcatgagccaccgtgcctggaccatttacttctattctaatcaactataaatttggatatgatttgctttaattgtcctgattccttgtaatgctaccttacagaagttttcccttccctgcttgtcactttgacaacttgtctaaaacaaatcagaattgaacaaactatgattttttctttgaattgttctaatttatgggcactcaaggagtttgttaatcactgaaatatacggagggttttatagatttataaagagatcatattacaaactcaatatcaaaaattataattttaggccaggcacagtggctcacacctgtaatcccagcactttgggaggccgagacgggcaaatcacttgaggtcaggagttcaagacctgtctggccaacatggtgaaactctgtcactactaagagtacaaaaattacccaggcatggtggcaggcgcctataatcccagctactcgggagactgaggcaggaaaactgcttgaacccaggaggtggaggttgcagtgagctgagatcacaccactgcactccagcctgagcagcagagtgagactgtcttagatagatgatagatagatagatagatagatagatagatagatagatagatagatagactgatttaaaaaataaaataaaaattataattttagaacagtccaagaaattacaaatggcaggagctcccatcaaaatggagattagaacacacaggtttacacctatccctctcaaaaccctctcaaaactacaataaagccacagaaaaggataaaccccaaaagacaaacagcacaggaattgaatagataacagtatatgggagatgtcaaaaatgtggaagctagaaaaatgtttggaagttagaaaacagataaatatgtaagcagctaactcagcagaccaaaaataagacttaagcttgcaaagagaaaagtcacaagaagcatgtgaattcagagtagtgaaccctaacatcttttacagcaaaatttgctggtcaactagttccactcttacacacagagctgccagaggtaattttagtgcttctctcaaatataatccccgtacatttgaagaaagcccataaagtgaaatgtcagagatcaaaacaaacacaaaagaacagacacaaggcagggagcaaaagataactcaaaataataataatgaaataataacgtagaagagaaagctatcttagacattaaatatctgatatgaaaaaatagcaagtttggaagataaacttgaggcaatctcagaagaataaaaagagaaaaagagggaaaaggaaacagaaaagataattgaaagactaacctaaaaggttcaacaaccaaataaaaggagatccagagacagagaggagagacagtgaaaattaccaagaaatagcaaacatgaaatcacatagaactgaagggtgtttccagatttaaaaagtcaaaagacactccatacgatgaatggggaaaagatgtataccaaggcacattattaggaaagttttaaataacagggacaatgcaaagatccaaaaactcccacattcaaacattcaaagaatcaggtatctgaatggcatctatcttctcatcagcattattgctgagcaaggaaaaagagcaaggtcttcaaaattataaaagaaagttattttcaatccaaaattttacacccaatcaatcaatcaatcaattaagggtaaatgtacaataaagacacggtcagatatgcaatgactgaaaaaaactgctgctgtcaggaagctactgggagatatgatacataaaaataaggaagtaaaacaagaaagacagaagacagcatcagggataaagagattacagaagaaaaaaaagaggacattccacaggttgatgttgaaaggaagtcttaggatgacagctgctcaacactcctaaagaggaattagttccgattagtaaaggacagaagactattgaagggatgaatcaataaaaaaaaaaaagtacggcattaataaattgtgtttgaacatacacagaggagctcagagatccagcagagagtttgggaatatagcatttgggaacaaactagtgattagaaaactgtaaaaacaacaacagtaacaaaaacggagacaattattggttctgaaaatcacaaaaagaaataacatgtaatgataatatgatataagtgaacagtatttacacagttataactatataagaatttgttttaattgtgattacataggaaaaattagacataacaagtaatcaattcttttacaagttttcaatttgtggtaaataattttatctgaaatatttcttattaaataaaatttactttttaccatgtaaaggaatgagaataagtaaatgttctttactggttttcctcaaaaaaaaaaaatatgtgtgtgtgtgtgtgtgtgtatgtatatttatacacattttcaaatatatgtatacaaatatacatatctatacttatatttaggaaaaccagtaaagaacaaatacatattacatattaataaaaataaaaatattaaagaatataaaaatatatattgtaaaaatataaatatataataaatatataaatatatatatgttttttctttttagacagagagagagagagataaagagagtctcactttgtcacccaggctggggtgcagtggcatgatcatggctcactgcagcctcaactgcccaggctcaaaccatcctcccacctcaggctcccaaatagctgggactacaggcatgcatcaccaagcctagctaattttgtgttttttaatttttttttttgtagagacagggtttcactatgttgcccaggctggtcttgaacacctgggctcaagcaatcagcctgtcttggcctcccaaagtgctgggattacaggcgtgagccaccgtgcctggcccaaatatatttatttttaattttaaaactagatttaatatctaccaactcttccaaacatatttgaccagttaaaatttgttttaaaatgttttttaaaaaattgaatctatatcagttcacaccagatcagtaatgttattttggtggccacaaggtagggcaaaaccagtaagggcaaccagcaaaaaaaacccgaaaactaaacaaacagaacaataacaaaaacaaaaaacctggccaaaatgttacaacagcagtagtgatggtataagtagtggcattaataaaaacaaaagctaaactttattgagcatactatgtgcaaaacattgttctaggtgtgtatatatgtaattatatcctcataacaactctatttgcagatggtaaaactgaagtagagaggttaagtaacctgcccaaagacataaagttatttgggaacagaactagaattcacatccagatagtatgatctatttttagataatgcaacctcccttttaccaagtaagtacattacaggcttctggactgacttgggctaattctcctgctgttcttttctttacctaattcaaaaggttctcaaaaggtagacttttggccagaaacagtggctcaggcctgtaatcccagcactttgagaggccaaggcgggtggatcacttgaggtcaggagttcaagaccagcctggccaacatggctaaaccttgtctctactaaaaatacaaaaattagctgggcatggtggcacacgcctgtaaccctagctacctgggaggctgaggcaggagaatcgcttgaacccaggaggcagaggttgcagtaagccggggatcacgccactgcactccagcctgggcgagagagtgagactccatctcaaagaaaaaaagaaggtagacttttgaaggtccctattgaacaggggtaaggggaaagaggggaaggcgggggaagtttctgtctaagaaatgctcacctgaaactgtatcaccacctgaggggaatgggttattcaaagcaccctggcatttctccccacacccatgctgagaattaattgctttagtgaagcatgtttaaagagaacatgacattattcagacattaaggaccgcaacctgaacagctctgagttcagaccataagaggtcaccagaaagtcctcatttcttttccaaggatagaagctctaagacatagtctaagaccaattagacttcttttctttgagtcattaataagttaatatgaagtcaaataacacctttcttcagataaaagtaaaggacctgatacatgcataaaagtgaaaagatttcattcaagcttaacatcaaaaagtatcccattttttgctcaacatttcacttaaaattcttctacatccatttaactccttgtattttacttaacattgtgatccttaagaaacgtctgagctccagtgacaagcaattcttctaaactccttatcagtcttttaaagtgctttaaaaatagcatgtcaatgctacattctatgccttatcttataaattcaattaacatcattctgctttgaaaatcatcatccaatgtaccacatgtagaatatttgctttgctgttttacttaaaaacaagtactcttttactgtataaatatttaaaaactcattcaagtacctgtacaatattcaataagccataccagcaaacttacaaattagtattttaaaaatcatcaactaagttcaagaaatacataagaatgaatactgcttgttgtgtaactaccaaattaccaaactgcatgcttacattttgaatactagagttaaactagtactaactgcacaaatcctgtatgcctgctttttatatacacaacctagattaaactttgtgttcatttagtcaaaaatgaatgtaaattttataaaaaatattttacttttatgaaaaagagtatcacttcaatgaaataaattgtcctactgaacatcaagagatgtgtagtctatgataaattagctgatttaaaactgtatatgtaattcaatttaagccaattcacaaaagaatcccaaaggaataaatgatataaactatttaagattctgagccttcaatgtggataaactttcctgagaaattacatctactaattttaaaagttgctaaaaataaatggcaatgtaggatatacatttactgtagaaagacttcagattcattctgcctatctcgttcttttaagtgcttgtgagagtgtatgtgtgtacatattgtatattttctatgcagggcaacaacagataaaataacctcaaaatggaagctactgcctgaaaaaataatctgaagaaagcatgtgaatattgctcaatgtgtgactctccaaactttttacttttttcttataatttcagtaaaaaagactataagagttttacccagaaacactaagctttgccccagagaataaatgtttattcaggaaaaaaaaatcataaaaacctgacataatttttaagtgctcataatatttcccctcaccttgaatatggacaggaccaagtaacatatacctaaaacgacttggtatcattggatttgaaactaagcagtgggcagaagctagaagcactttgaagacagttttagtaagagcctgaagagtcattaaaaaactgtcagaagcctgacagcctttaagaaagtttcaggaaggtaagggaaatattagaaagctggagaaaaggagattcttatgtggtggcagaaaatttagaaactgttgtattagtccattctcacactgctatgaaggaatacctgggtaatttataaagaaaagaggtttaattgattcacagttccacatggctggggaggcctcagaaaatttacaatcatggcagaaagcacctcttcacagggcagcaggagagagaactgctgagcaaagtggggaaagccccttataaaaccatcagatctcctgagaactcattcactatcacaagaacggggtggttgttccctgattcagttacctcccaccaggtccctcccatgacgcgtgaggaataagggaactacaattcaagaggagatgtgggtggcaacacagccaaaccatatcattctgcccctgccccctcccaaatctcatgtcctcacatttcaaaacacaatcatgcctttccaacagtcccccaaagtcttagctcattccagcattaactcaaaagtacaagtccaaagtctcatctgagacaaggcaagtcctttacagcagcactccactacttggtaccaatttactgtattagtccattctcacgctgctataaatacctgagactggttaatttataaagaaaggagacttaattgactcacagtttcacatgaagcctgaggaggcttcaggaaaattataatcacggcacaaggcaactcttcaaagggcagcaggagagagaagcgccgagcaaagagggaaaagccccttataaaaccatcagacctcatgataactcactcattatcatgagaacagcatgtgagtaactgcccccatgattcaattacctcctaccaggtccctaccatgacacatggggattatgggaactataattaaagatgaaatttgggtagggccacagccaaaccatatcaactgttggctataggaaccagaaaagtaacaggaaaagtaaaaaatgtacctaatgaactgggtggtctagcaaagcatgtaagatgttgcctggtttcttcttgctgcttataatcaaacacaaaaggagagagataagcttaagaaacgacaattaaacaaaagagggactgagacttgtcgattttgtaaatctccagcctctatagacagcaaaccatgctacagttatgagacagcttgcaagcaaacctcaaatccaggcaatagtcaggaaattatggtctaaatatcaagctgaaaaggtgactgtaaaatcctttgttcagatttctgacagatccatgcagttcctcaacagggcttctaagaagcttaaaggcattgtccctgcacaatctcatcaagaggccaaaatcagggaaacaattatctcaacaaaatgtatgagtatagattattctaatggagtaagctgcaatgagatttataggagacccacaaagtgtttttggcagaaacactaccagcattgactgcatagcacagagatgcacgaaatgaaaagagggctttggactccaaaatttctaaccacaggaagcaggctgagaaaactatctagctcaacacacaggctaccttccatgaaaaaggaagaactcagtgggcagagcaaaaaactcagagaacacagaaaggagccatgaaaaactatcctgaggtaggaatagaacttagttttaatgaagaaacttctaacatttgcttggctggattccaaaactgctatggaatagtgactcgtgcacttcctgtcttcctttttttttaaacagaactacccataatgatataattttatgcctgacccaccattgtacattggctattcggggtggtgggggtgaggtaagaaacatctcttttgtttataggtcttcagattgaaaggaactggacccaaggaacattatctctatctgaatgtaatttagaagatgacattctagattttgagctgatattgtaaagaaataatacttggggtagatgggatagtgcgtgtattttgcatgggcaaggaatgtaaataaggtgcggccagaggatagtctgagccagttttaaaacataaccataaattctttggcaattctcccctcaaaaggtggagcctcattcctattgccttgagtgcaggccagacctagtgacttgtttttttttttttaattgaggtgaacttcatatacaaaaaattaaccattttaaagtatacaaatcagtggcacttagtacattcacaatgtgcaaccatctcctctatctagtatcacagcattttcatcacctcaaaagaaaacactgtacccattaaggagttgctctccatccttccttctttcccacaccctgcacaccacaactgggccctgtcctggtctctggtaaccaacaacaatttgcctataattcaattgtaagttgtaagagttctctatacagtttgcttttttttttttcttttaaacagatggggtctcattatgttgcccaggctagtcttgaattcctgggctcgggcgatccacccgtctcagcctcccaaagtgctggtattacaggcatgagccaccgcacccagcttctatacattttggatactagacccttatcagaagcataatttgtaaatattttctctcattctacaggctgtcttttcacttcttgataatttattctcttatgcacaaaaatgtttaattttgatgaagttcagtttatcttttttgttatttctgctttagtatcattctctaagaattcactgacaaatccaaagtcatgaagaataaccctatgtttttttataagagttttaaagttttagctcttacatgtagggtgttgatccagccaatcagatcttatactaaaaggctgctgtatttgataaaacataggggtctaacttcattcttttacatgtggctatccagctatcccagtaccatttgttgaagagattgttcttttcccattaaatggtcttagcaactctgttaaaaatcagttggccatagatttatgggtttatttccagactttctattctattcccttggtctacatacctatccttatgctagtactacactgatttgatcactgcagtttcatattaagttttgaaaacagaagtgtgagtcttctaacatggttcttcttttttgatatgttttggctatttggggccccctgcaattacatatgaatttgagaactgacttttcctcttctgcaaaaaatgacctgaaatttggaaatagatctttaaaatctgtgaattgatttgaggagtactgccatcttcacaatataatgtcttctaatctctgaacacaagatgtctttctattgatttaggtcttttagcaatgttttgtacttttcactgtacaagttttttaactccacggttaaatttatattttaggtatttcattcttttggatgctattataaatggcattgtttgcttaatttcctttttacatttttcattgctggtgcctagaaatacaactgagttttgtggttgatgctgtaccctgaaactttgccaaatttatttactagctctagcagatttagatggttgacagataacaaacaggaagttgctctagctcatggggggctgaaacaaaggtatctgcaccagtccctcagggaaccaccagacaggtcaaaatgaaaactacaattttttttcagaacaaggatcttattgtccccgtcctggcaccagtgagctacaccgggaatatgggttgctggccccatagctgctgctgagctagaaaataaaggatattaggtatataagcaaaaatgtcataatgctttcttatcaaaatctggcactcccctggatgctgttaagttttctatcagattccagagttatgcaaaagttgatttgtcagttttttccagtttaacatagttgcttctgtggaggtaactgattcttagagctccttgctccaccactcacttgcttttaaaaactgggccgggcgcagtggctcatgcctgtaatcccagcactttgggaggccgaggtgggtggaacacccaaagtcaggagttcaagactagcctgaccaatatgatgaaacctggtctctactaaaaatacaaaaattagccgggtatagtggcatgagtctgcagtcccagctactcaggaggctgaggcaggagaattgcttgaacccaggagatggaggttgcagtaagccaagatcatgccactgcaatccagcctgggcaacagaacgagactcggtctcaaaaacaaaataaaataaaaataaataaatagaatgtggcagaagtgacagtatttaactcctgagactacaacataaaagacagtgagaggtcctctttgttctctctcttggaccactcactctgagagcccctgaatgagccatcctggaagtgaatcctccagcccttgtcaagccttcagatgactgcagctctgatgaacacttagattgcaatctcataagaaaccctgagaatgaatcacgtaactaagaccctcctgaaatagcaatctacaaataccatgataataaatgtgtgttgttttaaggtgctatgttttgggggtacatgatatttaaagctgagactcaaaagaaaagaacctagccactccaagagttctaagaaaaagagtgtttcaagtaccgggtatagcacatgcaaaggccctgagtaaggaaagatcttaagcatgttaaaaaaaaaattaaaaatctgaaagactagtgtgacttaagctcagcgaaggaaagaaaaatagtgaagaaagagacccccaaaggggcagaaagaaaccaaaattactataacaaagtcttaaaaagtagtaaaaactgataatatatgataaagtgcctttgaaaccacaagaaacaactacaaaaatttaacatttagaaacattaactggagagaaatctgaaactaaatgtatctatcatcacacaggaatccagggtaggaaatatgaaaccccctgagagcaagaaccaagggtctttacatctcccatatcacctactcatctttgtagaattaatgcacaatgacaaacctgaaaaaaataccttttgaagacactatttaaaattctaagtaatgaattcattggtgaaagattttaagtctagaatacaggcttcaagtatctcctcactaggtagtccatgacaacggccaaataaataactcatgtagctgcatatctaaagaacatgattataaatcagctctacaaagatgcacatttctccttgtcctgggctaccatgtgataaaaggttttataattggtaaaaagagtaaaagaatttcaaaagaattcccaactggataaccagtctctgaaattaaaactgaatttaatttagcaaaataattccatttgtatacagaaactgtaagatttttaaaatgaacttttatgggagaacatactgttacgaaatacattttcaatcagtaaaacataaaataatacatgtgttttcagattttatgactatttgaataccaagggttattctcctctatatctttatccagaaaaaaatatataacttgaaacacaaaggcaaaaaataattagcaaggtatagaagcactagacactacaaaccaggtgcagtggctcacacctgtaatcccagcattatgggaagttgaggtgggtagattacttgaggtcaggagtttgagaccagcctggccaaaatggtgaaaccccatctctattaaaaatacaaaaattagccaggcatggtagtgtgcgcctgtagtcccagatactcatgaggctgaggcaggagaatcgcttgaacccgggaggtggaggttgcagtgagccaagatcgtgccactgtactcccgcccaggtaacacagtgagactctgtttcaaaaaaaaaagtattagacactacaaaatgtggtaaataaatacaattattttatttcgttatttaaatgtagtaacatcaatataaagtaaaaggaattaatagctagtttaatatgctaggcctttttatgtcccacctgcaactcctgctatggtacgttttatctacagcatagctggtgaccagttaaaagaaaattccagaagatatgacacaaaactgtataaattcaagacaatatttatttaacaaacccagagttagtatcaactagatactaggtactgtggaagttcatcctatcaacattacattccactaatcactaattcttaagacatcagaaaaagatagcaaacatataaggcaaaccaaatatattttgagattcaatgaaaaaacatatcttacttgtatagtaaaacagtaagtgcttttaatatattttaacagaattacagacaaataactcagaagaaaaaaatcaactttttgaagataattacaaaccgaattttcttcttcctcttccaattctcgttgctgttcctcatgtcttttagctttgatctccatagcttctgtgatcaggtctcttaatattgatacaggtttggcattcttgataaaaggatgctaaaaaagtaaaattcaatggtataaattcaaaagatttttccgaattatagctaacaaatgttaaaacaacatgtaaatgttaaccaggatcacaggcttcaatgattgttttttcatctagaattaaatgtataggttaagaaaagagagtatggccactgcctagaaataaagaatttgctttggggcttgtttaaaaaaaaaacttaaagcacacatgcaaaaatgcaaccctgttaataaaactataatatccttaaagatctaattgtccaaaggaagtgtacattaggagtaaaaaagattaagttaaaaataggattacagattatattacacatagaaataaacttattttggtactgagttacgtaatttaattaatcttaataagttgacagccaaaatcagtggccaaaaggagagcaactattttgttacttctttaacatattttctattttattgtatcttaagtaatttaaccaagacaaaaatattttttcagaaaatgaatgttgcctaatttctttactatatataaaataacttgtcactttttaaaaaatatcaccctgatctagctaaaatagctaagctctctatcattctgacaaagagaaggaaaactatcagaatagacctaggttttgaatttctttttattgagaaggagggacatgagagaaagtagagtgaaaggttataattttggatagataacctaaatttggggcagcaatcagtttcagtaattttcatagttacatgtcagtagatagcatcaggtaaaagtgacctgactgagtgagtgagttatttgtttatttgtttgtttgagacaggggcttgctctgttgcccagatgcgagcacaatggtgcaatcatggctcactatagtcttgacctcctgggctcaagtgatcctcccacctcagccttcctaagtgctgggaatagaggcatgagccactgcacccagccctgagttattttaataaacttcaagagaacacaaaaatatatttaaagacaaaaaaaattgtgctgaagaagaaatagatacttgaaagagggtttaaaatggcaaacatatcatttgggacaactataagaaagaactttttcagagtacagaaatactaaaatcaattgtaaagaaccaataaattattttagaacagttatagattaatcttaccaaacaaattaagtcctattaacatatctgtggtagagactcctggtcatacaccaaaaatagagttgtggttggaccgacaattgcccaactggatcctacgtttctcaacttaacccattcaggtggttatatgcgactaagtgaatgcgggagcaaatactgtgttccacttcctggcctgggctatggagggctccttgttactaatggataagggtgagaggtcaggttctcccagagtcctgtactggtactgtgggaagtagtctcattttagctgattggcgatgaaagtcctgacccttcaccagactgcctctgaccccactccaacagggaggttgttgggttcttattcctgcctggtaggagtataagtctaggctcccacatggtcttcactggcactccccacttagggagggaatactttctacactgccttgtggagatgaatgccttagcatgacagccttctctgacaccgcctgagaaggactggacagcctcaaaaggatagaagtctaggttctccatttagcctttgctggtgaccggggtaggccatagttttcttggtggtgtttggctagagtagaacggttatcatctgaaagttttcagtcttactaggctgtccatttctccgtccttctgcttgaaagagcaggtttttatttctagtttgtgtccaatgttgtttctgggttgttggcttctccactacccagtgtgggataaatgagggaaaaagaaaccccagggaactcacagctatgtctttccttgagtcccaccatctctagcagtctattgccttctttccaccttttagagtctttttatgcttgttttatatacttacaatgtccatggttttagctgtactttaatgaggaagtatagagaaaaatatggttactcaatctgtccagcggcagaaatgccttcttcaactcactttaagcacttgttttatctgaagtgtttttgtataaatcattaattttgaacactatcagtttagaaattgataattcagaacatgaacaaaatttaagaggaaatatttcagattttaaaagaataaacttttcaagcagtctcaatttttaaaatacatcatcaagaatgtgataggttgatctgcagtaatttctgtcttctcattactttaggtggtttaagaatcctcaccctctttaatttttattttagacacatttagaaataggaaaactttactgcctattagaatctggtacattcatctttttcttgttgaaatactttataaaacccttcatataatcagccccttgcctgacataaatatatatatatattttttagtttccgttttttgccattcatgcattttttaagttatatgtattcaaatcatccatttttcttttgctttattgcaccggaatgaatatataaatattctcctatattaacccctagttctttcctatttccattttttgttttagtttttttaacatttaagaccttaatctatctggaaattactttggtgtttctgtggtgaagatctaagttaatcctcccaacaccccctaaaggcaggcagttatctcagcaccatttttactttgtttttccctcactgattagaaatgctatcttcataatatgctagtttcctttgtatattatataccatttgtgggcatttaattctgcttcattattctatctcatactggcgttacatacttttctaagcatttaacaaaaagatgtaatttgtttattaaacataaaatttgatttttctattaaatcaatcactatataattcagatgatgtttattttttgcctatatggttactcagtgactgaaaacggaatatcaaaatatcccaatttatttatttagagcaacctcttatgtctttaatttgtaacatacaatgctatattaatatatcaagtttataactatatcttcctttatattatgttctttatcaatattaagtgactccatcctcatttactgatttctgctgtcaattttgcttttttgatcatgttattcatactatctttttatattttattaaaatttcattgcctgtttttaacttttttttttaaataaaaacagacaattgaaacatttttattaggttaatttcactttttacattactacaacaataacaaaaataccaataccattgaatacaattaagaagtttacttaaatcatattcctcaaaatttggtgtgtatcatcacatgtgttagaatcatgggagcgagggcagagggttacttctaaatattcaaattctcggcctcccctagacaaactgaatcagaatttctaagaatgttgccatagaatctgcattttagcatttctttccaagtgatttttatgcaaaccaaaattaaaaatactgcattgacattttccatcccagtcttctgaagattgaaagttaacagcagggttggggtgggctggggtgggacaaggtcatgggaaatagcagcccaggaagcatcagcactgtcatcctcactgtggtttggatgaagtaccttttcaataagctcttctgtatctcttgataaacagttacatggtaatgaaacttttcaaggttatttccttgagaatacagctaaggcagcttcttgcgtctttccaagcagaatattctgatattattattaatctttatcttgtcttgttctgaaaacaatttgagctatcttatgaaattcatagtctatattagtttaagaagtagatgagaaaataagctcaggaaaataaacctatgggtaagagagagagtgtatgtgtgtgtgtgtgtgtgtgtgtgtgtgtaagagagacagagagaagaaagagagagaaggtaacttagagattaataaatacttcttttaaaaataggagttatttgtattttagtttttaattcaacctaaaccttctctctgtagggtttcacaattttaaaaaagtatgtcttttaatttaacaaaatgcaaacatgtatctctgctagtggagaaggtagtgaaaatctttttttttttaaagtttttttttcttttattattatactttaagttttagggtacatgtgcacattgtgcaggttagttacatatctatacatgtgccatgctggtgcgctgcacccactaacttgtcatctagcattaggtatatctcctaatgctatccctcccccttccccccaccccacaacagtccccagagtgtgatgttccccttcctgtgtccatgtgatctcattgttcaattcccacctatgagtgagaatatacggtgtttggttttttgttcttgcgatagtttactgagaatgatgatttccaatttcatccatgttcctacaaaggacatgaactcatcattttttatggctgcatagtattccatggcatatatgtgccacattttcttaatccagtctatcatttttggacatgtgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttagctgcataaatgtcttcttttgagaagtgtctgttcatgtccttcgcccactttttgatggggttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaaggccttgcccatgcctatgtcctgaatggtaatgcctaggttttcttctagggtttttatggttttaggtctaacgtttaagtctttaatccatcttgaattaatttttgtataaggtgtaaggaagggatccagtttcagccttctacatatgactagccaattttcccagcaccatttattaaatagggaatcctttccccattgcttgtttttctcaggtttgtcaaagatcagatagttgtagatatgcggcattatttctaagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggcctttttcacgatattgattcttcctacccatgagcatggaatgttcttccatttgtttgtatcctcttctattttcttgagcaggggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgaaactttgctgaagttgcttatcagcttaaggagattttgggctaagacaatggggttttctagatatacaatcatgtcatcagcagacagggacaatttgacttcctctttttctaattgaatacccttgatttacttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatatcccatcaatacctaatttattgagagtttttagcatgaagggtggttgaattttgtcaaaggccttttctgcatctaatgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattaggctgtgaatctgtctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctcggatggtagtttgtatttctgtgggatcggtgttgatatcccctttatcattttttattgcatctatttgattcttctctctttttttctttattagtcttgctagcggtctatcaattttgttgatcctttcaaaaaaccagctcctggattcgttaattttttgaagggttttttgtgtctctgtttccttcagttctgctctgattttagttatttcttgccttctgctagcttttgaatgtgtttgctctggcttttctagttcttttaattgtgatgttagggtgtcaattttggatctttcctgctttctcttgtgggcatttagcgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagattcttaatcctgagttctagtttgattgcattgtggtctgagagatagtttgttataatttctgttcttttacatttgctgaggagagatttacttcaaagtatgtggtcaattttggaataggagtggtgtggtgctgaaaaaaatgtatattctgttgatttgggatggagagttctgtagatgtctattagttccgcttggtgcagagctgagttcaattcctgggtatccttgttgactttctgtctcgttgatctgtctaatgttgacagtggggtgttaaagtctcccattattaatgtgtgggagtctaagtctctttgtaggtctctaaggacttgctttatgaatctgggtgctcctgtgttgggtgcatatatatttagtatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccttgtatttttagcctatgtgtgtctctgcacgtgagatgggtttcctcaatacagcacactgatgggtcttgactctttatccaatttgccagtctgtgtgttttaattggagcatttggtccatttacatttaaagttaatattgttatgtgtgaatttgatcctgtcatgatgatgttagctggttattttgctcgttagttgatgcagtttcttcctagtctcgatggtctttacactttggcatgattttgcagcggctggtgccggttgttcctttccatttttagcgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctttctcgaggagtatctttatggcgttctctgtatttcctgaatctgaacgttggcctgccttgctagattggggaagttctcctggataatatcctgcagagtgttttccaacttggttccattctccccatcactttcaggtacaccaattagacgtagatttggtcttttcacatagtcccatatttcttggaggctttgctcatttccttttattcttttttctctaaacttcccttctcgcttcatttcactcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgaacagatgggtttttggtgtggatgtcctttctgtttgttagttttccttctaacagacaggaccctcagttgcaggtctgttggagtaacctgccgtgtgaggtgtcagtgtgcccctgttggagggtgcctcccagttaggctgcccgggggtcaggggtcatgcacccacttaaggaggcagtctgccccttctcagatctccagctgcatactgggagaaccactgctctcttcaaagctgtcagacagggacatttaagtctgcagaggttactgctgtctttttgtttgtctgtgccctgcccccagaggtggagcctacagatgcaggcaggccttcttgagctgtggtgggctccacccagttcgagcttcctggctgctttgtctacttaagcaagcctgggcaatggcgggcgcccctcccccagcctagctgctgccttgcagtttgatctcagactgctgtgctagcaatcagcgagactccgtgggcataggaccctctgagccaggtgcgggatataatctcgtggtgcaccattttttaagcccgtcggaaaagtgcagtattagggtgggagtggcctgattttccaggtgccgtccgtcactcctttctttgactaggaaagggaaccccctgaccccttgcacttcccgagtgaggcaatgcctcgccctgcttcggctcgcacacggtgcacgcacccactgacctgcgcccactgtctggcactccctagtgagatgaaccgggtacctcagatggaaatgcagaaatcacctgtcttctgcggcgctcatgctgggagctgtagaccggagctgttcctattcggccatcttggctcctccgaaaatcttctcttgagaaaagtgaatggacaaataaagatttctcatttccgacaaaagaaaataaccagcattgatttgctatttctgttgttatgagtgcttccaggtggttgtctttggatctgctctgttcctgtgcacctcttcttggaatataaatttctgagcctcaatgtgccctgatgccgttcctttcttccaccgtaagagttaccgaaagctcggcgtccgtgatggggtagagggcttccgaggcgatcgggcagtgtcagtcttcagccgctaagccgagaagatctgggaaggagtcagagagccttgggccagagttccaggggctctgggagtggcggatttgaaattggtgagatgtatcttgggctggtcggtctgaggacctgaggtcctaggtggatctttctcaaggagcaaaaagcaggaggacgggggattgatctcccaagggaggccccccgatccaagtcacagcaccaaatttcatgcacgtccgtgtgaagagaccactaaacagctgtttttaacttttaacccaaattcttttaagtatgcctcatgtagaaacatgagttggattttatgtaagtttgtaagtttatctcatgtagaaagcatggagttgcatttatcttatgaactaagtgaaccatttagtacttaactaaatattatttaaaaaaattaaccacttatgttagtatataattatatgctaatgccattttatcacaattgttttacattatgtaaaacatacatgttttatcataatattctatcataaatgttttacatttgccatcttgttttttctgcattcttttttacgttgctttgcagttttaattttaccacctgctaatcttaaaatgcctttaaaaatatacagatagtccctgacttacaaaggttcaatttaggatttttcaactttacaatgctgcaaaagtgatatgcattcagtaggaaccatacttggaattctgatatttgatattttcccaggctagtaatatgtggtacaatactctcttctgatgctgagcatggaggtattaataagtcccagctcccagtgagctatgcgatcatgagggtaattaaccaatattctatagtgtactgtgttgtcagcattttttggatattgtgttttgtgttttcacattcaattgcgtctacaaaacactcaactacactaatgtatgtgttctgggcacgtttttggtaggctaggctaagctaggataggtgtattttaacacctttttgacttacaatattttaaaccttcattggggtttatcaggacctaactccattgtaagttaaggagcacttgtacttaaaaacttggcaatttgtctgataaaacttctcttctgactcaagaatactcaaataatatggtcttgctcttcatgtacccttttaactttattagccagttcctctttgttgatcaaaaccatgtctgcagcagttatgtagggaaagcatgagtacaaatgaaattggacataccgagattttgagattaagaatgttaagctctatagactaactgtagcataacactatagtgaattgacaatgaattgcataaaagcagggttgtggtaaattggacgaaccagataagtatattggcttttcttaaaaataactgcagcttagaagggtagtttatacattcccctgagaagataaagtataatgtagtttgaattttctatactttgttaaagaaatataattctactggtttctagtttctgtagtgttggtcttctctcacttctgttaatacataatcagtcactaaatccttctcattctttcatcagatttactattttctattttggcaactatttttttaaactcaggtccttaacaattcacacctgtattattacagtgcctcctcattctatttctatactttgttgcaatattatgttatcaaagacattcttttcttacattctcttgtttacatatgtaagtaaggtggctctcagacaaaattgaggcatctcatcctaggcatcagaatacccttcttgcttcactgttgtctgtatctaaactcagacaccacttctctaactggtgtttctattctggctaagcagatcttactgtgttctaaaatacatctcccatttttgtgtctttgttcatattgttcataccatttctcctccctaaaatgatctgcttcttctgtatgaggtatctgtgattaccatatccattcttctacttttacatttcttaatcatataggctgtgcatcatgaatgtaacttctacattgtattataattttttaacatttttgtctttcatttctcaaagaatataacttcagttttttgtgtgtttttggggtgtgtgtgtgacctttctactagtttgtcaaaaatgtttagagtaggacaggagtcttttctttcttattgctctacactcctctaggacactgtctttgtctttacagttgtttgaagttgtgttgtaagtacctctgttttccaacttgataaaaagggaagagatcatggaagactgctcactgacttactttatttatttatttatttatttatttatttatttatttatttattttgagacagagtctcactctgttgtccaggctggagtgcagtggtgcgatcttggctcattgtaatccctgtctcccgggttcaagtgattctcttgcctcagcctcccaaatagctgggactacagacgtgcaccaccatgtctggctaatttttgtatttttcgtatagacggggtttcactatgttggccaggctggtcttgaactcctgatctcaagtgatccacctgcctcggcctcccaaagtgctgggattacaggcgtgagccacggtgcctggccacttactgactttagaatctcggctgcccaccagcaggtataaggatcatcttcagatcaggaactccggtgctaatagactgaaactgaaccttgtcttttaacatctccagggttttaatttatctttaaaaactactaaaatttcaatttaataatctcaaaggatccttcccttctatgatttttaaaaatgtatacaataatctatctgtgtcatagaaaatcaatcactattttaaaaatccatcaggaatttctttttaaatattgtttctttgtttactggaaatgaatatggtataatctgtacacgtaagctatagatatatgtcaactaaaatttggtaatcagattgtccactgagagttaaactatgatttaaattaggggtccccaacctccagctgcagactggtacctgccttggcctgttatgaactgggctgcacagcaggaggtgagtgagcattacagcctgaactctgcctactgtcagatcagcagtggtattagattctaacaggagcacaaaccctattgtgacctgcacatgtgagggatccaagttgcatgctccttatgagaatctaactaatgcctaatgatctgaggcaggacagtttaatcctgaaacaatcccaactctgctcaccatccatggaaaaactgtcttccatgaaaccagtccctggtgccaaaaaggttggggacaactaatttaaatcataacagataagacatacaaaactccttgaagagacagaatggttcctaggcttcctgctaaataagactctaatgaggccaaagataattatcctacccccccaaaaaaaaatttaaatcagaagtttgttaggttaaatacacacatattaactttaatatgtacaagtactggatactaggagtccaaaggtagtaccctttggactactttaaaatacatatatatttcagcagggcgagatagctcacgcctataatcccaggaatttgggaggccaaagtgggcagattacttgagcccaggagttcgagactagcctgggtaacatggcgaatcctgtctctacgaaacagacaaaagttagctggatgtggtggcatgcatctgtagtcccagctactcaggaggctgaggtgggaggataggtggagcccaggaggtagaggtttcagtgagcgagatcatgccactgcactccagcgggggcaatacagtgagaccctatctcaaaaaatacatgggccgggcacggtggctcatgtctgtaatcccagcactttgggaggctgaggcaggcggatcacttgaggtcaggagtttgataccagcctgatcaacatggcgaaactctgtctctactaataatacaaaaattagccaggcatggtggcacacacctgtaatcccagctacttgggaggctaaggcacgagaatcacttgaaaccaagaggcagaggttgcagtgagccaggtgccactgcactctagcctgggtgacagagtgagataccatctcaaaaaaataaaaaataaaataaaatatatacacacacatataatatacatatataacacatacatatatatttcaaatgaatattgacaatatttcaaaataaatgttttaatcaatttttgtggaaaaataaaattttaccatcttaaccattactttttgaaaggtagtatttgcacataacccaaatcgcaaaagtctcataaacagttttcatcaaaaagcaagtctccatcccagtcctgccccatccatagttagttaccttttctggaggccagtttcttgcttatttttccagagatacttcattataagcattaagatatgtatatatgttgtgtgtacataggtgtatttttccagtaactctttttcttgtactttaaattgtttccaacttgttgacagacatttaggatctttccaatcttttacaatttcaatgttctacgaatatttttacacatgttatttcacacatggttaaatatttctgtagaataaattcctagaagtgcaactgttggatcaaagaatatatggatttttattttaaatagatattgctgtactggcatctatggagattgagtaccaagttacactttcataacaataaacattatacttaagagcctgttttccatacccctcaatacatccttttggaaaaatgggactttggaaagttacttttttttttttttccttttttctttttttgttcttttaacccaatggttcctttagagacagggaagtccctttttacaagaaccatgtttttcatccttttgtcacttaacaatagaaatcatttagcaaatatcaagttttgttaatgtgagacatacttattattagctgaaagttctaagactattctgttggggaaattaagattcacaaacacctattataaatattaaattatttctatttgcattaaattttaaggtagattttaaaatctactgacattctggatacaaagtctacttacaattattctatcaaaaaaaattgaaactctgaagctcttcatttagataatcctgtaactgatatttacaacgtgataatctcttcaaggagtccagggatcttgtacttacatattttatggtggagcaaaaagtcaaaggataaatgctgagtcaaggaacagaagaaaaaaaaaacatgagaaatagtaactatgaagacaaagattcctttctgaaaggagaatgctttggaaattttgttttaaaatgactctgggggaaatgaggggacgagaggggaggaaagaaaagaagggagcaaacaggaggggaggggaggtttacatctttagaaatcagttatgaaacacacagcaattctggccaatgtcagaaagctgaaaggtatgaagaaaatatccttcccttcgaggcacaagcactgacctgtaaaagttgtgttgcagtagctctctgctcaggattcttcaccaaacactttttaacaaaatcggtgaaatcatcggaccaaagttctggctttctgaatgttggtggtggatttgtgggaatcataaaaatagcctagtacaaatgaaatatccaaaagacagtaagaatcacactagcacaatcaaataaacaaatctctttatctgtctttttatcagactctaaatttgaaaaacaaatttaagctgttctaggatttctagtaacactgaaattcaggaagccagtccatctgctactaatgtaatcatttcccattaaatttcctctatttgaattgtagctcattgagcacatcattctttattttacctattacttttttttatcagtctctaaagaagactatatttctgacccactaaggactttccctaaacatatatattcccaaattttgctactacatgccagatttacttcttgtttcagttttatataagcattgctgcttaaaatgggtagtaggagtccaatttgcttttgcaatccagaatatttaagtaaaattactgctataatttgaaataatacttgacagagccaagacttttctctttttaaatatgagtcaaaatttcaaatgaaaaatttcaaaggtaatatactactttaatttattactaatgattgagtacttataatttagtggtaatgataatacattcagaaacctcaaaaatcaaaagccataaaaagagtccatctcatctctcgcctcctagatagtcaccctggcctgtttttgcttttaatctgagtatgtttatgacccaagaagtagattaaaaaaacaaaaacaaaaacctgaagacattctaaatatgaaatacaagtcagttagggggttaatgtagatgtcccaacatgagtaataaaatgttcaaactagaatagtatctacaggaatgaaatggaagaaatgaagcatgagatacttcaaaggaggaaccaagagtacatgctaataatattgttttggagaggtgaaaaaaggaagcatgaaaaattactccagaattcaagaaataagaaataggtaccttaaattgcaaggcactcaggtattttaataattgcctatatcattcttttgaatgccctcagaatatgcagccatttaatataatgcattatcattggtttcttacttggaaagtgatcaaatggactttctgtggacacagcagcaaagactcaatatccaagtctgttgattataggttaagagtcaatctttttaccagtatatgcatcttctttcaaaaaacgtaaattctttaatagattagaatattttatatacctcacgtcatgttatacatattacatctatgatagtctttcaaaagcagtgtagccagtattacaaaacaataaacatctttcaatcaaacaaatatttataaagcatttctgtgtgttcagaacaatgctataatttagaggtatcaaaacaaagggccacaggccaaatagtgccagtggacctacttcgttcagacaaaatcaatctcacattgccacaagatgaatctgctgtaattagactaatttaaactaggacatatgttcttccttttgcgtgagctctatctagcctggctcaattatctactttatgtgatggtccctttaaatatcagaccttataaacccggctattacagtttttaaaataggatacatatctcagacccccagagctcacagtcaacttgtgcagaaaaaaaaaaaaacacatatgaaacgaatagcaaacaactgagtgccagacaatgaaattctgcctgcaaataacctaattaatctcagacagctccacagttgaggcagaacctaataaggctttaaaaaatgagtaaaatggggttaaaagcagctgctggaaaaggcacacaaaaccacctgctacttccaactagagaataaaaataaatttgaactctcatctctgtgaaacagttcaaaggacttacataagcccctatatagactgacctcaaactgcaggtaaattatactagattgtctagataaatattgttcatctgcacttctgttgtaaactggtggataacacaatgatttatgtccttgaagccaatgctctcctttgaactttgaggcaatgagttgcagtcttatcttgagataatcttaacatataaggctcaccttagcagtagctattagaaacccaaggataaaaagcttaactctaactcttatttacccagtactctcataaagtgaacctaaaatgtcacattctaccctcaaatatgcattgaacaagcatgaacaccgagcatacagtccaaacaaataagtcttagcgtatgatctacaccaaaatgtctccaggaaaaccactatgccatttatttccattttttaaggttagctcatcaataatagattttcttgacagccttactgtactaatttaactaatttaacctaataatgaaccacagaggatcctcttaagaatctctaggttttatatgagttgattaggtattaggccccttctatagaaagttttggcaatcagtggctcactttagactaacaattcattcccttgccaccaaccaaatcacagggacacacattacagccatataatttatcttatctctaacaccattttgattgaagaatgttagtaaaataaatgacatgattatccttgtgtttgtttctacacaatgtgttgcttaactacataccaaacctctgattatgtttctaaaagaactactctgatcacaagcagtttaataacgcaagaaatctaggtgcttcaaaacaactaattatcttcatgcctgaaatgtcatgccttagactgcaagagtacccaggagatgtggaaagggctgaaaatgagaatcaacaatgactgaactttataatctcagtggaatgagtcaacacatgtctgactctacagcagctgagtctgtgaatgtatagaagtgatgggcatgccagaataacaaagaaattcatgctattatttaagaacctcagatatatgagcaaaaggttatcttcacaacaaataaatgagataaaggatgagaaaacactataaaactataaagaagtaaacaaatatagctgtttcctgatagcaaacataatacacaggtaacaagctaaataaaattttaaaataatttctggaaaggaaataaagtaattacactaatttataaaagacagtacaaataaaagcaaacagtacaatgtgatgaggccaatactggacatgagtcagaaaaactggcttgagttctaaatcactacctgactgtgtggctttagtatcattttgttttttttttccaagtaaggaggttgaactggatgtttatcaggtcccgtactgggtataaaaagaccctggcactctttaccacgtattaaaaaaccctggcactctaactgcctagcaattgaagggtaaaattatactaaacaagtattaaattgctagttaggaaagggatggagaagaggaaaaagagggaaggacaggaaaaggccttttagatgttaatataaaaatgtgaatctaggccaggtgcagtgactcatgcctgtaatcccaacactttgaggggctgaggcaggtggatcacctgaggccaggagttcgagaccagcctggccaatatggtgaaaccctgtctctcccaaaaaacaaaaattagccaggcatggtggcaggcacttgtaatcccagctactagggtggctgaggcagaattgcttgaacctgggagatggaggttacaacgagccaagatcacgccattgcactacagcctgggcaacaagagggaaactccatctaaaaaagaaaaaaaatgtgaatctaaatttttatcaccattccctcaaaagcaaatatgaaatatacagaaattttgaagagaatagtaaatctaaagtgaaactttctcctataataaagtttccacagtaagcacagagttaaagtattgggaacatgaactcacaattcactccagttccagtagcaatcattaatctggccaagaaaggccaatgtgccagcctggaaaccaaattaagggagagggtgcagctggtattctggaagtacaaagcaaataagagaaccagctctagatggcactgggtacataacagcaccattattagtaactatctgacctatttaactactctatgcctctgttcccatatcttaatatgggaatgttagggctgttctgaattttaaatagattaatacatgtaaaacacttagaatagtgcctggcacaattgtaaatgctcaataatgtgagctattattaacctaattttacgactgaggctcacaagagtaagctagcttattcaagatcacacagctagtaaagtgaatgtcaaaattagaacaagtttgattccttagcatatgctacctcacattaccactgcttccatcagatttctgctgcacataattttattttaagataaaggctctgttatatacattcagtctctagaaaaaagtggaaaagtatttgtaacaaagaagattatagttttactgtctctaacggtggaaaactgaagaaaaaaaaagtcaaacaattgagggtgctaagtaaactatatatgaataacataaagtaacatattgccataaaaactgacaaatgtgtgaattacaaaaccacaaagaaaagttcttaaaaagcaaaaatgagggagtaaaacagtaaagactgctttcacataaaaatgactagtatgcagcaataaaaactaaaagatggtatagaatcttaaaaatttaaactgtcaattcatagcagcaattatgtacaagattgtataagtgtctttaaaatttatttttactatgatggtttttaaatttttttttacttttaaaaattatacttgcagctaggcatagtggctcatgcctgtagtccctgagctgagaggctgaggaaggtggattgcttgagcccaggagctcaagacaagcctaggcaacacaatgagatcctgactctatttaaatatatatacatatatttaaaagtatttaaaaattatactcgcaattgcaaaagcttcatttgataccaccccttaagctgtcacctattccagtctgccccacaaccacctcttactcatgcactatttaaatcccaatacaatcaattgtaaatcttaaccatctttcaagactgaaatataatatccctttaatacaatccaacaatatcataaaacatggctgtagagaaaagcaaaagtgaacaaaagccaacacttaaagaactttatcacaaatttcactctctcagatagaagtcctatgatcagttcaactgacttttgtaagcacataaatgtatccatacctgcaatatattaacttcttcaagaaatttagagtctaatggaatataaaaatgtatatcagatcattttaataaaatagtgtaagtgctcaaatacatgtgagcaataggtattacaaaggatgacttagcccaaataggtatgtgagctaaatgggtatgggaagatgagatttcagctgagtcataaagaatgagtgagtcagtgaagcacagaaaggagaccagcatcttctcagttgtgaagtttgaaacctcatggagctgtgagagaaactgacttatttcagatgtagggcagggaaattacgaggtgagccaaaggcatcttgttgcccataaagaaagaaatcactcaaatactaactggatcacatcagaagttcagcacttgtagaacttagtatcagccataaaagagtctgatttaactgatctggggtgacgacaaggcacaatattttcttacatctcccaagcaattccaatatgtgagtaacatggagaaccactattctaaaatataaaatacaagacaagtgctatcactgtttaatatctcaacttcagaactttccatattttaatattgtactctgattagttataaactcattctaaatgccctggataacatgaaaactacctgaaggcaagacagtgtcttctattgtctgaatgtttgtgtctcttgcaaaattcttatgttcaaagcaaatcaccaacgtgatggtattagaaggtggggcctttgggaggcgattaggtcataagggctccacctttgtgaatggaattaatgccctcataaacaagtccccacagaaccatctaatcccttctgccaaataaggacacatagaaggtgccttctatgaggaacaagccctaactagacaccaaatctgctagcacctagatcttgaacttccaagcctccagaactgtgagcaatacatatcttttgtacataaattacccagtctaaggtattttgttatagcaacccaaacagactatacaatcacttaagttttatatgtcaactgcattaggcatagtacttctccatagtaaaacctaaatttatactgagagtgttgatataaagacatccagttaagtatggtaactgaacatactgatttacttcaactccttccccaaaatcctgctaaagtacagtaagaattttaaaaaggcttaacctccaaagagagaagggcaatagaaaataagagacagcaataaaattttggaaatagaaagtagatgaaagagtcataactgactcaaaagatctgagaaatcagtaagaagcacatcaattccctccaaataactaaaaaaaaaaaaaaagcctaagaacttggaagtaccaaatatatctaaagatagtggacacctgtaacaaggagcacacctggtaccaagatcttggcttctaaaatgccaatccccagtaaaagaaacctatgctccttgaggaaatgactaatttcaaaggtcaaaataggaaaatcacaaggttagctctgggtatcttgctaggccagaaggtaaggaaacactcaaagattaatggtattatgtcaaaaggacatataaataaccaaatttaggataatttgagcatcaaaataataatagtaataatgactataactgattataacaaattgaaaacaattagtctacagtgttttttttttttatttttgagatggagtctcgctgtcacccatccaggctggagtgcagtgacatgatctaggctcactgcaacttctacctcccaggttcaagcgattctcatgcctcagcctcccaagtagctgggattacaggtgcccgccaccatgcctggctatttttcacatttttagtagagacaaggtttcaccatactggccaggctaatctcaaactcctgacctcaaatgatctgcccaccttggcctcccaaagtgctgggattacaggtgtgagccaccgcacctggcctatgacaatatttttcaaagagtttaagaaaagctgttctttatagaaaaattctaaaaatacacagtaactgaaatacagtatcaacatattgcaccctcaatgtaatttaatgatcaattcaggcaaggaacaccaatggatacttgagtttggatatctgtcccctccaaatctcatgttgaaatgtggtcctcaatgctggaagcggggcctgggaaggaagggaagaaggaaaggaaggaagaaggaaaggaagaagggaagggaaggagggaaagatgatgtagagagatagaatgaataatgcccccaccccgcaagatgtctacgttctaatccccggacttgtgaatatgttactttacatggcaaaaaggattttgaagataagattaagttaaaagtcttgaggtggacagattatcctaaattatctaggcaggccaaatgtaatcagaagggtcctaaaaagtggaagagggagccaggagagtcagagggagatgtgagtttggaataatggtctgctttgaagcagtcttcaaataatgctgctttgaagataaaggaagagggccatgagccaaagaatgtgggcagcctttagaagcttgaaaaagcaaggaaacaaattctctctgagatactccaggataaaaaagcttccctgccaccacttcagatgtagcctagtgagatatgtgttagacactgtattttggaaagctccaaaataatctcctttgactccatgtcccacatccagggcacactgataaaaggcgtgggctcccaaagccttcagccactccatccctatggccctgcagggttcagcccctgaggctgctctcatgggctggcattgggtgcctatgggttttccaagtgcatagtgccagctattggtagctctatctggaggggtctggaggatggtggccctcttctcacagctccaccaggcagtactccagtgaagactctaaccccatatttccctcttgcattgccctagtagaggttctcatgaaagctacagccctacagcagacttctgcctggacattcaggcttttccatatctcctctaaaatctaggctggggttcccaagtctcaactgttgccttccttttagttatgaaaatggctgcagctggcttttgcaccctcaaataagtttttcttttctaccacatggctgggctacaaaattttcaacttttatgttctgcttcccctttaaatacaagtttgagttttacatcatttctttgctcatgcatatgggcacaggttgttagaagcagccaggtcacctcttgaacactttactgcttagaaatttcttctgccagataccctaaatcatcagtctcaagttcaaagatccacagatccccagggcaggggtaaaatgccactaggttctttgttaatgcataacaaaagtgacatttgctccagttcccagtaagttcctcatctccatccgagacctcatcagcatggatttcattgtccatatcactatcaacattttggtcacaatttaacaagtctctaagaagttccaaactttccctcattttcctgtcttcttatgagccctccatactcttccagcctctgcctgttacccactttcaaagctgcttccacattttcaggtatctttatagcaatgccctactccttggcactgattttctgtattggtctattctcacatttcaataaagaaatatctgagactgggtaatttataaagaaaagaagtttaactggctcatggttctgcaggctgtataggaagcatagcagcttctgtttcagggagacctcaggaaacttacaatcatggtggaaggtgaaggggaagcaagcacaccttttttttttttttttttttgaggcagagtttcactcttgtcacccaagctggagtgcagcggcatgatctcggctcactgcaacatccgcctgcccatttatggtgataacaacttcttcctctcttacttcctccctctctgtcttcgccctgcccccagctatccgtctatactagttttctatttctgctgtagtaagttatcacaaatgtagtggttcatacaacacaagtttattatcttacagctctttaggttagaagtacaatatggcttggctctgtgtccccgcttaaatctcctgtcaaattgtaatccccaatgttagcggtggggcctgatgggaggtgattggaccatgggggtggagttgtcatgaatggtttattatcatccccttggtgctgttctcatgatagtgagttatcataagatgtggttgttaaaagtgtgtagcaccttccccctttctctcttcctcctgctctagccatgaaagatatgtttgtggccgggtgcggtagctcatgcctgtaatcccagcgctttgagaggctgaggcagtcggatcacctgaggtcaggagtttgagaccagcttggccaacatggcaaaaccccatctctgctaaaaatacaaaaattagccaggtgtggtggtgggtgcctgtaatcccagctacttgggaggctgaggcaagagaactgcttgaagaagctgttatctccataaatgggcagtatcaggctagtatgatactgctgtagtgccatcagtatgtggtctccaccttccaatttacttcatggtttaagatgggtggttgaacattaccacacactgactccagaactcaaaaaaaaggggaagggaatggcaatatagagtattaatcagatctctttacccaggctccctggaagtccaacacaacatttctcttttgcagtgttctgaacacttttgaagctcttttccaagaggctgcaaaagcccatggaatttccagagatataaatgtctttgttatgctaaggagttgacacatgccaactgaagcccctagatagcttcaggatacaggatggtcagcagaaagaataagcatgtaattagcaggttagtatatttagctgcctgacctctggtgagtggatactaaagactgagctcaaacaaatggccaaaggtttaatcaatcattactacttaatgaaaccccagtaaaaactctgtacatctaggcttagcagagcctcctggttggcaaacacattcacatgtcctgattctacaaaaggaagtcacacaggctctgtgttccctctcagacaatcatatgggtctcttcatttgactggtcctcctgattagcatcctttataataaacctgtcattctaagtatagttctttcctgaattctgccagtcattctagcaagttatcaaacctgaggggatcaaaggaactgctgaatgtataaccatttagtcagaagtatgggtaacctagggacaaattaagtgtagctggtatctgaagagtggtcatgttggggatcatgcccttgaacttgtggggtctgagctaactctggatggttagcagtagaacagaaccacagtacactcaatttgtgttgaaatagaatactgtaattcaggtggtattcaaatgtattttcactgtttttcaaacatagcaaaatagtgaaattgataagcaactgatataagaagcactttttagacaaaggtgaaaaatactgtttctctaacagcttttctctacagttgtggttctcgaggtgttcatgaactccttcactgggccctttcagggatctaccaagtcaaatctttttttcataaaaacactaagccattcttttcctttttctctcaattgacatttgcactacaggtacaaaagcaatgacagataaaattgctggctccctagcaccaatgaagacagtggaacaaaactgtaatcattgtattcttcattgtcatgcattcacaatttttttgaatctgtgaattcacaaaaaagacacttttgattaagaaaatccttgatttaaaaaatactctttttagcaaatctttttagcatctttttagcattttgtagtgaaatgagaaatacgcataaactatacctgctacataatgaagtacaatggttgtctcaaggaaaattatctgtgattaaattgcatgttgaactacagcttttttcatgaatcatctttttcatttgaaagaaaaactgagagataaactttgattattcagatttggatactcaacagacattttctcaaaaatgaatcaactgaacctatgacatcatggaaacacagatggtttttgataacaattataaaatttaagctttcagttgaaaagtcaaattttcaaaagcttctatctgccaccatgaacttaacagtttcctagtatttagaaacttttctgatttttccaaatgacaaatacatgacattacccgttcacatatgaataaagatctattccaagtacaagatagagaaatagattttaatgtaacaaaatagaaaaactcactactatggtttcagattctaatactggaattaatctttagaaaattatcactgttgaattttggtgtagtatgaaaggaagaatatcataattaccagaaaacaaatgattagaatattgctccatcttaatcacatatcatatatgtgttaggccagatatttttcatacatttccattgaaataatgtgttacaacactcacaaataaaaaaaaaaattcaaccatcttctattaagctatccactcattatttttatgaaaatagtaattgattcatataaacaaaagctcttgggtcctcaattctttaaagtgaaaaggactgctcaggccaaaaagcctgaaaaccactattctatagtgaatgcaaaccagggaaactaacaggaatattttcttctgtttgatgcatgttcaccagcaacagtaccacaaacttgtttcattttatattatgtccttctaatttgtttacttttttacatatttgaaattttaacacagataaaatttggtatatagtttattttttctaagtaactgtattttaatatgcctgaaaaaataatgaagagacatggttcacaagacatcaaaagagcatccagaaaaatgaaattggtaatgtgtctccattctgtccaagaggatgccctggaccactaaaaaatatacctggtccttgcaatagataaattcaagtggtagacacggatgagcatagcttgatgcagtagtcaataagatcatccaactaatcaccttattctagtaaccattttcacctgacagccttctggtcaaaatttggattcccatgtaaaactgacttcagaagagaatatggtgatgaacatctgattacttgagggttaaatatctatttttaaagtaataaattggaattttgatttgtatatcagtgaacttggttaagtccatcctatgagacagttctatatttattacattggcagatcggtcttcgaataataaatgctgctctgtgatcttgtctgggtagccaactgatcttccttagaaaatacacaaccacaacccttccgcaagcattatgctcatactacatcactgattacctaaattcacaccctgacaaagaagagggctctgccaataacaaagcatattaagttatatatttcagaataacggaataagagtgaaactttactaagaatagtgaataaaataatattttaaatgttaaataagttttgagataaggccttttaatgtttaattttagaataattctaggcattttaacagcataataactcctcaaaaaaagaagtgtatggtttggatgtcactttaagccatgaaatttttatctcagctatttaaataaagtatctcatctgaaatatggtacaatgtatactttacactgcattagctataacaataaataatggatcataaacatttacatataaaaagaacaaaatgaaaggtaagactatgcggaaaaaatactagaacaaccactagaagtttacaaaaaataagaagacagtacaaaaacatcaataaaatagattgaaaaataaagctgatgaactaattgccttgaatgtatcagaaaacttaagggaagacaaaatattagaaatcagtggccaggcatggtggttccgcctgtaatcccagcactttgggaggctgacgcgggtggatcacgaggtcaggagatcgagaccatcctggctaacacagtgaaaccccgtctctactaaaaatacaaaaaattaactgggcgtggtggcgggcacctgtagtcccagctactcaggaggctgaggcaggagaatggcatgaatctgggaggtggagcttgcagtgagccgagatcagagatcgcaccaccgcactccagcctgggtgacacagtgagactccgtctcaaaaaaaaaaaaaaagaaataattgacatatatcagataaactaattgcatgtattatcaaaacaatttcagaagcatgataaaattaagaatctggaagaaaactttcatagtaacttatcttagtaataaaacagaaaatgaatcagagcttcaaaagcaagaaagaagaaccaatacccccatccaaaggaactatctggaatgtaccaaaatgtttcaaaacagaaaaaaaaaaaccatatgattacaaaatgagaaaaaaggaaataatgaacaaaagattcatgtaatgtaacttagtataatttgaccataagattagggaaataaattaatactagtcattagcagtttttgtatcatctggtaaaagagttccaaggacaagaagttcaacaccatgaagtactattagaagatcagaatattatatgcaatactgcctagcttcattttaccaaagtgcaacaataattcaattcaatccaaagtaaatcaatagcatccattgattttctttctattctattcccacctctgactcctaaaacagtgcggcacacacgtcttagctctatcccagtgcccccaccaccatatgccacccttgcaatagctgtgtcttgtccatcactagcctggtgcagtctgtcctaatgaggaaaagcagggaagatgcccgcataggctcaggaccatttaaatggggaatcctgggatcctgggtctgcagagcatgatctaggagggaaaactatgggctctagcacagagatgtagcatggcccatgcagggcataatctttgggcaaaggctccagttaccgggcctagtgcctataattgacatactatcctcaaaattatcatttagcataaaatcatcctgattcgagttaaaatattatgtcactttacaaccaaagtgcaaagactaagttgttatagaatctgtgaaagttaatcaagtaatcaaaacatagtaaaatataaaaatgctcattataaagaacacatcattcaaaatccagtcatatctaatagagactacaaaacttaagcagatgtttacacaaaggcctataaactcaaactgatacaaagaactgggttaaagctaaacaagcagaggtcagcacagagctcctgtgattgaatcacaataaaacaatacactagtcctaagatagcaagaatatgatgcaataagtgaggctctggtcccaaaacagtataatgcccagtacaaatcaatttcacaaaaatctataatagaagtcaatgtaaattaggattaagaaaatcaaaattaacaacaaaaaatatatgaagaacaaaaaagaaacaactgaaaatatgaaaagtttataattaaaaaaagacacacagacatatatacatacatcaaagtctacaatcagaaaaaaacaatagatctcagaaatttagtgtgaaatttaagagtaaatagtaagttttagaaagaaaagaaatctgtcaacacagcccctcattttcgtgcctagggaaaataaggcttaatctacagccttggccaaatatgattgccagataaataaacccttagattctaccataagttaattaaaatgataaaaaaaaattcatatattagtttctaactccaaatttctttaagaaaaccttatgattcacaagcaaccaaccaattccaaactctatgccagtggttcttaacactggctacatattagaatcacctgggaagcattctaaaattgcttattccctgaactcaacccaaagaatctggtgttgtctaggcctaggttggttggtttttaaaaaaatgtcctatatgagtgtaaggtgtatcaagggtcaaagatcactgcatgaatcaaacagtatggatccaaattcccactacatttagcacaagtttggggaataaaaacttaccatttttagagacagagttcataaatagaatgggagaaactaggaaaactaattcaggggccaactctaggcaacaacaatcaaactgttccccttgctaaataaataaatacatatatagtatataaaatatatataaatatacatataatagacatttatataaatatatatgtgtatgtatgtcactatattttatatttcatctaaaattccataaattagaaagtcattgctgtttaaaaactatgtgtaacttctgcttctaggaagatagagtagatgtacattttcctatttctctcgttaagtacaaccaaaaaccatggacattatgaataaacaagcatacgaagatccagactgggcacagtggctcatgcctataatcccagccacttgggaagccgagtggggaggactgcttgaaaccaggaattcaagaccagttcaagaccactgtttctaaacatatatatatatatacacacacacacatatgaattctatatatacatatatatcaattctatatatatatcaacccatatatatagagagattctaatatatatatatatatatgaaagatggagagaaggcagaacagctagggatcttggaacccaaggaacataactgatgacttccctggatcttctttgtcccttatatattccacacttggggccagataagccaacaaccagaaaaagctaacaggtacaaacaaaaaagctccgacaaaaccctgcccaaaagatgaagagaagaacaccatggaaagaagaaaactttaggcaaatttcactctatgtcagccaaacaccacagaaaaaactgtagtcccactctaaccatgtcagaaaggcttagtggacagcctaaagttctatcctcatgagactataacaaggtcccacaatactcctgacatggtgagaaaagaacaagtagggagccaagaatttcacccctctggaaagtaaaaggacagccccccctagcagtgtcagtagacagcaagtagaacctgtacttcctctccaaactggcagcaatgaggtgatcctcccactacccactgaggaggactagaaaaaagttaaattaagactttcactaaccagtggaaattaggtaagcaccaatacaatagagactacacacggagagctagaatcaccactctgactcagcaataatgaggagccactcctgctacttgagtagggcaacagagactgaaaggggaatctggacttcaacaaactctacctggcagtgatgagctcccttcccctcttaaagtaatgtcataaacattcacctaaaacagaaggtttaaataagatccagtctcagaatataatggggaaataggtcctgttttcaaccaaaaattactcatcagaccaagagtcaaaaaaatcacaaactgaccaaaaaaacaaaaaagataaaagtcaacaccaaaaaaagacatgtcagaagtatctgacaaatattttaagagtctttaaaaaaatgcttcaatgaacaatcatgaaaataactgaaacaatgtaaaaatagaaagcctcagctttaccagtaccttgtgataatttatgtacatatagaataatactaaaataaaccaccaaaaagttttgcatagaaatatcctcataaacactatagataaatcaaaagaaaactcttaaaaaaaatcaagtaacccacaggaagtaaaaaaaaagaaaacagaaattaaaaaaatgcaaaactttagccataacatattaataattacattaaatgtaaatcgcctaaatatgccaattaaaaggcaaaaactgaaaaggtagattttaaaatgcaactcaattatatgtagtatataagaaactaacttataatataaaaatacaggcatgttgaaagaaaaatgatggaagaaatataacatgcaaacaataatcaaaccaaagcagaagtggctatattaataacagataaaggagacttcagcaaagaaaattaccagagacagagagggacattacatagtgatgagacataattcaccaagaaaatataacaagcactaatgtatatgtaccaaccaacaagctataaaatatatgaagcaaaaactaaaacttgaaaggagaaatagataaattcaccattatcagtagaaatgtcaatatcctctaacaacaagagataaaacaaatagacagaaaatcagcaaggatacagaagaaatcaacaacaccatcaacaaaatttatagaataccccacctcaacaacagcagagtacttattactttcaagtaatcatggaccatataccaagagagaacatatactgaggcataaaacatacatcaacaaattttaaagaactgaacagagtagagtctccaagcacaatggaatcacattagaaatcaataacagagacataataggaaaatcaagcacttgaaaactaaagaacacgctttcaaataatctatgtgtcaaagaagatgtctcgatcgggggaggagccaagatggccgaataggaacagctccggtctacagctcccagcgagagcgatgcagaagatgggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgatggatgcacctggaaaatcgggtcactctcacccgaatactgcgcttttcagaccggcttaaaaaacggcgcaccacgagactatatcccacacctggcttggagggtcctacacccacagaatctcgctgattgctagcacaaagcagtctgagatcaaactgcaaggcggcagctaggctgggggaggggagcccgccattgcccgggcttgcttaggtaaacaaagcagccaggaagctccaactgggtggagcccaccagagttcaaggaggcctgcctgcctctgtaagctccacgtctaggggcagggcacagacaaacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccctagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaatggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctaattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgaaagattttgtgaccaccaggcctgccctaaaagagctcctgaaggaagcgctaaacatggaaaggaacaaccagtaccagccgctgcaaaatcatgccaaaatgtaaagaccatcgagactaggaagaaactgcatcaactaacgagcaaaataaccagctaacatcatcatgacaggatcaaattcacacataacaatattaactttaaatgtaaatggactaaatgctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatactaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaatttaactcatctccgcaccaagcggacctaatagacatctacagaactctccatcccaaatcaacagaatatacgtttttttcagcaccacaccacacctattccaaaattgaccacatagttggaagtaaagctctcctcagcaaatgtaaaagaacagaaattataacaaactatctctcagaccacagtgcaatcaaactagaattcaagattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaacaaagaaaaaaagagaggaaaatcaaatcgacacaataaaaaatgataaaggggatatcaccaccgatcccacagaaatacaaactaccatcagagaatactacaaacacctctatgcaaataaactagaaaatctagaagaaatggatacattccttgacacatacactctcccaagactaaaccaggaagaagttgaatctctgaatagaccaataacaggagctgaaattgtggcaataatcaatagtttaccaacgaaaaagagtccaggaccagatggattcacagccgaattctaccagaggtacaaggaggaactagtaccattccttctgaaactattccaatcaatagaaaaagagggaatcctccctaactcattttaggaggccagcatcattctgataccaaagccgggcagagacacaaccaaaaagaagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacagaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagatagggatgccctctctcactgctgctattcaacatagtgttggaagttctggccagggcaatcaggcaggagaaggaaataaagggtattcaattaggaaaagaggaagtcaaactgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaatagaagaggatacaaacaaatggaagaacattccatgctcatgggtaggaagaatcaatatcgtgaaaaaggccatactgcccaaggtaatttacagattcaatgccatccccatcaagctaccaatgactttcttcacagaattggaaaaaactactttaaagttcatacggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggagtaaagatttaaacgttagtcctaaaaccataaaaaccctagaagaaaacctaggcattaccattcaggacataggcgtggggaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtgaggggaggggggaggggtagcattgggagatatacctaatgctagatgacgagttagtgggtgcagcacaccagcatggcacatgtatacatatgtaactaacctgcacaatgtgcacatgtaccctaaaacttaaagtataataaaaaaaataaataaataaataaataaataaataaaaaggtcaacatcaaaaaaaaaaagaagatgtctcaagggaaattaaaaaaaatacactaaaccgaataaaaatgaaaatacaacaaatcctgttaaaatttgtaggacacatgctgctacttgaagagcctagacaaagaagaacaaaaataaatgcaagacaagaagaaagaaaataataaagagtagaaatcaatacaatttaaaatatgaaaaaagttaaaaatatcaatgtaacaaacagctattttaaaaaacacacacacaagaaattgacaaacctcttccaaaatgacaaaaaagacaaaaagagtagtaaagtttctaaatatatttttgttttttaagcaactgtaaatggtattgcatttttaacttcaatgtccatgaattcattgttaatgtacacagaaaaacaactgattttttttttttttttttttttgagacggagtctcgctctgtcgcccaggctggagtgcagtggcgggatctcggctcactgcaagctccgcttcccgggttcacgccattctcctgcctcagcctcccaagtagctgggactacaggcgcccgccactacgcccagctaattttttgtatttttagtagagaccgttagtatttttgtattcaccgttttagccgggatggtctcgatctcctgacctcgtgatccgcccgcctcggcctcccaaagtgctgggattacaggcatgagccaccgcgcccggccaacaactgatttttatatcttgcatcttgaaaccttgttgcgcttactcattaattctatgagtttattcattggtattttctatgtagaaaatcatatcatctacaaaaggagatggtttcatttctacctttccaatctgtatgccttttcctttcacttcttgcctttttgagctggcaagaactcccagtactgtgctgaatgagtagtgagagtgaacatcgttcctgttcccaacattaggggaaaacattcagtcttttaccattaattatgatgttagctgaaaggtttttataggtattcttcatcaaattgaagaagttatctttattcctattattctgagatcattcaataccgtaaatgggtgctgaattgcatcaaatttttttttctacattatgtgacttttcttctttagtctgttaatatggtgcattacattgattcagctgaatggtactctccccacccaacaacccagctgtctgtatgttcttaaggtggaagctcagagtgttgttttttttaacactatgaccctgaataaagcaacatatctatatagctagtcccagaatcactggtaattgcttacataagaagctccgtatggccagatgatacagattgtggacacatgagaaaaaccttcttgttgcaagtaaaatatatctgtggctgagaaaaaaagaccgtcaaatgaaaaattctacatacaaaaaaaaaaatcagacattgggcacggtggctaacgcctgtaatcccagtactttgggaggctgaggcaggcagatcacttgaggtcaggagttcaagaccagcttggccaacatggtaaaaccctgtctctactaaaaaaaaaaaaaaaaaaaaaaaattagctgagtgtggtggtgcatgcctgtgttcccagctattcgtgaggcaggagaatctcttgaacccaggaggcagatgttgcagtgagctgagattgcgccactgcactccagcctgggtgacagtatgagactccatctccaaaaaaaaaaaaattggatttttttggtttactttccctgattctattaatcactgaatacaataaaccaaatactaaataggattagttatgactcataaataaacataaggatgtatattacattgccattcattcattgtatgtaaatttcctacagctagactataatatacagcttcccaaagcaatctaaaagtaacaaactttaatgatatagcacaactgaagtttggtatagtaagtgcaaataagtattgcaatgacaattcatcatggtaaactcaagggtctgtaaaaaatcaaattatcgaggaccgagttcaagaagaactatattaatacatagatttctgtaacttggcagagaattccctacaattgctacatttaaagtaatcaacacatttctatatctcagaagaagacggaaattatgtgttcgcctatcctaatgtattaaacttttattacaatagttttagtatatttttagcttaacattaaggtagaaacattctatcaaactaagaaatagaaattgctctgaaattgcaaaaacctgtactatttcccattttaaaatcagaaggattacttctacagcatttaattgttacatcttacaataataaattacatgggactaatatgcataatagaacacaacggtagtagtaataatgattgagcagtagtatatttacataccgataaaagaaaacccatgtagaagaaactgaagaaaataaacgctagagtgaacaaatgatgagtaatgctccaaaatacaagaaaaagaaagaatgggatacagaatagaggttgagagattggacttgagcagagaaggaaccctcttcctccacatggaacatattgtgagggagggaagaataagatgagaaggaggagaaaaagaaacgaagaaaaaataaagggaaggaagaaaggaagaaagagagggggaaaaaagacataaaggaaggaaggaaaagtatagatattgactgttacggactgaattgtgtcctgtccccccaccaccaccactaccaaattttatgtcaaagccctaatgctccatgttactgtatttgcagattgggcctttaaagaggtattaaggttaaatgaggtcataaaggtggggctctaatccaatatgacttgtgtccttataagaagaagaagagacattaggaatgtgtacattcaaaaccaaaggccagggctgggcacagtagcttatgcctgtaatcccagcactttgggaggccaaggcaggcagatcactggagcccaggagtttgagaacagcctgggcaacgtagcgacagcccgtctctacaaaatatacaacaattagccaggcatggtggtgtgcacctgtagtcccagctactcaggaggctgaggtggaaggatcatttgagctcaggaggtcgcggctgcagtgagctgtgatcacaccatgacattccagactgggagacagagcaagaccctgcctcaaacaaaaacaaaaacccaaaggccatgtgagaacacacagagaaggcagccatctgcaagccagagggagacctcagaagaaaccagacctgccaacaccttgatcttggaagtccagactccagaactgtaagaaaataaactgttgttgtttaaatcacccagtctttagcattttgttatagcagcaggaacagactaatacattaagttagacggagggacagaaacagtgaactgctaatagtctccagtttttctttggaccagaaagcaagtctgacaaaaccaaggagagatggggtaaagaaattttgcaacagacccagaagagaatgaggtggtaggcgtaggggaacatgtgaaaggattgccaactgtccatttcagattagaaatcaatcttttgggggcatcagtcttcacagttacataattgcagttaagcagcctggttacgaggaacacagcaaaatgggaaaggtaaaaacctttgaggttttttaagtctgagtgataacctagctctatcagtgtagctgtgtcttgggttgttatctagagttataataatgatagttacatagagtgtgccaataataatatctactccttttagagttgttttagagttatgtaaaactttatcatagagttggtcagatagtagacaataaataatagctactatacttattactatgggattagtgtagtattggtacattgttaggaagatacagcaaaaaagagaaggaaaaaaaggaattaaaagaaagtggttcagccgggtgcggtagttcatgactgtaatcccagcactttgggagaccaaggcgggtgggatcacttgaggtcaggagttcgagactagcctgggcaacatggtgaaaccccatctctactaaaaatacaaaaaatgagccgggtatggtggcagatacctgtaatcccagctactcgggaagctgaggcaggagaatcacttgaacctgggaggtggaggttgcagtgagttgagatcgtgccactgcactcaagcctgggcaaaaagagtggaactctgtctcaaaaaagaaaaaaaaaagaaagtggttcaagtgacagagtagagtcttggctagatagaggagtaaagtgaatgcctgaggatactgacaagctggaaaacaggaggaaaaataagttaaatggcctgaggatgaagtccagttgaattttaaacccaagaaaatgagaaagatcgaaagattggtaattaaaataaaatcctccagagaagactgctgagtgtgaatcagcagctacttcttatatgtaacaccacagagaaacataacaaaaaaagaaagccagctaaatggtcgtggccttgtcattagctagcagtgtatcttgaaagaaggcgcttaaactgtgagccttactgctatttgaggattactgacaaattacctctggtttctcctttattccacttccactgtaccctctctccgacaacacacacatacacacatacacactcatcattatagtaaagatcaagaaaggcagtaaacaagagcaaagatctggaaagaaggcacattttcaaaactgacatttgtcttgtgcatcctcccacttcccttttccctctcccagtcccacctctacaagcccaaaaaccccagctctcactgctggctctgctcccagaaaaagcccaaagtgccatgtttctctttgacctttcttccctccctcccacctattaaaacttccactgagtctatctcagtttaacaagggaaaaggcaaactgattatgccttttcataatgatgccaggatgaacagtaactcatctgtgcttaaacctcccaagtgtgtttggcttaaaaattgaaacgaatctatttggcaaaatttcaggcagaatggaaaggggataatttggggcaaggagattttctttcttccctgttttaaagttgtgaggaagaaaaagaagtgtttgtcgtaactgacaacagacaaccaccacagaaaaaacatccacagcagctcagaatgctagactgctacacttaagggtactttttaggtgtacaggcctgcataggatgctgaagtggggggcttatgatagcaaacatgaggaagcaatctaccctactataaccctgaaaaaagtggttcagaaccatctaccacgtcatggtaatgactctcttttctcttccctttattacagaggctgcccctcaccctgccccccagatgctcccctgataaaaggaggtggggaaaaaggaggcagccataaaggcagcagcaggagtgaactctccatcttagttatttcctgttagaagtggggaaagaatctgcagcatagaagccttaacagaagcctgagtataaagcaagaaaatagctgtagatagaatcacatgaaaaagtgactatacaggaaaaggtgccattcaatgagaaaagggggaaaagtatcactgaagaaaagaaacactctcttcccaaaaaaggtagaaatacaatcaaatgtttcagagcagggatcagaaaacttcggcccacatgccaaatctaaccagtctcctgttttggtaaataaagttttatgggaacacagccacactcattcatttatgtgctgtctatatggctactttcacattataatggaagagctgaatgactgcagcagagaccatataacttgtaaagactaaaatatttactatctggccctttacagaaaaaaggccctgctttaggaggtcaggggtaagaaggggactgagatgaggccatcggatttgataataagtgatctctggcaaatatgaagaaataatttaaaagaagtttaaaagaaactaaatgtattctaataaagtagagacaatgaggataaggtattctttcaaacagcctctaggaacaaaggaagactacatgcaagtctgcatggggaaataagaaattttcttgatctcaccaatcttcctcctcttggagtcactctctttaatcaccaaccaaacagcttcccaaactagaaactgcagaattttggtaagtgattctagctccacactgctttctgtatcctcagttccaggtgcaatgcttagtatacaaaagataatgtttgttgagtaaaacaatttaagagtacagaatgtagagagaaaagattgagaagagagaaaaaaattctgtccccacttcatacctggaaaaacattccatgccacctctaatggctatgtggcttggactcaagtcttaagagtcatcataggccaggcgcagtggctcatgcttgtaatctcaacactttgggaggccaagcccagcagatcacttgaactcaggggttcaagaccagcctggccaacatggtaaaaccccgtctctactaaaaatataaaaattagccgggcacagcagtacatgcctataatcccagcactttgggagactgagacaggtgtatcacttgaggtcaggagttcaagatcagcctggccaacatggtgaaaccctgtctctactaaaaacataaaaattagccaagcgtggtggcatgtgcctgtaatcccagctacttgggaggctgagacaggaaaatcgcttgaacccaggaggcagaggttgcagtgagccgagatcgtgccactgcactaaaaaaagaaaaaagaaaaaaaaaaaaaaaaaggtctggttatttaaaagagcctgagactcctcccctttcttttgctcctgctatcaccatgtgacatactcatgcccccactgcctcaggaagtaaaagcttcctgaagcctcaccagaagccaagcagatgctggcatcatgcttgtatgacctgtagaactgtaggccaattaaacctcttttatttataaattacccagcttcaggtatttatttatagcaatgcaaaaacaagctaacacacacacagcaaagcctaagatttacatctatgtttactaccaaaaattttatagatttagctgttaaatttaggtctttggtgcattttgaattaacatttttacagggtatgaggttggagtctaatttcatttttgtacatgtgggtatctaattgtgccagcacactatgttgttttaacatcaaatgagaaaatatataagataatttgatactacaaatatttgtggttgttaaaattcaggtactaagcaaacagctcagtagaatactacaacaaacatgtaacctaattctcctgtctctagtttctcctttaatatctgttttatatctgtgtaaaacacagtccagtaatgcaacaactctacataaaactaaagatacctactgctgacagaattagaatttctggaaattctgagacagaacttgcccctgatttttccagtttatacaagctatccacaatccttcgctcatggcctccttcctctcttttcaattttccaggctcatctcttaccattgttcccaaccacttggtctggctacacaatgttactagacacatctgatgtgaagtactcttgaaagactctgtagattactcatgctagacttttggctttccttaacctgggggttccctgaagcagaaagaattttatttatccctatattcaagagtccaggagagtgcccaacacaaagcaggtgtttcataaacacttgctaagttaaaggaatacacaggcaggcatggtggctcacacctgtaatcccagcactttggaaggcagaggtgggaggatcacttgaggccaagagttagaaactagcctgggcaaaatagcgcaaccctatctctacaaaagtaaaattttaaaaatcagccagtcctagtggtatgtgcctatgttcccagctactcaggaggctgaggcagaagaacagcttgaggccaggagttcaagacagcagtgagctatgatcacaccactgcactctatcccaggcaatagaggaatatcctgtctccactcccctccacactccaaaaaaaaaaaaaaaaaaaaaaaggaatgtgcctataaatggaagacagtgacgaaggtaaaggaataaagtagacgaaggcaacaggtttggaaaacattaaatcatcttgtttggcaggaaaaattgtctatatagggggatgttgagagaagcctggaaacctggatgggacagcaagagtaaaggccaagtgaggaatttgtacagtgatagttttttagggtaacttgatggatttttagacacagattataccaattctcttttcccccaataagagatttgtgactttggctaaattatttgactcagaaaagactcaagtacttcatacacaaaattagactaatctctttagtatgataggctcagctggtaggcccatcaccctagacacagaagaaaaaaataatcatgctataataaggaagcttgacagtcatttacgagagtttaccaacttttgagcagtgaaatctactttccaaataaactcatacatggaaccctagtacagaaaccttttttaaacccacaataattgaaaggggcatgaaaaaaactggagaccccacacacccaccttccttcctctcacaaacattggttcatataatcaagtggacttcaaatcaaatatggggaaccctaaacactactttagaacatggtcaaaagtttactaatctagagggatccaggtaaagtcatacaaccaagattcccctttgtggctactgattcgaaaataaatgctagggaggaaacaaagataaaaactaaagatggaaaggaaggtcctactgtaattttcctgaccagaccaatggagggcataaactaggatggtagtattaaaaagacagaagccaagcaaatataacatacagaaactgttttcactttgttttccgtattcttgatgggaaccatgctgacccaggagagactgcccctcccaaggctagctacttcttagacagcaaactacccctccttgagtgcttttcgcatgcaaaccactcaatctaaaactacctcccatccatccccagtattcagctctcacagaactcttatattctgggactattagaatagtcccctgttctaataatcacgccagggccaggtatcaaacaacttgggggctgctcttatatgtgactatgccgacattattaaaaccagccaattctaagcctccttaccctgcctcgcctgttccttctcactaaaatcatgataaaggctctcccccatgatttccctagctatttctgcctcctaaacaaccctggtgcttccctatgagcactatgtggcgtggcatatatgccaccctgtctgatgtgccatgccctctccacttagaaactgtatcaatcttttcaatggcagttgtctcctgacgtgttagtttcaccatatttgaataataatataaaccacattttaaaaatagttcaggaccaagcaccaaacaaacagcacgtacttagagaataaaatgtgaagtattaagaatcagtattaaggctgggcatggtgggtcatgcctgtaatcccagcactttgggaggctaaggcgagaggactgcttgagcccacgtgttcgagaccagcctgggcaacacaatgagaccccatctccacaaaaaaattttaaaaattagcaggggtggtggcacacgcctgaagttgcagctacttgggaggccaaggtgggagaatcacttgagcctgggaggtcagggctactgtgaaccctaatggcaccagtgtactccagcctgggtgacagagaggaacagaagaagaaggagaaggagaaggagaaggagaaggaggagaaggaggagaaggagaagaaggaggagaaggaggagaaggaggagaaggaggagaagaaggagaagaaggataaggagaaggagaagaacaagaagaagaagaggaagaggaagaggaagaagaggaagaggaagaagaagaagaagaaagaaagaaacagtataaagatgagattttctagttatgagagatgccaaagcagaatgttttaagagataaacctgacatatagtaaacatttctttttttttattaaaacacattaactataaatatgtttaacatcatttcttatcttcatcattcaagatatctgagccaaaaacctaggccaaaaatcctgactctcatttacattccacatttagataatcagaaaatacaaatatccagaatctggccacatctcaacaactttacctttactaccctggttcaggccgccattatctcttacctggactactgaagaagtaacctcctcactattcacctggcttccattcttgtcctgctacaatcccttctcaatgaagaacgagccgtttaaatcacacatcagaccataccattcctctgctcaaaaccctgcaatggtttcctgtttcactcagggtaaaagctaaaggtcctgccgtggtttatgaaggctctaagtgatctggttccctgccatccctctgatctcatctcctacttctttcaccatcttatccagctccagccacttaaacctccttactgtttctaaaacatcaaacacagtcacacatcagtttactctgactagaacgttctttccccagaaatctgcattgctcatttacttagctccttcacatctctactataagtcaccttattagacaggcctttcttgaccatcctacatataatatcacaaacatatctgtcattctgtatccctcttatcctgctttttcttcatagctgttatcagtacctgatatgctatagttttcgtttttttgtgtgtttttttcccgagacagtgtctcactctgtctcccaggctagagggcagtggcacgacctcggctcactgcaacctccgcctcctgggttcaagcaattctcctgcctcagcctccaaagtagctgggactacaggcatacgccactatgcccacctactttttgtatttttaatagaaaatgcgtttcactatgttggtcaggctggtcttgaactcctgactttgggtgatccacccgcctcagcctcccaaagtgctgggattacaggcgtgggccactgtgcccagctttttgtgtgtaatttactgtctttccccactacaaataggtacctaagagattggaactttgtttcattcactgttatgtatgagtgcctaaaacagtgtctgagcaggcactcaataaatatgaaataaattaatataccaaagcctttctgagggatttacacttgtactgctcaaaaatccataaacctcgcaaagagacaaaactggatcactagtggtaatatataaaaatgtaaaaataaaaatgtagtcttctaagaaagatagaaggcttgacagtaaatgattaactaccaaaagaataaagtataaatgagagattggcgaccatgtgaactcacctcaagagaataatagatacctacaaatgaacatgtgaaaaactttataataaaactatataattaagcacagagaataagactatcttgccaagatttgctaacttggcaaacatccatattaaactcagcttccccaattccagatacaaatgaaattgtgaatttggcaattcactggagagaaagactgcattacaatctaggttcacattaaagttacctcattcttctcaacttagatctgacgcagaggaaaatttttaacagattctattggacatatgccatactatagtcagtaaagttcaacattaacattttagatgttaacctaaatgatttgttttcctaaaactaaactgcactaaaaaaatatgcattatgagtataaaatgaattattttaaataatattttgtcaaagaaaaagcaatttataacaccagtccttccctcgtattttgatttcattcatgtagtgcctcacccacagctgaacacatggtagcactcaagctgttcactgataagagagagaatattctttccttcaaggtttattaaatatagatatgtccacctcaaccttcccagttattaaaaaatgcaaatgaaaattatgtaccccaaatttgtatataaatgtattaatcatttatttaataattagtatgtcataaagcgtagtattagatactgaagacacaaaataaaaattacacatgctgctatcaataacttcataatgtggtagagaagtcatataaactataacagaagatgataacttgtatggtcttggggcacacaagatgcaaaggaagcccagaagaaaagttcccaagatagaatgtgtagaaaaaagatgggagaaaatgcaggcataaagtaacacttagaagaaggcagaggtaaacctaacactacctacaaatgatagtatggctaaaggaaaggaaatatcacatgaataaagatgtatgcagagcccaaggtcttacatgacacccttaaaaatttggctattaatggggaggatcttaagtaagacagtaatatgagttgtgtttcatttaagatgatcaatctagcagcatcatgaagtttactttagagaggagattgagactgcagattattaaatcagttggtactgatccagaagaaggtagaacgatggcggtggcgttggctttgccagctcaggactgagtgcaagtaacagagaatcagccagattctccagaggctcttcaggttctcctctgtctttcagtcagcagtctcagtccatttgcggaggaacattggtgttacagcagtggcgtttaataaggaacttgatcctgtacagaaactctttatgtacaaggttagagaatacaaatctaagtgacagacatctggaggatctgttgatactgatccagagtaccagcaagagccagagaagaagctttttaagctcaagcaagtgtatggtaaagcagacatgaatacattccctaacttcaaatttgaagatcccaaacttgaagtcatcaaaaaaccccaggcctgaagaaataaagtaaaattaacctggtaagttgtcaagggttagctgtacaactagctagaagtttcagaataaacatacattcacaactgtcaaatgttcttttaatctcgattccaaataaattagttggtgatgtggagtattaaaaaaatctggaaggaaaaataaagatgtggacgaaaagaaggggatattacttgagagatattaagaaagttacagagatgggaactggtgaataatgaaaacttgaatcagcacagtggcagtggagctggacaggaaggagggaaggaaacatcaacaggacctggtgactgattaaaggcagaagattgggccaggcacagtggcctgtaatgccagcactttgggaggccaaggcaggcggatcacttgagtccaggagtttgagaacagcctgggcaacatggtgaaaccctgtctctaaaagaaaaaatatatatatatacaaaaattaaccaggggtggtggtgcatgcctgtagtcccagctactcgggaggctgaggtgggaggatcacttgaacccaggaagcggaggttccagtgagcggagatcgtgccactgcactctagtctgggtgacagagtgagaccctgtctcaaaataaaataaaaaataaaggcggaagattggacagagggaggatactcttggttaatggcaccaccatctaaccagttgtttcaaatacatagttggttcaaatataaagggagaaacaagcctgatgaaaaaacagtgaaaacaacttggagatattggatttgaattatctcaaaatagtaaagaaaattatataagcagattactagaaatatgtctagaattcaagacagagataaaagctggaggaaagccagggaatggagacagcagtgttctctactgctgtcttaaccctttctttcagagccacatataaaagcagttcactggcacctctgcttcctgggtccaagtgattctcccacctcagcctcccaagtagctgggactacaggcatgcgtttttatactattttgagagaattcaaatgcaatatccccaggttattttcactgttttttcattctcccaaaggaaaactgtttgtctcctaaatcaaggagcacgtgagcctgtaaagttccatagcagagaggaaataagtgatgggtaggagaaaaaaaaacaagaagaaagaggcatacccttctataatactacagccagaaaagggtaaaatgaggccccaaagttcaggcatatgtatatggccatttaactaggactttttaagcaataagcatgctgtgcttaggctgtctcagcactattgttaaatgctttaattatgtaacttttgatacattcatgttatcatatgttgtaattattgttgttactattacattttctctatatagcacttattatgtatggggcaatgtactaagtagctttacaaaaattatttcttttaatcctcaccaaaaccctatgaggaagtatttctccattttatatatgagaaaactgagggatagaaaggttaaataacttgccctcaaatactcagcaaataaaggacagagttgaaaatggaacccaggcagtctagctccaaagtccatgatcttaatcatcaagttatactacctcttttcaggtggataaagaatacttttggttactaacttaatctgaagacaactattttctagtaggaaatatttctaattttacaatacatgtaggagaaaattgagtttactgatcagaaacttgctagactacattattaagtaaaaaaacacacagaattaaaatattatttaaaacatctgtacatttttaatctgtataaacatgtatatataacaatagttctcatctatataaatatgtacatataataattgttcttaaattttactatgcatcagaatttcttggtgggcttgttaaatgcagattgctgaacccctacttcaaaccccaatctttcccctattacttacgaaataaagtacaacttcttttcagcatggcttacctttggccatgaggcatcgtctaaccatctttcaataagtttttagtacattacctatttttttatgctttccctaatacaacccttcctaataaagccatacattccttctatgattccaaagcacctctaaaatagtaaaaaacagaacaatgataataatatcaattaactctgtggggcattcccaaggaaacatgaattacctcattcaatcctcataacaactcctcaggataaagattataattattctcactgtacatatgggaaaaaagtgagacatggagaggttaaattgggcatggtaatacaatcagcaagtagaaaagctaggattctaccactgcaattatactatataagcaattactagattgttcagtacttggatactatttagatactagatttttctaagtactaatgtaaataatttccttattcatttttacacttatttaactgacatttactgactgcctatcatatgccaggcattgtgttaggcacgaaagactatcatgttaaaatacaagggaagacccagtacctgctctcttgagacatggaatccagtggaaaaaccaaacattaaattaaaaatcagagaaatatttcaagaaatatgtgttaaagacaaaaagtacaaggcactccaagattataataggaagatctaagctgtttatagttattgtactggcagtgtcctattacaagagtataagttacacagaatttgcatttcaggatgccaaataattccatttcaaaatgacgctttcaaaatcaaattaattaattataagaccaaagtcatatagttaaaatttaaaacatattatttaaaatgaaatttaaatatgtcagctctttatttttccccttagcaaatggagctattacgcatctgacacagaatgtaataaatataaactatccaaaactaataaaatagcatttgaaaatgtccttgcaatattggtcatgataaaggtaaaataatatgccaagttcctgacaatcctagtagtgcataaagtacttccattttggacaatgctaactttcttatgattgaattagatccatgacttaatatacatcatttgtaagattttttttttttttttttacaaaaagcagacttctttcataataaatttcaaaatgaaaaccaatgtttttttacagaggaaaaatgcctaaaagtccaaatactgatcttacaaagagacatgaaaggtaaaatcaagtatgaaccaggcctggattcccacatcttcagtttctatttatcaaacagaaaaatctttccaactttctcctttcctgtataagaccaaaactatgcaatattctgtttgtattacaattacactaattcaatgcaggtcacttgctttttactgagtccagatgacattcagtaaactaaacatgggccaattagtttaaaaaaaagaggaagaaaagaaaaaaggaagaaacgagtgagttctgattgcctttgggtaggtcatacagtggctacagagcatcacagcctgaacttcattttggctaacaccaaccatacggctaacattaaggactagcattttttattcctttcagatttctcacatttggaaattccaatttaaataattttctggtgaaagtgaggacagcactcctgcataatatcagttttcccctaattcaactccaatgtcttattttggagctactaaaatggaatctgcacaatgtctaaaaaagtataataatcctttttaaccaatttttttatgtattacagttttaaatgagcaaatgaaactgataatttagctgacacaaacccacacaaaaaaagatggtctaaagctatgaagtttcaacatcaatgtttgtaatctcaaatcaacctgaaccaccatacaattaggtatatgacaaactaagtaatagaaatattcataactaaaagcaatattatttttaaatatcttattaggtgttggcacccaacattttcttataatctatcatgtaaagaaatctgttttactattccttttaaactctctactcatgctactttaggtgtgtttctagaaataaatactaaactctctgctaattttttttggctaagaaattttttgaaagttataatgtaactaagttaaaatgtacatataatcataatttgatatcaagactgctttcatacaaaaaacctacattaattaattccttaagtaaatttacactttatcaattgttggtattttaaaaagtactcaaaagaaactcttcattcaccattattacaaaaatggaagtctccaaatatgtaaactagcttgatttttaaatttgttacttatttagcctaatttttttaaacttgcctaaatttaactgaagaatattatgttcctgcaagtgttcatgaatacaaagatacagtaatgaagatggaaattatttactctaacaattctgactgcatgactgttaaatcacttacatacggccaaatgatctacaaggaagcagggaggtcctgaaattgtgtactcatatccattttcaactactgcacaggtgacacaaccaatcaaggcattactgaaacagaatgggaatagaaaggacttagtgaataaaagtgacttctttagacaaaaatgtagaggttagcttgtgaccaaggtggaagaaacagcagcaccattcctcccattgcttgttcatattaagagaaaactgagaccactaagaggcaaaggacagaggacagcaacaccagcaaagagacaggcagcagtggggtcagagcatgagaacagtattaagagttaaacatagagcacagagggggtggtttaaaatgtcagttttactcaattatttataggacagttcttggaaataatgttacaatgaaatgttggttatataaaaatcttatttaatgtagtaattactatttagacaagggcaaatatagtaaatattaagtaaaaattaacaataattaaaatgggcttatggtctgaaatagacatattatgggaaaggattactgttctaacaactacgcataaagctgtgaaaaggcaatagttatactagtctgtagaaacagtactctaaaagttacaataaggagatacacttttttttttttttttttgagcaaggtcttattctgtcacccacactggaacacagtggcatgatcacagctcactgcagtctcaacctcctgggctcaaccgatcctctcacctcaggttcctgagtagctgggactacaggcgcatgccaccacacccagctaattgtttttgtatgttttgtagagacagggttttgtcatgttgcccaggctggtatgaaattcctgggctcaagcaatccacccacctcagcctcccaaagtgctgggattataggcatgaggcaccatgcctggtccaatatggatattaatcctcctgaaatagatgggattttaaaatgcaatactcagtttcaatgttgaaatgtgctcttctttcactgaaaatgacatgacactgtgaaagctttcttctaacacaggaatttttagaccttcacacaagttttcataatgtttaatactttcaataagcttcatgactattaatgctttggggaaaacttactttttgtttctttatttgcttttcaaaaccaaaggcatatagtaataattcattatgcttttacaatcaggtttcatctgatgtcaatgttacctttcatatctttttaagtgtttttccatgttaacgtgaaggtgtgtttcttaacttcacatagcaagaaacaaagacacgcctttgttcaatttaaatattttggttcctggccaggcgcggtggctcacgcctgtaatcccagcactttggaaggcttaggcagatggatcacctgaggtcaggagttcaagactagcctggccaacatggtgaaaccccatctttactaaaaatacaaaaattagttgggagtggtggtgtatgcctgcaatcccagctgcttgagaggctgttatttgttatatgttattccatattccctattctattctattctattctactcattcagagacaggatctcaccccatcacccaggctggagtgcagtggcgcgatcacggctcactgcagtcttgacctcctggactcaagtgattctcccacctcagtctcccaagtagctgggactacaggcacaagccactatgccaggctaatttttgtactgtagacacggggtttcaccatgttgtccaggctggtctagaactcctgagctcaagtgatctgcctgccttggcctcccaaagtgctgggaatacaggcttgagcaactgtgcctgacctccatattcattttattcaaaagaattttatacacaaaattgtggcaaaacttcaaggaagaatatattcttttgtagttctgtaatctagtggaaaaatgtgatataaaaaaacataaaagttaatgatatactagtgaagggttcctaatattcaattaactttgattttattctcaatctattttatactaccattcttcttatgaaaatatcttcaacactttcattgtaccaataaacaacaatacaataattaacaatttgcatttattattaaagtattaaatttaaaactccaaagcacctacttgaaaggaacattccaatataatttaattattcttggtcatttgctcatgtttccttaaatataaatacagtatacctaacaaataataagcataattataaatattatcacattttacaattttttattctaataaagaaaacatatgctcaaataatggaatttaactataaaatctaatttttagctcattgaaaaaacataaaaaaggatgatcaaactatttaccagtcttaaatatttaagagtataatatgtttatactactatatttatatgttataaatacagactatatattaacacatttataactatagtaatatgtatttatatagtataaaaatatactactatatataatactggctttttaaatacatttcctaatttcctttatttactactttaactttgtagtttataatttacaaatttcccagcactatatcttccccacaagaagatttccctttctagtggctactaacatacaatgtttaaggattaattaatgatagattggttaatgaatctgcaaaatatttagctcttttatttccatttttctctcctgctaattgacttttgaccatgttagtgtttattaagctcaagatccaaattagctaaattcttgccctcccaaacaggaggcagtctaaagcaaaggtgttggttgactgcaagttctggtggaatttacctattaatcagttctacaccattttgtcaaatctgaaccaatatagtgccaaaagaacattcttaaatattaagacttttatctttggcatacaggattcattcatccaacaaatacatactgagtaactactatgggccaagcactgttctagtgcttaacatatattagtgaacaaaagaaataagaaattcctgccctcatgttgccaatttaccaaccctgtgctgtgctccacactaaaaatacaaaattgaagatactaccccttacttaaagaagatttaatctaatcaaaggcaagaaaaatgtcctcaatgcaacttatcatataatgctaaaatatgcatatgtaaatggtagcagaagcatatataaagtgccatgaagagtagaggggaagaagcctctgtgcagatgttactgagtacaacatcacaaggagtataattctctctgcctataacaatcaaacacaggcattccaacctgagaacagatatgcccaatacagctttatatctaactctatgttgtctttcttagaggtaaatcaaggtgctgctttacagaccttcataattaatgtccccttagcatcttcaagagttaatggaaaaggagggaaaattctaatcactacatgttgacactttttagtagccaagaaaagttctcaaagaatgacaatttaaaaaattaacttgtatacactttctaggttaaccgtgggcctcaataatccctaccattccaatacacaaatgtcacaagttctcattcatatgtgagagctcaaaccagtggatctcatgacatatggagtacacttgccatcaccagaggccaggaaggggagcggggagggaggagtgaaatggagggaaaagggaaataaatgtatttattggcactgagctgtacacttaacaatggtaaagatggttaatttttaaaatattttcaataataatattaataattatccttaccatccttatctcttattcacatgaagacattagttaccatttattaagtgcctccagcaggagaggcactgtgtacaccctttatataacattatttctaaggcttaaacctttagaagattagtatttttattacccagtttttcacatgtgaagactgagagtgggagagattgtataatttgcccaaggttgtacaccatttggcctggaatgtaaaagaaatccatacgaacacaaagtcaaggatcttttcactctacctgatagctgcccactcccataaagaatctaatattgagggatattaattcctcttctatgattatttttaaccatcctatatgtagataaatatgtaaactgatctaaaacagtttacatccttgttgaaaacaggatcacatatgattacctagcctgctaacccagacaggcagatggatggacaggcagatggaagaatgaacaaaatctcaagtataatgacatccaaactgtttaaatctactgcacagtgttcttataaatcttcaatggcaagtccatttgactgacactatttctaaaagaacaattaggctaggcacagtggcccatgtctgtaatctcagcattttgggagggcaaggcagaaagatcacttgagcccaggagtttgggaccagcttgagcaacatagtgagaccctcacctctacaaaaatatttaaaaattagctgggtgtggtggcacacacacctgtcgtctcagctactccagaggctgaggtggaaggatcacttgagcctgggagatcaaggctgcagtgagacatgattgctctccactgccctccagcctgggcgacagagagctcaaaaaataaaatacaataaatgaaagcacaattaaacaaaaaataaacttaccttgagatctttgtaacacctttattatccctattattacctcatcttctattaatgtccttctggctcactccagccacactggcctctggttaagaatcaaagagccaagcatgttcccatctcacacagactttgtactgtctgttccctccaatcaaggcagtcttaccccagatggctcactcccttgtgtgcttcagtctttagcttagatatctccttcttaacaaggcatccttgactaccatttaaaagtacaatcagaccttcatactccctaatcaccatccaatgatatattttatgtatgtgttatatttattatgtctaacccaaccagaatataaacacaatgaaggcaggaatttttgttttactcaaggctatatatcctgcccatagaaaagtggctgatgcacaacaaatatttgttgaatgaataaatgaactttgtgaccaggcacagtggctcatgtgtataatctcagcactctgggaggccaaaggaaggatagcttgtgcctagaagtttgagaccagcctgggcaacatactgagacttcacctctacaaaaaacttaaaaattagctgggtgtgatggcatgcacctgtagtcccagctactcaggtcaatgtgggctgaagtgggaaaatctcctgagctcagatatttgaggctgtagttactatgatcacaccactgcactccagcataggcaacagacaaagaccccaactcaacaataataataacaaccacaataataataatactaaatgaacttcattatttggaacctaaagaggaattgtataagttcaatttcatcactgataaataattcaattaaagacttcttttaaagccaagttttatattatttagcactactgaacttccccttcttataaaatgtttgcctccttactctggccaaaaatcttcttttcattgctctttagaagtttaacatgatgaaaatcagtgtttgactttaaaagtcaaagtatgaatgaaaccgaacttgtatagacacatcttttagctctcatttcaataaactgttattaaatccataatcttttgagagagcaactcacagattaaaaattaaaattaatattttatctgatgctttacggcatccattgtattgaatgcatttgtttaatatttctaagtctttagaaaagcttctgagaaaattgatttccttatgttgtttacagtctgtgaccaaatatttttaggacattcacatgaataaagggtcccaaatgcaacagaaattataatcacatcataacttaagctttaaattattcatgtcttttatgtttaacaaaaaaactattatccaaaactatttattatattaaaatatttttactcaacaatctttttctcctaaggtcaatgaaggcatatgactcctccccaattatataactttttattattttaattaaattaactgataccagcatgttttaatatcatccctacacatttagaagaagtaaataacctagagatcaaaatacacagtaaacccatacaaacagcagtttttcattgccatctctctatatataaacattgaatgcaattctatgaaagtatggctccacgtattcagatgaggaatatgtctgtttacatgtgtctctttcccggtccacattacagggggacctgtgtgtgcctccgtggttaagatttactgcatgttcacattaaagtctcatttccaacatttaaacatgcagccacaaagaccaattagaacagttattagtacaacccttggtgtaccaaagatttgggagttcataaagttgaaattgattgtttatggacaattacaggtaccaaaatgatttaaaacatttcaatttttgctctgctgaacgagactcatttaaacagcagaactagaagcagagacttaaatatcaacttgtaatcaaaaatcaccagtaatgtcttagcagcgtgttcatcctcctactcagtagagtccttaaacatacagggactccaatattagcttcaaaacattttcagaatgtctagcaaaaatatgtcaaacctggatctctgacttaaaggaacacacaaggcctaagaaataattgctgtctcaaatactgtggagttaataaggttttaaagtatataaagttgctataggctaaacggcacattttatattagacaccctttcttgctaaacactgtattatatattaaactgtagcaaaagtgaatgaatctatgaggaaaatcaaaatgaaattttcaagtactcacataatgacatacctctaaactgtgaggtactttatgacagagtgtgtgattcattcatcttttaattcctagtgcttgaatacaaagttgatattcagtaaacactgattgaatagaaaaatgagtaaatacaacttgaagaataactatgtaatgagatttctgattttacaaaacactttcactacttttctaattatatatatatacatatatagatatagatacagatatagatagatatagatacagatatagatatcgagtagagacagggttttgccatgttgctggtctagaattcctgagctcaagcaatccacccacctcgaactcccaaagtgttgggattacaggcgtgagctatcatgcccagtcgtgcttcaccacttttcaatgtcaacttcaagaaaatgaaaattgcacctttctgaacaaactttaagtctaccctaaactgctaagaatcaacactaagagcagatgacataatgtgtgggaaaataaaaagtcagccagccagctggacatcagtctcttctctgactgctatgactaaactcttcaaggttataacttttcaaatgctaccactgtaatgaactatttcattgctagtgttacctcctttccttggtcttcccctttctagacaagaattcctgttattatctcattcccttcttgactgcactttacacactggtttcaatttgtacttgacctagttcccagaaaacacccagttttccttttctcacttagtatcttaatatttgtaatattaataacccacttatctattcaattgtttaattgtattttatctattatctattcaattgtttatttctatttaattgtagtaactctattcagagctagcctatgcaaaagagaagacagcagtcttcagatgtgacttacttagtacagaaagatcccaaccctaatatatacaaacacatacacatgcaaacacacacacctgctataaaccaaaattagagatacatttctttgtgttaaactcctgcttcttgaggttcttattctccctctgtccctctcaattgttctgtcactctttacctcctgcttttttctgttttacagtaattctctccagctaacttcactcttctttcttctacatacaacatccaatgtgtccaaaaaaattctgtgggtttttgtttcaaaatatatccaaaacctgattaggtcttaccacctccactgttaccaacctaacacatgccacgatcatctctcacttggattactgcagaggcctcccaactggcctctttccttctatctttgcccaccccgcccccacaatctgttctcaacaaaacctaagtaatcctttaaaaatgtaaatcagatcttatcactctgctgctcaaggcctgccaggggtctgtctacaaggcactactgatctcacctacctccatcacctcccttacttcctgtctttctctgacattatctcctacttctttgtccctagatcactctgctcccttctgcctctccaaacacaaaagggctttccattgaccattccatctgcccaaaatgatctccccaggtatatgtgtggtttactcccacaatacctgcaagcctctactcaaatatcaccttcccaaggaggctctgaacaccatatttaaaatcacaaatttgtccaccaaaactccctgtatccttcttagtgtacactctagttttctttaatcatttccaaaacacttatggctttctcatattctatataaattacttattatatattgttttatatctattgcctccttctaggatgtaatctctgatatatcccaaatgcctagaaaggtatctggcagagtagacaccgaataaaaatttgaatacatgaaaatatactagactatcttaaaatacaataaatatatagtatgttctttttgtttgttttttgagacagggtctcattctgttactcaggctggactgcagtggcacgatctcggctcactgcaacctcagcctctcagggtccacaggcaggtgccaccacgcccagataatttctgtatttctttgtagagacacagtatgccatgtttccaaggctggtgttgaattccttgatacaagcaatcctcccacctaggcctcctgagtagctgggattgtaggcatgagccattgcacccagccttgatgtcattatctaatgtctcctccttaataaattgttaataacccttaataaattgtggctaacataccttttacaatacaactctagaccattaatgtgtcccataaatcctgtgtgcatcaggaggtatcttttttgcctcaatgccttttattaatgcactgtcagtattctacttgggctttattcaaatacaagcctataaaactactgaatctttttccatccctcctactttcccattcttgatttttcccctacctttctctacaactccaggtgaccagcaatgacaacctaatatgtatcactccataccttcttctccatccttaaataaccacgtacaaacatatgtagagatttaaaattctattttgtttctttgggaatgaagttgtccccatatatgctccttcacatcttatttttctcatctcatagcaaacagtggaatataactacattaattggtatacacagaactccattctttttaatggccgcatgttacaaggccaaaatgtatcaaatgtattcaacttttcccaccttgtttccagttttttaccactaataaaaatactgcaaaaagatccttgctttgaaaaatgcatatatccttacatatttatgcttttatttttatgagataaattctaggggtaaaactgccaaaactgctttccaagaaaagaagtaaatgtcacatttctaccacaaatgccttttgctctaatttgccaccaatattgagtggagccataacatttttaattttggatatatgatgatatctcagccaggcacagtggctcaagcctgtaatccctgtacttcgggaagccaaggcagatgaatcacttgagatcaggagttcaagccagtctggccaatatggtgaaaccccatctctactaaaaatacaaaaataagccggctgtggtggcacccacctgtagtcccagctactcgggaggctgaggcaggagaatcacttgaacctggaggcggaagttgcagtgagccaagattgtgccacagcactccagcctgggtgacagagcaagactccgtctcaaaaaaaaaaaaaaaattagcccgggcatggtggcgggcacctgtaatcccagctacttgggaggctgaggaaggaaaatcacttgaagccaggaggcagatgttgcagtgagccaagattgtgcactgcactccagcctgggcaacaagagcaagactctgtctcaaaaaaaaaaaaaaaaactcaatgttactttaatctgcatatcctaaagtactattaatcatcttcctatgtgtcattagtctattgggatttgcatttctgtcaactattcatctctctccctgttttttatactggattgtcttttgacactaatttgtagttttttttaatatcgtagatatcaaccatttatctgtaatttgaagtataaatatttttcccaacctaccgcttatctattgagtttgctgccaatgagatcccacatataagttacaaaaaaaatcattatatgattagatttatttttctttcatagctcctgcatttcctatgttggttagaaacttctcccaagtttctaattcatgcatatagtccagaattcatattcttccatgtaagtctctagtatacttagaatttatttaggtattgtaagagaccaaagattcaattttctttcagatgaacagataattccaaatgcatgattatcattttcccattgagctcaaattttcacatttatcatattaaattcccaacagactattgtaattacagtagctttagaatttattttaatatctggtaaagctattcatttctcacttttttctccataattttcttagtcaacaagtatgaacattatgttacccaattccaatgtaaaccataaaggaattttaactagaactgcaattaacttttaaacaatttttggtaaaagattattatgatatagtttttgcatggcaacacaatattataagaattgggaacatatttttaaagccagcatgctctttccttcatttcaattccagtgtaatgtctttcaattagatttttacgaatttcttcctacagaagtgtacttcttttgttaactttattcctaaggattttctagtttttgaaactacttttaattgattactttttccaatttttctttaataacattattatcagcactgagaaaggctaccaatttctgtgtattttatatacaactattcaccaaattatgttattaagtctgataatattttactggtaccttttggatatcataagcatacaatcatatcagcaaaataaaatgtatttttcctcttcttttctaatgttcatacagattatttcattttttacctcattcaacatgctagaacaaaactaaataacgataatgataataatgataatagaggacatacttgttattagaaataacattagcattccactgtttaaaatgtttacttttgaagaatggcccggagggcagccaagatgaccgaataggaacaactctggtctacagctctcagcgtgagcgacacagaagatgggtgatttctacatttccatctgaggtaccgggttcacctcactagggagtgccagacagtgggcgcaggacagggggtgcagcgcaccatgcgcgagccaaagcagggagaggtattgcctcactcgggaagcgcaaggggtcagggagtccctttcctagtcaaagaaaggggtgacagagggcacctggaaaagcgggtcactcccaccctaatactgtgcttttccgacgggcttaaaaaacagcgcaccaggagattatatcccgcccatggctcggagggtcctacgcccacggagtctcgctgattgctaggacagcagtctgagatcaaactgcaaggtggcagcgaggctgggggaggggcgcctgccattgcccaggcttgcttaggtaaacaaagcagccaggaagctccaactgggtagcacccaccacagctcaaggaggcctgcctgcctctgtaggctgcacctctggaggaagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctggccctggagccgcctaactgggaggcacccccaagtaggggcagactgacacctcacacggccgggtactcctctgagacaaaacttccagaggaacgatcagacagcagcattcgcggtcacgaaaatctgctgttctgcagccaccgctgctggtacccaggcaaaccgagtctggagtggacctctagcaaactccaacacacctgcagctgagggtcctgtctgtaggaaggaaaactaacaaacagaaaggacatccacaccaaaaacccatctctacatcaccatcatcaaagaccaaaagtagataaaaccacaaagatgggggaaaacagagcagaaaaactggaaactctaaaaagcagagtgcctatcctcctccaaaggaatgcagctcctcaccagcaacggaacaaagctggacggagaatgactttgacgagttgagagaagaaggcttcagacgatcaaactactctgagctacaggaggaaattcaaaccaaaggcaaagaagttgaaaactttcaaaaaaatttagacgaatgtataactagaataaccaatatagagaagtgcttaaaggagctgatggagctgaaagccaaggctcgagaactacgtgaagaatgcagaagcctcaggagctgatgtgatcaactggaagaaagggtatcagtgatggaagatgaaatgaagcgagaagggaagtttagagaaaaaagaatgaaaagaaatgaacaaagcctccaagaaatatgggactatgtgaaaagaccagatctacgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaagttacccacaaagggaagcccctcagaccaacagcggatctctcggcaaaactctacaagccagaagacagtgggggccaatattcaagattattaaagaaaagaattttcaaaccagaatttcatatccagccaaactaagcttcataagtgaaggagaaataaaatcctttacagaaaagcaaatgctgagagattttgtcaccaccaggcctgccctaaaagagctcctgaaggaagcactaaacatggaaaggaacaaccggtaccagccactacaaaatcatgccgaattgtaaagaccaccaatgctaggaagaaactgcatcaactaacgagcaaaataaccagctaacatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagattaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacactccactgtcaacattagacagatcaaccagacagaaagttaataagcatacccaggaactgaactcagctctgcaccaagcggaactaatagacatctacagaactctccaccccaaatcaacagaatatacatttctttcagcaccacaccacacctattccaaaactgaccacatagctggaagtaaagctctcctcagcaaatgtaaaagaacacaaattataacaaactgtctctcagaccacagtgcaatcaaactagaactcaggattaagacactcactcaaaaccgctcaactacatggaaactgaacaacctgctcctgaatgactactgggtacataacgaaatgaaggcagaaataaagacgtgctttgaaaccaatgagaacaaagacacaacataccagattctttgggacacattcaaagcagtgtgtagagggaaatttatagcactaaatacccaaaagagaaagcaggaaagatccaaaattgacaccctaatatcacaattaaaagaactagaaaagcaagagcaaacacattcaaaagctagcagaagggaagaaataactaaaatcagagcagaactgaaggaaatagagacacaaaaaacccttcaaaaaattaatgaattcaggagctggttttttgaaaggatcaacaaaattgatagaccactagcaagactaataaagaagaaaagagagaagaatcaaatagaagcaataaaaaatgataaaggggatatcacgaccgatcccacagaaatacaaactaccatcagagaatactataaacacctctgtgcaaataaactagaaaatctagaagaaatggataaattcctcgacacatacaccctcccaagactaaaccaggaagaagttgaatctctgaatagaacaataacaggctctgaaattgaggcaataattaatagcttaccaaccaaaaaaactccaggaccagaaggattcacagcctaattctaccagaggtacaaggaggaactggtaccattccttctgaaactattccaatcaatagaaaaagagggaatcctccctaactcattttatgaggccagcatcatcctgataccaaagcctgacagagacacaaccaaaaaagagaattttagaccaatatccttgatgaacattgatgcaaaaatcctcaataaaatactgacaaaccgcatccagcagcacatcaaaaagcttatccaccatgatcaagttggattcatccctgggatgcaaggctggttcgatatacagaaatcaataaatgtaatccagcacagaaacagaaccaaagacaaaaaccacatgattatctcaatagatgcagaaaaggcctttgacaaaattcaacaatccttcatgctaaaaactctcaataagttaggtattgatgggacgtatgtcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatcaagggtattcaattaggaaaagaggaaggcaaattgtccctgtttgcagatgacatgattggatatctagaaaaccccattgtgttagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaaattaaaagggacgtgaaggacctcttcaaggagaactacaaaccactgctcaatgaaataaaagaggatacaaacaaatgcaagaacattccatgctcatgggtaggaagaatcaatatcgtgaaaatggccatactgcccaaggtagtttatagattcaatgccatccccatcaagctaccagtgactttcttcacagaattggaaaaaagtactttaaagttcatatggaaaaaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggatcccctatttaataaacggtgctgggaaaactggctagcgacatgtagaaagctgaaactggatcccttccttacaccttatacaaaaattaattcaagatggattaaagacttacatgttagacctaaaaccagaaaaaccctagaagaaaacctaggcattaccattcaggacataggcatgggcaaggacttcatgtctaaaatgccaaaagcaatggcaacgaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagacaccatctcacaccagttagaatggcgatcattaaaaagtcaggaaacaacaggtgctggagaggatgtggagaaataggaacacttttgcactgttggtgggaatgtaaatgagttcaaccattgtggaagtcagtgtggcgattcctcagggatctagaactagaaataccattgacccagctatcccattactgggtatatacccaaaggactataaatcatgttgctataaagacacatgcacacgtatgtttattgtggcactattcacaatagcaaagacttggaaccaacctaaatgtccaacaatgatagactggattaagaaaatgtggcacatatacaccatggaatgatatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtgggaggtggggggagggatagcattaggagatatacctaatgctaaatgacgagttaatgggtgcagcacaccagcatggcacgtgtatacatatgtaactaacctgcacattgtgcacatgtaccctaaaacttaaagtataataaaaaaaaaagtttccttttttatatactttatatttatgtactcaagaaaggctgttgaattttattcaattttttcagcatccattatcatcatctaattttccttcttcaatttgatacaccctacttgatattctttaatttatgcagaattattttcagttaaaggctattaattagtgcgtcctttttatttcaaaaattcttatttagtatgcttccagtcactctatcattatccattgggatttggtaatatatatagaaagatttattgtttataactgtttcttcttcataatctttcaaggcctcaattctgattcatttgctgtttggttatagttagttcaagtattttcctcaaatgaagcaaatgagagttatattctgtcaatctctgaatatctaaacatatctttactctgaaaggtggatgaaatactggttgagtcactcattcatttattatttaataagaattactctacgtaatacagatggatacaaaatgacaaaaaactccctgcctttaaagaatacatatattccagcagacaaagacagacaataagcacataaatgaatcaattaattaaatataaaatggttagaagagctaagaaaaaataaggcaaggaaaggaaaatcttctataatatatacataacagtcaagaccgacctctgattttgacaataatggccattcacccatatatagtgctttctaagtgccaggtactgtggtaagtactggacacacatcaaatcattcaatcacaaacaacccttcgagatagttactatgaaaataaaaatgctataactggtgaaactgaggcacaaacaagttgatttaccaaaggtaaaacagcaaataagtagtagaaccaagctgtccagctcttaaccattatgttttcttgcttctctgataatatgccatttcagtagataatgaaaggaaatgagggcaggagagagacccatagggttatatggaagaatagaattcctagcgaaaagaaaagccaccacaaatcttataaacgccatgaaaaatagatataaatacattaaaatatttgtattataatcttagactcaaccttaaaatatgtggctgaaacaattcctcacatgtatagagaaatgtttaggttatattaccttatcactcaagaattgatcagataaagtactcaggattaaaatgcaaaaaagcaaaaaaaagagtattaagagtatcttaatgtgatttcttaaaatttatttctaaaactaaatgctagaattatataaagtgaagaaacacagacacattctcaataaaaatggaaataaaactagaataacagtctacctaccacccctatgtaccaatactgtaatggatcctttacacacaatttctcatttagtccttacaataagcctgtgattccaataaatctattgtgtccatttaatatataaagaaagtaaaatttaggagaatcagtatattgccctaaagtcacataataggaaaagtgggaagaaataaaatacaaatttgtaaaacatcactgtataccttaaacatataaaatctttatatgtcagtatatctcaataaagctgctgaacatatgaatttgtatgatggcatgagcacagactattagatccaagaaaatcaattgtctatggtaaataagttcagcaaaattataggatatatggtaaatccaaaaaagtaattccctattgaagctggactgtgcggtagagaaaaaaaatgagctttggagcaaaatatgcttgattcaggtcaggcagagaaggctatggagttaactgaagagggagtgctgctgagattagtacctgcagggtcatgcttgcaataaccctagtggatgcaccagtgacaaagttgctcagcaacaacagcaaactaaagcaaacatatctgttcctagttctgagagatcaaaaggcaaccaacccaaactatgtaagaagttaagaaccttactccctttcagccctcattctcttctcttctcaatactactacttttacctcctgttaactacctcatttttctttctttccttgctctttgactctttcttgctgacgcttcccttctaggtctcttttttcctttcaatcaccccctattgaactgctttcttccctctcaccaccagtttggtttcaagaggattcttaaataacttcattacctccaaatacattttgatctcaaaggtcatagctcttcttccaatattagtaatttaagaattactaatgagacaaatccacaggttaacatgaaacaattccacatgtcacagagttaaaaaatgggtcaaacacactgacctgtttatgttaaaatattatatggctttagaaaaaaattatgccctaaatacaacatgcgctgcattaacaactgcattaacaacattttagtcctttagatatgcaaatacttattgtgttacaattgcctacagtattcagtacagtaacatgctgtaaaggtttgtaatctaggagcaataggctataccatataccctaggtgtacagacagctatattatctaggtttgtataagttcactctatgatattcttcacagatttctcagaatgtatttccatcattaagcaatgcatgactgtattaaaaattctttcatacaatttttcattatttttgcaaaattcaaggagtaatatatcacttatttaacaaatgttaacaggatatttcagaagattggtgtcaaaaagaaactcagttattgctttaatgtctctcagcaccaaatttcttttccatttggacttaataacaccttacatatacaaatgattcacaaaagacaagtcctctacagtttactatcatgagactcagaaaccagtatcacacaatgcttttaattcttatcatattactaaaattttatcagaaacagatgtcagcaatacaattttgatggaattacttaactttttttttttttactttcataacaaattaagcattgctcagttgaaaagttataatgtcacaagccttgaggcagcattaggtgctataatttgaaccgatgcagtgtagagtttgcatgctagtagaaaagaatttattagctacattgttgataattatttaactagcaaactccaagttttcttaaaaacacttccaatcaattaaatatctaagaaaactaataaaataactcaaagttttctagatgtataattaacatagcaatacataagttagcaatatagctgcaaaacaggtggaaaatataaccattaaaatgacttccatcctttcggtaggaagtagcttaaaaaaacaaataaaaataaaaacaaaaacaaaaaataaaatgacttccaaagaacaaaccaggcaaatggtttatgtccctaaataagctgaagcctagagataaagaaatttagtgggtaaaaaggaaagataatctatactaaaaacaaaaccaaaaaatgaacgaagacgatgaatggataaacaaaacgtggtataaacatataattgaatattatttagccttaaaaaggaagaaaatcacatgctaaatacagatgaagcttaaggacattatgctaagtgaaataagcccattgcaaaaagaaaaatactctatgattacacttacaggaagtatctaaagtagttaaattatcatagagacagaaagtagaatggtagttaccaagggctggagggaggaagcaatggggagtggttacttaatgggtaagagttgcagttgtgctagatgaaaaaatcctgcagatctgctgtacaacaatctgaatacatttaacgctactgaactgtgcactgaaaaacagttaagatggtaaatttttttaaccacaattaaaaataagagctttttaaaagaatgtaaagtaaaaatggaagatctgtgcacaatttttcttacgggcaaagaaatggtacatcttacaggtaaaacatgtatgttatgtgttacaactttagggaagccaaaggttttaatatctgatgccccatgaatgtgatatagcagctctctccatatcaattctgacaaacactatcaactttatttcttaaaactgtcccttagccatattcattcacccctctcccaccaatgttgtaggattccaagccaagactttctgctttgaagccctttaccaatgcaatcagtacccaacatacaactttccatccagtatttgtcagtcaagatatcacattaggttttcccttccctcttctcttcactttcccatcatcactgtagaagcctctgctacctgggacttcctctccctcctcaaaaatgaagaagaaattaagacattcccagataaacaaaaactgagagaattcactgctagcagacctgccctgcaaaaaacaaaaaggaagttcttcaggtagaaatgaaaggacactagatactaacttaaatccacacaatgaaatcaagagtacagcaaaggtaactacagaggtaaatgtaaaagacagtataaatgtatttttttcttttctttgtaactctttagagcactcctaccataagtataaattacaatttttaaaatgtcacgctacaattcaataggtaaatactgaacctgttttaagaagtacgttttatatttcacttctagaatagagataactaaaggaaatacagcctctttgaaaataaggaaatgcttcaaaacaaatctgtggtagatgaactatccctcacatgtcataggcatatagtactcttataacttgattatttagctcaatgaagttttaaaatactaaccacatcttattttacctcttttatatctctgggacctgtccctttttctctatcaccgcagctaataccttaatccagggtatcatcatttctcccctggattattggcagcctcctaatgggtattcctaatattagtcctgctccactttaatctgtttcctatactgatgccattagtgacataacaacaacaacaaaaatcagatcccaccattctgctcaaaattttcaagtggcctcccataatcttcggggaggaaaaatttaaattcccaaataatatacaggtcaggacatgaccactacctctgtctccagtattagaatcaccacatacataaataatctacacccacattctctgctacagcccttaagagttatttaggatcccagaataccacacatctacttttatacatgcttaccttctctgattagaaaaaccttactttgtctacccccatctctacttctttagtcttcaggactcagtgcctatacctaccacccaccctaactcccaataatgctgagttatatcatctcatagattctagtcacaattaccacagtacttaccaaaatgtactataaacacctgcttgctatgtatttatcccacagactgtaagcttcttaagcataaagattgtttccttactcctattttttgtccctagtatacgcaaaaaatgtctgccatggagtaagtgtttaatcaatgtttgaaaaaaatgaatgaaaggatgaagcaggttgtacattgagagacccatggagaagctgttcaatttttactatctataacaaagacaaacatcaaaattaataatctgataaaactgaaataccaaaattaatctttactttgtaatcagtaaaaataagtaaatcgatatactaatgtaattcttaatttttgtagttcattcttcaaaatattttattcaagcaagtgggatccagcaaaaaaatggagaccctccccaaaacttttacaaccagaaaatgagcttctttcaaattctgatgtggaattcccaagtaatcttgcagcaaattaaacaatatgatctatgatccatatgtaggccttgactattaaacttattttgtcttattaacagtattggagggatttttttaacaccatggattaaaaagtgaaaatgagttttttaaaagtaaagcttaaataacactctatctactgttttgcaaatgtgttatgaaggctttgaaaccacaaaatttccaacagacctaaaaatgtataatgtgctatatgtcaagctgtatttctttttttttttttaaactttaagttttagggtacatgtgcacaacgtgcaggtttgttacatatgtatacatgtgccacattgttgtgctgcacccattaactcgtcatttaacattaggtatatctcctaatgctatccctcacccctcccccaaccccacaacaggccccggtgtgtgatgttccccttcctgttaattcaagatggattaaagacttaaatgttagacctaaaaccataaaaaccctagaagaaaacctaggcaataccattcaggacataggcatgggcaaggacttcacgtctaaaacaccaaaagcaatggcaacaaaagccaaaattgataaatgggatctaattaaattaaagagcttctgcacagcaaaagaaactaccaccagagtgaagaggcaacctacagaacgggaaaaatttttgcaatctactcatctgacaaagggctaatatccagaatctacaatgaactcaaattcacaagaaaaaaacaaccccaacaaaaagtgggtgaaggatatgaacagacacttctcaaaagaagacatctatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacagtgttggtgggactgaaaactaattcaaccactgtggaagtcagtgtggtgattcctcagggatctagaactagaaataccatttgacccagccatcccattgctgggtatatacccaaaagattataaatcatgctgctataaagacacatgcacacgtatgtttactgcagcactattcacaatagcaaagacttggaaccaacccaaatgtctaaaaatgatagagtggattaagaaaatgtggcacatatacaccatggaatactatgcagccataaaaaatgatgagttcatgtcctttgtagggacatggatgaagctggaaaccatcattctcagcaaactattgcaagaagaaaaaagcaaccaccacattttctcactcataggtgggaactgaacaatgagaacacaagttgtatttctaaggtaggagaaaggttacatagtctttaatactttctcctttacaacaaacttttccttatatataaaatacagcaaaaatagtaccttttgttcaaaggattgttgagaagactagaattcacgtaccacacttttgcctcatgcacaataaaaactttttacatgtttaggtgttattattactataattattatgacatatccaagtcccaaaaagttatcagcagtatactctgcaaaggaaaagaaaacacaccactcagataagtctatattcattaatgaatatatctacataccaaacctgcccccatttctttctactgattcccatctaattgaagaaagattttagtagtattctgctgtggattgactcttaaatcacttcactaataaagtcctatgaaaatttaaccaccaccaaaaaaaaggggatcagcacttaatcgcaatcctggattgcaatatgagtgatcagatgctaccccggtctgggtcttcatttcttcatctgtccaatggcaatcacagttcctatcggatctcatagggttaactatctgtgagaatttaaagattataatttatgtagaattgtttgctaagcttgaaaatacttcataaatacagactaataatactattgctgtacaatgccaaataataaatattctacgttttaagcagattgtctttgcttccttcagaaccaggtcttgactctttagcccaacttcgtttggtttggatatataaaacgacatcttataaggtgttcccttcaagggtactttatattactatgcataagaaatgctttccatattaactgaaaaggagatgaactaataagttcaccgaaagcataaatgactaagaggagagagaatgatctctggctttgagaattctcttagaagtactgcctataatcccagctacttgggaggctgaggcaggagaattgcttgaacccgggaggcggaggttgcagtgagccaagatcacaccattgcactccagcctgggcaacaagagcaaaactccgtctcaattaaaaaaaaaaaaagtatctaggtatagtaagtagtttaactaaaaacagtcttagaaacatggatcccaattcctaccctaaattccactaggacacaacattcttataattgtatgtactgttctttcttgccaaggtactcagcactaagaaggcaaattcccagaaagaatgaaaagtgtaagaatgtatgtgcactaactttaacttcctactgtgtgtcaaacactatctttacctactttctcatttaactctcaaaacaaacttgaaaggtattacatcttttttacagatgattacgttacgtaattcacagagatcgtattagagagaacaaaatgctgaaactaaaggtctgactacaaaggcagttctttctatttcaccacactattgatcctatgaagcagaagtcaaaattttaaaatgtcatcagagggttgtatccccattgaagtagctggttacataaaccaccaaggtttctttttgtttgtttgttttttgagatggggtcttgccctgctgcctaggctggagtgcagtggcacaatcatgactcactgtagcctcagtcttcccaggctcaagcaatcctcccacatcagcctccggagcagctgggactacaggtatgtgcaactgcgcccacctaattttattttttgtagagacaaggtctcactatgttgcccaaactggtctcaaactcctagactcaaggaatcctcctacctcagcctcccaaagtgctgtgattacaggcatgagccacaaccacacccagtacccatcctgattttttttttttttgagaccgagtcttgctctgtcgcccaggctggagtgcagtagcgcgatctcggctcactgcaagctccgcctcctgggttcacgccattctcctgcctcagcctccagagtagctgggactacatgtgcccgccaccacgcccggctaattttttgtatttttagtagagacagggtttcaccatgttagccaggatggtctcgatctcctgacctcgtgatccacctgcctcagcctgccaaagtgctgggattacaggcgtgagccaccgcacctggccccatcctgatttttaaggaaacttcaacacgagttcttccagtcccttttaaatgatggacactgtcaagaagtaaatttcacctaataactggtttatccagaaagaaaactgactcctcattcaaatggcattatattaaaccagaataatctccttaccttgacacaatggtttttgtaaatgtaaaaaaaaaaaaaaatcacacagaggtattctgattcatccaaggacattttctatattagcctagtaacatatagaataaagtaatatacaagaaaacttaggggtagacaggtatatattcagccacatgcttctcaataagaaaaatgatttatctactgtaagaaaaagtaaccttatagtaaaaaacagcagcagaatattacttgtaatagatgttaaatatttagtgtctctgttagttctatatacagttatacctaatcatgttaagtgtagagatttagcctcataaatatttctataacagaatataacctatatttcttaatacacaaggcaaatgtaaataaaacaaagatttgctggtctaaatacccaattctttaaaagtaaaccaaaattttcccatataaattttcctttggagaacacaggaataaatcccatctgatgaaggaaattatcaaaagaatacacattgatctaacatgtctggctcagtttgcctattataaacaattctggtctctggacatgaaaaactaataattttcagccacttgttttattacatctaagtctcaattattcacaactaaaaaagatagaataatgacattttacaatgtcccaaacacatgaatcaatcatacagcaggtggaaaaaatgctagaaaagataacatttgtgtcagctttacctctctctcacaggagtctcaacagtgtaaaccttaattcgtatatcttgactgcccagagccttccagagaaaaggatcatattgtctttttaaaaaatctcaattgtcaataactgaaggaaagcaagcatagctttccaaaacaactgagtccagatattttttccattgttgctgtcaattacttttctaatttctaattataattctaataaaaacttcagcataactaagaaagacaaactaaaactactcaggaattttcatgcaaaacttccaattatgtgtcctaaactcttttactccaacatgagttcacaaactctgacagatgttttataaccctgtttaaatatttagtcagtaaaaggataaaatttttaaaaaacagaatgatttcattcttttcaaaaaccagggtggtctatgggcaattttggtactagcagtgttgccgggggaacaaaatgaaaacaggtgtcatcaaattcaaattaaagatttacttctattttaaaccaccttaaacaatgtttccataaactttctaactgatactactataaatttgacaatattttataacaagaaaaggattataaattgtctgtagaccatcaaattttaactgtaacaaattttgactgattggcaacacttccttttaaaaaacttttttcattaaatatgcagcatcattttaaaaattgaatgtataaaaggcaagtcaaaataagaaaagagagcaagtatagactctgatagtcttttctgaaagattttactttgttttgagcctatgctgttttaaaaataaaaaacgaagtacaaaacaaatgttaaattcacaacatataaggaaaaagtgatacaattagtaacatgacaatcataacttttcctcataaacttaattgaactacaatcttcaatgttaaaaaaatccattaatttttgtgtcttattttggtaatgaaaagagtataaatacttggtttctaccattaaatagcacttatttttactcttaaaagagatgatgaagcaagtgactcaccatataaaagttaatcaatgcttaaaaatacattagagtattagacactttctcagttgtttaatacagtttcagtgacaaaatacacttacttttgttaaaagctttaattaagaaatgaacatataagaaatttttaaataggtaatattgcagattggttatgttcttcttaataaaactgtttaagattctttcagaatggattaaatacttacccagtgaggattctagatacaggtaagatgaggtgtacattcttcagtattattaatttaaacagaattaatttctctttgtattagttttgacaggtgaaaacttcttaaacttttaggggcatttaatcttgcactgaggagagtccttttatcttgactgtgaataatcaaattccattgtcatttcaaatctttcagacagttcaaagttttatttttagcagtgcttcagggaggcacaagttggttcactagtgtggaatcataacttacagtcagctccaccagttggattatttccaatatttattagtttcatcaactagttttcaaaaaagcttaaagtttcagtattaatagataaatgtctttgaaactaatatttctagcttaaagtttccattaaattgtatttataaaaataatacaaaatcttttttcagattactacatgtattttaatagtaaaagaaaaatatacagcattatataatgttgaacaatataaaacttcctttacagttagtttaaaataatctcacttgcatataattataaaattactatactcatctattgcttactttgaaagtgattaatcaaagtcagagaaagccaaccatcaactgaagtgtgttacaaatttccttctcagaggcacatcaaaaaaagatgagtcaattctactttaattaaaaccttgtttaagaatatgaaataagtgttttctgtataattccaattatatttcaattgtgttcagctttcaaactgcctctgctacttgattacacgtgccaaattaatcttgtcttttttttttttttttttttgagatggagtcttgctctcgctctgttgcccaggttggagtgcaatggtgtaatctcagctcactgcaacctccgtctcctggctccaagcaattctcctgcctcagcctcctgagtagctgggattacaggcacgcaccaccacacctggctaatttttgtattcttactagagatgtggtttcatcatattgatcaggctggtctcgaactcctgacatcatgatccacccacctcggcctcccaaagtgctgggattacaggcgtgagccactgcgcccggcccattaatcttatcttttaaatcatatcaacagttctaaaaaaagacttggattttttattgttctagtgggtattgttctagaagcaagactcctctaattgatcataacaccaagcctaccccttagctgacagttcagatgtgtgtttttggttggttcaaatacaggaagacaccctttgtatacatttgactaattagtcaaagaataagaaggcaggggaaagaaatttatctaaaatattttttgactaatacatagcagtcttccaaaaattcaaagtggaatttttagagaaactacatgttctaacatgttctcttagggtgcttcatacagatcgtcaaggaagtatcccaaaaaaaatcaatgaacacccggaatacagggtcttcaacagaatcaagcaacatgttacacaactgagggtaacaaagtatcagtccctacaacacttgtgtcaaacaaatctgtttctcctttcaccttacttacctcctttctcctaccctgttctatgtatggcctagcccttcgaagatacccaaacacaggaaagattaaagatccctttcaaacgatagaagatctctttcacacgatagatgataaaatgaagagatgttcagaaggctgtagctgctagcattcttccaccataagcttctccacctatatctgtagtagataactgtacttttagataacttttcaacccttttgaagggtttcaggttaacaaatatttgaaaattagtactcacaacactgtatataaaaatgaatagaggccaggtgcagtagctcatgcctgtaaatcccagcactttgggaggccaaggcaagtggattgcttgagtccaagagttcgagaccagcctgggcaacatggtgaaaccccatctctacaaaaaatagaaatattagctaggcgtggtggtgtgtgcctatagtaccagctactccagaggctgaggcgagcaggtgcccaggctcgaggggttgcagtgaaccgtgatcgcaccactgctctccagcctgggttacagagtggggcctcatctcaaaaaaagaaaaaaaatgaaagaagtatggactcaggaaagaagtactgacacatgataagcaataatctagatgcaaataaaaatcattagatttaatataacatctttaggctcaaatggaagctcactaaatattaagtcaatcaacactgatagaggcaggaagcagaaaaatcctagtcagacagggtgaaaccccaccttcaagtcaaaaacagcctgaaacccatgacccagagagagaacttctatttctgtttgcctgctctttcccaactggttctttctgaataatgctttttaaccaatcaaatgttgccttttccaatactacctgtggcccatgggcccccccgatcctgtgcccataaaaaccccagatccagccacactgagggagatgacccaacttcgagtgagagaccaccttcctgtcccctctctagactgagagctgcttcatcactcaataaaattctctgtcctcatcacccttcaattgtcagtgagacctcattcttcttggacatgggacaagaactcgggacccactgaatgtgggggctgagtgtgcagttgtggcagctgtgggatccacactggagtgcaagccagatgcggcctggcaggctgagtaaatggggcacctgctcctgcgagcccagcaaaggggccaagaaaaatcctgcatcaacactatttaaatgttaaaggaaaagtcaatataagtaacatgtataacacactaaaaatatattaatgataaggcaaaatgaaattagagaatgtataataaagctctgtgggataagaaccttctcttataacattctgtcaatggctgaacttccagaaacattacctatgaaattaaggacagcctttgtaaatagaagggctaactccttacatggagacttaccacccagaactattgtctgaatccatctgagggggaaaaaacccatttccatggtaaggaacaaagcagagacaaagttcattacagctacatacaaatggaaatgccataaattacataaaagctcatacaacaaagaaactagcaacttggttatttgtatacatagaaagacagcaggaaataaaatattttatattatatgaaaacaaaatgcttaagaactcactgacacagttatttgacaaatatgctgaggtttttgtatataaattttttagtttggggtttttttttgttttttgtttttttgggacagggtctctcgctctgtcacccaggctagagtgcagtggtgtaatcatggctcactgcagcctcgacctcctgagctcaaaagttcttcccacctcagcttccagagtagctgggaccataggcacataccaccacacttggctactttttaaaaaatcttttgtagataacagtgatatggtttggttctgtatccccacccaaatcttaccttgaattgtaataatcctcaggtatcaagggtgggaccaggtggagataactgaatcacaggggcagtttccccctgctgttctcatgatagtaagtgagtcctcatgagatgtgatggttttataaagggcttccccctttgcttgccactcattctctctcctgccaccctgtgaagaggtgccttccaccatgattataagtttcctcaggccttctcagccatgtggaactgtgcatcaattaaacctcttttctttacaaattactcagtctcgggtatttcttcatagcaccatgagaatgaactaacacagacagggtctctcaaacttgcccaggctggtcttgaactcctgggctcaagtgatcccccaacctcagcctcccaaatatgtagacccagcactttggaaggctgagacatggtgggcggtgggtgtggggggttagggggttagggggtgtgattggtgggggtgttgtgccaaggggcttgaggtctcaaagagctacgatcccgccactgcactccagcctgggcaacagagagaaaccttgtatgggaaagaaagaatttttgttttgttttgttttacagctttgggaaagatcttttctatagaatcatatatctgatattacaataaaattatgactcaaaaatttgttttacataaaatctctcatctacatgtcctcaagctaattacttaaacaacatcaccatctcttccacaggcactagcacatttagaaaagaaagaggtttgggttttgtttttttcctgtactcaaagttcagctaagtaaagaaacaattatttcccaaaggtttcaaagcaattgcctcagtaaatcaaaagaatgctttcctattagcaaagccatataatttaagagtaaagggttaagatgatttaattttctcaaagaaaaaagtgaaaagttaggtggctatacagttaatgaccagaattctggaaaactgccaaattcaggcacattctaaccatcaagttattactatttagtggaggtcgggggcagtcactaagaactttttatgcaggtttaaattttacatacagagaagccatataattattgtgaaatacttcaagggattcaagaagaagctatgacagtttgctgtgtttctttaaaaaaaaatgcacatttactgactttgagtggtatttagttccaaaaatatcaaaaatatcagaaagataatgtctatatttaatatttggtattacatattttggttatggcttctaaactttctcatagcccaggcactcagctattcaacctaaatttttccagttgcctcaatgttatataattcccttttcaattttgttcagtcatacttaggatctactttatacaaggatgaataaaacactattttacatctaggtcataagaccaggatataaagtccagtgtctgggttctaatcctggttctaccaattactagttctttattctctctataccttactttgatcatctgtaagctgtagatatagtactaacacccacaaaatagggtttgatgtgagaatcaaataagttagtatacaaaaaatactcagaacacaaccatataaaggaataaaatgcgtgctacaacataaatgaacctcaaaaacattaagctaagtgaaagaagccagacacaaaagtcacatattgcatgattccatttagataaaatatataaatccataaagacagaatgcaaactggtggttgccaggatcggaggggtggggaggggcaggtgggatggtggagaatggggataaaatgcttaacaagtaccgggttgtattttggagtgaaagaaatgttttagaactagataagagttctgaaggccactgaactgttcactttagaatggttaattatatgttatatgaaattcatctcaataatttcaaattttaaaaaaagaaataaaaaacaatttattaacaccatccaaaaaaatacttagaacaatagcagtgatacaaaatgagttcagtaaatgtacactgtaataattatcaatgccacataaactggtaaatatgtagaatactatgctacattccaaagattaaaataaatatacataggtttggagtttatgttttcttttaagtactcattttaacaatttatttctcctaaattcagcatgaaattatgtaattcatctacaaggaactctcgcttcctccaaaagagacactcagagagaaaatacatatgaaaaatggaaactaaaaatttattttgtacatttactgctatatgtcatccaagttatgttattttaacatacagtgcttatgtgttaaactatctgggaaataaagagatgacatgcatgaagaaaatatacacaaaaggacaaccaaagaattattttgtaaatttaaccccacaaattataaatattatattgttacattcagttgtttaaacaatatataaaataccactaaaagactcatacacatatttataaactcaatgaaatgttcaatttgtgatgaatcagaaaaaaatgagaaaacatcttcataatgggatacaaaaatggaatttagaactggatcagcctggggaaagcaaattttaaaaagacaaaatcatagggctagatttgtggatatgagaaatcaatgaattcatttttgaggcaaaaaaaggtcaaagtaaaaaagcattctatatatcaaacttaacacatttatactatagtttaaagaatatgtcaacaaatgaagagatcacagttcccaaataattatagcagccaaaaggtcaagtctaaaaacccttcacttcaaataaaaagctactaggagagactatgaggtactttctactaatatctcagaagaaaactcatgaaatattcaaaagcaagagaataattcgtatcttccgtttctttgcctcacatatttgttttactattagaagaaggctgtttttttgttttctttgtcatgactaatgtttatcttataaatttctattaaatgtgttaccaaaagttcctgtcgggaatggtaactacatttcacatacacatttataaacaacaaaagagaaaactgtcattaattttaatatggaattaaattattagaataaactttcaaacatatgttgaccagtcaaagaattgtggcatgatgcatgtagccttcactgtttcaaaagcacagagtttaggtcaagctccttaaaacagccaaatgttttaacaagtaaagaaaaatatacataaagtgcttcatgaataaaagtagttcaaatgaacaaggcttgtggaaaataaagcactgtacagattttatatcaaacatgccaagaatgttaataacactacactacactatatatgagaaagaactctccaactacaagaattgttatattaaaaatatacatgttatctttttctgttaacatctttaaacaaataagtcagctagcttcctgaaatgatgtaaatgtgattcaacctaaagatgtgattttcttgcacgtcatgagttccataaatctttgaatacaaatattatgcattttatatgccatcttatctgtatgtctataaaaaaaatggctgagctatggaaaaacagtatggtggttcctcaaaaaagtaagcatgaaattatcatatgatccagcaattccacttctgggtatatacctaaaagaattaaaagcagggactcgggctgggcgtggtggctcatgcctgtaatctcagcactttgggaggccgaggtgggtggatcacgaggtcaggagatcgagaccatcctggccaacacggtgaaaccccctctctactaaaaataacaaaaaactagccagacgtggtggcgggcagcctgtagtcccagctactcgggaggctgaggcaggagaatggtgtgaacccgggaggcggagcttgcagtgagccgatattgcaccactgcattccagcttgggtgacagagcgagactctgtctcaaaaaagaaaaaaaaaagcagggactcaaacagaatatttgtgtgtccacattcatagcacgattcacaagagccaaaaggtggaaacaatcgaagtttccatcaatagatgcacagataaacaaaatgatgtgtacgcataaatgaaatactattcagccataaaaaggatatgaaattctgacagttactacaagatgaatgaaccttgaatacattgtgctatatgaaagcagccagacagaaaaggacaaatatttcttgattccacttacatgaggtacccagaatagtcagatttatagaaacagaaaatacaatagttctaacttgaagctagaggagaaagtagtaggaagtaactgttttaacaggcatggagtttcagtttgggatgatgaaaagttctagagatgaatagtggtgatgttgcagagtaatacgaaagtatttaatgccacttaaaaacagttaaatggggcggggcgcggtggctcacgcctgtagtcccagcaccttgggatcacccgaggtcaggagttagagaccatccagcccaatcaacatggtgaaacccagtctctactacatatacaaaaattagccaggagtggtggcacatgactgtaatcccagctacctgggaggctgaggcaggagaatcgcttgaacctgagaggcagaggttgcagtgagctaagatcatgccattgcactccagcctggggaacaagagtgaaactctatctttaaaaaaaaaaaaaaagttaaacggtaaattttgttaagtgtattttgccacaataaaaaagtaaaaaaaaataagttctgtgtatggatggtagtgacggctgtacaacagtgtaaatgtgtatataacatctctgaattgtacacttaaaaatgttaaaatggtgaatttatgcttatttccacaatatttttaaaagctggttaaggtctttcagtaattagcttcactctaaattatttttaaggcagatcagaatatagttgctcagaggcttctaaatactttgtaagcaactgaaccaccactacagctaaccagcacccctaaaccaattattgcctagcaaagtattactgcctttcaacccactggccctgcctaagtctggcaaccatataaaatgcttgatactgcttctgcattaataagcagtgagctcttcaaatgtaacacttgatgtccagggcaggagcaggttatagacatagtatgcttaaatctactttccccatggttgatgactagacttaaatcctcagtcacattccctgctacctgactggggccttgtttcattatctgtcgcccttggccctactccttacatctttaatcctctcctctgggtcctacatctcattctaaaatcagactaagtctcctcatgccattaaaatcttccctggactctcaaaccttcaaatctcaccgcacccccaccccccgcccccaccgccacccaacttactcctcttcttggctaccgaacttcatttctggatcccccaggaattgacttcagcctgctacttgactgaattacactcctgaaagttaaccatgacctccaatctgataacctattattcatactacccaaactaaaggcaaaaaagaagaaagaagaagaaagacaaaggaggaagaggaaggaagaaggaagaaggaaggagaaggagacggagatggagatggagacagagaagaggacaaacatttgtaaaaggtcatcaatcacaacctccttaaaactattttctcccttggctgaaactctcctaattcttctcttactctctggtctcttttatctccttccaccaaatctccaaatatgggtacttgtcattctgccttcaccctttttcttccctctcctaggaatttttcagaacttttcttctcaaaacttcgcaaaacatttgaaaatgttttttacattttatatgaataccatcagcacaagaggttgcagaaggagtcaggtagttggagaacaattctgcctaccccagtaactaagaagctggcaacagaagtatgcttccctactgcacatgtatatatcagtgtccaaggttaagaaaaccacatttgtattttttggcaggtacaatacattttaaatgaaaaaaacatttagaatgttttcttttcaaaatgattgtactgatagaaggaagtatctaacaatctgttcattattaattgcatgttttctgatatggttaattatttaggcttgatgtaatcactcagctggttaagactgcttactgatacaaagttaaagataggatgtacaaatgcaattaaatatcagtttcttaaggttaaaaaaaataataatttcctccaatagagagttcttaacattctatgtggaaataaaatttgtagaaaagaaacagaaaaatgaaatccatagagaattgatatgctacaccttaaattaaaacttatcatcagaatacttaaattcttaaaaagtataatttatgatatttaataaataatttatgagtatgaaaaattaaaaccatggacttttttaaactttaggattaatgactagtaatggcttctttgcataagttgcttcctttcgccttaaacaaagaaaccatacattttaaagttttatcataaaaacagaatgtatatgaaattatttcactttagcaatttttaaagtattttaaggctcaaaaacttaaggatatgggaaagtgatcaagatgtagtgatagaggaaaaaaagaaagttataaaacaatgtaatctcatgattccaattttggttaaaaaccagtatgtactaatgggcacagtagatacacaaagtacacagaagcccatatatcaaaatgttaatggtaaatcttgaggtagtacaagtatttttattttcttccttatactttgttttcttcctttatacctttattcctttctatagcaaacatgcatcacatttacagttgagttttgtggaagaataaactctatatttcattccatttctgccttcctgcttatattttgatagactaggaaaggaccatctttcaaagctgtgcagagtaactctttagcattgtcagtgctctcatatacctaatccatcagcaaatcctgttaatccacttacaaaatataacagaattcaactactcactattttcactgcttcttcaagagaagtcaccgtcatctctcggtttatgcaaaagtctcctaactagtctatgtaattccacccttaccacctttctggctctaatgtcactcctctacttagaaattctgtgacttctcatctcattcagaataaaagtctaagcactgattgtgaccttctaggctctatgatctggaccaggaatcaccatgcacactcccacttcagcaccacagaacttgcagtaagttggctctgcctagatattctacatccagataccctcattttcttcagctttttattccagtatcatcttctcaatgaggccttcactggcaatccaacacaacacatcaaccactccaccctacccttgaaatttcctatcttgtttccctgttttattttttctactctagcacttatgactatctaagacacatgatgtatttatttatttttgatattatctccctccctcagtagaatataaactcaataaagagaaatttttacctttgtttttcctgctgctgcatccctagtacctagaatagtcccaagcacatggtaggtactcaatatatatctactgaataaatggataaatgcattccagtgaatccacaagcttaaacccacagcttctcagttacagtaatagttggctcaatgaatgtcatgaaatgatagcaacacatttattcatattctgagaatcaatgactttctaagtgactttgcatagggcaagagagctgaagaacagctatagtaaacaataatgtagacatattttctcaagcctaaaagggagcatctaggatcttagcttcaaaatttatgaataaaattatgacttgatttggtataacaaaggtaaggtaccctgagatcatattgctgttattgttggtactaaaaagtaagcaaaactgtctaaaatcatattgttactcttctaacttttccattagaatattcaataccagtctgtgaaactggatatataactttccttatgcaaacaaaaaactagctgaatatcatactactatgcacctgagtatctgttatctgaaagatctttggatcttttataaacatcaatcaatgctgtgcagacagagctaagagggaaaggcaattagatactgtgaaaaaatggaggcaatcagaagaaatacagtccatggtggcagtgacagagctaagcaggaggtatggataatctgggtaagtgccatggaaaaataaatatcatgattgaacttgaggcaaatggaaacagttcaaattggcttcatacactactctgtggaacatatgatgtccatatgtccattaccaacaaactgaaacatggaaaataacaaaagccgatgctatgatggctataagaacacacccaatgccagtctctaccacaccgcagcagcataacttactacagctgccaggtaagttggctaagaagtcagaagcaataagaaaaaaaggagaaagaactaactataaactgttctctttccctacagaagacaaagttgggatctatactagaaagtagaatgtagcaacgataaaggctgaaagtaaagcacaattttttctctgtagacagtttctaaaagtataaactactttggaattaaagaaggcaacattttatccaaaactacaaacgatttaagatccagagaactaaataaaataacagaggaataagatggaataacttccaaataaaaaattataaatatgacctttcaagttttgaaatacataatagagtataaaaagaaactgaacaaaagatgtggtgggaatccattatgttttacatcagttttaattagtctaccaaattttccttctatagtttctaaccccacctttcttttttttttttttttttggtgttgttgttgttttgagatggagtctcactctgtcacccagggtggagtgcagtggcatgatctcggctcactgcaacctccgccttctgggttcaagcaactctcctgcctcagcctcccaagtagctgggactacaggcgcgtgccaccacacacggctaatttttgtatttttagtggagacagggtttcaccatgttggtcaggctggtctcgaactcctgaccttgtgatccaaccacctcgacctcccaaagtgctgggattacaggcgtgagccactgcacccggcctctaacctccacctttctatactctctaacccccaaagcgattcatcttcaagatacaataagagttgacataaaagaagtagagcttaacttaggcaagtatcatgaaggaccaatttacacagcaaagccaaaactgtaaaaaaaaataaaaatataaattttttaataatgtttaagtgttaaagcctatctggtggtcctgaccttttcaaccaatcaaaaccaggccagtcagatgaactgtataaaaataatatgtacaactactacatatccataatacttaaaatgaatgtttaagaaaataatctcagcacttattcagaaatatactagtgtcactcaaactatacagtaatgaaattcagcagctaaaaatatataactattttacagtaaatatcaatgtcattcctgtttcaacctgacttcccattctacccctaaactcccaaacttgaaaccaactacaatttcttgagtagctggagtgtggtttaggaaaggaagctatgcttgtttgtatggaatctgccatttcctccctgccaaaacacttgtttaaaaagtcatgtaatatttctattaaattgtaaatgcagtcgacaaggaaatggcctactagcagtgtattacctttgtggcagtgccaacgggcctacagcaaaatagtgcacatgataatttcaacatgcattcccaagtaacaaaattgtgctttacataaataccacagaacctgagcaagatccagaaaaagcaatgaaaatctgcccaagctttcatgcttgcctatatcaattgtatgtcataagtaaagcaaaatagaaaagcatctacatatgttcaagaagcttgtgaagttagatcatataaccctgggaaaactattgcagcttaaatctgtgtatttcttgttaaccactgtaacaactcactaataaaaatgaagaaaaaccatggatatcaaatgaaccaaaatgtactaactacatacaagtccttaaagatcatgatgcaacttattaacaggaacatattttcagtgtaagccacaattgttatgttaaattacttctttctttgatatcattcatttgattacagaatgtaagagattcacgagcattccaattaaaatggtgaccttcagtttataagtcacttaccgaaatgcttacaaagtcaccgctaatcatttatttcttaccttgcattgcatagcacaactacatttaattatgcaaattaaatgatcccagatgtaataaagatggttctattcatgtgaaagttatacttaaaaccaagttaacaaaattaaataattaatctgtaattaatatagtcttctaggacagctgaattctattctacagcaatttaactaaaatgcatatttattttataagtcaggtatgacttgtctttctttttaaaaatatcaatcgacacataatttcaaaatttaaacctgatagagacaccatttcctccaaaaatgtaaatttttaagtgttatacacatgaaattagagtaaatacctgccctcagtatacctccttccaccttcctaccctatgcacacctagctatttatgtctcctaaaataaatgctagcttaaatctctggcacaaatagttactattactggcttagaataaaataaaacttactatgaccaacagagtaagtccacacaattgcttttaagatatatatcttcaataatgcttaatggttgtctgttaaaacagttttcatccccaattagcaaaccaaagctactatatcctgaggccaaaattaagggtgcccactactgatttttctgatctctaataaggaacaggaactaaagtgccaaaaaataaataaataatataaattatatcaatttaaaatttaaatgttaaataaataaattgtgctaagtaaaagtttgaaaggcaagctgtgagggatgacagctctttcaagttggatttgattagcatttaattactttcactttttaatttatttcattgattcttatgctaagttgtaagtacaacacttattattttaagaaagaaaaatctgagcttaccagatttcagtattaacaccacagaagtatctttgagataggaaaggaaataagcacatattcaacaaaaatatttattggatattcttatgttagaatctgctagattcatttagacacacaaagatgaaacatacttgaatttaaaacttagatttagtagggaaatacgacaactatatcaaaataactatgataatacacagtaagtttaaaagtgccataagaaaattatagataaggtgatatgagaattcaaagaaagaaaagattttttaaatcagtgggatgaggaacttctaacaataattagacttatctaaaactaagctttccagaagtagaaagattacgggaggaagacatcataatctacatttggttccaggttgaaatgcagaactgtaatatgctatgataaagaaaatagtaaacaaaacactaccctaaatacacaatgtaacaagatacactcttgagggtcactgatattaagaaccacagttctcagttattttcgatcaaggaatccttgtttcaaggagttattattttcatttgatggaaaactatgaactatcttaccagaaaaatacatatctgcacaaacatcaatatttaagtgcaatttcataagatgtgctgactgaattctctgccccagaaacagctcattctaccctcttgtgaatcatggtttccattactgggctagtatgcagtataggggaaaatgaagaagtaaaaaataactgtttttcatcattagaaaagataaaatgtatcacagtcctaataggctcattattttcatattgcttccagtagaggctgcagaagacatctcagcagccataagcaagaacttaaaagttttcagcaatctcccctggctagcaataaactgtcaataagcaggttcaggcacagaaacagtaattcctttgggtactgtgtaacgtcccaatacctcccatcctactgaatgtcctacaacaaaatcaggtgatgaaaaacaactgctcgatccttccacagctcaaagttccttaagtaacaatagtaaatattaaacgggcatcctctgtaagaacctgaactaatttatagtctcaatatgttacttcaaaagcaacttcataaagctagttcatatttctacagtacttagtattttacatgtattgttcatatacactatcccttttgatcttcaaaaagaactctgtgaagtagatggatgagggtccattataactaattcagagataacaaaattgattcaagcctcacaagtctcaaacatcaggtcacaccattattacgtagcaacaatagaagcattcggactttgttagaatttggatttccaacacctggttcagtaattattgctctatagattcaagttgcaaatcattactgggtcataaaatcaatgtaatggatttggaccacacattttttaacgaaaagatgaaacagaatagaatactgtgatagaacagaagtcagagtgaatcacaaataaggaaaataagtatggtttcatgtatattttgtttcacttatgtgtgtgtgtgtgtctgtacacatgtgcataatggatcacactgtgaaaatatttctaccatggaccacaattttaaaagtctgaaatgtaaatgtcatctttcaatcattaataaatcaatttaactcatctcctttaaattctcccacacaaatacagagaaatattgcatttgtcagtatcccacattaaaatcctaaaaagatgaaatgtagtataattctttctcagtaagtattactctaagcaatacttaatggaaacacgtctccaaaactataattcatatttatataatttgtatgtcagtaggaaaatgataattatttcctcaatattaccaaactaatcatgtgtacagagcacttggcaataccaacagcaaggttagaatacagacgaagagtaggaatgcctctttcctgtgtaagtatcaggggtgaccccagcaggcttaatctagagaagttgagacctgtttattctcttcacttgttcatgtcttaaagaataataactctgacaagacaaaaatatgttgaaactgtcactgtaataaaccttaatccccagtttagggtctaggatgccttataccaccaccacccttcaatgtgtatcaggaccacaaagcagagaactcttaactttcaaatggagtaaaaatccatgtcttggaagcagtactgaaattccctgatgatcccatttctcccactcctctggatccttggatgatgtgaaagtacggttaatagaatcaaggtatcacctaaaataggcaaaaaaatagggaagagaaaggaaaggaaaccaaaggtagagaggggggtgaggggagagtattcacctacacaccctgtcaggaaacaaaaaaatgaaaagacaacagtaggaagaaaagaaaaaaaggaagataagggcaggttcaagggagaaatgcaagtaaagtatgtaatgacaaaataataaaatttttatctacaaccatatgatcttatgtaatttgagataatatatacatataactgaataaacgttttacagtgtatagcttcctattctaatcaacaaaactcttatctaccctttcctattaaataaaacagaaatctaaatgattctaacattaaaatgctagttatcactgaactataaattccaaaagaacagtgaacatgtctgctgtgcttactactacttcctaacagctcaagtggtacctgataagtgtgcaccaagtatctacagaaggaaataaaggaaagggaaagggagtaaaagaatacagaaggcactctagatgacatttaatttctctgacacaaaacaaccaatttgggagagaagagatactgtccaactggtcccaaagccaaatttattgcctttatgttagaatatgcatttcttgcattaacaatattaaatcaaaaataatttaatattaatgattaaatttagtattgacgaaaacatgggactgtcccatcatgagaagatacacatttacatggcagaaaatttcaagagtgtcattctcgttgctaaaagattcattaaaaattatttgtactccaaaaggtcccactagctcccaagcaattactcctaaccagaatgaaatgtatgaaataacagatacagaattcagaatatggatggcaaagaaactcaacaagatccaagagaaagttgaaatccaacacaaaggaaacagaaaaataatctaagatttgaaagacggcacagttattttaaggaagaaccaaacagaacctctggaactgaaaaatttactagaggaatctcaaaatacagttggaagccttaacaacagactaaaccaagcaaaagaaagaatttcagagattgaagatcagttcttcaaatcaacccagtcagataaaaataaaaataatttttaaaaatgaaaaaagccttcaagaaatatgagattatataaaatgaccaaatatgtgacttactggcattcctgagagagaagagaaagtgagcaacttggaaaacatatttgaagatagatataattcagaaaaaattccacaatcttgctagagggatcaacatgcagatacaagaaatccagataactcctacaagatactacacaaaatgactattcccagggtacacagtcatcagaccatccaaggtcacccaaaagaaaaaaccttaaaggcagctagagaaaagtgtcatatgacctgtaaagcagcagtctccaaactttttggcgcaaggaaccggtttcgtggacgacaagttttccatagatagggttggagggggtggtttagggatgaaactgttccacctcagttcatcaggcattagttagagtctcatgaggactacacaacctagatcccttgcacgtgcagttcacaaaagggttcacgctcctaagagaatccaatgtcagtgctgatctgacaggaggcggagcttaggctgtaattcttgatcgcccaccgcccacctccagctgtgtgacccggttcctaacagttcatggaccggtaccagtctgtggcccaggagttgggggacccctgttctaaagggaaacccatcagactaacagtagacttctcagcacaaatcctacaaaccagacaagattaggggccaattttgagcattcttaaaagaaatgccagccaagaatttcatatcttgccaaactaagcttcataaatgaaggaaaaataatgtatttcccagacaagcaattactaagcaaattcatcactgccagaccagccctacaagagatgcttaagggaggtctaaacatggaaacaaaagaatgacatttactaacacaaaagcacacgtaaagcacataacccacagactctataaagcaactatacaatcgagactacaaagcaactagctaacaaccctgtgatgggaacaaaacctcacatatcaatattaaccttgaatataaagggcctaaatggcccacttaaaagacatagagtggcaaactggaaaaaacaaacaaaatccctctttctcttatctgcaaaagaaccatctcacaagtaacaacacccatagactcatagtaaatgaatggagaaagatcagttaaacagaaaacaaagaaaagcagaggtcttatattagataaaatagactttaaacaaacgactgtaaaaaaggacaaaaaagagcattatataatttttaaagggttcagttatacaagaagacttaactatccttaaatatatacacactcaacactggagcacccagatttatgaaaacaattacttttagacctaagaaaagatgttgacagccacacaataacagtgggagacttcaacaacccactgacagcattagactgattatcaaggcagaaaactaacaaagaaattctggacttaaatttaatgcttgaccaactgaacctgatagacatctacagaatactctaccaaacaaccacagaatatacattcttctcatatgtacatagaacatactcaaagactgaccacctgctcagtcataaaggaagtctcaataaattcaaaaaaatcaaaatcataccaagcatcttttcagaccacaatggaataaaaatagaaaccaacaccaagaggaactctcaaaaccacataaatacatgaaaactaaacaacgtgctcctgaatgacttttgggtaaacaatgaaattaaggcataaataaaaaagttctttgaaaaaaatgaaaacagagacacaacataccaaaacctctgggatacggcaaaagcagtgttaagaggaaagtttagaatgctaaatgcctacatcaagaaaatggatctcaaattaacaatctaacctcacacctaaaggaacaagaaaaaactaaacccaaagctaggagaagaaaataaataagtaaagtcagagtagaactaaatgaaattgagaacaaaaaaccatacaaaagatcaatgaaacaaaaaattggttttttgaaaggatgaatgaaactgacagactgctagctagattaaaaaaggaaagagagaagatccaaataggcacaatcagaaataacaaaggtgacatcacaacgaagcccacagaaatacagcagatgttcagaggctactatgaacatttcagtacatacaaagtagaaaatctagaggaaattgattaattcctgaaaacacaaaacctccaagattgaactaggaagaaacagaaatcctgaacagaccaacaagtaacaagattcaatcagaaattacacacctaccaatgaacaaaatcccccaaagagagagattcacagctgaattctaccagtcctaataaaactattacaaaaaatcgaagaggagggcctcctccctaactcattccacaaaaccagtatcatcctgatatcaaaatctggcaaagacataacaaaaaaagaaaattacaggccaatatccctaatgaacataagacccaaaattcctccacaaaatattagcacactgagctaggtggaatggctcacatctataatcccagcacttggggaggctgaggcagaaggatcactggagctcaggagtttgacaccagcctgggacatatattgagatcccatctctccaaaaaaaattttttaattagccaggtacagtggcacatgcttatagtcctagctactcaggaggctgagatgggaagatcacctgagcctgtgaggtcaaggctgcagtgagccatgactgcaccactgcaccccagcctggatgacaaagtaagcctgtctcaagaaaaaaaaatttatatatatgagcaaaccaaatccagcagcacatcaaaaaattaattcaccaccatcaagtgggctttattcctaggatgcaaggatgattcaacatatgcaagtcagtaaatgtgatttaccacataaggagaattaaaaacaaaaaccatataatcatctcaatagacacagaaaaggcttttgacaaaatcctatactccttcattataaaaatccacaacaaacttgacatcaaaggaacataccttaacataataagaggtatctattacaaactcacggccaacatcatactgaatgggcaaaagccagatgcattcccttaagaactggaccaagacaaagatgtccactcttaccattcctatccattatgtcactggaagccctagccagagcaataaggcaagagaaagaagtaaaagacatataaataggaaaaaaagaagtcaaattatctctcttcactgacaatataattgtatactagaaaatcctaaagattctgtcaagactcctaggcctgataaatgatttcagcaaagtctcaggatataaagtcaatgtacaaaaatcagtagcacttctatacgctaataatgttcaagctgagagccaagtcaagaatgcaatgccatttacaattcctaccaaaaaaaaaaaaaaaacaacctaggaatacacctaaccaaggaggtgaaggatctccacaaggagaactacaaaagactactaaaagatagcagagacgacacaaacaaatagaagagcattccacgttcccaggttggaagaatcaatattgttaaaatggtcatactgcccaaagcaatctacagattcaatgctattcctatcaaactaccatcatcatttttcacagaattagaaaaaaactattccaaaatttatatggaaccaaaaaggagcctaaatagccaaggcaattctaagcaaaaagaacaaagccagagacatcaatttacctgacttcaaactatactacatggtactgtaaccaaaacagcaaggtactggtacaaaaatagacacacagaccaatggaacagaatagaggcataaaaaaataatgggatcatgtcctttgcaggaatgtggatgcagctggaggccatagtcctaagcaaactaacacagaaacagaaaaccaaacactgcatgttcttacttataagtgggggctgactactgggttcacacagacataaagatggaaacaacagacgctaggaactctaaaaggaaggaaggagtggagaggacaagggctgaaaaacttcctatcggatactatgttcactatctgggtgacaggatcagcagaagcccaaacctcagtaccatgcaatatacccttgtaacaaacctgcacatgtaccctaaaataaaaatggaaacttaaataatacaaactgtgaaaaaatatttttaaaaaataatttccaaagaatatgaaatgctgatttacaattattaaatatttacacaacttcttcagaacacacctattgcataatgcaaagtacatatatatgatttaataaaaataatcctctacttggtagacaactaagtcatttgcatagaaacagtgaaaagcattctgattgaaagatctctcaatatagtgattacaaagaagacatacaaagggactcagactgtgtattataattggggtggagaaagtgatatggggacaactggaaagacaataaacaggcagtaaaaagttaaaggagtaggacaccttcaccagcatagaaacaacaagcaggtcagtactagagagaggttaaacaaaaagcccaatttaaaaatgggcaaagcagcaccgggcgcagtggctcaaaacctgtaatcccaacactttgggaagccaaggtgggtgaatcaaaaggtcaagagatcgagaccatcctggcaaacatggtgaaaccccgtctctactaaaaatacaaaaattagctgggcgtggtggcgcgcatctgtaatcccagctactcgggaggctgaggcaggagaatcgcttgaacctgggaggtggaggttgcagtgagccgagatcatgccactacactctagcctgggtgacagagcaaaactccgcctcaaaaaaaaaaaaaaaatgggcaaatgaattgaatagacagttcccaaaagatatacataatggataatggacaataagcatatgaaaagatgttcaatatcactagtcatcagagaaatgcagatcaaaatcacaatgagatgccacttcactcccattactatggccattagcaaagaaaaacaacagaaaataacaagtgctagcaggaacgtgaagaaactggaactcttgtacattggtggtaggaatgtaaaatggtacagctgctgtggaaaacagtatggaggttcctcaaaaaataaaacactcttgaattgatgattgtggatccagttcatggtagcattattcacaaaagccaaaaggaggaagaaacccaagtacccatcaacaaatgaatgaataaacaaaatatgctatatacatacaaagaaatattattcaggctttaaaaggaagcaaattctgacacattctatgacttgtataaattattgaaaacattaggctacataaaacacacacacacacaaaagaacaaatattgtttgattctacttatatgaaatatttagaacagtcaaactcatagagacaggaagtagaatactggttgcgaggggttggagcaagaggatatggagaattattgtttaatgggtacagggtttcagtttgagataattaaaaaatttctagaaatagtggtaatgattgcacaataatgtaaatgtactttatggcaatgaattgtatagagtactttaaaatggttaaaatgataaattttatgttatatattactcattaatcctaattataatcttaaattatgtaattatacttatactatataaatgttaatcttaaattatacataattattaatcttaaattttctttctctatttgaaagaagagaacatattatggggagtgtagtgagttgaaaaatggccatcctcagaagatatgtccacatcctaatctctgaaacctctaaatgttacacaatttgggggggaaaaatacaatttatgcagatataattaagttaagaatcttgaaagcagaagatcatcctggatcatctgagtgggccctaaatccaatgacaagtgcccttataagagaaaggcagagagaaatttgaggtagatagacaaaaaagaagacacagggctgggtgcagtggctcacacctgtaatcccagcactttgggaggccaaggcagacagactgcttaagctcaggagttcgagaccagactgggcaacatggtgaaccccatctccacaaaaaaaatataagatttagccagccatggtagcttgtgcctgtagtcccagctacttgcggggctgaggcgggaggattgcttgagcccaggaattcgaggctgcaatgagccatgttcacgccactccagcctgggtgacaaagcaagaccctgtgaaagaagaaagaagatgatgatgatgacacagacactcagaggaaaatgcaatatggagatgtaggcagagattagagtaagacaactacaatctaaggaaaacaggattgcaggcagccaccaagagctggaaaaagtgaaaaatagattatcctgtagagccccttgagggagtacagtcctgccaacactttgatttcagacttctggtttcccaggctaaatgaagatactcctctatgccattcaccactgtgttaaatccttgcaaggaatcttccaacaggtggtgtcagacaaacacaggtgcacatacactaagacatccaaggtatctacaaatacctacacagcagggactgggagatggaaggtgtgttaagtgtgttgggtgtggtattactcaagtctcaccactacagagaatcagttttccagaatttctcaagcaaattttattattaattgagcaggaaaggaggacatggatgcttttctcttttttggtgttgggtttttttaaatattaaaaaacggttaactaagtgttcactcttcacatgtggacataaccacattttttgtctctttttttaaaatcctttctttgtgaaaaaagtagtgccatgggatttccaatgggagagagctactgtgttttactttttgatatgcactataaagaatgatcttctaacccatgtctgtttttacgctgcctatactaaagcatttgttgcatctatttaaatgctatgtttctccaaaaagggaggtggaagccagttggaaaatatggtgggttaaggaaaagactcttcaggaaaggatagcattatttttgaaaacatcattcatcaaaaatgactccttatgtttgaaaatatctgcagggctcctttatttgtaagtaggtagtgtaaggacacagagatagagacctttttttaggctaaaataattctttttttttcatactttaagttttagggtacatgtgcacaatgtgcaggttagttacatatgtatacatgtgccatgcgggtgtgctgcacccattaactcgtcatttagcattaagtatatctcctaatgctatccctccccactccccgcaccccagaacagtccccagagtgtgatgttccccttcctttgtccatatgttctcattgttcaattcccatctatgagtgagaacatgtggtgtttggtttcttgttcttgcgatagtttactgagaatcatgatttccaacttcatccatgtccctacaaagaacatgaactcatcattttttatggctgcatatcattccatggtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatatacccagtaatgggatggctgggtcaaatggtatttctagtcctagatccctgaagaatcgccacactgacttccacaatggttgaactagtttacagtcccatcaacagtgcaaaagtgttcctatttctccacatcctctccagcacctgttgtttcctgactttttaatgattgccattctaactggtgtgagatggtgtctcattgtggttttggtttgcatttctctgatggccagtgatggtgagcattttttcatgtgttctttggttgcataaatgtcttctctgagaagtgtctgttcatgtccttcgcccactttttgatggggttgtttttttcttgtaaatttgtttgagttcattgtagattctggatattagccctttgtcagatgagtagattgcaaaaatttcctcccattgtgtaggctgcctgttcactctgatggtagtttcttctgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatggttttaggtctaacgtttaagtctttaatccatcttgaattaatttttgtataagttgtaaggaagggatacagtttcagctttctacatatggctagccagttttcccagcaccatttattaaatagggaatcctttccccattgcttgtttttctcaggtttctcaaagatcagatagttgtagatatgaagcattatttctgagggctctgctctgttccattgatctatatctctgttttggtaccagtaccatgctgttttggtaccagtaccatgctgttttggttactgtagccttgtagtttgaagtcaggtagtgtgatgcctccagctttgttcttttgggttaggattgactcggcaatgcgggctctttttgggttccatatgaactttaaaatagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcccaggtattttattctctttgaagcaattgtgaatgggagttcactcatgatttggctgtctgttattggtgtataagaatgcttgtgatttttgcacattgattttgtatcctgagactttgctgaagttgtttatcagctaagggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttatggagagtttttagcatgaagcattgttgaattttgtcaaaggccttttctgcatctattgagataatcatgtggtttttgtctttcgttctgtttacatgctggattacatttattgatttgcatatattgaaccagtcttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgtcaggctttggtatcaggatgacgctggcctcataaaatgagttagggaggattccctctttttctattgattggaatagtttcagaaggaatggtaccaattcctccttgtacctctggtagaattcggctgtgaatccatctggtcctggactctttttggttggtaagctattgactattgccacaatttcagagcctgctattggtctattcagagattcaacttcttcctggtttaatcttgggagggtgtatgtgtcgaggaatttatccatttcttctagattttctagtttatttgcatagaggtgtttgtagtattctctgatggtagtttgtatttctgtgggattggtggtgatttcacctttatcattttttattgtgtctatttgattcttctctcttttcttctttattagtcttgctagcggtctatcaattttgttgatcctttcagaaaaccagctcctggattcattaattttttgaagggttttttgtgtctctatttccttcagttctactctgattttagttacttcttgccttctgctagcttttgaatgtgtttgctcttgcttttctagttcttttaactgtgatgttagggtgtcaattttggatctttcctgctttctcttgtgggcatttaatgctataaatttcactctacacactgctttgaatgtgtcccagagattcttgtatattgtgtctttgctatcattggtttcaaagaacatccttatttctgccttcattttgttatgtacccagtagtcattcaggagcaggttgttcagtttccatgtagttgagtggttttgagtgagtttcttaatcctgagttctagtttgattgcactgtagtttgagagacagtttgttataatttctgttcttttacatttgctgaggagagctttacttcctgttccaaaatgtggtcaattttggaacaggtgtggtgcggtgctgaaaagaatgtatattctgttgatttggggtggagagttctgtagatgtctattaggtctgcttggtgcacagctgagttcaattcctggatatccttgctaactttctgtctggttgatctgtctaatgttgacagtggggtgttaaagtctcccattattattgtgtgggagtctaagtctctatgtaggtcactcaggacttgctttatgaatctgggtgctcctgtattgggtgcatatatatttaagacagttagctcttcttgttgaattgatcccttcaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattttgatgttagctggttattttgctcgttagttgatacagtttcttcctagcctcgatggtctttacaatttggcatgattttgcagtggctggtaccggttgttcctttccatgtttagtgcttccttcaggagctcttttagggcaggcctggtggtgacaaaatcactcagcatttgcttatctgcaaagtattttatttctccttcacttatgaagcttagtttggctggatatgaaattctgggttgaaaattcttttctttaagaatgttgaatattggcccccactgtcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacacagtgagatgaagatctggtcttttcacatagtcccatatttcttggaggctttgttcatttctttttgttctttttctctaaacttcccttctcgcttcatttcattcatttcgtcttccatcactgataccctttcttccagttgatcgcatcggctcctgaggcttctgcattcttcacgtagttctcgagccttggctttcagctccatcagctcctttaagcacttctctgtattggttattctagttatacattcttctaaatttttttcaaagttttcaacttctttgcctttggtttgaatttcctcctgtagcttggagtagtttgatcgtctgaagccttcttctctcaactcgtcaaagtcattctccgtccagctttgttccattgctggtgaggagctgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtgtgttggagtttgctagaggtccactccagactcggtttgcctgggtaccagcagcggtggctgcagaacagcggattttcatgaaccgcgaatgctgctgtctgatcgttcctctggaagttttgtctcagaggagtacccggccgtgtgaggtgtcagtctgcccctacttgggggtgcctcccagttaggctgctccggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcctccagaggtgaagcctacagaggcaggcaggcctccttgagctgtggtgggctctacccagttggagcttcccggctgctttgtttacctaagcaagcttgggtaatggcgggcgcccctcccccagcctcgctgccgccttgcagtttgatctcagactgctgtcctagcaatcagcgagactccgtgggcgtaggaccctctgatccaagtgcgggatataatctcctggtgagccgttttttaagcccctcggaaaagcgcagtattagggtgggagcgacccgattttccaggtgccgtctgtcacccctttctttgactaggaaagggaactccctgaccctttgcacttcccgagtgaggcaatgcctcgccctgcttcggctcgcgcacggtgcactgcatccactgtcctgcgcccactgtctggcactccctagtgagatgaacccagtacctcagatggaaatgcagaaatcacccgtcttctgcgtcgctcacgctgggagctgtagaccagagctgttcctattcggccatcttggctgcttccccaataaaatcaataattcttaatttactcttaaacagagattgtcatgctttatgtgagttaaatttccagaaagttgacaagtgcctccaattatctccttaaatcacatttgacataaatcttccaaaatacactatttatttacacatctttttttaaagttataaacattcagtattgcattgcatagaagtaaaaattcttggtttgatttctattttctttcctttgcctgattcaagaaatcatcaggtacttctcctgctgtccacagagtgatccatacagttctttccttacccctttccctatgctgaacaacaggtaagcaaacacaaagggtttttacaggttacgcctgtactcccaactactcaggaggctgaggcaggataattgcttgacccagggaggcgaagattgcagtgagcctagatggcgccactgcactccagcctgggtgacacagcgagaatccatcaaggaaaaaaatacaaaaatttgctgggtgtagtggtgtgcacctgtagttccaggtattcgagaggctgaggtgggaggattgcttgagcctgggaggttgagggctgcagtgagctgtgattgtgccactgcactccttcctgcctgggtgacacagtgagaccctgtcacatggatggaaggaagggagggagggagggagggaaaagaaaggaaaggaaaaaagtaaagagaaaagaaaagaaagagggaaggaaggacggaaggaaggaaatgatactatttattcatctcctgatttaaaatatatacatatatatacatacttcctaaggctgagtgcactggcttacgcctataatcccagtactttgggagaccgaggcaggtggatcacttgaggtcaggagttcaagatcagtctggccaacatggtgaaaccccgtcactactaaaaatacaaaaaattagcttggcatggtggtgcgcacttgtaatcccagctacttgggagactgagctgagacaggagaatcgcttgaaaccgggaggcagaggttgcagcaagccaagactgccaccgtactccagcccagacaacagagcgagactttgtctcaaaaaaaaatatatatatatatatatctatacacacacatatatatacacacacacactcacacacacacactctctctctctcacactcacttcctaaaggcctgagaaaaagagaagactgatctcctcaaaagtatgtggttaactgaattcaaaactaaatttttttaactattctatttatctaactgatcaaaattaatttggtggtttcatatttaactttataaaataaactgagttttaatttaaaaaaatttgtttcacttaacattctgattagacttactcccatttgccactactcactaattttaatctcatagctgaatataaatttataagcacttttatccctctcctgtttaaaagctttatatgtttcaatgtgtacatcatcatttccctttactaaacagataatcattactgtctaccacagtgaagattcggtttacatatactacaagtttctttggggggaagaaaaagttgtatggaaactaacaaatttggttaactccttgccatcaaacaaatccagtgtttttaatagttcttcttattagaaaatttctccttgaacatctatattccaaatattccttattctgcccaggaatgataaaagaaataatcaatctctgacaaactgataaactaaagcatataaaacaaatgacctcagacttaacacctttgaaagacccattctcaaataactgcaaatttccaatttaaccactttcattttctaatttagtgccatctttaagttcttcgtatccctcagactatgacaccctaaatatatgtcctacaaaaaccttaatcagtgaaaaacagtattaatttgtggccacttaaggagaagcaactccattctaaattatccaagctcaaggcatctctttttgcccctaatttttgctggcctaagcaatactactttacaaacaggcctggtacctaaacacggtaaaaggctgagaaaatgactgggaaaccaaatcccagttcactcagtctacaaggcagcaccactgttctggagtgttcctaattatatacagctagtgggcaggcatagtggaaagggctagaactctgtgaggatgaatgcaaggcatttcagaaagactggctagaatcctcactccaattaggcaataccaccagtggctgggcaccccactatagatggaggctggggaaactcacccaccacatcctaactttgtctctaactttgttctagatagccatgtatatgtagtaaattgtatcatttacttatattaaaataactatcaggttttttgcctgttatcagctgtggggtcttcatgtcaatcacatctttgtctcattgtggcaactttgtagattattgattacctcattagcctatatgtctaccaaaacatggctggaaaacaaaactttaaaaattgaaatcttacctaggttaccatatttcctgctactctggaaaacttagagggttcagattttaaatcagtaattataatattgtgattacatggttttaaaatgtcttatttttgttagccgctcctccacttgcactgagttgggatattaacacagaggatatttctttggtgtctaggcaaaaacacagaacaaactgagttcatatctcagttctgccactgacaagttatgtcatcttaaataacataatcttatccatttcatccaatccacccaatggaggataaaatatttatttcacaaaattactacagtacaaaaaaaaatgttggtaaaaaacttcaatatttcactcacttaccatagtgtcatatcctaccagctttctcatatcttaactaccactttatctcctctctaacctcctgagattctgatttaatctgtttagggtagggctccccacatgacggctatgcagcaagcatggagaacactacctattctttgatcaccccatttccttacactctctcttttctttccagactgtgccctgttagtaaccccttgaactgtctctcagcagcatccttaaattccctatagccccatccttctaagacactcattcattaaaacccaaaccctccatatcaaggccataatgcattctactgcacagcagagcacactaccataggaaggcccacaaaccaggattaattacactatactttcccaattaccaattttagctgggccctcaacaatttttctctcttggacagctctttctttcattgccctcactataccccccacaaaactactgtaaaccttgatgaaacagtaaagtttattaattctattaaatttctacacttgaatatgtatttttaatattctacattgacaaaatggaaaatatgcataaagcacttccccacatatcaaagaacaacaataatctgaaaaaaagcagttgtgtgactgagctgcaagctaaataaactacaaggctcttttcaaagaacatcatttttacttgaagaataactaacagaaaactaaggttacacagacttgggtatttgacagacattttctcaaaaaggaaccaagtgaacctgtcatttcaaggaaaacaaaaggcagtacttgttaccagtgataaaactatctgttacatgatctcaacagcttccaatacttgcagttcaatactctactttgtaagacagctcacaaacacaagaaaagttaaataatgatattatttaaataggaaataaactatattatgtttggaaatgcacgaggcaacacttgattaactgtccaaagaactggactgtgaagaaattgcctatatacaaaatatgaggaaaaagagaaatttacttgggcgatagctgtcaagaatggctctacacaggcataaaatccaagttgggacttgaaaaactggtaggatttagatttaaaaaaaaaaaaacagtgagcaaggcatcctaggaagtttgcaatacaggtatatttttttctaaaagaaatattattttcaggtatatttttaataatgtataatgtattcattcaaactctcaggtaatattagaagatccttaaaggaagaggccacatattacaattctctgctatctgagcacaggatcaaatttaacatgttgaactatttggttggaaaaataagatttacacagggaagaagcagaatagtaataatggaagtcctaagttaaatcccagctcttgtacttacctaggttgccttgggtaatttagtaaacctcactgattcaaactcaaatacacctactttgaggatcaccctacaaacatcctaactaaaagaaccacagataactaatgatcagagatgaaataagactttgtgttcctgtttttatgctgaccttgttgtttttcaagttattttcaaacaattgatgcatttttatctttcatttaccaaaaggaatttatatacaccaggaagatgatacatattgtatacaattacattactcaaagaactctaggctgggcacactgctgtaatcccagcactttgggaagctgaggtgggcggatcgcttgagcccagaagttggagaccagcctgggcaacatggcgacaccttgtctctacaaaaaattagttgggcatggtggtgcatacctatagtcccagctactctgcaggctgaggtgggaggatcacctgagcccaggaggtcgaggctcgagtgagccatgatcgcactactacaatccaggctgggtgacagagtgagaccttatctcaaaagaaaaaaaaaaaaaactctctttaaaatgtttcaatacagcagacagatttttaaatattttctgtataatacactgttacctatattatcgaaatttaacccacaatggcattataatatcagatgtaattccaatttattcttcttcagatattctaaaatatctgaatttttatgcattcttcctctttctatctatttacttcacattcctccagccaccatgatattatcttctcttttctacaaatacacacatacatacactcctcccctcattcctacatccttattgagataactacagccactagagggcaataagtatacaaagatcagtgtacctatttatgatgatgaacttatctatatgattcacatagtaataaacctaaaaagtatatcatcacaaaccctgaaacacaggcaattagacttgaatatgcaaaatatatatttcaaactcaaaaattatcctgcagagttcacagaagcatataatgatgttcaaaaaaggaattccattttctcagcatgcattcattaaaaaaaattagccgaattcctttatatgtgcatagtaatattagaaattaggattgcttaataccatcctcagaccaaagaagagaaaaggcagaaaaaaaaaaacacacagtaaggtataaatcacagagtgggtaaaaaagtgagaaatgattacttccaactctttcactaccacaatcaagaaaacaataaactgaagagcaaagaggatttaccaaccctttcttctattgaaaagcaagcaaaaattttacaagtatatttttgggggaggagaacagtgatggtagagatatacaaagccttcagttcttttctcacaattaagaatgcagaaggaagagaagttaacagttactaatctttaagaggtaattttaccatttttaaaaagaatacatttaaatgaacttatttagtttatatttacttacattgacattacaaaacggcaacacttatataaggctaacattttcagcaaaccataattttcttaccctcattggatgtatatcagcataaggaggttttccttcagccatttctatagaagtaatgccaagggaccagatgtcggccacacagttatagcctatttcttgaatcacctcaggagccatccaaaatggagttcctattacagtattgcgttttgccattgtatcctgcaataatgttacatagccataaatgctactacaaaagcacaaaggaaatctgtatgccaaacatacttttaaaaaatgttaaaacctccaatgccacagattatatcagaaattgactattttgctaaaatttcaactagttatgacatacttaggaattccgaattctgaaaataaccaagagtccacaggtaacttatccacactaccatcattaaacacagtcattaaagatagtgctacaatgataaaagctacagaaatgagctacgtagcttcccttttagaacatttaagcattttgattataagatatattttcacattcaatcaccctaaattataaattaaataatactcaaatttggctcaattatggttccttctccacaaaaattaaaaaactacacatttctttccattccccctcaaaaagtaattgaagtttagttataatcaaatctgaacaaattagccaagtgtttagaaaaccattaaagttaacttactgttaactgaccagccactccaaaatctgccaattttgcatgtccttctgtattgaggagaatatttccagcttttatatctctgtgtatttttctcataaagtgcaaatattctagtcctttcaatgtagatttaagaatggttgcaatttcatcttctattaactggaaagaaatatttttaaaaccataattaaaatgccacgttagataaaatcttacgaaagagcactagtaacaagtatgtctttccgtgtgtgtgtgtgtgtttttttttaagagaccccactctgttgcccaggctacagtgcagtggtgtgatgatagctcactgcagcctaaaattcctgggctcaaggcatgctcccacctcagcttcccgagtagctagaactacaggcacatgccaacccaataggctaacttatttttatttttgtagagatggggatctcgctatgttgcccgggctggtcttgaactctttgcttcaaacaattctccttcctcagcttcccaaagtgttgggattataggtgtgagccaccatgcctagccacaagtacttctttctaatgaccgctaaacctccaggaaaatgctaaaggggtaaataatcgagaacctcttcttcccacaataagctttcttattacacattttactaatgaaaggatgatcaaatttctctctttaagattatcagtatcagcagggcgtggtggctcacacctgtaatcccagcactttgggaggctgaggcgagcagatcacttgaggtcaggagttcaaaaccagcctggcccacatggtgaaacctcgtctctactaaaaatacaaaaattagccaggcgtgatggcgtgcacttgtaatcccagctactcaggaggctgaggcaggagagtcacttgaacctgggaggcagaggttgcagtgagctgagatcacatcactgcatgccagcctgggcgacacagcgagactccatctcaaaaaaaaaaaaaaattatcagtatcattcctaaagcaaacaacatatctcaagaatcagcctgatataaggaatcataatagtgatttcccacatcttctaatactgggagggcactatcacagctaatatctgttctgaaaaagtaaattcagatacttcccctgagatatttcagattcttgatgaaaatgaaaccaacagctttacataaaggaaagtaaatgagggagggaggcttgcaatgaatcttctgcgagaagctcctacaccaatgccactcctaacccttccaagttctggacttctgacctaatattgagaactcagaagaaaaaacgtcagagaaagattaggaaaatggaaacacaagcaaagactatcagaggagggaaaaaggggagagtagagaaggccgaggaagagacggatgggaaagaaagaaaatcttcttaacagttgtagcagtagagccactgctatctgtaccaggcaatgtgctaagagttatgcatgcattctctcatttattcttaaaacaaccttgtaaggtagtgtgatattatgaaatcacaggaaatatttggtctttgtaggttcttggcacaaaatctcctaagaccctgtgaattgactgagtgagtgagaagttgaatcaagatattttatctttgttttctcaccctctcacaagagtgagaggggctgtcttttgtcattcataataagctcctttcaaccataccagaatttatactgatcaggtgactcttggtgggagcctagatagcttcaggatgggagctggttgccgaaaaaaccaaccaagtgattagatgtttggaaatttctgcctgacccctgacttacgggagggctgcaaggagagagggggtagagatttagttaagcacaaatgtccaaagacttaatcaatcatgcctatgtaacagaatcaaccataaaaattctaaatgattagggactgctctcaagcttatattctatctataagcaacgggataatttgatagaaaataggataacacaggaaaatgtctgtgaaaattgctatgaggacaacaatagagagctactgatagagaacgactgagaagctactttagattgacattcaagaaggcccaaaagacattttactgaagtctaaatgatataatggggccaaccatgtgaatggctatctgggaacatacactccacaaaaaggaaaaaaaaagattaaaatatcttgattcaacttctcaaattttctaaaacactgaagaaaagagaacacttccacactcattttaagaggcattattctgatatcaaagccagacaaagttaccacaaaacaactaagaccaatatcccttatgaacattgatacaaaaatcctcaacaaaatatagcacactcacttcaacaggattgtaacaggttatacactatgaccaactggaatgtattcctggaatgcaaggttgattcaacatacaaaatcgaacaatgcaatacaccaccttaacagaatggagaagaaaccacatgatcatttcaaatgaaaacagaaaaagcatttgattaaatttaacttcttttcataaaacacacaactaatatgaatagaaggaaactatctcaccatagtaaaagccatatacaaaaaacccaaagtaaatgtcatactcaaagcagtaagactgaaagcttttccacaaagatcaggaacaatgaaaggatgctattaggttggtgcaaaagtaatcgcagtttttgccattttttttttaaagtaatggcaaaaaccgaaattacttttgcaccagcctaatacttctgttacatatagtactggaggttctagacagagcaattagggaagaaaaacaaataaaggcatccaaactggaaaaaaagaagtaaaattatctctgttcacagatgatatgatcatatatgtagaaaattctaaagattccacaaaaaaaacctattagaactaataaatagggatggagacaagacggctgaataggaacagctccagtctaaagctcccagcgtgagcattgcagaagacacatgatttctgcatttccaactgaggtaccagattcatctcactggggagtatcggaaagtgggtgcaagacagtgggtacagtgcactgagcatgagctgaagcagggcggggcatcacctcacctgggaagtgcaaggggtcagggaattccctttcctagtcaaagaaaggggtgacagatggcacctggaaaatcaggtcactcccaccctaatactgtgcttttccaatggtcttagcaaacggcacaccaggagattatatcccgcgcctggcttggagggtcctacacccatggagcctcgctcactgctagcacaacagtgtgagatcaaactgcaatgcggcagcgaggctgggggaggggcgcctgccattgcccaggcttgagtaggtaaacaaagcagccaggaagctcaaactgggtgcagcccaccacagctcaaggaggctggcctacctctgtagactccacctctgggggcagggcatagccaaacaaggcagcagaaacgtctgcagacttaaatgtccctgtctgacatctttgaagagagtagtggttctcccagcacacagctggagatctgagaacagacagactgcctcctcaagtgggtcactgacccccaagtagcctaactgggaggcagccccaagtaggggcagactgacacctcacacagcccggtactcctctgagacaaaacttccagaggaacgatcaggcagcaacatttgctgttcaccaatatccactgttctgcagcctccattgctcatacccaggcaaacagagtctggagtggacctccagcaaactccaacagacctgcagctgagggtcctgacagaaggaaaactaacaaacagaaaggacatccacaccaaaaccccatctgtacatcaccatcatcaaagaccaaaggtagataaaaccacaaagatgcagaaaaaacagagcagaaaaactggaaactctaaaaataagagtgcctctcctcctccaaaggaacacagctcctcaccagcaatggaacaaagctagacagagagtgactttgacaagctgagagaagaaggcttctgatgatcgaactactccgagctaaaggagaagtacgaacccaggcaaagaagttaaaaaccttgaaaaaaaaattagacaaatggctaactagaataaccaatgcagagaagtccttaaaggacctgatggagctgaaaaccaaggcacgagaactacgtgacaaatgcacaagcctcagtagccgattcaatcaactggaagaaagggtatcagtgatggaagatcaaatgaatgaaatgaagtgagaagagaagtttagagaaaaaagaataaaaagaaatgaacaaagcctccaagaaatatgggactaggtgaaaagaccaaatctatgtctgattggtgtacctgaaagtgatggggagaatgaaaccaagttggaaaacactccgcaggatatcatccaggagaacttcctcaacctaccaaggcaggctaccattgaaattcaggaaatacagagaacgccacaaagatactcctcaagaagagcaactccaagacacataattgtcagattcaccaaagttgaaatgaaggaaaaaatgttaacagtagccagagagaaaggtcgggttacccacaaagggaagcccatcagactgacagctgatctctcggcagaaactctacaagccagaagacaggggggccaatagtcaagattcttaaagaaaagaattttcaacccagaatttcatatccagccaaactaagcttcataagtgaaggagaaataaaatactttacagacaagcaaaggctgagagattttgtcaccaccaggcctgccctaaaagagctcttgaaggaagcaataaacatggaaaggaacaaccagtaccagccactgcaaaaacatgccaaattgtaagaccatgaatgctaggaagaaactgtatcaactaacgagcaaaataaccagctaacatcataatgacaggatcaaattcacacataacaatattaaccttaaacgtaaatggactaaatgctccaattaaaagacacagactggcaaaattggatacagagtcaagacccatcagtgtgctgtattcaggaaacccatctcacgagcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatcctaaatatatatgcacccaatacaggagcacccagattcataaagcaagtcctgactgacctacaaagagacttagactcccacacaataataatgggagactttaacaccccactgtcaacattagacagatcaacaagacagaaagttaacaaggatatccaggaattgaactcagctgtgcaccaagcggacctaatagacatctacagaactctccaccccaaatcaacagaatatacattcttttcagcaccacaccacacctattacaaaattgaccacatagttggaagtaaagcactcctcagcaaatgtaaaagaacagaaattataacaaactgtctctcagactacagtgcaatcaaactagaactcaggattaagaaactcactcaaaaccgctcaactacatggaaactgaacaacctgctcctaaatgactactgggtacataacgaaatgaaggcagaaataaagatgttctttgaaaccaacaagaacaaagacacaacataccagaatctccgggacacattcaaagcagtgtgtagagggaaatttatagcactaaatacccaaaagagaaagcaggaaagatctaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaattaatgaatctaggaactggttttttgaaaagagcaacaaaatagaccgctagcaagactaatagaaaagagagaagaatcaaatagaagcaataaaaaaatgataaaggtgatatcaccaccgatcccatagaaatacagactaccatcagagaatactataaacacctctacgcaaataaactagaaaatctagaagaaatggataaattccttgacacatacaccctcccaagactaaaccaggaagaagttgaatctctgaatagaacaataacaggctctgaaattgaggcaataattaatagcttaccaaccaaaaaaactccaggaccaaaaggattcacagctgaattctaccagaggtacaaggaggagctggtatcattccttctgaaactattccaatcaatagaaaaagagggaatcctccctaactcattttatgaggccagcatcatcctgataccaaagcctggcagagacacaacaaaaaaaaaagagaattttagaccaatatccctgatgaacatcgatgcaaaaatcctcaataaaatactgacaaaccgaatccagcagcacatcaaaaagcttatccaccatgatcaagttggattcatccctgggatgcaaggctggttcaacatacgcaaatgaataaacataatccagcatataaacagaaccaaagacaaaaaccacatgattatctcaatagatgcagaaaaggcctttgacaaaattcaacaacctacatgctacaaactctcaataaattaggtattgatgggatgtatctcaaaataataggagctatctatgacaaacccacagccagtatcatactgaatgggcaaaaactggaagcattccctttgaaaactggcacaagacagggatgccctctctcaccgctcctattcaacatagtgttgaaagttctggtcagggcaattaggcaggagaaggaaattaagggtattcaattaggaaaagaggaagtcaaattgcccctgtctgcagatgacatgattggatatctagaaaaccccatattgtctcagcccaaaatctccttaagccaacaggcaacttcagcaaagtctcaggatacaaagtcaatgtgcaaaaatcataagcatttttatacaccaataacagacaaacagagagacaaatcatgagtgaactaccattcacaattgcttcaaagagaataaaatgcctaggaatccaacttacaagggacatgaaggacctctttaaggagaactataaaccactgctcaatgaaataaaagaggatacaaacaaatgcaagaacattccatgctcatgggtaggaagaatcaatatcgtgaaaatggccatactgtccaaggtaatttatagattcaatgccatccccatcaagctaccaatgactttcttcacagaattggaaaaaactattttaaagttcatatggaacccaaaaagagcccgcactgccaagtcaatcctaagccaaaggaacaaagctggaggcatcacactacctgacttcaaatacactacaaggctatagtaaccaaaacagcatggtactggtaccaaaacagagaaacagaccaatggaacagaacagagccctcagaaataatgccgcatatctacaactacctgatctttgacaaacctgacaaaaacaacaaatggggaaaggattccctatttaataaatggtgctgggaaaactggccagccatatgaagaaagctgaaactggatcccttccttacaccttatacaaaaattaattcaagatggattaaagacttacatgttagacctaaaaccagaaaaaccctagaagaaaacctaggcaataccattcaggacataggcatgggtaaggacttcatgtctaaaacaccaaaagcaatggcaacgaaagccaaaattgacaaatgggatctaattaaactaaagagcttctgcacagcagaagaaactaccatcagagtgaacaggcaacctacagaatgggagaaaatttttgcaatctactcatctgacaaagggctaatatccagaatctacaatgaactcaaacaaatttacaagaaaaaaaaaacaaccccatcaaaaagtgggcaaaggatatgaacagacacttctcaaaagaagacacttatgcagccaaaagacccatgaaaacatgctcatcatcactgaccatcagagaaatgcaaatcaaaaccacaatgagataccatctcacaccagttagaatggcaatcattaaaaagtcaggaaacaacaagcgctggagaggatgtggagaaataggaacacttttacactgttgatgggactgtaaactagttcaaccattgtggaagtcggtgtggcgattcctcagggatctagaactagaaataccatttgacccagccatcccattactgggtatatacccaaaggattataaaacatactgctataaagacacatgcacacgtatgtttactgtggcactattcacaatagcaaagacttggaaccaacccaaatgtccaacaatgatagactggattaagaaaatgtggcgcatatacaccatggaatactatgcagccataaaaaatgatgagttcatgttctttgtagggacatggatgaagctggaaaccatcattctcagcaaactattgcaaggacaaaaaaaaacaaacaccgcatgttctcactcataggtggaaattgaacaatgagaacacatggacacaggaaggggaacatcacacaccggggcctgttgtggggtgtggggagtggggagcgatagcattaggagatatacttgacattaaatgatgagttaatgggtgcagtacactaacatggcacatgtatacatatgtaactaacctgcatgttgtgcacatgtaccctaaaacttaaagtataataaaaaaagaactaataaataaattcaacaaagtagcagtatacaaaatcaacccaagaaaatcagatatatttttatacattaccaatgagcaatctgaaaaggaaactacaaaaaaaattctatttacaatagaaatagaatttctttattttaaagaataaaatacttaggaattaatttcaccaaggaggtgaaatatctgtacaatgaaaactacaaaacactgctgaaaaaaaattttaggacattaataaataaaaacctatcatatcttcatagataagaaaatttaatgtttttaagatgcccatgctacccaaagcaacctacagattcaatgtaatccctatcaaaatcccaatgatgtttattgcagaaatagaaaaacttatcctaaaatttgtatgaaatctcaaggggccccaaaacaacactgaaaatagaagaacaaagctaaaattctcatagttcctgatttcaaaacttattacaaagctatagtaatcaaaacaatgtgatattggcataaacacagacagatagatgggaggaacagagtagaaaacccagaaataacccttgtatatataatcaaattattttcaacaagagtgtcaagaacattcaataggaaatgaacagtattttcaagaaacagtgctggcacaactggatatccgtgtgctaaagaataagtagaatccttacctagcaccatatacaaaaattaattgaaaatgaatcaaagacctaaacataagacctaaaactataccactcttgggaaaaaataaaacagggcaaaaacctcatgataccagatttggtaatgatttctcagatacgaccaaaaaggcacagagaacacaagaataaaacagacaaattggacttcatgaaaattaaaaaaaaaaacctgtgcatcccaagacaatatcaacagagtaaaaagacaacccacagaatgggagaaaacatttaaaaattacgtatctgataagacattaatatacagaatatatagagaactcctaaaacttaacaataaaaaaatcaaattcaaaaatgggtaaaggactcgtatggacatttctccaaaggtatacaaatggccaagaggcacgtggaaagatcctcaacatcaccaatcataagacaaatataaatcaaaaacataatgagataccacttcacacccattatgacggctattatcaaaagacagaaaagaacaaatgttggcaaagaagtagagaaattggaaactttgtgtatagctaatgggaatgtaaaatggtacagcctctgtggaaaatagtatgaagattcctttaaaagttaaacataaaattaccttttgacccagcaattccacttttgggtaaatactcaaaagaattaaatgcagggtctcaaagaggtgtttttgaacaagtttcacctcacgatgaacgtacacccatgttcatagtagcattattcacaatggctaaaaagtggaagcaacccaaatgtcattcgacagacaaatgaataagtaaaatgtggtagaaacatacaatggaattttattcagccttaaaagggaaggcaattctgcaatatgctacaacatggctgaaccttgagtacattatgctaaatgaagtaagtcggtcacaaaaaaaggcaactaatgtatgatcctgcttatatgaaatactcagagttaccaaaatcacacatctagatagacagtagaacagtggttgccaggggccgaggtagcacacaatggacagttagtgcttaatgggtacagagtttcagtcttacaagatgaaaagagttagggggatggataatggggatgcttacacaactttataaatgtatttaatgccactgaactgcacacttaaaaatggctaagatggcaaattttgtttatgtgtatcttggcacaataaaaataaaactgagggggggaaatgccttgattcaagaaaaagctcaccatatttgagttgaataaagaaggctgaagtttaatgcaccagaagactagctctagatgagatctgagagacaggcaaggaccagatcatgtaaggctttcctggccataggtaagcagtctggattatctgaaaattccggtacttccaggaatttattctctccttcagactagatggtctgacttgacagcgcagagaaagcaagcaccatactctaaagctgcaccatccaacagagtaaccactaaccacacatggctcctaaacatttgaaacgtgggtattctaatttcagttatgctataaatgtaaaatatacaccaaagatcaaggcttagtacaaaaagaatgcaagctattttgttaaaaattcacatactgattacccactaaatatttacatattatgttatgatattaatatattaatgttgaacatataaaatgttaatgtttaatatagtaagtattaaatatggtatttcatattatataatattgttatttattaatatgtgtgatacattatgaaagttaatttcactttttttaatgtggctactcaaaaatttaaaattacatgtggcttgtgtttcttttggacagtactgcactagaaagggtccacaagaatgttttgtgaacactttgttcactgatgtatccacaatgcttggaactatgcctggcgtacagatagcacttgataaataatgaatgaatgggtacagacttgtcgatacaaaaagaaaggagacaccttcatctgatgttcccaatctttctaagttagtggtgtgcagccaaatgtgggggagtgggaggtaggagtgtgtttagggccaccataatggaccactacagacggtgggcaaggtggtggtgctgtcatgtgcacctagcttttctcgtctgtcctcatcctccactctttgtataaagactaaaaagcttggggtgttaataaaggcagcatcagcccataaaattgtgtcttatttagttacttcagtacagacctttttagttacctagacttcaatttttatctcttaacattctatttccaaccaataagtcactaattttctattaactctgatttgttatctctgctcctgtaccctatatatcactgctctactaaagaatgttcagaattaaataaactgactgtacttcagggtcttaggatctgtctgattttaatgctataaagccactggacaaatccacagcaagtctaaaggaggattttccagggatattatactaattcatgaactgtctggctttgctcaatgacttgaaagggtcattccaactctatgattctatgttatcaaagtatcttcatgtagaggcaatcttcactaaataaaattctcactcatttgggcatcaatctatgtgttcatttagtaaatatattcttgactggctctaccacagcgctgatactcttcaaggtgctggatatacacggacagggaaactgataatcccagtcctaatgagcagacaagaatatctgagggcataacctgaatttggctctgaactgttaaaggtggagagtgcagatctgaagtttatacagcctctctttcattatgcttccctttggtaacaaatccctcccactacttcagagagtcaatgtcttcccattcgcttcatatcctccttaatcaaaaaatgatgcaatatccagtcattcatacaagtacatgaatagagcttaatttaaatttattttaacaacccaatttagtattaaggcttataagcagtatctgtactttaagacttttaaattcaattatgaaatgaaaggttcctatccctcaataaaatcactttaaacaacaataaacaggtggagaaatattttctagaacgtaaaggcatactgttgtcttaaatttttatatttatttacagtttataaaaagtattttatgtgatttctctacttaagtaagtaagcagaaacacttattattattccttttaacagacgaggaaacgaattcagagaaattaaatggactaccgaatgtcatacaactactaagtagcaaacctcacatttcttcaacaatcaatattacttccatcccaccactgccagatgtcacaaacataaatatatgaattagtctaatataagaaaaactggggccaggcacggtggctcacgcctgtaatcccagcactttggaaggccgaggcaggtggatcacaaggtcaggagatcgagaccatcctggctaacacagtgaaaccccgtctctaccaaaagtacaaaaaaattagccaggtgtggtggcaggcaccagtagtcccggctgctcgggaggctgaggcaggagaatggcatgaacccgggaggtggagcttgtagtgagcatagatcacaccactgcactccagcctgggtgacagagcgagactccgtctcaaaaaaaaaaaaaaaaaaagaaaaactgggggttttgagacttgttctaagtgtgatattcaaaatatctgacagtcattaaagcaaatgtctaattagaacagttgccaaccacaataccaaccaatcaaaacagctaccagtggtaaacaacagtaagaacagataccagccataaataggcagtaaaaaaaaatcatccctgaatatcagacagagtacctgccccagctcagcattcaaatttaaattattttcaatggtatgccagccaaacaaaacaaatatacctgttaatgaattgtagaagtaagcacactcacctggccaataatttttttgattcctttcaccctgagtacattaatgggtggctttatgagcattttattgaaaacagatgcttaattctgctaaaacaaatatataaatcaaagatttaaacattttaaaaatacttagaagaaaaccaaagtaagtttcaaatcactaagcaggaaagatagtttctaatcaaaaaaagcaaagaaagaattatgagaacttattagttttgtctacacaaaaacttaaaatacataagcttagaatacatacaaggttctacataaccttagaaaactcagaaaaatagccagttatggtggcacaggcctatagtctcagctacccagcagactgaggtgggaggatcacatgagcccaggagttcgttcaagtccaggctgggcaacatagtgaggcctcgtctctaaaaaaaactaaataaatttttaaaaagaaaaaaatagtcatagcaagatattaatatatataattatttatttagaacatagagctcatataaaaccttcagaaaaacaataaaatctcaataaataaacaggcctaagaaatgaatataaaattcacaaaactaaaaaaaagagctaattaacatacatggaaactactaaactgctctaattatcaaagaaaggcaaattaaaacaataaagtaccaaatataaaattaccccaggggttacaatattgctgtgaataacagcacatatataaccagaatgtaaaccagagtgtaaaagtgacataagaattcagaagtattttccaagaagcactaggaaacattgatccactgaaaaattatttattgagcacctactctagatttaatttttttttaaatctctaacctaacctcatggggctccaatctagcaggaaatacagacttagagactcataaatgatcataaaaagctctttcaaagtgaaacataaccaaaaaggagtgcaattaattaggaacagatagaggaagtggcattaaaatcaagctttaaataaaaaaagtagctcactatccagagaaaggaaagactactaatagagtaactcaaataatgaactaaagaatagaaatataacaattataaaatggcactcagaaaccaagtaaggcccagttttcttccttccactacaataagaaaaatgacaaaaagcgatagtccaaatttcagccttgtaccaaaacggagacaaatcttagcaaatttggaagataaatgtttacttggtctcttttaaatatcaatggtgccaaatgaactttggacaagagaaatatctgtatcaaggtttaaggtactctacaagtattgtgtgtcactaatggaaaaggaggagagtggaaggaaataagaacgtatacttagtggacaccatacagcaggttctgatctagatgtttatatcatgctcatttcatgtcatttggacatatgttaacctttttgttattaaaaaataaagaagttgacagtcattttcctagatagatggagttttgttttcaaataatctctagctgttttaacaaatttcattcacatataagcacagccaattaccaaaagtagctagatttttatttggcaacaaagagaactacttctttccattgtgacataaaatttaaagcagtacctttctcatatctgtaagacttttcatgaggctggataggtccatacccaactatttcaaaatggtcagatttatactgaaaacaccaagagggagaaaacacatgagagaggatctgcttcatatagaagaaggtaatgtaagaattcagctccaagatggaaaagcgttagatccattctcaaatcacagctagcacttccttcagtggtatctgttaagaatcccttaaaacaaacaaaaaaaaaattgtggacaccattgattggaatacaaaatattttatcaacagaatacttcatttgtggatttaattaggttatcctcaatacattacagatttcatttcatttaggtcactatacaaatggtgcgatgtcatttttaaatcctctgaatcacattttatagtctgttttgctgtatttttttaaagaagggtggtagagagataataaaccatgaatgaaatactcagcaatcagggataaaagtaagacatttatagctgagctaatacgttaaaagatggaagtctacatctggtttcaattggtatgaattcactggcaaatttaagaagaatttcattgtacgaaaacaaaaagatggttttgataggctttagtcctctggttacttttgtttctttagtcacatgattagtataataatatgatacatttaatatgtcactgtgtatatggttttgataaaaatacacccaccaacttgtctcaagggcacatgcacaaatggttttaaaatacatatactgccttaatgtttttagatcagtaaaaatgaattcaagtgaggttttaagttcacacaaaattaagaattttaattttctaataagtctttcgcaatgttagctaaacaccttttggacataattacttatgcatataaaatgacgcattaattctacatttaatacctattagatagtaaggatacaaaaaattagacatacgccccccttttcaaatgccataaatagataagtacaggtacttcatttaagttttactttcataggcacttgcataaggtcttaaaaattgatcgaaactcaccaatgtaatccttacacagtcttttaaggcctggatcaaactttgcctctttcaagaaatcaccctatattcctcgagtcaggattaatctatccagtgttaacaatggtgataacaataacagcttgcatttattgagttcttactagtcagccactccacaggtttcatttcatttaacacccaaacagaactgtagaaggtaggcactaacaaggatttactgaaagtctgttacatgatcactgtcttcatgacactcagaattttgtgggaagggaataggaacaattaattacaatactaagcgatgcctgcaacaacaggattagcaataggagcactccaggacagcagttcttaaagctgattatgcataagaaccagtactcttaaaatccaaaccatctaatacaacatttaaggccttgaatgatacaattcctgccagcctcgaccatctaccttaccattctaccactcaggaagggcttcacagagatgacttttgagctgactctaaaagagtgaacaaagtttatcaggtgaccaaagagggaaagatacataaggcatgtgcaaaggcactgagcataaaaatacataaagtgcattaccaatgaatagttctttgtgtttgaacatagtgtgtatggtaaaatagtgcaaaatgggaagtcagattagggccaaactgttttacacacccacatatttttaagtggaaagatgacatgatcatatctgaacttttaggaagaaaactctgacagcaggctctcagacaaagactaaaaggaggaaaacagaagtggagaatttaataataaaataattcgtaaaaataacagtagtagtagtaggagtaatagtaacaggtctataaccttgcttagaatcctaagagagacttgtgtggtagaattaatagtgaacaccttaagcaaaattattcagaagacgaagaagagtcagaccatgcagagaagccaaaaggtgccaaaagcaaaatccatctttcctaatttacgtaggtcttaaagactatctagagtcttttcccacaactgaaagtgccttagcactaaagaatcatatattgcttagttagcatcctctcagttctcccaaaaaattgttataaaaaatgaacatgtcctttgactcagtaattccatttcattaatacatccaatgaccacaacacaaatatgccaatacctatgtacaaaagttccctgcagctttgagtgtagcaataaaacattaaaaagttagaagtcactttcatccaggagactgaaaaaaatacattctgttacacacacataagacctatatgtactggtatgggaaggtatctaaaatatatcagaagttgaaaatgaaaaacggtaaggtataaaacatcacatatggtattaatcccttgtgtaaaacaagatatacatacatatgtggtgaaagaatccacaagaaattaactgacacaacctcaaggaagtaaaattgaagggtagatgtgaagacattaacttcctcttttgtacccttttgtattatttgaaatttttacaatgtgctcgtgttatgtttttctctataatttatataattaaaaggaatgaagcagttaaaagtacactctagttaaaagtacagataattatgcaacgcaattttagaagatctccatataatactgttaaaattagaaatttgccatccaaggaactaactttccatttcctggaatattaacttatatatatttcttgatttcctaagattaaacaaaagtaagataagacacaatgatcttttcatatgttttttctaatgctgaagaatatccactatttcaacaaacatcatacaattcttaaatcacttgtgatttaaaactaaataccactttttaaagtttttaccttaacagtaaaaagtggcaatttacatttgtatagaactttacaggttacagagtcctctgacacttaccatgtttttttcccacaagaaaacactgatgtaggtaaagcaagtaatatgatattagatcaatttcaggattaggaaactgaagctgagaggagttacacaatgtacccagggtcacagagctaataagtaacaacccaagcactgaagcttggtcttcctgctccacatccaaagggctttccactaaaccacatcactccaaataaccactgttacagcgtgctatggggtcaggcttctgacagggaagaagggctcactacagatctggcaatgacaggcagtctgcctgcagaggaatgtacaatacaaaaataaagtgtatgaaggtgggcctgactgacgaaagggaagtagaactgggagaaatgccaagaagaataacaaaggtgaaaactgggcaacttaccaataagggaagccaaggaaatacctttgtaaacttaatttacttagttaaggtagaagggatagtctatgtaggggactatatattataatgtggaaaaatcataaagtgtttataattcaatcaaaagatttagaaaagatgtaatgaagcgtgatgtgtatgctgtatttaatcagagattacaatgtggcagcacatgactgccatgaaaattttaatggtctaatcccacaatgcatatcctgttaatgttgtggcttagaactttaagaggcaagtgtgaagtacactcagaactcatactcactccatgggacacccgaaataaggagcaaaaagtatcactttctacacaaaagaactcattctcctaagattctagtacagcactgatcattagtacccactcagagtcagaaaatccttgtaagaacgggccagggacaccagaaataacaccaggatcaagccatcctggactaaagagaaccatgggtctttccactgagtactttccaggaaaatcctttagcaaacatttactgctgacctagcaggaacaggctccttgagaaacatcaaccttactgtcccttactgtgacagaaggaaaaaagagatgggacccaaaagctttgactcaatgtcaccagatgtatcttccacagtttaagattcattttgtgagctattttagagtttttaaattattgtcctttattcctggtgtgttttgaagtttagtaaatatatagaaacatctattattttttgccagtctagcactcatttgctcttctcctgctaaacatattctgatttccctctaggaaatcactacttctccattctcagaccatgtatttctggtagtcaagtctaccctagctccagattgaacatatgacctaggtctaagtcaattactaaatcacattgtaatggccacaatgatttgctcagagaagggcacatgacccacgcagaggcacaagattatcactcttttctgctggatttcaactagaaagatataacccagggaactgctggcagacatcttgtaactgagggaagagcttgtgtgagtgaggccaagaaagaggtatcagaacaaaaacatgaattcaagtaattcctctcaccctgaatcaagccatgcacaaactaactttgcaatgagcaagggttatgtgaacaaataaattccctctttggcttgagctggcttaggctgggttttctgtaacttataaccaaaagttgaaactgattcagtaaacttgaagtaaataccaaacaggagaagttcttggaaaagaggtttgtgtaaagcacaaaccactgactaactccagaaatgctagaggttattccagatgtataacagctttagatgtctgatctattttctactttctggcccatcaaaaaaagggatacaataattggcggaaagaaaagtagaataaacatattttttaaaaggaacatgcacagtcatttttttaaagtctcctgctgccttcattttcctactagcacctcccctagctagtttgtcattgtattcatttgcatttgatttctcattttacggaactctcagatgtttcagtttccattcatttttatggcataatcaactcacacaatagttaccaaaaccctttacagaaaaatcaatggtttcgagaaacttggtgaatatgtagcaatttctgaaatacttaaatctcaaaagtaatacttaagcttacatgtaagattttatctgatcattcatcaagcttcatattccaacttcttaacaaccaaaatttctccctgccccctcctcctctcctaggataaagaatacacacattaaattggggctcccaggtatcctggatgaggaaaatactctgggaaaaacagcacagctgttcagttaactcccttctaccctcacaaatctatttcattccacccccctaaagaagagacttgaaaatataaaatatccaaggttataaacaataaaaaaagttatggaatttgtccagaaaaacacaaatcttctgttcaacacaaagtacatacattaggaaaaataactagaatattttaaccattattcgagagggcagagagaggttgtctttcatgaaatctggattgcacatgtctggcaaggaaaaaaaagattaataatctatcacaaagccccacaactagtgattcaaaatgaaagctttcactacttacaccatatgtaaatatatatatatacaagctgcttataatcccttgatctgcagagaaagagaactgatactctactgtgaaaatggtcagtgggtacacattttaaaatcctttcccacatgaaaagattcctgaaaaagagatcagaagacaacagaaaagcactcaatatatatggagttgtaaatccagtatgaaccagtatctattacacaaaggaggaacatgcaacaaagtgattaggaaagtcaaacatgaattaatctaataacacaaaggtaaatataaaccccaaagagcactttattgaacagaaatccacacatatcaaaaagatgtctactattaacaatgacatatcaagcttttaaactccaaattaatcttaataatcaataatgcaaacttgatatgcccttaccaagaaaaaaaagtttgaagaagcacttaacatcaaggcagaacatatacatatttttaaaatataacaaaccaaatgtttaccataaaggctattacatgcaaggtattgattctaagggcacttggataaaatatgctagtatattttgaatagccactgcttgactcttttatttatttggttatttggttatttatgtatttatatgtttattgaggtggagtctcactctgtcacccatgctggagtgcagtggcgagatctaggctcactgcaacctctgcctcctgggttcaagtgattctcatgcctcagtctcccggcagctaggattacaggcgcatgccaacacaccaggccaatttttgtatttttagtagagacggggtttctctatgtcagccaggttggtctcaaactcctgagcccaagtgatctccccgcctcagcctcccaaagtgctgggattacaggtgtgagccacctcgcccagccaccaccgtttgattctattaaagaaactaacactgtacctaaaaatgtgaggtctatgttatggaatgtatactttcttcattaacaacaataattcaaagtaccaaagtaccaatggtgaatactaagattctatccttggttctatagttctctgcattcttctacccaaatacatctggtagatgatcatgtccaaaatgcaaagacacttttatctacctaagtgagatgataggataaggatgacaatgtcaaaagcaaatatatatagggccacttatgtgccaggtgttattctttaaatacatgtaatctttataacaactcatatcttgtcccatatatcagatgaagaaattaagtcacagagaagtttaaaaacttgcccaagttcagagaggtagtatgtagcagagccaggattcaaatcctggcagtctggctccacatttcatgttctcagctcaattctagtcttcagctataattccaatcctttctttccatatcactacttaacctccatatgtttccatttctcatctggaaaatgggtcattaatagttcttacctcatagagttctccaatcctcatgaggattaaatgccataatatacataatgtatttagaaaagtacctggcacataaaagtaatacatatttctgttgttattttatctaccaaatgtctgtcactggagttgagaaccattgttctaaaactgtaacagtgagaatttaccaagcagaatagtcttaatgtgcccttacactggtaactaaagaaaactggactttctcaattattttcaatataaaacaagtccaccaccagccttcaagaaaatatacaaatcatttaagagttgctatcttcagtctggaatttcttctccattattttgtgttccctcacacccacccaatattacagaaatagatctcatcctgataaaggtatatagtgaaaatgtctcttatatatcaaactgaatgtttatacaacttttaagacataaaggccaggtgtggtggctcatatctgtaatcccagcactttgcgaggccgaggtgggtggatcacctgaggtcaggagttcaagaccagcctggccacatggtgaaaccccatctctactaaaaatagaaaattagccaggcatagtggtgcatgcctgtaatcccagctacccgggaggctgaggcacgagaactgcttgaacatgggaagcagaggttgcagtgggccaagatagtgccactgcactccagcctgaacaacagggcaagactccgtctcaaaaaaaaaaaaaaaaaaaaaaacacctgtgtggtattttaatgtaattctcatctatacagctggatgctgggtactcttgaatcagaatactactcccagagtttggcttcacgaaagagctacaaagtgtgaagactgagggaactacaaccatcctttaacccagggactaacgctgatcgacatttaaatatgcttctattaatagttttctgttgtgacaacactcttgcacaggccccactatacaattgtgccaagatttctcaaaagtacagaaggaggaggaaaaccactggatagagcctagagtacatacatattcaacgacaggagattatcaaattactctttgaagtagttgtactaatttaaattcctaagagtatgatagcatatagagtatatataaggcacaagtgagtacaataaatttggaagcatttctatggagaaggtcataaccaagagcagacaaagaagtgatctaccaagtaaaccccagaaggactccaagcttagaaccatagggtagggagagcaagagggaaagggagttcactttttcacggaagctgtaaagaagaaaatggaacaagagttggctccttgaccccagtctgcccctgctcccatgtacatgcagattacatgaattctggcatttatccccagatcaaaaaaaaggggaaagggttcctctctaaagaaattcagggggccgggcgcagtggctcacgcctgcaatcctagcactttgggaggccgaggtgggaggatcacgaggtcaggagatcaagaccatcctggctaacatgatgaaactccgtctctactaaaaacaataccaaaaaattagccaggcgtggtggcagtagcctgtagtcccagctactcgggaggctgaggcaggagaatggtgtgaacccgggaggcagagcttgcagtaagccgagatggcgccactgcactccagcctgggcgacagagtgagactccgtctcaaaaaaaaaaaaaaaaaaaattcaataaaaacctgttgtaggccctttcccttaaaagctagctcccaacccattcaccctaatattatgcctgtcagtcaaaaggcattgtcccagtgcttacggtgagacctgagcagccttccagtcccaagggcaagaccagaataaataaaacaaggaaatccataaccctagaagaaacagaaatgattcaggaaacagacaatagcatttatttaaaaaacgtattattcttaaagcaatttcaaaagcttttctatccatgtcagcatcaatatgttatgaaaaaggaataatcaaaagagttcttgtaattaaaatataactgctaaaataaaaagttcagttagaaaagtcagaaaataaagcaaaataaagcaccccgcctcctccaaaaggcaaaaagacaaaaagagacggataatctaagaggaaaaacaaattcaggagattcaacctttcaataaagaaaatagaaattttccaaagctgaagacagacaattgtttatatattaaaaggaactactgaatgctgagcataactaataaaatggactcacatctaggcacattcttgtgaaatatcagaaacgtcaagataaaaagaaaactccagaaatttccagagggggaaaaaacctacaaataagtaagactctgacagccattagcaacactagatgttagaagataaatggaggaaagtctcaaagctctgagagaaaattattttcactgtaaaattctacgtaggctatcaaccaagcataaaagcaaaataaagacattttcagatatgcaaaggctcaaataataattgaccccttattcttgtatcatgaagaagacagtttaggaagaatacaaaacaaaggtaaaaaccaagaaaacaggaaatatcctttttttaatggtggcactaacccaagagtcaagtgaaaagaaattctaaggatacggctataaaacagacctcaaagcaataagtccacattagaacaagaaatcaggaagctccaaagaaatctcaaagaagaatcacatacatttcaggaaataaatacactgagtaagaagctcaaagatattaccaaagggataaaagatgcatacattgcttttttcaaaataacaaaaaaagaaaaaactcccagaaacagaaaattatataacaacatgatcctaacatagagccatcaacctaaaatgtggcaatgattttgagtaattaattgtgagaaaagtaaatccatttagaccacatgctgggaacattcttctttgggtaacctaggggtacaacactggatatttagagacagaaataaaatttgagcatatcattgtttcctcttccaagatgttctttgccctctcttctctgacttactcatttattcattcactctctcaatatttactgagcacccatcctaggagctaaagataaaacagtgaacgaaaaaagaaaaacacctgcccttttgaagcttatattcaataactcctattctttcaagaatctgctaaagcaggagtccccaacccctgggtactggtccatggcccgttgggaactgggccacatagcagcaggtgagtggcgggtgggcaagcattactgcctgagctccacctcctcctgtcagatcagcagcagcattagattctcataggagaataaaccctattgtgaactgcacatgcaaggaatctaggttatgcactccttatgagaatctaatacctgatgatctgaagtggaacagtttcatcctgaaactatcacccccatccgtagaaaaattgtcttccatgaaaccagtccctggtgccaaaaaggtcgaggaccactgtgctaacggattctctcaccaatgaaactttttctaaattgttaggctatgtgcatctccttttttcctcctaaagaactctaactctttgcaaaacagaatttggctttttacatacctattacctcatctagtgtgtgaagaatgcaagacagcaacatttattagttatttgtacttctagtgaacagcactgggcctaaatcaataaatgtgttttgaacctttccattcaaccaaaatgtaaataaaactgctgtattcatccactctcacactgctataaagaactacctgagactgggtaatttagaagaaaagagatttgattgactcacagttccacaggctgtacaggaggcatggctggggaggccatggagactcacaatcatgacggaagggcaaaggggaagcaaacaccgaattctcatggcacagcgggagagaggatgaagggggaagtgctacacactctcatgagaactcactatcacaagaacagccgggggaaatctgcacccatgatccaatcacctccaatccacctccatgatccaatcacctcccaccaggtccctccccgaacactggggattacaattcaacatgagatttgggtgggaacgtagagctaaaccatatcaactgacaagtaaaatgtaaagcactaggcaaatgttacttattacttaacagatgaggacactgaagtccttgtcagttgaatgatttgctacagaccacaagactagtctgtagaagaaccaaaactaaaacccatattgctgaaagcctgggttcatgccgtttctcctatactaggttgaatgaaaacaagtagtcaaatcaaaaaatgggcctaaatgggaaagaataaccttaggcattttcttagaatgtttttaagtatacaataaacatccaaaatatagactctatttcttccatatgtcaagacatagctttacaattatgtaaagatcatttggaaagcctctaatcaaaaatctaacctatcttttaagagcttcaatttcacagagttatgcatttctactctgcagtatatgtttgaaatgcataaatgtttcgagatgtttaacggcatttaatataatataaattggtttttaaaaaatttcttcatgggaaaccttcaaaacttactaccacaaatatactaaagtttttattcttttaaaacttgaaaacacttgactcctcaaaaaaaaaaagctcatattaccttacacaaacaacaacaaaaagctttttcatgagtcacagaaggcctatggttaaaattatcaagatacacatttttaaaattaagcaaaaaattaaacagacacatatataacttttgtaaaaatcagggaactaatgaaacattctggtatttcacacatgccaaggttactagtaagcatactttttatggcttgtctttggtatatgaccatatttgttcagcaatccacattattaataccgaatagtagccatgcaaattataacttatccacaaaaatataacactgaataaagaggtagggtaattttatattcacaggacaagaagccaaaaaattggctgtttcagctcaacatttatcaaaggcttgtaggtgccaaaagctattctaggcacttggaatatttcaagattaatatattaaaactcctgggcaactgcaactactcttctcccaaacactaaaagctgactaattaaatgtaactcccatatataggataccatgactgggttatctacaaagaagtttcatcaaacttaaaagatagtttaaaatactgtgaaaaaatcagttactgaatgtgaatgatacgaggacttgagctgtgtttgtgagtctgatcacaaaaatcagaaatttaagtcacatatactattttatagagccccaaatacttaaaaaccaaaaggactcaatgaatactaatcttacagtgatttttactcataatgtaaccagaagagtcagagaaacttttatcacccattagaatacaggagttttacctttttcctaattctagtaccactaccattaattaccacaattcgttaccagctcaagtgccaactctgtgatctggcccatgttgagtaagaatcagcacttaaatagacaaaatctctaccctttacaactcagactcagttacaatcactggaatatgtctaattaacccacaacttaattctatgccttcatcttttcctacatgtttcccaaaggaaaagtatagatcagattttgaaggtccttctttaatatctatgctgacaatcagataatttgttttatgacttttaaaatatgtgaagtactcatataactattagcaaactgtcaagcaataaaacataaaaaaaaggccaacagaaacaacaaacagcaaagaacaggcacaaaaagaacatgaaacagccaatacaaatatgaaaagatagcctacctaatagtcaaaataaacatcatcatcacagtaaaaatagcatttattgtgctttctttatgtaagagtgaatatgcaataaacacccaattaattaatcaatgaattactaaatagacaacaaactacctgagaaaataagcaaattttcaaataagaggtaacattttcagctgggccttcatggatgcaaatacactaggcaaagactgggggtagggataacactaaaagaagtgcagaggatgaggcaagggcatacatataatcaccaaaatatgaagccagttcttattctaggagccagttctcattgtaacactgaactggaaagtacctgataaaacagtgacaaggtatgaaactgtacaggaagaaaggaggtaatacataaactctgtttatacatcaggctaaaaaatttgaacttaaatgttttatttaaaagacatgtaacttaattggacttgctctttcctgtgccttttattttcaattttcaaggaaatatttgttcaaaaatagacaatagtcaataattcagaatcaagaacgctttacccctaataagatttctttcaaagacaagcacaattccacacacaaaataaatatgttacttaggtggttctccaagacttactactcttaaaacaaattaaaaatttagaatctattgtcaactccctaaatcatcacataattttgtttcttctctataataaatgaagctcactatatataaatatgtacaaatagaatatgcaaattatacatagacaatatccagaaagtttctaataatgtaatctaaactgtccattactctgagaaagcttactattaatgtggttaatatatgtagtatatacataatcaaatgaattataaagttaaggtctcacatcagaacaggattatgctgtcacaacaacatccatctgggtccacttgagcaccaatccaaccttgttctcaacctatattttatagtttttattaacaatttaaagataagcacaaaacaatttcagtaatcatgtttttatatctttttttagatttataaaggttaaagctgtcaataaagttttacatccacagatcatacatgaattcatttaagtgaatataataataagaaaagtcaattcaagggctctacctgacatacccaaatgaacaagagtaaaaagagatgcaagcaaatgagtaaaccagtatctgagatactcactccaaggaaaaggccccaaacataaagcatgagtttcaaggacaagataaaactcctaaaaagagattaagagaaataaatggggtactaggcaagaataatacaaaatgtcacacaggattattaactggattacaaaaaaggtacatgaatagaaaataaataagcaaatgactaattagtaaaatcaaggaacagggtcagaggagtaacaacggtaaaaactgctatggtgaataacaaaaatatatgagatacagcattcttagatactagcattagccgactagaaaatataacagcaacaaaagatcattcacattagcagtaaaaatgacaaagctcctagaagcaaatcaaatttaaaacgtatataattttctttttcttttttttttagatggagtttcactctttcgcctaggctagactgcagtggcgcaatctcagctcattgcaacctctgccccgcaggttcaagagattctcctgcctcagcctccagagtagctgggattataggcacctgccagcacacccagctaatttttttgtatttttagtagagacagagttttgccgtgttggccaggctggtctcaaactcctgacctcaggtgatccacctgccttggcctccagaagtgccaggattacaggcgtgagccaccgcacccggccgaatgattttcaagaggatttaaaaatgcatttaaatacaaaaaagaagaactgaacacaaagatattctatgatcatgcattggaaaatattagttaacacaaattatgagttaaatgtaattccaatcacaaacccagcaagactttttgtggagcttgacaacttattctaaaacttatgtgaggccagacacggtggctcatgcctctaatctcaacactttagatgaccgggtggatcaccccacgtcaggagttccagaccagcctggccaacgtggcgaaaccctatctctactaaaaatataaaaattagctgggtgtgatagtgggtgcttataatcccagctactagggaggatgaggcacaagaatcacttgaatctgggaggcggaagttgcagtgagccaagatcacgccattgcactccagcctggggaacaagaacgaaactccgactcaaaataaaataaaaaataaaataaataaataaataaaacttataagagagatcaaggaaaacaaagacaagggaattgcatcccaaacatcaagcacgccaccatataattaagaacatatttctggatccgggagccaagatggctgaataggaacagctctggtctacagctcccagcgtgagcgacgcagaagacgggtgatttctgcatttccatctgaggtaccaggttcatctcactagagagtgccagacagtgggcgcaggacagtgggtgcagcgcaccgtgtgcgagcctaagcagggcgaggcattgcctcactcgggaagcgcaaggggttcagggagttccctttcctagtcaaagaaaggggtgacagagggcacctggaaaatcgggtcactcccacccgaatactgcgcttttccgacgcgcttaaaaaacggttcaccaggagattatatcccacacctggctcggagggtcctacgcccaaggagtctcactgattgctagcacagcagtctgagatcaaactgcaaggcagcggcgaggctgggggaggggcgcccgccattgcccaagcttgcttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgaacagctttgaagacagcagtggttctcccagcacgcagctggagatctgagaacgggcagactgcctcctcaagtgggtccctgacccctgaccctggagcagcctaactgggaggcacccccaagtaggggcagactgacacctcacacggccgggtactcctctgagacaaaacttccagaggaacgatcagacagcagcattcgcggttcatgaaaatccgctgttctgcagccaccgctgctggtacccaggcaaacagagtctgtagtggacctctagcaaactccaacacacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacaatcaaactactccaagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagacgaaataaatgaaatgaagcgagaagggaagtttagagaaaaagaacaaaaagaaatgaacaaagcctccaagaaatatgggactatgtgaaaagaccagatcttcgtctcactggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttaaaatgaaggaaaaaatgttaagggcagccagagagaaaggtcgggttacccacaaagggaagcccatcagactaacagctgatctctcagcagaaactctacaagccagaagacagtgggggccaatattcaagattattaaagaaaagaatttttaaaccagaatttcatatccagccaaactaagcttcataagtgaaggagaaataaaatacttaacagacaagcaaaggctgagagattttgtcaccaccaggcgtgccctaaaagagctcctgaaggaagcaataaacatggaaaggaacaaccggtaccagccactgcaaaatcatgccaaattgtaaagaccatcgaggctaggaagaaacggtatcaactaatgagcaaaataaccagctaacatcataatgacaggatcaaattcacatataacaatattaactttaaatgtaaatggactaaatgctccaattaaaagatacagactggcaaattggataaagagtcaagacccatcagtgtgctgtattcaggaaacccatctcacaagcagagacacacaaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtagagggatcaattcaacaagaagagctaactatcctaaacatatatgcacccaatacaggagcacccagattcataaagcaagtcctgactgacctacatagagacttagactcccacacaataataatgggagactttaacaccccactgtcaacattagacagatcaaccagacagaaagttaacaaggatatccaggaattgaactcagctgtgtaccaagtggacctaatagacatctacagaactctccaccccaaatcaacagaatatacatttttttcagcaccacaccacacctgttccaaaattgaccacatagttggaagtaaagctctcctcagcaaatgtaaaagatcagaaattataacaaactgtctctcagaccacagtacaatcaaactagaactcaggattaagacactcactcaaaaccactcaactacatggaaactgaacaacctgctcctgaatgactactgggtacataatgaaacgaaggcagaaataaagatggtctttaaaaccaatgagaacaaagacacaacataccagaatcgctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcgaaccagaactgaaggaaatagagacacaaaagactaatgaatccaggagctggttttttgaaaggatcatcaaaattgatagactgctagcaagactaatgaagaaaagagagaagaatcaaatagaagcaataaaaaatgataaaggggatatcacgaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaacaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaattctcccaaactcattttatgaggccagcatcatcctgataccaaagccgggcagaaacacaaccaaaaaagagaattttagaccaatatccttgatgaacgttgatgcaaaaatgctcaataaaatactggcaaaacgaatccagcagcacatcaaaaagcttatccaccatgaccaagtgggattcatccctgggatgcaaggctggttcaacatacgcaaatcaataaacgtaatccatcacgtaaacagaaccaacgacaaaaaccatatgattatctcaatagatgcagaaaaggcctttgacaaaattcaacaacgcttcatgctaaaaactctcaataaattatgtatcgatgggacatatctcaaaataataagagctatctatgacaaacccacagccaatatcatactgaatgggcaaaaactggaagcattccctttgaaaactggcacaagacagggatgccctctcaccactcctattcaacacagtgttggaagttctggccagggcaattaggcaggagaaggaaatcaagggtattcaattaggaaaagaggaaggcaaattgtccctgtttgcagatgacatgattggatatctagaaaaccccattgtcttagcccaaaatctccttaagctgataagcaacttcagcaaagtctcaggatacaaaatcaatgtacaaaaatcacaagcattcttatacaccaataacagacaaacagagagccaaatcatgagtgaattcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtattttatagattcaatgccatccccatcaagctaccaatgactttcttcacagaattggacaaaagtactttaaagttcatatggaaaaaaaaaaaaaagagcccgcatcgccaagtcaatcctaagccaaaagaacaaagctggaggcatcatactacctgacttcaaactatactacaaggctacagtaaccaaaacagcatggtactggtaccaaaacagagatatagatcaatggaacagaacagagccctcagaaataatgcttcatatctacaactatctgatctttgacaaacctgagaaaaacaagcaatggggaaaggattccctatttaataaatggtgctgggaaaactggctagcgacatgtagaaagctgaaactggatcccttccttacactttatacaaaaattaattcaagatggattaaagacttaaacgttagacctaaaaccataacaaccctagaagaaaacctaggcattaccattcaggacataggcatgggcaaggacttcatgtctaaaacaccaaaagcaatggcaacaaaagccaaaattgacaaatgggatctaattaaactaaagaacttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaagtgggcgaaggacatgaacagacacttctcaaaagaagacatttatgcagccaaaaaacacatgagaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgggaatgtaaactagttcaaccattgtggaaggcagtgtggcgattcctcagggatctagaactagaaataccatttgacccagccatctcattactgggtatatacccaaaggactataaatcatgctgctataaagacacatgcacacgtatctttattgcagcactattcacagtagcaaagacttggaaccaacccaaatgtccaacaatgatagactggattaagaaaatgtggcacatatataccatggaatactatgcagccacaaaaaataatgagttcatgtcctttgtagggacatggatgaaattggaaatcatcattctcagtaaagtatcacaagaaccaaaaaaccaaacgctgcatattctcactcataggtgggaactgaacaatgagaacacatggacacaggaaggggaacatcgcactctggggactgttgtggggtggggggtggggggagggatagcattaggagatatacctaatgctaaatgacgagttaatgggtacagcacaccagcatggcacatgtatacatatgtaactaacctgcacattgtgcacatgtaccctaaaacttaaagtataataataattaaaaaaaacatatttctgttgcagaagcaggcaaataaatctctgctagaacagacagaccaaatatagagacaaatatatacataactttagtaggacaggcttataagccagttaaaaagggatagaaaattgtgttaggacaattagatttccacacagaaaaaaaaaaaagtgctgtatacccctatctcctatcatatacagaaataaactccagctagattaaagatgtaggtaaaaagccagcctattgcaagataagagtgacaccatttcaaagcaaaaccaccataatgacaggagtttggctccagcagcaaggtctttaaacaatgcctgtagcatagacaacccctcataaagatgtttatctaacctctccagtggtcatgagtagcaacaaagtctgaggtgtaaccagctgcatatgttttaccaaaaaagcttgctatataaaggatattttcgggagggtggatgtgggaatacaccacctcttggccacccaaaacattatttctgtttgttagtctgtaataaatgtttttttataagaaactggatttgtcagtgtctttcttcagctctcagctcccttagcctttgggggtagctttgcatatgtttgctcatagcagaacagaactgctaataacaaaacttgtactatttgaaagagttccacttctggtagtgataaactagataattcagaccactctcctgcttaaagaactaaaatgtctggagaaaatacatttaaaagtctatgttaaggctaatgaagacacacgagcagtgtattttgtctgaaaacaaaatattaaaaaaagaaaaaagaagaggtaagcctagcaataagggctgcttttccccaagaggcatctatcaattatggaacagaggccaagaggctaataagcagagcagaccttttgactgacttacaagatgagaaggtcaaagactggaaatcaaaacctaccgagaaactgagaagccctataatgccaaaggaccatatcctagatgtaaaggaggatcaaccctcaaaagtacagtcatgtgtcacctgacaacatggatacattctgaaagacatcattaggcaacttcatcattgtgtgaacatcacagagtgtgtttacacaaacctagatggtatagcctattgctcctaggctacaaacctgtgtagcatgttaccgtacagaatgctgtaggcagcagcaacacaatggtaagtattcgtgtatctaaacacatctaaacatagaaaaagtacagtaaaaatacgatactataatcttatgggaccacaattctacatgcagtccatcattgatagaaacatcattatgtagcacataactgtactgaagcccagattcaaattatctctaaccccaattgaattaagtgatccaggattgctagttctagccaccagatagaaacaaaaaccttaagtaaaatacgtcaacattcagaagttcaaataacctctatcacgttttacgcaatgtctagcactctatcaaagatcacaaggcacagacaaaaacaataaaaaacaagagaaacaatataaaatagaaagagacccacaggagattaacatttaaaagattagcagacagaattagactataattaatatgttctaggatatgagcctaggcagcgaagtgagaccctatctcttcaaaaaatcaaaaaaattagccaggcatggtaccacacgactgtggttccagctactcaggaggctgaagtgggaagatcacttgagcccaggaggccggggctatagtgagccatgatcacaccactgcactacagcctgagtgacagagcaagaccctgtctcaaaaataaaaataaaaaataaaaataaattatgttcttggatataaaatacaagatttctggataatatctttaaaaggctaaaaggaatcactaacctagaattctttacccagcaaatatactgttcagaagtgaagtgagggtcagacatggtggctcacatcagtaatcccagcactatgggaagccaaggcaggagaattgcttgagaccaggagttgaagaccagcctgggcaatatagccagaccccatctctacaaaataaaattgttttaattagccaggcatgatggcatgctcctgaagtcctagttactcaggaggctaaggctggaggatcgcttgagcccaggaattcaaggttgcagtgaactgtgatcacaccactgcattctagcctgggcaaaagagcgagaacctgtctcagaaaaaggaaaaaagaaaacatgaagtaaaataacaacattttcaccaaaaaaaaaaaaaaaaaagacattatcatcatacccaccacacataaggaaatactaacagatattcttcagacaactgagaaacacagaaagaaataaagaacaataaaaagcataaatatatgagtaaatataaacatttgcaatacaaaataagaataacaatataaaataacaagaattccatgtgctatttaaaatgtatacagaatttaaagaaacaaagcagatcacaaaaaaaacaacagaccatacaagctcttaaaaacaaattgccatattcttaggaaaagattgtttcatgaccatgaaaacaattactagagtgagttttacacctgtttaatcaaagacgactgttagactcgtcaaatttttgaaagccagtcagtcagtaatagtcatgcttctgaaattcagacaatcaagagttaacactctagtgaacaaaggcctacaacatccagatattttttaaataggatgttacgtatctttatattattaaccttaacaataatggtactctttttggataataaataaatgaagaaaaatgtccttgcactagaaaagaaagatacaaatattcttgagacttaataggagctgtcatcaaggcaacactcagaaacaatatacctacagctcctgatcaatctcttgtgcagctctgggttccttttcatatatggaaattagactcttaccatgccatcccagaacccagggtacctgttgtgtgagcgtaacaactatgttattccaagtgtacaactccccaacatgctcagtggactgtgtcttataacaaagaatatgaatggataaaatctttcctttgataactgacaaagagttttctgaagataatgatctgatccatacctatctttaagaactatagtatgtcttcacagttgtaattattggcaacaagcattaaacttcttggatcaaatacttcatatctactcaaaattgtaacattaacacttaaaactaagaaaatagagatgtttaaaattttccatttcacacactacttcatattcctacctgataactttaaataccaaatgcactgagtttagccctgaaatgagtttaaaacaattctctaactgggatataattactttccactgaagcatttttctgccactcaagaatcatctgatttacataaatgctagttaagcaccatagaaattctaaaatatatcattagcagaatgtcacagatcacttaatctactctgtcaaaacagggattatttcaacttctgtttcacttcccttaaaagaaatcctatttactttcttttctctaacagggaaaaaaaattagtaaaataaacttacagtgtacttcccaaatcaaactttaaaatgattctggttaactacaaattgactgaagtattttttctgaatgtattttactgaaacatggctgacaacatataataatgttactgctacagaattacaaattatttcactgattactcttcctattcaagaaaaaaaggtcactttggtccatacaaattgtccaaataaactagatgtattactagcttaaagtaaacaattttgtaaatagcacttctagttagagttaaaacataaccataaaaagcttttattaaacaatacatttcactaagctaaatttatagaaatatatatatttctatcactttcacacatcctgacaatatttgggaaaataaatacaaaaatgtttttttttaattcagaagtatataatttcttcaaatattccagccataaattataatacataaaatttaagatacgtaaataccatgaatattataaactttaaataaaattctagccataatttatgaaactcacattattaaacaacacacacacacgctgattccaaatgaagaagagaagtaccatggtagtttctctgtgacacaccaaaaattatcctaataaataaattaaacaatcatgtaattcctaaatttgttacagaaagatatgtggctggttctcacacctcctactagatatctttacaccacttaaaaccttttcttttttcatgctattattttctgtgtaacaaaataccaactagtcagattctaaaatatcaatctttagaaatgatattagcaaaacaattttaaaatacttactgtcttgtttcgtaatctaattatgtctgagacagagccagcgccacagtactccataacaatccagaggtctgtattcttaaaataactgccatagtactttacaacatatgggctaaaggaaaatacataaacaattaaatttagttaattcccaaagaaatttttttcttaatcccaatacaaagtattttcaacatttcatactgttccaataagttaaataagtaaatttctattgcacatcaaattctcaatatctggagttcaccaactatgcataattaggctttacttcatggacgaaatttaacaggattacaaaccagaagaggcccaaatgttttgagtgattctgaagaaaataagacttcattttggcaaagaacttactacttaacatgaggaacaaatgaaaatttttccctttaactaaagcattttaaatatgtcttctaaaggattttgcattcagtcaaatattaatcaactcgaaaataatctatatttccatgaggccaaaaagttattttaaattttctttcattctggcttttgaaaattctagagaaaaaaaattataaatttttctgcttaaatttatagaattaaaatattagcaatttaatttctaaactgaggtcttacgtcttccagagcagaataaactatgtttatagccaagctgtcttcaggaagatttagaaagggacaaatgaccatcagcaataatgtatattatggataaactacatatagtgatgtatgagaaatctaacctatctcaaagaggcagaatatcatattcaaaaaatgcatagagatagaaaatacaagacagcagaaactaaataggacacaactttaatgctacaagagctcaaatgaggaaataacattggaatcatccaaagagaactttgtggaagggagtgggatttgaatgagattttgaaagaaaagtttaaactccaaaatgtagatggagaagagggataagaaaattctagaaaagagaaagaccatgaataaaggtacacaaatagaaagggaaaaaccaagtatggcatgtaagaggacaacttgttcaaataaatacttctatctagtaatagctacaatcaaaaacagtagccattttgctgggcacaaatgtaagataaatatgacagaaaaacaaataagcaaaaaaaaaaaaaattgaaagtacaataaaagaacacgtagagactctatcaattgtggaggttaagagaagactgtcagggaagacttctcagtacagcctttaaaattttagctatgctctaacactgaggcagtaataaacagcctaccatccaaaaaaaaaaaccacccaggaccagatggacttagggccaaattctagcagatgtacaaagaagagctggtaccatccctgctgaaactatttcaaaaaattgaggagaaggaaatgctccctaactcatcctatgaagccagcatcattctgataccaaaacctggcagagatacaacaaaaaaagaaaactttaggccaatatccttgatgaacattgatgcaaaagtcgtcaacaaaacattagcaaaccaaatccagtggcacataaaaaacctaactcaccacagtcaagtaggctttctctttgggatgcaagattggttcaacatatacaaatcaataaatgtgattcatcatataaacagaactaaagacaaaaaccacatgattatctcaatagatacagaaaaggctttcgataaaatcagacatccattcatgttaaaaactctcaacaaactaggtattgaaggaacatacctcaaaataataagagccatatatgaaaaacccacagccaacaatcatactgaatgggcataagctggaagcattccccttgaaaagcggcattaagacaaggatggactctctcaccattcctgtttaacatagtattggaagtcctggcaagggcaatcaggcaagagaaagaaataaaggtcatccaaataggaagagaggaagtcaaactacccctgtttgcagatgacatgatcctgtatctagaaaaccccatagcctcagcccaaaagcttctcaggctgataagcaacttcagcaaagtctcaggatacaaaagcaatgtgcaaaaatccctagcattcctatataccaacaacagtcaagccgagagccaaatcgggaactaactcccattcacaactgccacaaaaagaataaactacataggaagacagcaaactagggaggtgaaagatctccacaaagagaactacaaaacactgctcaaagaaatcagagatgacataaagaaatgggaaaacattccatgctcagggatagaaataatcaatatcattaaaatgaggctgggcactgtggctcacgcctgtaaacccagcactttgagaggatcacttgaggtcaggagtttcagatcagcctggccaacacggtgaaacccccatctctactacaaatacaaaattagctgggcatggtggcgcatgcctgtaatcccagttacttaggagggtgaggcaggaaaatcacttgaactcaggaggcggaggttgcagtgagctgagattgtgtcactgcactccagcctgggcaacagagcaagactccatctcaaaaaaataataataaaaaataaaaaaataatatataaacacacacacacaaacacacatcattaaaatggccatactgcccaaagtaatttatagattcaatgctattcttactaaaactactatttgagattcggcacagaactagaaaaaactattttgaaattcatatggaaccaaaaaagagcccgaatagccaaggcaatcctaagcaaaaagaacaaagctggtggcatcacactacccgacttcaaaatacactacagggctacagtaaccaaaacagcatggttatgatacaaaaaaagacatacagacaaatgaaacagaataaagaactcagaaataagaccacacaactacaactatatgatctttgacaaacctgacaataacaggcaatggaaaggaaaaaggattccccattcaataaatggtgctgggataaccagctagccatatgcggaagattgaaactggacccctcccttattatcatgttcaaaaatttaactcaagatggattaaaggcctaaatgtaaaacccaaaaatataaaaaccctggaagacaacctaggcaataccatccaggacataggcaaagatttcacgacaaagacacccaaagcaatcacaacaaaagcaaaaattggcaaatgggatctagtaaaatcaaagagcttctgtacagcaaaagaaactatcaagagagtaaatagataacttacaaaatgaaagaacatttttgaacaaactatgcatccaataaaggtctaatatccagcagctataaggaacttaaacagatctacaagaaaaaaaaaacaaacaaccccattaaaaaatgggcaaaggacatgaacagatacttttcaaaagaagacctacatgtggccagcaagaatatgaaaaaaagttcaacatcactgatcattacagaaatgcaaatcaaaaccacaatgagataccatgttacaccagtcagaatgactattattaaaaagtcaaaaaaaaaaaaacagatgctggcaaggttgtgaagaaaaaggaatgcttatatactgttggtgggagtgtaaattagttcaaccattgtggaagatagtgtggcaattcctcaaagacctagagacctagagacagaaataccattcaacctagcaatctcattactggatatatacccaaaggaatataaattgttctattataaagacacatgcatgcttatgttctttgtaactagcactcttcataatagcaaagacatggcatcaacctaaatgcccatcaatgatagactggataatgaaaatgtggtacatatacacaatggaatactatgcagccacaaaaaagaacaaagtcatgtcctttgcagagacatggatggagctggaggctattgtccttagcaaactaacacaggaacagaaaaccaaatactgcatgttctcacttataactgggagctaaatgatgaggacacatggacacacagagtgaacaacacacactggggcctatcagaaggtggaaggtggaaggagggagaggatcaggaaaaataactaatgggtactaggcttaatacctgggtgataaaataatctgcacaacaaacccccatgacacaagtttacccatgtaacaaacctgcacatgtacctctgaacttaaaataaaagttaaaaataaataaataaataaataataaaaacatcagtcatctaaaaaacaaaagtttaaaattttcccattataattaaattttatattaaaaacaaaggcaataaatacaaaaaaaaataactatgtcttgaagtcaaaggtagaacagagtggttggagctgaagggcctgaattcaaacctgttttatccccactgctactccgttacctcttgcacagacttgctccccactggtctccttgtcttagttttctcccctgttctagtctatgctacatacagttgacaaggtaccttactttaaaacaaaagtaaaacaagctgatcatactgctctcctagttaaacaaaaatactctaacagctctccattacccaaaggaaaagctcttaactgcttcatatcgcatacaagttatttcagagtctaccttgttacccgtatctctgattactctccatctcataccttaaatttccagacacactcagctttgctaggtcttgggaattgaaagtatgtatttggagttcataaatgttcactgaaccatttaagaaaagtgcttgtttacaaacaaatgaaactaaatacagacttagaactgcaacatatgagaaacaaaaaaaaaaattctttacatgtactcctttaaggtatggcgcctatgtggaaacttttatagggagtagcgttcctacacctggctgtgcatgagagccacctgtgacccaagcccacactcctttgaggttctgattcagtaggtttttaaaagctctaccggtgactctgacatagacccagagttaagcttcactctaccagtgaatagactgtatatccttcaggggaaaaaaaaaaaactctctctctctctctttttttttctgaagcagaatctcattctgccacctaggctggagtgcagtggcaccatgtcggctcacagcaatgtctgcctcctgggttcgagtgattctcgtgcctcaacctcccaagtagctgggattacaggcctgtgtcaccacgcccagctaatttttgtagttttggtagagatggggttttgccatgttgaccaggcttgtcttgaactcctggcctcatgtgttctgcctgcctcagcttccaaaagtgctgagactataggtgtgaaccaccatgcccgccaaaaaaaaattctttaaatatgaatgttctcattcaaaattttgaaaagtgttaagtaacaatgaattgacgattatgttcactgaaaagcatacaaaaaaatgtacatttttcttgccatacacactaatcagcaatgctaagggtagaagtgacaactcatgaaaattaggaattctaacctgggcagccacctgaaaacacagccctatctctccataagagtaagtcaagagaaaactttggcaaaacgtaaaattctcttcaaaaaaataattcatggcccatctaacacccacgtaagtagatggatccaagtccaacacctctataacataaaacatggcctcactaactttaacccagcaaagtatttaagcaactagaactaaacagccacatgcattcactgaccctctactcgggccaggcatttcaccagatgttcagtatgcactagtgaaacacacattcacaatttggaccctcataccgaatacactagcatgaatatacaggaattaaggaagtaaactcacaaataaatatgattactaaccatggcaagaaaagaagaaagggtgctataagataaactggctgtgactttattttgtattcaccatttctgcaaataaaattgctcctagttcatatgaaggaatggaatgcattcatattccatggtagcctctgagacttggaaggcactggagtatgtgaaaaacctttgaaagcagataagtgagctttaacaataaaatgtcctttctccactgaactgctgtgaattacaaaatccacagattggaaaagaaagaaatgcttaaactccagagttcatatgtatacagtggccatcctctgacactttctaagtcagcaccttttatactgtaaagcacttattacatcctgcaaggactttgtcattgacttttatctgcctcccccagaagaacagaagctccataaagataggtaccaatctgtctcgctttccattttatcctcagtagctctcttctcctatatacaaactaaagaagcaggccgggcacggtggctcatgcctgtaatcccagcactttgggaggccgaggcaggcgaatcatgaggtcaagagatcgagaccatcctggccaacatggtgaaaccctgtctctactaaaaatacaaaaaaaattagctgggcgtggtggcaggggcctataatcccagctactcaggaggctggggcaggagaatcgcttgaacccgggaggcagaggttgcagagagacgagatcgtgccactgcactcctgcctggcagaagagtgaggctccgcctcaaaaaaaaaaagaaaaattaaaattaaaaaataaagaaagaaagaaaagaaccaacgaataaataaatcacacaaaaaactaagacaggacctaatttaggactctccaagggaataatatttaagctaagatgcaaaacttaacgagaagttagccagataactaagcactaagaactgccctgcaaaggccctgaaagacagaacaaatcacggtcaaagaactgaaagattagcgggcccaggataaagtgagtaaaggatacagtagaacataatggagttgcatatgtaggcagaagcctgaccatgaagggcctcaaaaccaaggtaaagagactgggctttatttgaaatacagaaaaaaaaatcagtgaagaattttaagcagacgaataacatgatgtaaagtttctgtggttgctgaatgaaagctagattgtagggaagcaaatgtgaatacagagagaccaattaaaaagtaatgttagtccatgcagagattatagtaagcatatctttttattttctgtattcttgatgctttggtatctgggaccttgctaaaactgaagcgactgcccctctcagggtaagctaattcctagagacagcaaactaactcccatggaaggatgtctttcatatgcacaccaacctatctaaagcccaaacctccaaccacctctatggttacactctagggtcaacttttcacctgcccaaattgccccagggccaggtaccagacaaccagagaaagccctatgccccagaacccactcaaaatactcaaagtagccaatcctaaacctgtttaccctatctcacctgtcccttcccagggaaaccacacaaacattcttgtccacttcttcccccctctttctctgcctcctaactgactctggtacttccccgtggagcccctgtgacacagcacgcctccttctcttgtgagctgtatatataacaatatatcttttccatagcaatagtctcttgatctgttggcctcatgatatgtgagtaataataaagcatactttttttttttgagacagagtctcgctctgtcgcccaggctagagtgcattggcgcgatctcggctcactgcaacctctgcctcccgggttcaagcgattcgcctgcctcagcctcctgagtagctgggattacaggcacccgccaccatgcccggctaatttttgtatttagtagagatggggtttcaccaggtcaggagttcgagaccagcctgaccaacatggtgaaaccctgtctctactaaagatataaaaaattagccgggcctggtggcatgcacctgtaatcccagctactcaggaggctgaggcaggagaatctcttgaacccgggaggcagaggttgcagtgagccgaggtcgcgccattgcattccagcctgggcaacagggcgagactccatctcaaagaaaaaaaaaaaaaaaaaagcctaccaataggctcagacagttcaagacctgagacttctaaactcaagtctatttccattaacacagatatgcattcaaattcacatttatttatctttttttttaagtaattcaaacaacaaatattcactgaacaagcctactagcagaagctagggagaaaaatggaaaaacattagactagtgacaaagaagaaagggcagtccaggcaatggggaacccctgaagaaatttatataaggaaataatacaatcaaactagcatttaaacattatcctgagcaggattgtcaaggatcaaacatgatgttgttcattctagccagcaagttaactaactacaattatttagatgttctaacatctgtttttaaaccagcatgttgattattaaaggttagggaagaaggggagagagtttcactcaaaacactgtaacactctagtgttatatacaggcaaatctataagatattgcaggtttgattccagaccacctggataaagcaaatatcacaatacagtgagtcacacaaatttttgttttccagaaagaaaccttggatcaggcagattcatagctgaattttgctaaacgtataaagatgagctggtaccaatcctactgaaactattgcaagaaagctgaggaagagagactcctccctaactcattctacgaggccagcatcattctgataccaaaatgtggcagagacaaaatgaaaaagaaaacttcagaccaatatctctgatggacataaatgcaaaaattctcaataaaagacctgcagaccaaatgcagcagtacatcaaaaaactaatccaccacgatcaagtaggctttattgctgggatgtaaggttggttcaatatacacaaatgaataaatgtgatttgccacataaacagaggagattttgcaaaattcttgagggtcctaagatttttggaatgggcaatgaacactggcttcaacttaaagtcatgagaggcatcagcccctaacaagagagtcagcctgtcctttgaagctaagcagtgacttctctctagctaggaaagtcctagatggcatctccttccagtagaaggctgtttcgtctacattgaaaatctgttgcttaatgtagccaccttcatcaattatctcagctacatcttctggataacttgctgcagcttctatttcagcacttgctgcttcatcttgcacttttatgttatggagacagcttctttgtttaagcctcatgaaccaacctctgctagcttcaaacttttgttgcttcctcacgtctctcaaccttcatagaattgaagacagtaagggcattgctcgagattaggctttggcttaagagaatgctgtggctggtttgaacttctatccagaccactcaaactgtctccatatcagcaatgaggctcttccactttcttaccactcatgtgctcactggagtagcacttctaatttccttcaacaacctgtcctttgcattcaagcttggctagctgtttggcacaagaaccctagctttcagcttatttcggctttcaacctgtcttcctcactaagctaaatcatttctagcttttttatttaaagtgagagttgtgtgactctccctttcacttgaacccttacggaccattgtagaattactaattggcctaatttcaatattgtgtctcaaggaataggaaagcctgaggaaaggaagggagatggggcccacggcctagcagtgggacagtcagaacacacacgacatttatcaatttagttcaccatcttacaaaggtgcagttcgtggcacctcaaaacaattacaacagtaacatcaaagatcactgatcacagatcaccataacagatataataataatgaaaacgtctgaaatatgggaaggattaccaaaacatgacatagagacatgaagcaagcacaaactattggaaaaatggtgctgacggacttgatttgctcagtacagttgccacaaaccttcaattaaaaaaaaaaaatgcagcatctgcaaagtgaagaagtacaacagagtaaggtatacctgtatataaattttaagcaatgcagaaagttttaattcagccatatgcctaagaattttgactaagccagtatatggacttgcaggttgtatcagaacccagcaattctatacacagtcatccctcaatatccatggcgaactggttccaggaaccccacagataccaaaatccatgaatgcacaagttccttatattaaatggcacagtatttgcatataactacatacatcctccagtatactttaaatcatgtctagattacttattacacctaatacaatgtaaatgctatccaaataattgttatactgcattggtttttttttttattgtttttttctattgctttttttctcccaatatttccaacatgcagttagctgaatctgtggatgcagaacaagcaggatacagagggctaactgtagttttgttacattttttatttttattttttaagagacagggtatcactctgtcacccacgctagagtgcagtggcacaatcatagctcactgtagcttcaaactcttgggctcaagtgatccttccacctcagcttcccaagtaaccgcaactataaacatgcacacacccggactaattttttttattttttgtacagacagggtctcactacgttatccaggctgctctcaaattcctggcttcaagtgaccctcctgctttggcctcccaaagcactggaattacaggcgtgagccactgtgcctggctagttttgtctcttttaaagaggagtaagcagctatgtctttgaaaatttcactgggtggaagaaccaggaaaacacaaaggaaattacagactacaccaggaagcagaggtgaaatatgatgccttaataactagcatgccaatcatgagccacattctatgcctttctcttatgcatcttctctccatttcatcctcctgtctcattaattttttccttcccctatttaacgccttcaatccaataaaatgacgtatcttgttctcgttttcttttttttgagggggtggggggcttctgggcttcctctcatctcatacctaatgatcacatcctttccatttccatcttcactttacagctccctacactctttatcctaatggtcctcctctagtatcacaactcaaaatagaaagagtattaaaaaaaaatgagaaaaaccaaaggggaaaaatggaaaaaggactacatactcctatctaattgtaccttacttaaacactatgcatgatacaaattatacggactgaatcattacgtttaagcttcttataaaaatccaaatgttctattcataacacccaaaatatggaatcaatctaagtgtccatcaacaacatcatataattaaataaagaaaatggaatactatttgaaaatactgcttgaaaggtgactttttctttttttttttttttgagacagggtctggctctatcacccaggctggagtgcagtggcatgatctcaggtcattgtaacctctgcttcctgggctcaagcaatcctcccaacctcagcctcccaagtagctgggactacaggcacgtgccaccatgcctggtgaatttttgtattttttttagagagagagttttgccatgttgttcaggctggtcttgaactcctgagttcaagcaatctgcccacctcggcctcccaaagtgcaaggattataggcatgagccaccacatacaatcaaaaggtgactttttaaatagtaacttgaatttcattctaattgaagaaaaccatatatagctaaaggtatactttttaaaagtcttcctaatatgagcatgtgataattaaaatactaaagaaatggctatttttaattacatcattttcatcaacatcttactataatcttagtagtgttctataacttagtatggtaatacagtgtttttacaaaggcaatgtggatattctattaaaactgagctgtttccagcataaatctcaatcacacagcaatttatttcttggcccacccaaaactgaatatacaaattgccaaagttcaaattgctgatacaaattgccaaagttcatcaataatcctccaacatggtgattttgaaacttttgattttttatttatttatttatttatttatttgcctcagaaacagtgttcaaatggaatcttatctagaaacatgaggaaatagaacaggtaagaatgtagaatactctggtagaagccaaggggtgctcagtgacaccctgaacaggccagctgaaaatgctctatttcaccataagagttatctcttctctttgcccagcaaatctaactcatcaatcaggactcagctgaggtatgacctccctgggaaaactttccctgaacctccaaacatgaggtgttagatatctcttccaacccacatacttccccatatctatcccatcacagctgttaccacactgtgtactgaaacagcctacccattcgtctgtttcttccagctgagtgaaagtctctctaaagcctcaaacccattcttttttgtttcttttttttgttttgttttgtttttgagatggagtctcactctgtcacccagactggagtgcaatggcacagtcttggctcactgcaacctctacctctcgggttcaagtgattctcctgcctcagcctccccagtagctgggattacaggtgcctgccaccacgctcagctaatttttgtatttttagtagagacggggtttcaccatgtttgccaggctggtctcaaacttctgaccttgtgatccacccgcctcagcctcccaaagtgctgggattacaggcgtgagccatggcacccggccgagacccattctttgttgtatctcttgtgagagcacatcaggcctacacttaggagtaggtggtactcaatacatactagttgaacaggtaaaaaggggataagtgtgtgccctgattcataacaacatatttatctttgtttagatatgaaaagttccttctctgcatataagcaccaggagggtagggactatgtcagttgtgattaccttgtgtacatattacctgccacatagtattgctaaccagctgttgcctctactcctaggaatgccttgagagtgcttcactttgaactgttggaatctttttacaggcattgctttcttcaacactggccctgaagtagggtaaatgtgggttcttattgcatctcagtcactaactagcagtgtgattttgggcaattcatgtaaaagctctaggtctcattttctgtatctgcaaaattgtttttaaatatgctttagcactagaagacttttcctcaaataaaaatttcaaaagagtcccatatataaaaaagataaaagcaataatgaggttctcattctactcaattcttcagtgaagaaaatgcccctagaagtaccttcttagagcagggtatgatttgaaaacactaaactagctgacccacagaagttgaatctagcactaatattctatgatttatccatttaataaatactcattaaatgtatactctgtacctggtactgaactaggcactgcacattcagcaataaacaaagcagatgggctccctgagatatttatgctaacatgtagtattcagcccattattaaatattcacttaaaatgaacaaaaaaagattaaaacaccacctctggtccttttatagagtatagaaaacaagacaatttaccaaattcacaaatagctgaatgtattaagaaaatagttaaatttcagaaatgcatatctcattttccctatcaaaatttcagtgtattatttgggaatttttcaattcatactgttttcttccaatcatttttatgctaatttcttaataacacatttacattaatactagttattggtagctaaaatctaagtttctccctgtcatttcctaattgtttttctttttcttttttttttctttttgagacagagtctcactctgtcacccaggctggagttcagtggtacaatctcagctcactgcaccttccgccttccaggttaaagtgattctcctgcctcagcctcccaagtagttagaattacagtcacctgccaccacgtccagctaatttttatatctatttagtagaaatggagttttgccatgttggccaggctggtgttgaactcctgacctcagatgatccacccacctccgcctcccaaagtgctgagattacaggcgtgagccaccatgcccggccctaatttattttttactagtcctatcttttagcattttaggatcttttaaccaactaattttttgatccttcgcaacttcatacttacaatatgaatttgacagtaaaatcttaaaaggcagaaaccatttttcatcaatatttgcctcagcatttatttcattcaacaaatatttgagaagtacctactatgtgcaaggcattctgctataaagtggtacaaaagttctagaattctataacatttccttctcattgtattctttacttttctttccctttaaaagcttaaagtgcataacaagaataagtacctgatttccctggggttccctcaatctgtaatgctcttccttgtactcctcatacataccacaccctttcattcattcatcaaaaagtatactgctaggcgctgaacaggtgctaataaagaaaaatatatggttcctttccttaaggaatgaagagaagaataaagatagtgatgacatttcagaaggaaaatctacaagactcagtatcatctgaagtatcataaaaaggaataaagatgattctcagccttgctaaaagactaagtagatgatgatgcctttgatacacaggaatttgaaaggcttgtctggaatgtttaaaactggttttagaatgttaaatgtgtaattccctctggatagtctagttgagttgcccaaacagaaattattaaatagaagtactcattagtatctgagtaaccattatgtggcaggatccaaggacactgagtaaaatacaatccccgaactcaaggaacttaagacttagatgatagagaatacaagtaaacaggcacttaaaagagaaactcaggtaagagactggaggtgtaagcactagatggaacatgaaggaccttgtatgccactcttaggagactggatttctcgaggcaatggggaaccatgggttttaaacagggaatgcttgattacatttgcattttggaaagaacgctctagcttcaaggaagataatgggttggaggaggcaaacaaagtgaacaaataagatgctgttgcagaaatctgaacaagatttgagggaagagatatgtaatagtaatatttgagaccctgactttcctagacaacactcaaagtacaatgctaatccttgaactatttttaaccataataacaaaataatactcgcatcaggcaagtataaagcatacctggtggccgagcactatgctatctcatctcttattctatatcaaattgtgggaaccacagttgaggaatgtatctttttttttcctataaccacttgaatttcacatgctatgggaaatatgtaacataatttaaatatacagcatattctaaagaaaagcaaaattgaacagatccaagcagcaaagttcctctaggattatgcaatcacttcattagccaaaaagcttacaatctatagatcctatgtattgttaggagtgaaagctttccataaatctctaattacagggccctgaattgataaggggagacaatgtgcccagactaccctgtgtcaccagctctaagtcacacgagacaatttttacaaataagactgaagttgaaggtttctgggaaagccccttccctgcttcttcttttcttcctcctgcctggaatgtagacataaagctggggctgtagcagccctgttgtagccatgagataataagcatgaggacaaagcacatgctaacgatgagagagtacaagaaaagaagactgagacatggctgttcctttgttgctgctgtactagcagactttttgttaagggagaataataaatccctctgtggttaagtaactttaggctaaacatagtcataatttatatactctgaatcccttatagaataaagcctaggctacttcacattgcataagatgcttctcaccatcagctccatttaactatccaacctcatttcattctgttctctgtcccatactttccattccaataattctaaatcttgtcagatgagcacaccccaatgagttgtttttacctttctacctgtcatccccttgactctcccttatcactccatttcttcacccaattaactcttcgtcagcattccagatttcctggctccactggctgaggaagatgccctgccttcttcttttcacattaccccatgcaccagtcactacaatgagtgtgctatattacagctatttatttatatatttgtcttcccaactacactactgacccctcaaaaagaaaaaagtatcttagttcttttggcattcttagatcctggcacagtaccgggtcaactggggatgctcagtgaatgttgaatgaattagatttacataaaacatgacttcttaattagtaaaagtgattacataatacagactgttaaatgacccctttaacatcaaaaactcattctcatccataaatttgtcctaaaaaagtccaggctatagtgcagtgctgcaatcatagctaactgtggccctgaactcctgggctcaaacaatcctcccgcctcagcttcccaagtagctagaactacaagtccaagctaccacctggataattttttcttttttggtagagaaagggtctcactatgttgctcagactggccttgaactcctgggctcctttaccctcgatgctctggcctctctaagggttgagattacaggcgtgatctaccacatccagcctcatttctgcttttaagcagaaaagctgcaaagagctgtaagtcctaaagacacttgacaaagccatcctcatctgccttaaaggattaatctcacttccaatgggaagtcagaaatgaaaactaggccaggcatggtagctcacgcctgtaatcccagcactttgggaggccaaggcgggtggatcacctgaggtcaggagttcgagatcagcctgaccaacatggagaaacccatctctactaaaaatacaaaattagccaggcatggtggcacatgactgtaatcccagatactcagggggctgaggcaggagaatcgcttgaacccagaaagcggaggttgtggtgagccgagatggcgccattgcactccagcctgggcaacaacggcaaaaccctgtctcaaaaaaaagaaaagaaaaagaaatgaaaactaaacagatgatcaaagaataaattttgttatattttattagcaaaactcgtcaaaacaagggtaagcaaagaaataaaatctcttcatacctgtcacattgctgcattatggaaatttctttgattatttcctgaagatctgattcaacaggtacttgtttaattgcgacaacttgaccggattccttgtgtattgctttaaatacacttccataagacctaaaagaaaccaagacattatttttttcctatcaaacatcgtaactataagattaaaagtctactatgagttttctgtggatagtcttttctagtttaaaacactatttaaatgattaaaaaatcaaagtaaacaagtaacaattttaaaaggtaatgaattatatcttagctttattgcttcaactacagacttaaaatagtcaagttaacatataatgagtagctatttttcttatgaatgaaagaaacagacttgcgtttggtcaactcaaacaaatgcagcattaagaagatataaatggaaattaaaagaatgaaatgtagattaaaaatagccaaagcctcaaattaggagaaaaggctgatctcaaggaaaatgacccccagaatatcaaaaagtcacacttctgttcagagtaccttaacagttaaaaccctcagctggggaccatattaacatcaaagttagagaagcaaggaatctgcagccatctgcttctacctgatttacagatccaaggtctctttttaaaaagttcctttcattaccttttcctcaagagaaaaactacaaactcacaggtaaataaaatgaggaacagggtctaatagtcacttgcccaaaacctgtctctgctacaactcctgaaactttgccaactgaatattcacgtgttttaaaaagcaaaaacaaagaaggaagaagccatttgtaccttagtatgaacttaaaaacgaggttaaacactactatgtactgagttcttactataaaccaggtcctatgctaggtgttttacatgcattatgaaattcaaccctcacaatcataaggaaaaacactattatcgtcattaaaagatgagaaacagaccagtagggccagaattcaaacacattcccaccccaaaaatcaggtttttctcaccatatttttctacagaagagaaacaagagcaagccaatggaaaacatcgaatgtttcctaatattagaaatctatgcagaagcccttccaaatttataatcttttaaaataagtgaaaaagagacaaataagtgataacgcggctacttcaataaaatacattttatcctctcctctgtttctttgggctctctgaagtcatttaatttggtttggtacccaaagtcacattgggctgggtgtgggggaatgtatgtgtgtgtatctccccttgaaagccatatgtgtgtatgtgtgtatattccctcaaaagctaacatagaattcagtgctagatcatctactgtcaattaggcaacaccatcactcctttctaaggactcctcagcactacgaaagagaagctgcaatccccacttcccagaatccccttccctgaatggttcctcattaaaagtctgccagtgagaaaaacacgtatgtgtgaatgacgaaaggagaaaccatttttctccagatacagttgtagcagatggactgacagatatgaagtgcacagcagcttcctgctgagcttccaacagccaccactgctgcagactgaggtagttggtgggagtttctcaagactgcaggattccagcagattcccagagagcttttgagaaacacccacttcagtgcttcaggctgagatcttcaatgctgacttcgaccttcaacctttggcaacagttttcatgaactttgcatccctggcccctccacaattcatttgagctcctaacttcattactaaattcttcatatctatagagtacatacagtagcttatcttttccttgatagcaatatagtttttggtagaagaagtgtttccaagggaaagaatcttaaagatgagaatcttgaattagttctttcttagatgttgatatggtttggctatgtcccacccgaatctcatcttgtagctcccataattcccacctgttgtggtagggactcagtgggagatgactgaatcatgggggcaggtctttcccatgctgttctcatgatagtgaatgggtctcacaagatctgatggttttaaaaatgggagtttgtctgcacaagctctctctttgcccgctgccatccatgtacgatgtgacctgatcttccttgccttccaccatgattgtgaggcctccctacccacgtggaactataagtcaattaaacctctttctttcgtaaattgcccagtcccaggtatgtctttaccaacagtgtgaaaacagactaatacagatgtgtagacagtaatgacttcaatacaagtaacaaatagtatactgatggtctatggcattcagtggcaaacagttatttaaattatcacccttagttgcctggagtctaagcaaagctttaaaagaccaagtagctgtatcaatacaatgtatggtgaaaataaagtataaggactatagaatgggctgctgcctctgcctgcactggaaaagttatagaacaaacacagcaagctaaaggcttaaatgtccagctcaagactgagagaaccagaaaacttctgaatttcttaattcttacagaaacagggttgagatttctgaaaaacaaactctaggtatagtcttactggaagttgaattacatttcaagttgaattcacatcagcaccaggtctgttatgttaaagttaaggtatctaacaataaagagaagtacctagagaactggtattaggacatttagatagattctcattaatctgagtaccttgaatccccaaatcctatcaagcctcccttgataccaaaagcaactctgccctcctgtctgagaaaattaaccttacaatgcctgaagactctatctacctcctgaggcagtcacttttcagcagcatgcagtggtcctccagaccactccaccaccacttattgcttccagacccaaagttatactcaactcccatagacaccagggagacaagtataaaatttaacccaagcagctactattcacactaaaaaagttgcaagattttgccaatttttatcagaaccctaaagaatatgtgtgagaacaaattctaagatttccagagaggaagaaatgtactgatatggatgcaagaccagaaattccagactcagcatgttagctcaaacagttgggggtgtccctaacagttgctcagccagttaactgaaacctggactcaaaagtggcccatattaagtgagatgctaagtgagcctcagtacacaccaaaggaagcatatcaaaggctcaaggaaatgggatactagaatggatatatattataagtgccatgctcacatactccctaactatgttgacaaaaagggtccagaggataccagcatcgaccaaagctctattagtgcaggggaaagatgacaaatatgccaacagtgaaactggctccttgagtttaatagataacaggatcccagcacaagagaagtggcaacagctattcacctgagacaaagtgggaacagttaccataatgagtaacaaagcaaggctgaattacagttttcttttattgtacatttaggtcttgatattaaagttacactagcttcatttaaaaaaaaactataattaactgtcctttaaacactgtataaaacagtgtttaatacagtggaacctttctggaggggaggaggtgaaatacacacaacataaaattcactgttttaaagtgtatgattcaatggcatttagtgcattcacaatgctgtacaaccattatctgtatgtagttccaaaatatatagaatctgctttctgtctctacagatttatctattctagatacttcatataaatgaaatcatacaatatgtgaccttttatatctggcttcttccttcacttagcataatattttgtaggtccaactacactgtaaaatgtaccagtacttcactactttttatggctaaaaggtcactgtacagacatatcacgttttgtttattcacctgggatagcagatggacatttgagttgtttccacattttggctattgtaaataatatgctatgagttggtacctttataattaacagttatttaatcatttctctatcactggctatatcttccttcttattccaaatcttctgtattttctattttctttagtcaacattgtaagaggtttaattattttactgatctcttcaaaagcttttatatatacaaacatatacgtatctttttttttttgagacagagtcatgctgtgtcacccaggccagagtgcaatggcacaatctcggctcactgcaacctccgcctcctgggttcaagcaattctcctgtctcagccttccaagtagctgggattacaggcacatgccaccacgcccggctaatttttgtatttttagtagagatggctactctactaaatgacaatatggtttcaccatattggtcaagctggtctcgaactcctgacctcaagtgatccacccacctcggcctcccaaaatgctgggattacagcgtgtaagccactgcacctggcccatatttatcatttctaattttttttctatctcattaatttcagctttttctttaattcaatcttcagtttcttttggtatgtttcataatttttctaagttctttaagtaagcactaagtttattttttgcctttctttgttagtctaatgaaagaatttagaactaaaacttttaattagttttgctatattccatagatactggcacaatgtgttctccttttcattgttttataatttataatatcctcttcaatcaatgggttacttcagattatgtttcctaatttctagttggtgtggattttgtcatattataattacttatttctaatttagtgagtataatcagtgatatggtttgcatatttgtcttctccaaatctcattttgaaatgtaatccctaatgttggagatggaacctgttaggagacgtttgggtcacaggggcagtttcctcatggcttggtgctgtccttgagatggtgagttttcacaggatgtgcttatttaaagcggtgtggcaggccgggtgcagtggctcgtgcctgtcatcccaacactttgggaggccgaggtgggaagatcacctgaggtcaggagttcaagaccagcctggccaacattgtgaaacctcatctctactaaaaatatgaaaattagctgggcgtggtggcaggcacctgtaatcccagctactcgggaggttgaggcaacagaatcccttgaacccgggagaaggatgcagtgagccacgatcacgccattgcactccaggctggatgacgagagtgaaactctgtctcaaaaaaattttaaaataaaaaaaaataaaactgcgtggcacctcccctgccctatcttgctcctgctctcaccatgtgagacatctgctccccctttgccttcttccatgactataaccttcctgaagccctcaccagaagcggatgccggcaccgtgctttttgcagtgtctgcagaaccgtgagccaattaaatttttctttataaattacccagcctaaggtatttttcttataacaacacaagaacagcttaatacaatcagaaaatgtgacctgtaaaaatctcttattttttagaatttgtaacttttcttttatcaatggtcctttgaacatacaccagaaaagcaggtctgcaagaatatatatgcatagttatatagacatacaggtactttatatatttttactttatatatatttacatttctataaaatcaagtgtattcatcataatgtttaatccctctatgtcctttctcttttttctattatatctgtccaattctaaaagagatacattgaaatctcccatgcaattatacttttattagatgcctctgacatcactaatagcttttctgtcataaatttagctgccatgttgtctgacatgttttgttataaattgtccttgatattgctacctaatatatctctttatttagttgaaaccttttaaactttaatgtatctaatataaatattgctactattactttctgtttttttatttgtatgtttatctataatatttttataagaaatatccttataggctatgcacagtggcccacacctataatcctaacaatttgggaggccaaggaaggaggatcacttgaggccaggagttgaagaccagcctgggtaacatagcaagatcccatctctattaataataaataaatagccttatatttccattatttgttttacttgcatctcctataaacagaatataggtagatttcgcatgttcatttactctaacagtttgtcttttaatgggaaaattaacatttactgaaaagtacacttgattttattccttccatcatgttcagcttatttttattttttatttatttatttatttatttatttattttttgagacggagcttcgcttgtgttgtccaggctagagtgcaatggcgtgatctcagctcaccacaaccttcaccttccgggttcaagcgattctcctgcctcagcttcccgaatagctgggattacaggcacccgctaccacgcccagctaatttagtatttttagtagacatggggtttctccatgttggtcaagctggtcttgaacttccgacctcaagtgatccacccacctcagcctcccaaagtgctggaattacaggcgtgagccaccgcgaccggcctagcttattattttaccttttcattttctctatttccttgtccttgttcttgctgatctataagcttcttttaattctgttttgtacctttattattttggaaattctcctatactttgccattccattaaatgctccctacctttctctctgctcaaaccggcacgtttctctactgttattttgaaatcatgtcaactattcttctgcctatataaactgtttccctcactaagatattcttgtcatatcaagacaaagactacttaccttttccaaaataaaatgagcctcaagatctaaaaggatggccttatggtcacttgcctaacaaagtcaaaaccttcaaacgtattaataagaatgccgtaagggatgaactaacaaaactcttaaacatcatttcacagcacatttcttgcttttcccttatatatatatatggcctactttctctgaaaaaacactattaccagatttagcacaaactaatctttaaaattcagtatcacctgccaagtttaattactattaaatactattcaattcatacgaatatactctagttgaaagattaacatcatataatattttttaaattgttctgaaattatttacatgctttcatactttttgtacttacccttctccaagcttctctaatacatcaaaaacttcttcaggctgcttagtcaaactgtcttcactcagcttttttagtttactgatttaaaaaagaaagaagaaagaaaatattttctttaaagaccttttacaaaatttttaatttttaaaattttaccaagtttttaattttattttaatatattcagaagactcaaacaatataaaaacatacatagtaaacattctcctttcaagccctgttcctcatgtgcccagcaacacctccaaaaataatcacttttattagttttttgtgaaacctttatataaatatgaatacatattcttaattcctcccctttgaatatataagaagcatatacacacccttctgtataaatattgtcatgttgtctactgttttctcttgacaaaactatgttagagatctttccatacaggttaatcatccataatccaaaaatctgaaatccaaaatgctccaagatctgaaattttttgagcaccaacatgatacccacaatggaaaatgccacacctgacctcatgtaatgagtcacagtcaaactgtaagcacataacacaatttaaggaaaaaagatcctccccagcccccttcagctctgacatatcttttccatgcatgcacagattctcccacccaagcacatccaaagaagggtaataaaatggcacaggtacacgccagacgcaccaatgataggttccccacgatgccccacacggagccaagactgtgcattactcactgtgggtttttttgcttattctctgctttgttggataaagacaatgttgaaaatctgagtaagtgacagaaaaagaggaagcatttatgcttatctctagccaaaaagtcaagctgctggataaactggaaagcagtatgggaaatgtcttacaaaagagcatggtgttggaatgaccaccatatacaacctgaagaaacagaaggataaattgttgaagttctatgctgaagtgtcaatgaacagaagttaatgaaaaatttttcttaattgcagaaaaccaaatgaagatctcaaatgtgtactgaaagagtaaatctgtcagcacggcagagaaaacatactacttaatggtatggtgctcatgaaacaagcaaagatatatcatgatgaactgaaaattgaagggaactatgaatattcaacaggctgattgcagaaatttaagaaaagacacattaatttttcaaagatttgtggtgaataaagcaactgctgatcatgaagaagcagaaaaattcattgacaagtctgccaaggccatcactgatgaaaatctgacaccagaacaagtctataatgctgatgaaacatcacagtttagtgttagttccccagaaagactctgactacagcccctacaggataagaatgccatggacagagtaactgtcctgggaggtgctaatgcagaaggcacactaagtgtaaacctgctgtgtgggaaagattgggttcattattagactaacaaaaaggcatgggtcactagggacatcttttctgattggtttcacaaacattttgtagcagtggttcaggtttgctgcagggaagctggactggatgatggctacaagattttgttattccttgacaactgttctgctcatcctccagctgaaaaatctcattaaatataatgtttattccatgtacttttccccaaatgtgacttcattaattcagcaagtgagcagggtatcctcagatcaataaagaataaaaataaaaacactttcttgaacagcctacttgcagcagtgaacagaaatatgagcgtggaaggttttcaaaagcagttcagcatttagaatgctgtatatgctattgtcgatgactggaacacagtatctaaagacacagttgtgcatacctggcacaatctctagcttgcaactatgttcagtaacgatgatgaacaaggcaatgactttgaaggattctgtatgtcaagataaaaaaaaaaaaaaataggccaggagcggtggctcacgcctgtaatcccagcactttggaaggccgaggcggtggatcacgaggtcaggagaccgagaccatcctggctaacacggtgaaaccccgtctctactaaaaatacgaaaaataagccaggcatggtggcgggtacctgtagtcccagctacttgcgaggctgaggcaggagaatggcgtgaacccaggaggcggagcttgccgtgagccgagatcgcgccgctgcactccagcctgggcgacagagcaagactccgtctcaaaaaaaaaaaattaattaaaaattttaaaaataaataaataaaaataaaaaggtgtttgacttccttacatatacaaaaaaataccttcagagtctgtcagtaagttggaagaaatggatatcaaataagtttttaacattgataatgagtctccagttgctcattcattgaccaatggtaaaatagcagaaatgggctgggcacggtggctcacgcctgtattccagcactttgggaggccgaggtaggcgtatcctttgagctcaggagttcgagaccagcccgggcaaacggcggaaccctgtctctattaaaaaatacaaaacgtttggtgggcatgatggcacatgcctgtggtcccagctacttgggagactgagcctgggagatggaggttgcagtgagccgagatcacgccactgcactccagcctgggtggcagagttagaccctatctcaaaaaaagaaaaaagaaatagcagaaatggttctgaatcaaggttatggtagtagtaatgacaatgaagatgatgttaacattgcagaaaaagtgccggaagacaacatggtgtgatgggcttattttaggactagagtgcattcttaacagaataggaaatcacgtcactttataacatcaaagagagacttctaagacaaaagccactgttaatgaggcagacgattctcgaggaaacattttaaaaagccatccaagcaatggggaaaggattccctatttaataaatggtgctgggaaaactggctagccatatgtagaaagctgaaactggatcccttccttacaccttatacaaaaattaattcaagatggattaaagatttacatgttagacctaaaaccagaaaaaccctagaagaaaacctaggcaataccattcaggacataggcatgggtaaggacttcatgtctaaaacactaaaagcaatggcaacgaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacgatgaactcaaacaaatttacaagaaaaaaacaaacaaccccatcaaaaagtgggcaaaggatatgaacacacacttctcaaaagaagacatttatgcagccaaaagacacatgaaaacatgctcatcatcactgaccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccgtttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctgagcaaactatcacaaggacaaaaaaccaaacaccgcatgttctcactcataggtgggaattgaacgatgagaacacatggacacaggaaggggaacatcgcacaccggggacggttgtggggtgggtggagcgggcagggatagcattaggagatatacctaatgctaaatgacgagttaatgggtgcagcacaccaacatggcacatgtatacatatgtaacaaacctgcacattgtgcacatgtaccctaaaacttaaagtataataataataaaataaaataaaataaaataaaaaagccatccagcagaatgtttccttatccctagcagacctatttcctggcccctcagctgcttctgatgtttcttctcaactaaaaaaaaaaccacacagtgtataatagtaacctttcaatcaaaaatcagcatcataggtgaaaactaaaagcctgccgttgtttgttgttcctgttgtttaaaagctgatagaggtattctggtaatgccactgtgctgcttcattaccctgaacatattttttttccactgtattaatgttatgccatattttttgcagttaagtacttatgcatgagcaagtataagaaaatgattgcttatcagtagcatgtaaattcagagtcagaaatgaaggtgatgccaaacaactccacagactgtccacatgggtggctgagatagtgacacctttcctttctgatggttcaatgtatgcaaactttgtttcatgcagaaaattacttaaaatattgtataacattacctacaggctatgtgtataaggtagatacaaaaatttcatgtttggccttgggtcccagccccaaaatatctcattatgtatatgcaaatactccaaaaaacaaaacaaaacaaaattcagaaatctgaaacatttatggtcccaagcatctcagataagggattctcaacctgaataaagcatcaatgttcttttttacagctgcatcctattcaattacagagatatagcatatcttacttgcccagtcttttgcttatggacatccaggttctcttttgatatgataaacaatgctgcactgagtaaccttatatataagtcaatgaatgaatgaatgaatgaatgaatgaatgaatatatataaacttatatataagtcaatgaatgaataagtcatgtgctagtatatatgtggaataaattcccagaaatgaaactgagaatacagacacattcacacacacataaatataaaagtagatatgctgacaaataagtatataatcatgtaataatataattttaataatgtagtataacataagatcactattgtcataactatatggtaattattaaaattattgattacattatggtatattttacctattataattatatgttatataaatatatatacatatacactgatttcagcaagttgtcctccatagagtttgtactaatttattctccaacaagtaatatatgagagcccttctttcccacagttccatcaatagggtatttaatgaaattatttggattttagccaatctgtgatgaaaacttattagctcagtgtagacttaacttgtattattatgagtgaagttgaccatcttttcatatgattaagaagctaaatcacctacttgttctttgctcatttttccactgggttttcggtccttttcttatgtgtatacaaaggaaactagcccttttttcgagattataaacattttcatttggattttgacttcacttataagcttttagttttgcagtctatttgattttttgccatataaaaaatgtcattattttatttttgcaaatgagtggatggtaatgccatttactaaggtaagaaacacaggggaaaaaaaaaacagtctggaggggaacaagatgggctcaattctagtcatctaaaagtagatttccggtaagcaactggatttacaaatctcaggagagatttgaactagaaatataatttttggtgtcatcagcacattgcttaaagctttcagaagagacaaaatcatcaagaaaatgtctaagaaaaaataagagtcaaacacaaaacacatatcaaggaaacaccaatatttaagaaatgaggtcatgaagcacaagaaggtaatatttggctacatcaaaagctaccaaaagtgcaagcagcttgaaagtttaagtatccattgtagaacttccacttctagccaccaggtttatgacaggaagcagaattatctgtcagctgcaaatagctacaaaactcaacaaaatgtaagaaactattttcagatgctggctatcaggcattccagaactggatatactgaggtccccaagagaaggagaagaaataagatgagccctgccatcgcccaggctttagatctagagactatgtcagactgtagcacaggaaaagaagaactcaaagagaaccaagtaattttgctgagttgaagaaatagagcttagagtttggtgaggaatcaaggcaaatggaaattccattacagagtatcgggagaagggagctatgcagggaaaaggttcagcaatctatctagaggtttccatgaaatgccaatctgtgcatgcttacaaaacactcctcaaagcccagcaaaaccagtttcttaaggcgaaaaaaaatgaccagggaggaataaaaagcaaaattcccagacaaggcaatttatcacaaaatatcacaaggcagggaatctttcccactatccagagttgaaagaactccacgaatacaaaggtcattcagaaaagaactcagaacagcattattttagaaaggagattatattaccaaaagataaaggatattccagattctccctagaggagcttaaaaactaacctcaaaagcatcaagccaaaccacaagacaacttgcttaactgcctaccagaacgagtctgtaacttcttaagcaaagcaaaattcaacattcacaaatgtaaaattaacaatgtcaaaaaaataaaaaaaaaaattattaaacctatgagtaatcaggaactataactcataaagagaaaaattagccaataaaacagacccagaaacgaggtggtgaaattgataaaaatcttaagaaaacctcttatgaatatactttcacatactcacagatgttaaaggaaatggaaggtagggggaaagataaatggaaatttaagagataaaaaataaaatatttgctttcgttgctgcagcagacgctgtgagtattttcaatgcttcagaagaggcttgcctctagtgtcctccgctgtggcaaaaagaagatctggctggacaccaatgagaccaatgaaattggccatgccaactcctgtcagcagatccagaagctgatcaaagatgggctgattatccataagcctgcgactgtccgttcctgggctcactgccaaaaaagcaccttggcctgccagaagggcaggtacatggtcataggtaaacaaaaagggtacagccaatactcaaatgccagagaaggtaacctgggtgaggagaataggaattctgcatcagctgctcaaagatactgtgaatctaaaaagactgatcgccacatgtatcacagcctgtacctgaaggtaaaggggagtgtgttcaaaaacaggtggattctcatggaacacatccacctgctgaaggcacacagacccacaagatgctcctggctgaccaggcagaggcctgctggtctaagaccaaggaagcatgcaagtaccatgaagagcgcctccaggccaagaaggaagagagcatcaagactttgtccaaggaggaagagacgaggaaataaagctccccttctcttgtctgtacatagtggtcttggtgattatacagatcaatcattaaaataaaacaagcctttatctgctaaaaaaaaaaaaaaatctgaaatataaattttgttgaataagattaaaaggagattagacagtgcagcacaaaagatgaaatcatttgaaaaggaaaaagtgttatttaaataaaggaagaaacaaaaagcctgagtcccacatgaaaaagaaacaaatgggatgggaagtaaggaaagaaaagtaaggaaaggaaggagggaaataaggagaaacattttccaaattttatgtaaaccataaacccacacagatgcatcaaattcaacaaatttgaaaagataaaacacacaaagagagaaagaaggagagggagagagagagagagagagagaaccaaaatatattatgatcaaattgctgaacatcagtgagaaagaatactaaaagtagtcacaggaaagacatataggcatatctcagagatactgcaggttcagttccataccgcaacaataaagcaaataccacaataaagcaaataacacaaaaatgtttgttttcccaggatatataaatgtttacactatactgtagtctattatgtgtacaatagcattatgtctgaaaaaacaacgtacataccttaatataaaaataatgtttgaggtgaaggatacccactatgccctgatgattgttatgcattatatgcctgtatcaaaatatctcatgtacccaatatatacacctactatgtacccataaaaattaaaaataaaaaagattttaaacactttattgctaaaaatgccaatgatcatctgagcctacaacgagtcaaaatctttttgctggtggagaatcttgcctctatgttgatagcttctgcctgatcagggtggtggttgcaaaaggttgggttagctgtggaaatttcttaaaataagacaacaatgaagtttgccacatcaattaattcttccttcccaaaagatttctctatagcatgtgatgctgtttgatgcatcttactcacaagtagaactttcaaaattggaatcaatcctctcaaaccctgccactgctttctcaattaagattatggaatattctaaatccttttttatttccaagatggcagattagaggcttttagtgggcctcattcacttggaaatagcaagatagtgtacaaaggccaactctgagagctttaattcacaaaggaaaacaggaatccactggaatcgtgacagacacctcagatccaaggaagacacacaaacacaaacagcccctattatggcatccaattgataaaagtgagggaagcccaagtatgcaagacagtcagaaagcctccctctgtgactcacttttccactggagatctgagcaacccaggtcaagaaagagcactttgtttcttctaagccctggatctaacttggggacaagctgatttggagatgctgtgagggacagacactcggaaaagctactggcatttcccagacccaggatggagagcaggacactattttaaatgtgggtgcatgcaagtcaaccattctttggcaacccagtagcatggccacataggcttctggctctggagcaggacagaggtcttcacagccacactgtagttagtgcctcagcagtaggtgctgggattgtgctctcctccactgcaggtcaaggatgagagaagagctgctacagctattgtttctcctggacaaccagacttcaagccagatccagcttagcaacctggaactggtctgcatgtgccatgattggttgccacagcctgttcccctgtggtgcagcagggccctctctgctctactccctggcaaaaatccaggcatttggagcaactgtttgcctggacaagcaggctgaaccacctcacccttcatggatatagatcatggcacagtggaggcctctctgctccacatgcaggcagatctagagctattcagagcaccccctcacctgcaaccgcagtctgagttgccttacccttcctgtgtgtgcatagattgtggtacagtggggccctctccactccacatggagacagatacccaggcatctaatgcacctgctcacatggactagcagattgagttgccccacttttcctgtgcagagattctgtgcaggggggccctctctgctccatgcccaggcaaatctccaggcattcagagcatctgctcacctgaatcagcagcctgacttgcctcacccttcctgtgcagagatcctagtgtagggaggccctctctgcttcacactcagacagatctcccaggcattcagagcacccactcacctggatcagcagcctgaactgctccatccttctatacatagattatggtgcagcaaggcccttccactccattgcccaagaagatctccagatattcaaagtacctatttgcccaaattggcatattgggccatgccactcttcctatgaagagatctgggtacaggcaggccctccctgcttcatgcccaggcataactccaggcattcagagcacctgcttgcctggttcagcagcctacatcaccccaaccctcctccgcagaaatcttagtggtggtggggtggcagggggaccctttccacttcatatccaggcagatgtccagccatctggagcacctactcttcaggattaggagtttaagctgccacccatccctgtgcagagaacttagggccaaggaggtctcccagcttcatacccaggtacacctctgggtgcttggtgactacccactggattctccctatgcgctgacacttgtgcttgccactggagggtctggcggtgagcctgcccagtccagccctgcatatctttccctctgccccctcagggctgagcaggaaactcagactactgtacactccacaaatcagcccactgcctgaggcaacggagagctgctcccagtaaacaaggatcaaatatatacccagtcacactggcaacacctggctcttacccataagcttataggccaaactacacagcccaatataaaacctgccaactgaagtgcataggactataaaaacaaagccaaaagactctacacagcattatttccactcacaacccctaaggagtaggggaaagggaaagaagaaaaaaacaacattgtaagacaagaaagaaaaaatcctaccagtacgaaaataattacacaaattagcagtgccagtgtctccagatgggaagaaaccagtacaagaatactggcaccatgaaaaaatctgaatgtagtgccaccacagaaggatcacactagctctccagcaatggtccccaaccaacaaggacactcagaaatgacaaagaactcaaagcatgggttgcaaggaagctcagagatccaagacaagattgaaaatcaatactaaaaaacttcaaaggaaatccaggaaataagaggtaaagatttttaaaagaaatcaatcagagcttctggaaatgaaaaaggtttacttaagaaatttcaaaatataactgaaagctttatcaatagactggaccaagcaaaagaaagaatttcaggccaggcatggtggctcatgcctataatcccaacacttgaggaggctgacgtaggaagaccatttgagccaagtagcttgagaccatcctggaaaacataaagagaccgtgtctttccaaagaaatttaaaaattagctgggcatgatggtttgcacctatcgttctagctacttgggaggctggggtgaaaggatcacctgagcctgggagttcaaggctgcagtgagccatgatcacatcactgcaaaacagatgaacaaaaggaaaaaagaagaaaggaatgaaagctgatcttttgaactaacccagtcaacaaaaatagaggaaaatgaacttttaaaattgaacaaagtctttaagaaatacaggattatgtaaagcgatcaaacctataaattattagcattcatgatacagaaagagaaaaagcaaacaacctggaaaatatatttgaggaactaactcaaaaaaatttccctaatcttgctagagtagtagacatccagatacaacaaatccagacaacaactgtgagataatatacaaatccagacaacacttgtgagataacatacaaaatgaacatcaccaaggcatatactcaccaggccgtccaaggtcaatgtggtgcggtggctcacgcctgtaatcccagcactttgagaggccaagacgggcagatcaagaggtcaggagatcgagaccttcctggccaacatggtgaaaccccgtctctactaaaaatacaaaaattagcttggtgtggtggtgcatgcctgtagtcccagctactcgggaggctgaggcagaagaatcacttgaacccaggagctggaggttgcagtgagctgaggtcgcaccactgcactccaatctggcaacagagcgagactccacctcaaaaaaaaaaaaaaaaaaaaaaaaaaacaagaactgaaggaagagatatttaatgaaatagatagcataaataaaaaaacttcaggaaacaatggacacatttacagaaatgcaaaatgctctggagagtctcagcaatagaatcaaacaagcagaagaacgaacttgagagctcaaagacaaggtttttgaattaacccaatccaacaaagacaaaggaaaaagaataagaaaatatggacaaagcctccaagaagtctgggattatgttaaacgaccaaacctaagaataatcagcattcctgagaaagaagataaatctaaaagtctggaaaatatatttgggggaataattgaggaaaacttcccagccttgatagagacccagacatccaaatacaagaagctcaaagaacacctggggaattcatcacaaaaagatcatcgcctagacacactgtcatcaaattatctaaagttaagacaaagaaaagagtcttaagagccatgaggaaaaagcaccaggtaacctttaaaggaaaacctatcagattagcagcagatttctcagcaaaaactttacaagctagaagggattgcagccctgtcttcagcctcctcaaacaaaacaattatcagccaagaattttgcacccagcgaaactaagctacataaatgtcggaaagatacagtctttttcagacaaacaaatgctgagagaatttgccactaccaagccagcattacaaaaactgctaaaaggagctctaaatcttgaaacaaagccagaaaacacatcaaaacagaacccctttaaagcataaatctcacaggacctacaaaacaaaaatacaatttaaaaaacaaaacaaaacaagaaaaccaaggtatacaggcaacaaatcgcataatgaatggaatgatacctcacatctcaataccaacgttgaatgtaaatagcctaaacattccacttaaaagatacagaactggccgggcatggtggctcacgggggtaatctcaatactgggaggccgaggcaggcagatcacaaggccaggagttcgagaccagcctggacaacatggtgaaaccctgtttctactaaaaatacaaaaattagccgggcgtggtggtgcgcgcctgtaatcccagctactcaggaggctgagacaggagaactgcttgaacccaggaggcggaagttgcagtgagccctgattataccactgcactccagcctgggtgatggagtaagactccatctcagaaaaaacaaacaaacaaacaaacaaaaaaaaaaatacatatataattgcagaacggataagaattcaccaaccatctgctgccttcaagaaacacacctaacacataaggactcacataaacttaagctaaaggggtggaaaaagacattccatgcaaatggacaccaaaagcgagtaggaatagctattcttataccagacaaaacaaactttaaagcaacagccattaaaaaagacaaagagagtcataaaaggccttgtccaacaggaaaatatcacaatcctaaatatatatgcacctaacactggagctcccaaatttataaaacaattactaatagacttaagaaatgagacagcaactataatagtgggggacatcaacactccactgacagcactagacaggtcatcaacacagaaagtcaacaaagaaacaatggatttaaactataccctggaacaaatggacttaacagattatacagaacattctactcaacaactgcagaatatacattctattcaacagcacatggaactttctccaagatagaccatatgagaggccacaaaacgagcctcaataaatttaagaaaactgaaataatatcaagtactctctcagaccacagtggaataaaatggaaaatcaactctaaaaggaaacttcaaaatcatgcaaatacatggaaattaaataacctgcttttaaatgatcattgggtcaaaaatgaaatcaagatggaaatttaaaaattcttcgaactgaacaacaatagtgacccaacctatcaaaacctctgggatacagcaaggcagtgcttagaggaaagtttataaccctaaatgcctacatcaaaaagtctgaaagagcacagacaatctaaggccacacctcaaggacctagagaaccaagaacaaaccaaacccaaacccagtataagaaaggaaataaccaagatcagagcagaaataaattaaattgaaacaaaaaaaatacaaaagataaatgaaacaaaaagctggttctttgaaaagataaaataaaattaatagaacattaacaagattaccaagaaaagaagaaagaaaatccaaataagctcaattagaaccgaaaagggagatattacaactgataccaaggaaatacaaaagatcattcaaggctactatgaacccctttatgtgcataaactagaaaacctagaggagatagataaattcctggaaagataaaaccttcctggcttaaatcaggaagaattagataccctgaacagatcgacagcaagcagcaagattgaaatgataatttaaaaattacaaacaaggcacctgggaggccgaggcaggtggatcacctgagatcaggagttcaagaccagcctgcccaacatggtgaaaccctgtctctacttaaaatagaaaaaagtagctgggcgtggtggtaagcagctgtagtcccagctactcgggaggctgaggcaggagaattgcttgaacccgggaggcagaggttgcaatgaggcgaaatcgcgccattgcactccagactgggggacaagaaggagacttcatctcaaaaaaaaaaaaaaaaaaagtccaggactagagagattcacagcagaagcagaagtctaccagacattcaaagaagaattggtgccaatcctactgaaactataccacaagacagaaaaagaaggaaccctcccgaaatcattctatgaagccagtatcaccctaataccaaaaccaggaaaggatgtaaccaaaaaagaaaactacagaccaatatccctgattaacatataagttaaaatccttaacaaaatactagctaaccaaatccgacaacatatcaaaaagataatccaccatgatcaagtgggtttcataccagggatgcagtgatggtttaacatacacaatgtgatgatacaccacgtaaacagaatcgaacacgaaaatcacatgatcgtctcaacagatgcagaaaagcattcaacaaactccaacatccctctatgattaaaactcagcaaaatcagcatacaagggacatacctcaatgtaataaaagacatctatgacaaacccacagccaatgtaatactgaataggaaaaagctgaaagcactccctctgagaactggaacaagacaaggatgcccactctcaccactcctcttcaacatagtactggaagtcctagacagaccacttagacaagagaaagaaataaagggcatctaagccgggtgtggtggctcacgcctgtaaccccagcactttgggaggctgaggcaggtggatcacgaggtcaggagttcgagatcagcctggccaacatagtgaaaccccgtctctactaaaaatacaaaaacttagttgggcatggtggcaggcgcctgtaatcccagctacttgggaggctgaggcaggagaatcacttgaaccccagaggcagaggttgcagtgagctgagatcgcgccattgcactccagcctgggggacagggtgagactccgtctcaaaaaaaaaaaaaaggcattcaaatcggttaagaggaagtcaagctgttgctgtttgctgatgatatgattgtttacctagaaaaccctaaagactcccacagaaagctcctagaactgataaaagaattcagcaaagtttccagatacaacattaatgtacacaatcagtatctcttctatacaccaacagcgaccaagctgagaatcaaatcaagaacttaactcctcttacaatagctgcaaaaataaataaaatacttaggaatacacctaaccaaggaggtaaaagacctctacaatgaaaactacaaaacactgctgaaagaaatcatagatgacacaaacaaatggaaacacatcccatgctcattgatgggtagaatcaatattgtgataatgaccatactgccaaaagcaatctacaaattcaatgcaattcccatcaaaataccaccatcattcttcacagaattagaaaaaacaatcctaaaactcatatggaaccaaaaaagagcccacatagccaaagcaagactaagcaaaaagaacaaatctggaggcatcgcattacctgatttcaaactatactctaaggccacagtcaccaaaacagcatggtactggtataaaaataggcacatggaccaatggaacagaaagaacccagaaataagcccaaatacttacagccaactgatattcgacaaagcaaacaaaaacaaagtggggaaaggtcaccctattcaacaaatggtgctaggacaactgacaagccacatgtaggagaatgaaactggatcctcatctctcaccttataaaaaatcagctcaagatggatcagggacttaaatctaagacctgaaactataaaaattctggaagataacattggaaaaactcttctagacattggcttagtcaatgatttcatgaccaagaacccaaaagcaaatgcaataaaaacaaagataaatagctgggacttaaactaaagagcttttgcacgacaaaagaacggtcagcagagtaaacagacaacccatagagtgggagaaaatcttcacaatctatacatctgacaaaggactaatatccagaatctaaaacaaacacaaacaaattaagaaaaaacaaacaatcccatcaaaaagtgggctaaggacatgaatagacaattctcaaaagaagatatacgaatggccaacaaacataggaaaaaatgctcaacatcactaatagatcaagaaatgcaaatcaaaaccaaaatgcgattccaccttacttctgcaacaatggccataatcaaaaaataattgatgttgtcggggatggagtgaacagggaacacttctgcactgctagtgggaatgtaactagtacaaccactatggaaaacagtgtggagattccttaaagaactaaaagtagggctgggagcagtggctcacgcctgtgatcccgacactttgggaggccgaggtgggcagatcacctgaggttgggagttcgagaccaggctgaccaacatggagaaaccccgcccctactaaaaaaaaatacaaaattagctgggcatggtggcgcatgcctgtaatcccagctacttggaagactgaggcaggagaaatcactttaacccaggaagtggatgttgcggtgagctgagattgcaccattgcactccagcctgggcaacaacagtaaaactccgtctcaaagaaaaaaaagaactaaaagtaaaactaccatttgctccagcaatcccactcctgggtatctacccagaggaaaagaagtcattataagaaaaagacacttgcacgcaagtttatagcagcacagttcgcaattgcaaaaatgtggaaccaacctaaatgcccatcaatcaacaactggataaagagactgtatgtgtgtgtgtgtgtgtgtgtgtgtgtgtattacatatgtgtgtacatatatgtgtatgtgtgtgtgtatgtatatatatgatggaatactactcagccataaaaaggaatgaattaatggcattcacagcaacctagaggagattggagactattattctaagtgaagtaactctggaatagaaaaccaaacatcatatgttctcactgatatgtgggagctaagctatgaggacgcaaaggcataagaatgacacaatggactttggagactcagggggaaagggtgggaagcggataagggataaaagacgacaaattgggtacagtgtatactgctcaggtgatgggtgcaacaaaatctcacaaatcaccactgaagaacttactcctgtaaccaaacaccacctgttccccaataacttatggaaattaaaaaaaaattttaataaaaaaatggagaaaccccatctctacaaaaaatacaaaaaattagccagatgtggcggcacaagcctgcagccccagctactcaggaagctgagatgggagaatcacctgaatctgggaggttggagccgaaattgtaccactgcactccagtctgggcaatcagagtgagacagtctcaaaacaaacaagcaaacaaatacttctagacctaggaaaagacttaaacaaccatacataataatgggagacttcaacagcccactgactaatgcattagcctgaccactgaggcagaaaactaacaaagaaattctggacttaaattcaacacatgatgaattggacctaacagacatctgcagactacttcatccatcaaccactgaagatacactgttctcgtctgcacatggaagatactacgagatcaaccacatgctcggccataaaacatgtctcaattaattcaaaaaaaaaacaaaatcataccaaccatactctcagaccacagtgtaataaaaataaaaatcaataccatgaagatctctcagaaccacataattacatggaaattaaacaacttactcctgaatgacttttgggtaaacaattaaattaaagcagaaatcaaaaagttctttgaaataaatgaaaacagagtatcaaaatctctgggaagcagcaaaaaagtataaacaggaaagtttacaacactaaacacctacctcaaaaaatcagaaaaatctcaaatcaacaatctattatatctagaggaactagaaacaaaagaacaaactaaccataaagacagcagaagaaataaaagcaaagaactaaatcaaattaagaccaaaaatacaaaggatcgatgaaacaaaaagttggttttctaagaggaaaaacaagaccgacagactgcaagctagattaacaaaagaaaaaagagagagaagatccaaataagcacaatcaaaatgacaaaggtgacaagcaaccaatgccacaaaaatacaaaagttccttagggacaattatgaacactcctatttacgcaaactagaaaacctagagaaaatggataaattcttggaaacccacaatctcccaagattgaatcaggaagaaatagaaaccctgagcagacatcagtattgaattctgaaattgaatcaataattaaaaacttatcaaccaaaaaaatccctggaccacatggatttacagccgaattctatcagatgtacaaagaagggctggtatcaatccttctgaaactattccaaaaatcaaggaggaactcactgcaactcattcgaaggatgcatcaccctgatacgaaaacctggcaaagacacaaagaaaaaagaaaactacaaaccaatatccctgatgaacataagacacaaaaatcctcagtaaaataactagtaaaccaaggctcggcacagtggctcacgcctgtaatcccagcactttgggagcctaaggcaggtgggtcacctgaggttgggagttcgagaccagcctgaccaacatggagaaaccccggctctactaaaaaacccaagttagccaggcgtggtggtgcatgcctgtaatcccagctactccagaggcttgaggcaggagaatggcttgaacccgggaggcaggggttgctgtgagacgagatcgcgccattgcactccagcctgcgcaacaagagccagacaagagcaaaactccgtcgcaaaaaaaaaaaaaaaaaaaaaaaaatatatatatatatatatatatatatacatactagtacaccaaatccagcagcacatcaaaaacttaattcactgtggtcaagtaagtttcattcctgggatgcaaggttggttcaacatatgcaaatcaataaatgtgatccaccacataaacagaatttaaaataaaagtcatatgaccatcccaacagacatggaaaaagctttcaataaaatccaacatcccttcatgataaaaaaaaaaaaaaaaaacctcttgaacaaactagacatcaaaggaacatacctcaaaacagtaagagccatctatgacaactccacagccaacatcatactgaataagcaaaaaatggaagcattccccttgagaactggaataagacaaggatgcccactcttagcacccctattgaacacagtactggaagtccttgccagaacaataaggcaaaagaaagaaataaaaggcatccaaatagaaaaaggagaaggcaaacaatatctcttcacggaaaatatggttctatacctagaaaacctgaaaggctccaccaaaggctcctggaactgataaactacttgagtaacgtttcaggatacaaaatgaacaaaaaccagtagcatttctatacaccagtaacgttccagctgagagccaagtcaagaacacgatcccatttacaatggccacaaaatacaatacaatacaatacaatacaatacaatacaatacaatacaatacaatacaatacaatacaatacctaggaatacatctaaccaaggggatgaaggatctctacaaggagaactataaaacactgctgaaagaaatcagagatgacacaaacaaatggaaaaacatttcatgttcatgaagtggaaaaatcaatatcattaaaaataaaaaacatttcatgttcatgaagtggaaaaatcaacatcattaaaatggccacacagcccaaaggaatacacagattcaacactattcctatcaagctaccaacatcattttggacaaaactagaaaaaaactattctaaaattcatatggaaccaaaaaagggcctgaacagccaaggcaactgtaagtaaaaaggacaaagtcagagatatcacattacccaacttcaaactatactataaggctactttaaccaaaaaatcatggtactggtaccaaaacagacacatagaccaatggaactgaaaagagaacccagaaataaagctgcacacctacagccatctgatcttcaacaaaattgacaaaagcaatagggaaaggactccttaattcaataaatggtgctgggatagctgactagccatacgcaaaagaatgaaactggacccctaactcaagatagattaaagatttaaacagaagacctcaaactgtaggaatcccagaagaaaaaagaggaaacaccattctggacatcagccttgggaaagaatttatgactaaaagcaattgcaaccaaaaaactgacaagtgggacctaattaacctaaagagctgcttttgtgcagcaaaagaaactctcaacagagtaaacagacaatctacagaataggagaaaatatttgcaaactatgcagccgtcaaaggtctaatatctagaatctgtaagaaacttaaatcaaaaagtaaaaagcaaataatcccattttaaaaatcggcaaaagacatgaacaaactttcatcaaaagaagacatacaagtagccaaacatatgaaaaaatgctcaacatgactaatcataagagaaatgcaaatcaaaaccacaataatataccatttgtaccagtcagaatgacaattattaaaaagtcaggcctcggatttctggactgatagtgagcactggcttcaacttaaagtcaccaacctcaccagtccctaacaagaaagtcagcctgtactttgaagttttgaagccagccactgacatcttttccctagctatgacagtcctagatgacaccatcttccagtagaaagctgtttcatctacattgaaactctgttgtttacagcagctacactcatcgattaccttaactagatcttctgataacttattgcagcttctatatcagcatttgctgctagtgggtggtttcttggcccacctgaagggcagacagcttttgcttctacttgcccatcagaaacatgattttttgcctggagtcagaatgaaaaatattcctatccttcccccatcagcagatggcttttccttctctctctctcccttaggacaagtatatcatgtgcaaggattggaagacaatatttttaaactcaatcctccccagtttgagcttagatcaaggcaataagaatcaaaatcccagaagcctttctggtatgtcattacacatcactttgaaaggtgcatgccaaaactgagagaaagtaagataactgactgcaaaggaacacaacacaactttttgaggtggtagaaatgttctaaatcttgatttgggtgagttacaggattatacacactttgtcaaaactcatcaaactgcacacttagagaacatgaactttattatataaaaatattaatgatcctatcttttaaaacttcagccagtttttctagtagaaattgacaagctggcaatcttagagtttgtgtattttcttcaatgctgctcagaactctgacagtagaatttgtccagagttagcattttccaggcagatgccacagaacaacaatgatataagggagttaaagatattagcaaaagaatggttgatgaaatagaccgagcagagaaagaaattttaaaagagggaggggaactaatgagcagggagaggaataaagtagaaacattttgtgaacgattaaagagcatattcctatagaaagagaagcaatcttttttaaaaattgacaattgtgccttagaaatcaaagagacttcaccttcatggctaagctcaagatgaagccatccacatgatacagcaatagaggcagcactatactaacaaatctcattaatattaaaccaaacaagtaatctaatggctacattattctccaggagtaaaaagtttgcttcaaggcagctcataatctggctcactttaaacaaataagtcaaagatcccccaaatgaatccagtaaacacgagaattttctatatttctatatttctatgtcaatataaaatacacatacaacacaattttctattttcctgacttggcaaacacaatataatgtacagagtttcatctgtctttgacatattgtgaattttaacacctcagaatatcatcataaaggtaatgtttttaatcaaaggcccccaaaaacgttattcttgactgagtggctttagagcatgtactcttctagttgcttgggaattttgtggagaacaagttacccacaaagtacctctcctggaagttaaaacagaggatttcttatatgcttaggcagacatactctagaatcatctttttaaaataagcaactagcaaatgcaatctggttttcctattgctatgttttggatatgtcccctccaaaattcaggtgctgaatctaaacggtcaatgtcatgtattaaaaggtggggtactttcagaagtttgaggttatagtgagctatgatcatgccaccacactccaacctaggcaacagagcaagaccctttaaaaaaaatcaggcctttaagaggtaattaggtcatgagggctcctcacctcgtgaatgggattaagaccctaatgaaagagatttcacccctgtcctttcacaatgtgaaaacacagcattcctcaccaccagaggatatagcaacaagacactatcttggaggcagagagcagcccttattggacaaccaaacctgctggcagcttgatcttggacttcccagtctttagaaccatgagtaaataaatttctcttctttataaattacccagtctatggcattttgttacagcagcacaaacagacttaagacatctatcatttgactatctcattaagtttaggcaagagcataatctcctattatactggcaatggaaatatactgaatcaaagataaaagcaatcatttttaaacattagtattacatgcagtgcaaaaacccaaagtgacggcagtcttacattgccaaagccatcaaaaggggaaggagagggaagaacagcagcataagctgctggcagaggcagggaaagacaagcagaaaggaaagagagaaagagacaaagtcagagagacacaggggaagagacagagagaaaaagagggagtcacagagaaagagagagacaacaaagaagtcaaaaagaaagggagatagaattagtaaagaaaaaagcagtgtaccctattcctttaaaagccagggtaaggttctgtctacccagccaaggtatattcttcttatgtggaatgtctacctatatctgcctccccactaactggaccggcacctgcaccttagtctttccaagttccaacattaacattgccccaggaaatcagaccctatcagtacccctcaaagctcaagtccatcagcacagagccatacaactaatacccctacttaatagggttaggaatggctactgctacaggaaccggaagagccagtttatctacttcattatcctactaccacacactctcaaaggatttttcagacagttttcaagaaataatgaaatctatccttactctacaatcccaaatagactctttagcagcagtgactctccaaaactgccgaggcctagacctcctcactgctgagaaaggaggactctgcaccttcctaggggaagagtgttgtttttacactaatcagccagggatagtacaagatgccacccagcgtttacaggaaaaggcttctgaaatcagacgcctttcaaattcttataccaacctctggagttgggcaacatggcttctcccctttctaggtcccgtggcagccatcttgccgctactcgcctttggaccctatatttttaacctccttgttttgtttcctctagaattgaggccaccaagctacagatggtcttacaaatggaacctcaaatgagttcaactaacaacttctaccgaggacccctggaccgacctgctggcactttcaatggcctagagagctcccctctggaggacactacaactgcagggccccttcaaagcccctatccagcaggaagtagttagagcggtcatcggccaaattcccaacagcagttggggtgtcctgtttagaggggggattgagaggtaacaacgtgctagcagccctcactcactctcagcacctcctcggcctcggtgtccactctggccacgcttgaggagcccttcagcctgccgctgcactgtgggagcccctctctgggctggccaaggccggagccggctccctctgcttgcgggaaggtgtggagggagaagcgtgggcaggaaccaggactgcgcgcagcactcatgggccagcacgagttccgggtgggtgtgggcttgatgggccccgcactcagagtggccagctgatgccgccagccctgggcagtgaagggcttagcacccgggccagcagctgcggaaggggcaccgggtaccccagcactgccggccctcccgcgctgagctcgaattcttgccaggcctcagccacctccccacagggcagggctcaggacctgcagccccccatgccagagccccccccaccaaggtgggctcccgtgcagccggagcctccccaacaggcgctggcccctgctccacggcgtccggtcccataaaccgcccaagggctgaggagtgcaggcgcacagtgcgggactggcaggcagctccacccgtggccctggcatgggattcactaggcgaagccagctgggttcctgtgttgggtggggacttggagaacttttatatctagccaaaggattgtatatgcaccaatcagcactctgtgtctagctcaaggtttgtaaacacaccaaccagcactctgtgtctagctagaggattgtaaatacaccaattagcactctgtctagctcagggattgtaaacgcaccaatcagcaccctatcaaaacagaccaatcagctctctataaaatggaccaatcagttctctgtgaaatgggccaatcagcaggatgtgggtggggtcagataagggaataaaagcaagctgcccaagccagcagtggtaacccgctcggtccccttccacactgtggaagctttgttctttcgctctttgcaataaatgttattgctgctcactctttgggtctgcactgcctttatgagctgtaacactcacctcgaaggtctgcagcttcactcctgaggccagcgagaccatgaacccaccgggaggaatgaacaactccagacacactgctttaagagctgtaacagtcaccgcaacggtctgtagcttcactcctgaagccagcaagaccacgaacccaccagaaggaagaaactccaaacgtgtccgaacatcagagggaacaaactccggacacaccatctttaagaactgtaacactcaccacaagggtccacagcttcattcttaagtcagtgagaccaagaacccaccaattccagacacattaggatatgccttttttttttcagtgacatccaaattctctagcacttcaaaacagtaagcttgttgtatctcatttttgttgtttcctgttcaatgtaagaatttccagccagaaacagtggctcatacctgcaattccagcactttggaaggtcgaggtgaaatgactgcttgaggccaggaattcaaaactagcctgggcaatgtagcaagatcctgtctctacaaaacattttaaaattagccaggcatagtaatgggtgcctgtagtcctagctattgaggaggctgaggcaggagaatcccttgagcccaggagtatgaggttatagtgagctatgactgtgccactgcactccagcctggactacagagcaagaccctgtctcttaaaaaaataaaaaaggaaaaaataattctgtcaaaatttttcctagctctcaatacaaagttttctaaatcttgaggggaggtgaagattctgtatagaatagtctccattttctccaaattcttcctaattttttataatttcaagaataagttacatttcaaattataccacagataatgctaatatggtgataaattatttaatattcttatcatttagagatgcatgctacaagttaagaacatatctaagattaacttcaaaataataaaggatgcagtatatataggggaatatattatgtaagattggccaaggaattaataattgttgaaactgggtgatgaatacatataggttcactttctcaactttgctaaactatgtttaaagttctccctaataaaaagatttttaaagagtaaacaataggtattaaatctaattaaattgttcttagaaataattagacacaaaaaacagtattaattgtaaattatttataacaaaatttagaaggaaattaaatgtccaaacataaaatattaattagttatagaacactcattccatgagataccaagtagccactaaaaatcatgttgcagaaaactcattgatataaaaagaattcacaatatacttctaagagaaaaaaaggcaggttacaaaataatatgtacagaattgaaccattttttaaatgtgagcatctgtgtgtgtatgtgcgtgtttgcatatgtgtgtatttctgccaaatactgacagactttgtttcattcactgctttatccccagcacaaaaaactgtacctggaacataataagaacaatacatacttgttgcaggtaaaggttttagaattccagacaacagggtttcccttggggtatgattctctctacgcttttgtttcatacggtttctcaaataaacattcagttttttctgttattgggggaaaacctttaaaattgtatctcacataacaaaattaaaatttatttgcctgattcaataattacttcatgaaatgcattcaataaaatcatcttatacactgaaaaaagaaaggcctcttctatactttgaatgaataaactggccacggcaatcagaaatagtaaaaacaggccaggcatggtggctcacgcctgtaatcccagcactttgggaggccaaagcaggcagatcacgaggtcaggagatggagaccagcatcctagctaacatggtgaaaccccgtctctactaaaaatacaaaaaattagccgggcatggtaggggacgcctgtagtcccagctactcgggaggctaaggtaggagaatgacatgaacccaggaggcggagcttgcagtgagccaagatcgcgccactgcactccagcctgggcaacagagtgagactctgtttcaaaaaaaaaaaaaaagaaaaaaaaagaaaagaaatagtaaaaacaataacctgttaatcagtcttatccctgtgagtgaattctgctgctgagcaataacataaccttactatctttaggaaactaatacttctaaaatgaatctttaaaacgggtacaaaaaattataaaatcagttttaaaaaattagtccattatattcattcaatacacacttactgaatttgtagacaataagttacctgctagggtaatccaaagaaaattaagttgtagcccttgataaccaagaggctcccaatctagtgggaaagatagatgaataaaagctaaatgaaacataataataaaggtagctgacatttattaggttctttttttggcattgtgctgacacttaacaagcattttctttcttttttttttgagacagagtctcactctgttgcctaggctggagtgcagtggtgcaatcttggctctctgcaacctccgcctcccaggttcaagcaatcctcccaactcagcctcccaagtagctgggattacaggtgtacaccaccacgcctggctaatttttgtatttttagtagagatggggtttcaacattttggtcaggctagtcttgaactcctggcctcaagtgatccgcccacctcggcctcccaaagtgctgggattacaggcgtgagccaccacacctggccaaacaagcattttcttatttaatccctataacaatctttttggtagttactacgatattctcagtttttagataagaaaacgttaagacttaaatgacttcctcagtcacttgagtaataaatggcaaaacagaatcaaaccaaataaaccctgtcccagatacaatatagtgtctctcattattaggatgctagtaaacaccaaagtggactctatcagttccatcagttactatcaagtataacacaatagtcaccttttttaaggtagatatccttttggaagtcttcccaagaatttcttatcttcaactcaactagttatctccactttgaaatacactattacaaccattaacctatgagcctctagagcacaggattcagtagtttctcttctcccagtgctatacaatgtatgcactcaagaaatattaaacagatgaacttttagcttcttttatgcttcctaaattccaaatcactatgccatattacataatagttggtctaggtcaatagcaatttcatttatgttattaggaaaatgtggtatgagagaatcagagaataaaattctgaagtgctaaattatggtggttatgctaatggcggaacactgctgactgtataagatgaaccaagatactcttcctccagggacttcttcctaatcttctaaatgtcctataagccaaattttataagagaactggaaatgtgcaaaactagggggtagttttgtttcttgcaaaaatctggtgataaagatctgagctaaaaatagcgagaatgatgggaaataattcaagagatatttcaaaagcagaatcatttctcactacatgcaagacaaaactcataactaactgcggaacctaagaccttctcagtcatctcatttctgtttcctacagcctagccagagtgaactacttcttaaaggtcctgaattctcacataacattttaaaactcccacaataactgtaatataggccgggcgcggtggctcacgcctgtaatcccagcactttgggaggccgaggcgggcagatcacttgaggtcaggagttccagcctggccaaaatggtgaaaccccgtctccactaaaaatacaaaaattagccaggcatggtggcgggtgcctgtaatcccagctactcgggaggctaaggcaggagaattgcttgaacccaggaggcagagttgcagtgagccaagatcatgccactgcactctagcctgggcgacaagagcaaaactccatctccaaaaaataataataataataataataataactgtaatataaaaagcagatagtgtgcagtcacttgtatgttacataagaaatagacagtagaacacaggaatgggaaaggcattcaaattttgtgttggaaaatgaatgaatgaagataatgcaggagaccttcataactgatttgagaagggactagcagctatctcttcatgatgagataatacaggccctacctctatatcaccattttctcttacaacatgatcttccccttctctctgcctgtcaaaattaaccacctccttaaagacacaatcaaaaattttctctgggaagtttaaagaaatcacctcctcacttctaccactgtccccacccatccacacaagcacacacacatacacaaagaactagtcccactgtctactatggtcccacagcacttggcacctgcctcattgtagtacttagtacagtgattcattattcctttcattattatgtactgtatgagaatatcactagagctagaatatgaattccataaagatatggatcatgtcttatctagcctatttccattaaatacctaccacagaacctcacacactactgtttaaataacatatctaataaataaatgaataaacaaatgaaaacaaatttgctaactcctggagacctaaaggaacctcaaaatgtctgtgacttaaaacatgcctttatgggaaaaaaaaaatatatcttcctatataaacgcttatggctaaccatgacctgcttcaacttaaatcagttttgctaccacagcaataaaaaatacacatatatggctagaagtcgatgcaaaggccaaaagcatccctaccagggctgaaatggccaatggggatattccaaattttatggttgcaaaatgacccaattaatcttagatttcagcaaagtatacatgctaactgaacaaagacaaaagtcactggagctcaagtcattattccaagtgactctaagctgttagtccctgtgttaatggagcctgttaaacaacccagtattagaaaacactggagctcagagggagcatgctaccccatgcacatttcccaagtatcctcacaataaacttctattactgaagataatctatgtacttctctaccttgagtcttaagagacctaagtaacagtaaataatataggaaaccaagcagaggaaagaatcacacaccaaatgtgaactggaaaaagtgacaacgccaattagtaaagattaggtgggctgaacacggtaagattaggtgggctgagcacggtggctcacgcctgtaatcccaacactttgggaggccaaggcaggcggatcacaaggtcaggagatcgaaaccatcctggctaacacagcgaaaccccgtctctactagaaatacaaaaatttagccaggcgtggtggcgggcacctgtagtcccagccacttgggaggctgaggcaggaaaatgccgcaaacccaggaggtagagcttgcagtgagccaagatcgtgccactgcactccagcctgggcgacaagcgagactccgtctcaaaaaaaaaaaaaaaaaaaggattaggtagaaggtgaggattcagttctgaacataatgcctttaaggagacagtaatcaaatatttgggtttttggttttgggggtttctgttttgttttggagacagagtctcattctgttgcccaggctggagtgcaatggcatgatcttggctcactgcaacatctgcctcctgagtccaaacaattcttgtgccccagcctcccgaggagctgggattacagaagcacactaccatgctcggttaattttttgtatttttagtagggatggggtttcgccatgttggccaggctggtctcaaactcctggcctcaagagatccagccacctctggctcccaaagtactgggattacaggtgtgagccactgtacccgaccagtaatcaaatgttatttaggagactggaaatagtgaataagactgagtacaaaaattccaagtctcaaaagtatttgtgggtcatttcaatcaaattgaagccattagagtagataaactcaccaaggaaataactatgcaaaataaataaataaaggaggaaaagatagaaaatgcaaagtcactgtcaattatgcactgtgaagatcagttcataaccgaacataaagcaggcagagaaacagaggcaacaggagaatcaaaatgccagagaaaacttcaagaaacagatatgaggaatgttaagaacagagaaaaagtttctggtcttgccaaaacaataactaatttgcaacctagagtagtttcattaataaacaaggcctgaccatgttggaaggctgaaacagaatacactcgtagaaacagatttttaaactggggggcaaaagtgtgattacaggaataaagtcctaagagctatgaaaagggacatgttcaaaggtcagataaaaggaagaagagaaaaaattgtcgtgtgacagaagcaaaaattatgtagaacaataatcaaatgaaattaagatgaaagtacataaggcagcacctcttcctaacagccactgtatttcaatcttctctaagaagtagcagaaagcatctgtgttaaattatatgaaaacatgagggcaggacaggaaagaaagtgtgaagtgagaggactggagctgtttctgaaaagtctgcaaacaccaaaacacatgaaacagctcagtcagtcataaaaggccttacggcagaaaaaatgaagggactatatttggtcctctttctttattttctctgtttccaaccttggaacagcagtttgcaagtttgtggacaggttgtaacttctgctaaggatgtctcttcagttttgaagagactcaggaaaagttcagaagaaaggagagagctgtttatgattggctaaaggcttttttttattattgtggcagaatatacacaacataaagtttactattttaacatgtacaattcagtgatccatacattcagctcttgtgcaacaattactgttatccatttcccaaactttttcatcatctataatatggtgatctagtaagaaattcctggcacactgcccctaaaacctttggaatttcccgaatgataagggtggaagaattatcttttgctattcataataagtccctttcaaacatatttgagcttatgctaaagagatgactcttggtaggcccctacaaagctgcaggggagtgggtagggaagctggtcacccaagaaatcaatcatgtgattacatagtcagaactttcagccccacctccagggaggggagaaggactagagactgacctaatcaccaatgaccaataatttaatcaatcatgcctacagggtgaagcctccataaaaaccctaaatgatgggactcagagaatttcttctggatcgatgaacacatccacgtgctgaaagagtgatgcaccccaactccatggagacataagctcctgcactggggacccttccagacctcaccctatgtgccttttcatctgtatatcctttataataaactggtaatagtaagtaaagtgtttccctgcattcaatgaatcattgtagccaatgactgaacttgatttgtagccaagtcagaagtaccagaggcctggggcttgcaactggcatctgaagtggtggaagtcttatacaactcagtccttaacctgtggtgtctgacactcactccagggagatagtatcaaaattgaattaaatgctaggacagagaactgagagctgtagggagaaaaccccatgtatttggtgtcagaagtcttataagtgtagaaaaagttttttatcatctccaaccaaaattctatacccattaaataactttccattttccacttccccatagtcccgtgtaaccactattctactttctgtttctatgactttgactattctagtggaatcatacaaatttgtccttttgtgtgtactttgcttcagttagcataatgttttcaaggttcatccatgttgtaacatgtatcagaattttatccctttttaaggctgaataatattccattgtatatatatataccacattttgtttatccattcatccgctggtggacacgtgagttgcttccacctttgggctgttgtacataatgctgctatgaatataggcacacaaatatcttgagaccctgctttcaattcttttgggtattgcattaatccgttctggcgctgctataaagaaatacctgagactcggtaatgcataaagaaaagaggtttaattggctcatggttctgcaggctatacaggaagcatagcagcttctgctctgcttttggggaagcctcaggaagcttccaaccatggtggaaggcaaagggggagtagcacttcacatggccacgtggccagagcaggaggaagagagagagatggggaggtgctacacacttagaaacaaccagatctcgtgagaaccctatcacaagaccagcactgtgggatggtgctaaaccattcatgagaaactgctctcatgatccaatcacctcccaccaggtcccacctccaacactggagattacaatttgacatgagatttgggcagggatacagatccaaagcatatcaggtatatacccagaagtggaattactgagtcacagggtaattctatgtttataatttcttgaggaattgctacactgtttcccacagtgggtgcactatttcactctcctaccagcaatgcacaagggctccaattgctccacatcctcaccaacacctgtgattttctgctgtttttttttttaataatagtcatcctaaagactatgaggtggcatctcattgtagtttccattgcatttccctgattactagtgatgtcaagcatcttttcatgtgcttattggccaatgtatacattttctttggagaaatctctaagttccttgcccactttttatttgggttatttgttttggagaaaagcttttaaagagagacacagaggaaagctttctgtacaatcagatctagctctctagtcaaaaataattggtgatatagtttgcatgtttgtcccctccaaatctcatgttgaaatgtgattcccaatgatggaggtggggcctagtaggaagtgtttgggtcatgggggaggatccttcatgaatggcttggtgttgtccctggcgatgagtgagttctcactctattaattcacaagaaagctggctgtttaaagagcctggcacctcctcttctctcttggtccctctctcttcccatgtgacacacctgctcccccatgccttctgccatgaataaaatcttcctgaagtgtcaccagaaactaagctgatgctgctgccatgcttgtacaacctgcagaaccatgggccaagtaaatctttcttcattaattacccagtctcaggcattcctttatactagcaacacaaaacagactaatacaattggtatctgccctctagatcttttaggaaactaatcatggagaagaggcactggcaagagtgctaacccagcagaagagaaaaaacttccacccctgagaacagagatttctttttcataaagtgccttctacctgatttcagctctgtaactgtcaatctctttttctcttctggcagatttccctatccactagagcataggttttaatgaccacactgctggtagctgtatcactactaatagtagctacttaatgagtcataagtgttactgctatgtgctaggcatgatccttcatctcatatgtgaaatctcatttaaaattaagtcctactaatgatgccgagaagattatcatggttcttacacaaggatgatatgcaaattcattaagtgttccatttaagaaaagaaaaaagaaaaaaaaaaaaaacctcttgtaccctagcagtttcatcttgaatactgttaaaaaaaaaaaaaaatacatctttaaaacacatgaaaggttttcatcctttagtccttcaatgtaacattattaaacgatgtcaaaaagtctcaaagttagcgttaaataacaagcattttctaaattatacattgaggagtctgatcttgaatccacaaaataaaacatcttttctacatcaactacaggaagtacatttttacctcaaactagtaaaatgaaaggttttgttgttgttttttgagacgaagtcttggtctgtcacccaggctggagtgcagtggcactgcagcctccgcctcccaagttcaagcaattctcctgcctcagcctcccaagtagctgggattataggtatgggacaccatacccagctaatttttgtatttgtagtagagacagggtttcaccatgttggccaggctgttctcgaacttctgatctcaagtgatctggccacctcaacctaccaaagtggtgggattacaggggtgagccaccatgcctggccattttttttttcaatcctgctcccttttgccttttaaaagctcaacattttataaatatttagcaaatgtttagctctgaagtaataaagttgatttttcttaaaaaattcaactagaactagaagtgaacatcgtctttttatactcttagaaagttatgtgtttctcatgaaaaaatgttcaccatcactggccatcagagaaatgcaaatcaaaaccacaatgtgataccatctcacaccagtttgaatggcaatcattaaaaagtcaggaaacaacaggtgctggagaggaagtggagaaataagaaaacttttacactgttggtgggactataaactagttcaaccattgtggaagactgtgtggcaattcctcaaggatctagaactagaagtaccatttgacccagccatcccattactgggtatatacccaaaggtttataaatcatgctgctataaagacatgcacacatatgtttactgtggcacaattcacaatagcgaagacttggaaccaacccagatgtccatcaatgacagactggattaagaaaatgtggcacatatacaccatggaatactatgcagccataaaaaagggtgagtttatgtcctttgtagggacatggatgaagctggaaaacaccattctgagcaaactatcacaaggacagaaaagcaaacaccgcatgttctcactcataggtgggaattgaacaatgagaacacttggacactgggtggggaacatcacacaccagggcctgttgtagggtggggggagtgaggagggatagcattaggagatatacctaatgtaaatgacaagttaatgggtgcagcataccaacatggcacatgtatacatatgtaacaaacctgcacgttgtgcacatgtaccctagaacttaaagcacaataaaaaaaaaaaaaagaaagtgatgtgtttcttcaaaagatgctgacgacgtcagacacactttttaaacagtttggaagctgtcttcagagacaaatgctttacaatcaatatttcatttaatcttcacaaaactcaaggagaaggtagtatataacttccattttacgagtaaattcagacagaaaagctaaataacttgcccaccactgcatttcagtaaatggcagagctgagattagagccaacatctatcggactctaaagcaccagctcttaattgcttcactttctatcattgttttgatagcaaaatagatgtaatctgatgatctcatagtgtatttacttttataaaacagtattaaatttatgggggtttaattaattattggcaccataaagacctgaaaccacctaagaaaataaatgctctgcaatagacagaagagcttttttaattatatgaaagtcttgtttttcaactctatcataccatttcctcttaagttgggctctttgcccaaaagtactctaaaattataattttctggcaaggagttttaaaagaagctgaaattttctcttcttccttcacccttggactctaatttttattatctaagaattttctccacttatcataaactggaaagtgatatgatttctttacatttcttgtaacaaacctatacaaaattaacaaacactgcaacatactccctatccctaagacatgttattacattcgctttcttaattactaattactcaaaaatcacaaattcagaaaatatagacaaatttgaaaatgctctaacatattcacgtcctattaaaataaatttgaaaattccctaacatattcatgttctagtaaaataaaaattaaaaataattttattagaaatatggacacctataaggctcatacattttaatccagttcgttgtaagtattctgaaataaccatacctagatttgagaactaaaaaaggcaactgaatctttaattgatttttttcttctttttgagacggagtctcactctgtcgcccaggcaggagtgcagtggcatgatctcagttcactgcaacctccacctcctgggttgaagcaattctgcctcagcctcccgagtagctgggactacaggtatctgccaccatacctggctaattttttttgtatttttagtagagacagggtttcaccatgttggtcaggctggtctcgaactcctgacctcaggtgatccacctgcctcaacctcccaaagttctgggattacagccgtgagccaccgcgcccagcattttttttttttttttttgtcacccaagcgcagtccaagctggaatgaagtggtataattacaagtcactgcagcacaacctcctaggctcaagcaatcctccaacctcagcctcccaagtcactgggacaaaggcatgcgccaccacgcccagctaattttttgtttgttgtagagacagggtctcaccaggtcacccaagctggagtgcagtggtacaatcacagcctgctgcagccacaaccccccaggctcaggcaatccttccacatcagcctcccatgtagatgggactacaagcgtgaaacaccacacctggcaaattttttttatttttagtttactttagtttgagacagggtctcactctgtagcccaggctggggtgcggtggcatgatcatcgctcactggaacctcaacgtcccaggctcaggtgatgctcccacctcagcctcctggctgtgaccacaggtgtgcaccaccatgcccagctaatttttgtatttttttgtagaaaccaggttttgccatgttgcccaggctggtcttgaactcctagactaaagcaatctgcctgcctcggcctcccaggtgctgggattagtgcatgagctactgcacccagcctaaaatctgctcttatcaacagtggtgttatttgtcttggattattttattttctatctttttcatttaaaatgacactaggtcatctgaaatatttagtggtgagaaaaaagtaagactgggtattaggattatagtgggtcaaagagcaaccagagcaaataggaagaacataaagataaaagtctgctctgaatagtctatatcacgtaatttgaatttatatatgcccaatttctgactcaaacttagaaaataaatgtgtagtggagagactatccagagaaaagagctcaaaaccaccagtgtcatcacttttggcagaatatccatagtttgaaagaaaaaatcagttatcctatctatgaataaaatgctattaaaaataacaggatattagttattaggatattagtctccaggttaggatcttgaaatatcatttcttactaagagaaaccacggctttttggagaaatggatgattccagatctaggacaagaagtatacaagatgggccccaaatatcacagcagacaacaaggaaactatcaaaaaccactagggtcatgttatctcctgaagagactcccactaaccaaaggtgagacaatttgcgcttcagtgaaagtgattccaatggattaaatccatcaagtatgtttaaatccatcttctcataatggcatttaaaagaaaaaaaaatggccacctttggagaaagacagggaactaattcgttatcttgaaaacttgtaaataaaaggaaagaatcaaacatttatcctgtctttcctttatcaacagtaccactgggtaactaaacagaagatgaggggaagttactttttataaaaacattccaattaataaatgaaagcaaaatgatgtatttagaatttcattatattgcaacacccactaaccatccacagccgctaacatcacaaaaaagaaagacaattagacattatgatattcccatggtcttgccaaaccccatctatatatatatatatatcacaatgcctaagggatcgaacttgagtctgctccatctctggatccagctgcacgtttgcagaaaatacagaagacaaaggaacatgttgaactgacctatattaagcaatcagcaaaatccaactctgggaaactagtacaaacaacctgggttctccaacaggaaaaggaaaaggatggaggactaaactaaagattaaaagtgacaactcatatcaaaactgctttttgggctgggtgctgtagctcatgcctataatcccaacacttggggaggccaaggcaagaccacttgagcccaggagttcaagaccagcctaagcaacatggcaagaccccatgtctacaaatacacaaattacctgggcatggtggccaatgcctatagtcccagctcctcagaaggctgaggcaggaggatcccttgagcccaggagggtcaggctgtagtgagctgagattgcactactgcactccagcctcagtgacagggcaagatcctgtctcaaaaaacaaacaaacaaacaaacaaacaaaacacaacctagagacagtgtttccctcttgttgcccaggctagagtgcaatggtgcaatctcagctcactgcaacctccacctcctgggttcaagggattctcctgcctcagcctcccgagtagctgggattacaggtgcctgccaccatgcctagctaatttttgtatttttagtagagatggggttttgccatgttggtcaggctggtcttgatctcctgacctcaggtgatctacccacctcggcctcccacagtgctgggattacaggtgtgagccaccgtgtctggccaaaacttactatttcttaatcatcaagactaacctacagtatctagcaatgcacatttgggttattactacacaagtcaggaaaatgattacttatagggaaaggccactgtgatctatttctcaacctgaggggtgattacaaaggtatctgccttataataattcaccaagccatacatgtgttctgtactaatgttttattttgcaataaaaagattttttttaaaatagcaggttaccagcacacctgaacatgtcaacacctaaaaacggctagatatgttttccattctctactctaactgagtgaaaacaataggataaaaatagaaatcaggccgggcatggcggctcatgcctttaatcccagcactttgggaagccgaggtgggtggatcacctgaggtcagtagttcgagaccagacaggccaatatggtgaaaccccatctctactaaaaatacaaaaattagctgggtgtggtggcacacgcccgtagtcccagcggcttgggaggctgaggcaggagaattgcttgaacctataaggcggaggttgcagtgagccaagattgcaccattgcattccagcctgggcgacagagcaagactccatctcaaaaaaaaaaaaaaaatagaaatcagtgtgcatcatttcctccctacccacttcctcttctaaaggaaccacttaatatcacattttaggccaatcagattcactttcttgggattatgaaattccaagaaagagactatagatatccaaacctgttctcccggtctttcctcattccccaagttgtttcaattcaaaacataggagccaggattgattctttttttcccctcattccccacatctagtctatcagcaagtccttcatttataactccaaaatatcgcaaatctctcaacttctatctccactgactctaccatctcaaatcacaaactattcaaatagtttcctaacttgtttctcttttattcttaaccctctacaatctactctacccaaagcagccaaaaggatgttttaaaaacataaactgcttaaaaacctttaatgacagcacacagagctctgacttaaatccaaattcctttccatggccggcatcattgaatccgtgcccatctctctgagctcatctctagccactgtcctcttctccaatccaggcacactggtgtcatttcaattcctcccacacattaagctctttcccacctccaggccttctcatagctttcccccctgcctggaatacttttcccttgctactcacatggataacttctcaatgtcaggttacaacttaaatatcaccttctcagagaagcctctgccaactgccctattaagcaggtttcaccatctttctctacacactacttatatctttcatagctcaagctacaacaagagtgtatgttatatgagggcaaagaacccacctgtttcattcaccaatgagcatctggaatgtggaaaacaattaataattactgaatgtatgaataaatgaggaaatgaatgaagtaaaggccgaatgccaattttgccatgagtagtgatcagtaagtaaagaaagccagttttcagaaagaacagagcaacacaacagagaacaggagactatgtggcttggttccataaacagagtcaagaaaattagctgccaattataaattataaatgtgtgtgtgtgtgtgtgtgtgtgtgtgtgtgtgtatcaagatagcagaaacatctgaaaaatttactcaattcacctctatactaagatgtctggtattatataaatctataaactaattcagaactcaaaataatactacctaaactaattatcattaatgttaacactttgtaattctcattttgctatgagtcatttttcaagatatactcctatgatgtactttcagaaattcaaggtaatcttcatgtcgatattcacggtatgtatgcaaacaatgaattttttttgttgtttttttgagacggagtctctgtcgcccaggctggagttcggtggcgcaatctcggctcactgcaagctccgcctcccaagttcacacgattctcctgcctcagcctcccaagtagctgggactacagatgcccgccaccatgcccggctaattttttgtattttgtttagtagagacagggtttcaccatgttagccaggatggtctcgatctcctgacctcatgatctgcccacctcagcctcccaaagtgctgggattacaggcgtgagccaccgtgcccagcccaatgaacgtttttgagacagggtcttgctctgttgcccaggatggaatgcatccacacaatcatggctcattgcagcctcaatctcctgagctcaagcaattgtcccacctctacctcccatttatgtaaatgtgtgggtctgtactgagtctcagtatcaatgaatttttttttttaaatgttgaaagccagtaatatatgatggcctgaagtgttcctagagtcaactaaagactgagtttctctagttgacatgcaacagaagtttgtttaccggaagtattgcaaattttattgtcgcactccctctctccaagaaggaagagccaactgactattcccatcagcacggcctaaagcaatcctaatcaagttaatgccaccctaaattaaccaagaaaagccaaagggaagacagcagatgctttagggaccaagttgttaattcagagatgctcctgtttggttggttcttttccccttggactaactactttgaatattttgtccacttgcctacctctagaattggaaattttccctagggccttcctctgagtctgctggggtttttttaagagttcttagagttcatcttctcaaagacaactccagctctctatttagtcaatctctctgatatacacacaattttactttccaacattccaaggaaacataaattagaaatatacacataaaatgacatccacccctcttctccctgcaataatatctttgtgatattcctactatctacttaactggtgtgttgctttctctcacccacttccattcataagcgctgagagttatctgctatctctctccattcctaattcctggcctgagatccgggctacagatgctacaagttgatgtgggctcttcatgctgaagaattcatgagtactttctgcttaactcctctatattctcaacccgatccctttgctttttctttccataataatctgttttctgatgggtaatccatccaaacactcatttgcccttatgaaattagtgttttctagctttccatttgcgtgaaggacccctaacatatgacttcaaccttcaattttatttcccccaaactaccctttcacactattaaaaataataataaaaaattgccacagaatccaactatagcttaaattaaagaactcacctgtcttgagagtaagtatgcttcaatagcttattcttttactatccttttagtgttttcattgttcaatgctaacctgccctccaaccataccttaatcaacgaattacacattttaaataactactaacactataacctatttgaggaacaagcctatctggtaaagtgtctcactccagcagtgatattctgtcctctctttgacaagtattaaatatattttcatgctgcccacctgtctatcatagagacccacctcccttctatgaaggttccacctggtgaagagcccatgttttctggtcatttacctttctacctatcaaagctggactattatgtggtcatttttctctcagctagcagttcccctataaaaaatccaataaattcggctgcgcggtaactcaagcctgtaatcccagcactttgggaggccaaggcgggtggatcacgaggtcatgagatcgagaccatcctggctaacacggtaaaaccccatctctactaaaaatacaaaaaagttaacctggtgtggtggcaggcgcctgcagtcccagctactcaggagggtgaggcaggataatggcgtgaacctgggaggcggagctcgcagtgagccgagattgtgccactgcactccagcctgggcaacagagcaagattccacctcaaaaaaaataataaaataataaaataaatccaacaaattccatctaaccaaaatgctaattaatgatcatttaataaaggagtccccaactcctttacagcacaatacagtggaccagtactggtccatggcctgttaggaaccaggcaacacagcaggaggtgagctatacgcgagcattaccgcccttgctctgggctccagctcctgtcagatcatcagtagcattagattctcataggagtgcgaaccctattgtgctgtgcatgcaaggaatctaggttgcacgctccttatgataatctaactattgcctgatgatctgaggtggaagtttcatcctgaaaccatttcgcccccaaccaaaccatctgtgcaaaaattgtttcccacgagactggtccctggtgccaaaatggttggggatctatgatttaatgaatttcccttcccagagggaaatccttttaataacgactttggccagcttgggcaacatggcaagacctcatctctacaaattaaaaaaaaaaaaaattaggtatggtggtgcgtgcttgtggtcccagctaatcagggaggctgaggtgagaggatcacctgagcacagggaggtcaaggctgcagtgagccatgattgtgccactgcactccagccagggcgatagagtaagacccaatctcaaaaaaaaaaaaaaagttaaaaagaaaaaaaaggacttctgaagacctcagtgacaagtatgttaacgaaatctaaggaatctaaaaactactctggtacctcaagttggtgacatgggtgaccacatctattgcctatgtttaacacaaaccttgttaaggagaccaaatcaatgaatatgagggtgagaggtgccttaaaaatcatctaggtctctgagtcatgattcttgaactgggctacacactggaatctccaactcccagaggagaagaagatgcccaaagaagcaaatttcaaagtcagtgacaaggccaggcctaatacccatgcctaacattatgtgttgatatgtgtacatacatacatatatatatacacacacatacatacacacacacacatacacacacacatatatatgtaacatactaaaaatataaaggcatgtatgggaaggacaaatatccaattcatgtcagtgattaccttttgggggatgggaagggagtgtaattgagaagaaatacacatggtggcttcaaatgtattggtaatatttttattaatatttcttaaactggatggtaatacctaagtatctattaaattaggctctgttcttttttctttttgttttgtttttatttttatttttgtttctttgagacagggtctcactttgtcatccaggatagagtgcagtggcacaatcatagctcactgaaacctcccactgctgggctcaagcaatcctcccacctcagccccacaaagtgctgagattacaaggcgtgcaccatcgcagtaggccctcattatcttctggatatctaaaattttgtaataaaatagaataaaaagatggtatataatcaaatgtatatcacattaggaattcagtgaaatatctcaggctagaaagtactcagaaaacatacttgatgaggtaggctttgatggaagaataaaacatagattattcttcaggcaaaaagtaacacaaacttttctaaaggaaaaatgtgaataaaggtaaagctgggagtacccacagcctataacataaataaagaacaacgggggccaggcacggtggttcatgcctgtaatcccagcactttaggtggccgaggcaggtggatcatctgaggtctggagttggagaccagcctggccaacatggcgaaacgttgtctctactaaaacacaaaaatgagctgggcgtggtggcgcccgcctgtaatcccagcctctcaggaggctgagggacgagaatcgcttgaatcaggatgccagaggttgcagtgagccgagattgtacccctccatctcaaaacaaaacaaaatagttttgaaaaccactggactaaagcgtccagctagaaggtactgctgcaattcaaaagtgagggtcataaaaccatggaatgggttttatggggtagtactcttgagaaagaaaacagaaaaaattaatccaccaactttttaatagaaaatttgataggctatagtgacaaactagatgggataatgaaagagtaagacctacctgaaaaaataaaaaatgccaactgagcagcagcttctagtcatacttgaacatcaacgacatcgataaggccatgtaaaagtcagcactaaggaagtgttattcaaggcagaaaagcaaaatggcacttttataaggattaagagcagaataagcaacagagaccaggagattacagaaaaagaggaccactacatcatggaatgataagaaagagagtttcaaaaagagccatcactgtatacaacaagagggtgcacagcctttgtagccaatcagatgcagaattctggcactttctccacttgaccaagttatttaacgtctttgagcctcatataataaggaaaacataagttaacaactaacactgttgaacacataggggcttcaaatatatttgtcaaattttatttcttaagctcagtcgtgatacataaatatttattaaattagtccccattatcttttgttgtttttgttttgtttttgtttttttgagacagggtctcgctctgtcccaagtgctttacatatcacctcatttaatccccacaatacatttcacagatgaagaaattaaacttagaactagcataataagtagcagagccaggattactatttcttaggatttaaataatgtatacttaaatttcctggcaaacaggatgacctcaaaacgagtagctatatttcattattaggagataataatcaataggggcaaaactgccagtaattcctgtcatagccttccatgtggcaaactctctcaacatcctcatctataaattaggattaatgcctataatccaatctactccatagggttgctgtgaggattaaatattatgaatatgaaaattctataaaaaatgttgagacattcaaatatcagggattgctgtcacatatctttcgccttcaaaaatgcttttgcggcatttttgttcactacttcaaaataagactctgaataagctaaaaataagtctgttaaaagtgcaaccaccactttgaaaagtataaatcaccacagaattgctgcctacacctgcccctgactcctccaggttctctaatgtctccacaagggcaaggattctcttacacctataatgaaactctgataacttacagtacagctaatcaatagagagctgcacttcaattcagagttgttcaaactggactactgtgttttctcagaggtgctccttccagttcttccagaaaagaaaaaagtgcccaattctcttatattgtattaaaacggtgcccaatgagtagaatgcaggtaacttacaaaatgctagaaaagaatctatcaattgacttgctcaagtgctctgacagcaggtcccttttggaaactccttcacgaccccccctttttttcacctgaacagatggcttccaggcttcaaggctcacatgtctagtcacacaattcacaatagctcccaaagttcctaacttttcaattatcccatgttcttgaacacacctttcatctaaagatctctagctgtcaaagcatacgaactctttaatcttcacaacagcactatctgagagattactatccttattttataagttaaaaatgaaagactgaggttaaatattttagcaacatcaaacaattcgttaattcattcttggggagagaggaatacatattatgaacttctgtcaatggacaacctagatttggcttcctaagatcattgcaaatattagctcaaacacatcccactcttgtatgcatacatttccaacacaggtgtcaaagattaaatataaactattaataacagtaaataccataccaaagcagcactatttttacacgcaaaactatattgggggagggggttctaatttaaacttcccactgtcttgcatccataaatacttttgaacttgagggggaagggggaagaacacctgtcagagcagcacatccacaatgttttacagactgtgtagctattaatatttaattcctcccgccccgggaggtcaggccgcagggagcccggcgctgcccacccgactttccacgcgccaggcctgccggccgcaggggaggctccggctcccgctcccctcaggtcccctcgcccgtggacagacgcggcgggacactcggacccgcctcccgacctcagcgcgcccggctcggggcccggcgggcggggagaggctcgcagcagggcctggcctagccacccccgccccgcggccgccggcgccgcttccctccttcttcccgctccccgattcgttacctcttaggcgccggcggctgctccatggcggccggggacagagagagggacctggtggacggcgaaggccgaaaggaggaaaggagccggggcaccggccggccgagcctagggcaccacagagggaaactctgggaactcggaccaactttcccgtaactccgcggcggatctccctcccgcttaggagcgcggctcctcccgccccgccccgcccccggccgccccgccccgcccccggccgccccgccccgcccccggccgccccgccccgcccccggccgccccgccccgcccccggccgccccgccccgcccccggccgccccgccccgcccccggccgccccgccccgcccccggccgcgccggccgccagcctgcggcggcggcccagagaaggtggacggagccgggcaccgcggcggggggcggagcctgccgcggcctgggttggcgggcggggccggtgccgcggcgggtgggcggggccggggacgaaggcctggctggccccagagccccgtgaccgggaaaaggagaaggttccgctagagctagggggcgaggccggagccgctctaggctggggaagggcaagtccctctgagctggcccagagctccgcccctagcctgccctcactacggtttgccctgatccaatttgactcatttctttggctttcccaacgacacatcctaacatcgtgtgaatccgtttgaagtattactttctcactgcccacgcttccctctctagttctgtttataattatcggttatgttttcccccagccatttgacatgtgtaggccacagtactagggatacttctggaaattcttgtttgatttttattgtggacaagctcctcgctacatttcacaataattacatctaattaccgagaaaataattcgtacagtgagatctctcggtacaccaaattcagttgcactgggcccttgcagctgtcccattgggtaacctggcaagcctgtcacaaattatgctgccaggaagaatactcaagaaaagtttgtttcctcccctctttggtcctctcccccaacctgattccagcagccctcatcccattgtaatctgaccactgcatgcatccatattgtgggtatacttttaaccttaaattccatatatacctttcacataacaatatacagctgctacatgagtttacttgtttttgtcagaaattgtcaagatgggccgggcgcggtggctcacgcctgtaatcccaatactttgggaggccaaggcgggcggatcacttgagctcaggagttcaagaccagcctggccaacatggtgaaacctcgtctctactaaaaatacaaaagttagccgggcctggtgatgcgcctgtactcccagctgcttgggaggctgaggcaagagaatcacttgaacccgggaggcagaggttgcttttaaccttaaattccatatatacctttcacataacaatatacagctgctacatgagtttacttgtttttgtcagaaattgtcaagatgggccgggcgcggtggctcacgcctgtaatcccaatactttgggaggccaaggcgggcggatcacttgagctcaggagttcaagaccagcctggccaacatggtgaaacctcgtctctactaaaaatacaaaagttagccgggcctggtgatgcgcctgtactcccagctgcttgggaggctgaggcaagagaatcacttgaacccgggaggcagaggttgcagtgatccgagatcgcgccactgcactccagcctgggtgacagagcagaccttgtctcaaaaaagaaaaagaaagaaagaaattgtcaagatgtagagttacatagaattttcttggaggttagaacaataaatatgaagagaatgttaaataaaggaaaccaatttgaagagaatgttgaataatgtgaatatttgcccaaattaaacttgactattagcagctaatacaagtttagtttagtcctctttttgcattattttaagtttcactatgtaataaacttacactattttcaaaccattatattctttcctaaatttagttattttaagaccattcatttttgaaactctaattctgagaacaagaaaaagggttttttttgttttgtttttttgagacaggttctcactgttccccaggctggagtgcagtggtgtgatcatgcctcactgcagcctcaacctcccgggctcaagcaatcttcccacctctgcctcccaagtagctaggactacaatgcccggctacaaaattttatacttgtttgcatttattaaagatccacagtctgactgttcagaaataacaggacaacaacaattttaaaacctaaatatttaaaatgttaaagctgagaagaatctttgaaattactccactctaacccccccaactctcatcttcacttccatgccatactcccagctttttttttttttctttcactcttgttgcccaggcttgagtgcaatgccgtgatctcaggtcactgcaacctctgcctccctggttcaagagattatcctgcctcagcctccctaatagctgggattacaggcacccgccaccacgcccagctaatttttcgtgtttttagtagagacagggtttcactatgttggccaagctggtcttgaactcgtgacctcgggcaatccacccacctcagccacccaaagtgctgtgattacaggcatgagccactatgccaggctcactcccatctttttgtgtttcatcagagaaacctcttgaggaaggctgggcgaggtggctcacaccttcaaccccaacactttgggaatccaaggcaggcagatagcttgagcccatgagttcgagaccagcctgggaaacatggtgaaacccatctctacaaaaaaaaaaaaaaaaaaaaaaaaaaaacaaaagaaatagctgggcatggtggcatgcacctgtagtcccaactactaggcttcagtgagccatgatcaagccactgcactccagcctgagcaatagagtgagaccctgtttcaaaagaaagaaaagaaagaaagaaagagagagagagggagggagggaggaaggaaggaaagagagaaagaaagaaagaaaataaatgatccctgaattgttttaccaacagcaatctccagggagcctttcccagtcaaaccaccagcatcatcacccactatctgtcacatttaagttgtgatagagatactgtcttgtatatatgtccgtagtaccctgtgttggcttttgtatgaaacttgtcacactatattgaagttctgtttattaggctgtcatcccaacccaactatgagttgattgaaagttgagccatatctttattctctataccttgcatagcaagtgcctgataaatcgtaagggcactgggctggatagcatccttttggtcctgcagattcattctccatccttttccatctgctctctgctctgagagctaatatgtatggctgacatcagaagccccttggcttatggttgggtctgatgatagacccagcaagagatcatctgagggagaaaggagggtgaggtcagactattggatgccctggttcccttcctgtgaggtgacctagggctagctgtgttccagagaatcatggctctttgcaaggcaaactactctacctaattattcctccttccccttgaccctttgggcctgagtatcatggctgctctgctattccctgggtttcttctctatgtcctatgttcccctaacctcaatcctcaactgatgctttgtaaattaaactcttttcaattgacactaatttgattgcaccttctaaagggcttatgatcttgactgatacacccataaagaattgtggaagtaggaggaatactatcagaaaataaatttctgaggtctttcctcaacttgaaaagggagaagactaataattatcatacgactccaataggatcagacactaggcctccattttctcattaaaccctgaaaacaaccttgtgaagtagttatttccattttataggtgagaaaactgaggttcaaaagtgtgaaaggagttaccctaggataaacagaatgtctgtgttctaatccaggcctttaagactccaaagctggaacttattccactgtagatcagtcaacaaatatttattgagcacttaagtatgccaggcactgttctaggtgctggatattcatcagtaaagaaaagagacaaatagacaaaaatccctgccttcaggggatttacattctggttggggaaacataataagataaaaaagtacctaatgggtcatgttagagattgaaaactggtaaggaagaaaagtgaaatggaaaaagggaatataaagtggaggggaagaggccggacgtggtggctcatgcctataatcccagcactttgggaggccaaggtgggcggatcacttgaggtcagcagtttgagaccagcttggccaacatggtgaaaccccgtctctactaaaaaaatacaaaaattagctgggtgtggtggtgggcacctgtagtcccagctactcaggaggtcaaggcaggagaatgcgtgaacctgggaggcagaggttgcagtgagccaagattgcgccactgcaccccagcctggacaacagagcaaaactctgcctcaaaaaaataaaaagtaaataaaaataaagtggaggggaagggatgaaattcaggtaggatggcaaaggaaggcctcaacgagagagtgactaaggaagtggaggccagagccatgcagatagcatgaatgtgaggccaagggaatgttagaatgtgaggccaagggaacaataagtgctaaggcccagaggcaggactgtgcctggtgtgttgtgtgttactcaataaaggaattgtttttctcctgaattacttagaagaagaaaaaaaaatgcttcaagcttctgttttactttgtctgttgaaaaccaacctgaagattccaggaagaaagcatagaagtcaccattcaaactgcaaataagaggcagcagcattcatgaacaaaggaaagctgcaggaacatttgagatacaggtaagggtcacccagcttcacttaactgtgaaagtaaggtaatcggccaggcgcggtggctcacgcctgtaatcccagcaccttgggaggccgaggcgggcagatcacgaggtcaggagatcgagaccatcctggctaacaaggtgaaaccccatttctactaaaaatacaaaaaattagccaggcgtggtggtgggcacctgtactcccagctactcgggaggctgaggcaggagaatggcgtgaacccgggaggcgaagcttgcagtgagccgagatagtgccactgcactccagcctgggcgacagagcaagactctgtctcaaaaaaaaaaaaaaaaaaaaaaggaaagtaaggtaatctgtttctgcttccaacagctccatttggaatcgagattaaatatacactttaattatactagcaaacagctgattacaattctcagttgagtgctctaagagaaatgggaaagaaatctgcaatttgagatccagtgcctttgaataacaaaaagcatacgttctttgtaactgaatacgtacaccaccatgtttaaaatattaagatagaaacatattaaggtaaaaatttttccttgtcatactagttgcagctattcattgaaactacaactttgtatttctcttaggctggagtgtagtgacacaatcaaagcccactacaaccttgaactcctaggctcaaggaatcctcctgcctcagcctcccaagtagccgggactataggcatccaccaccatgcccagctaagtttacttttgagttttgtagaaacagaggtctcactatgttacccagactggtctcgaactcctggtctcaagcaatcctcccaccttagcctcccatagtgctgggattataggtatgagccgccatggccagcctcatttttatatttgttggaaaaataatatcaattaacaaatgttaattaatcttttctgctataataaggaacagtttggggaagagagaaatcactaatcaaatatattgtgtaggtttttatttgcaggaaaatttggaaatgttttccttcaagaggtaactttacaaaacattttctcttgatctgtttctcttttctaacttagttttatagttagtttgaaactagcatgttgcatttgaatttaaccactgtcctcctttatcataacaatcttaaactattatttaacttgtttctcagaccacactgtgaacctcttgggaataaggacagtatcttcttcctatttgtcatgtcaggagtctagcataactattagctacaagtaacaactcaaaatgatttttaaaacaagaagactagaaggaggtgtttctaggtttgaataattcttcaatttacttccatttcttgttgttgatttaagaatcacaaggttcataaatttggagtggagagctttatttgttgtaaaaggttgcagcctgcaggctggccatcccacaatctgggaagcatagcctctgtcagaaaccggaagcaggcattttaaagaaggaagaatgagacggattggctaagtgtacatattcaataggttatagtgcctccttttcgtgaaaaaaaaaaaatatatatatatatatagatatctatatatatattcacaaaggcagacactcacatgcacaataagcaaacatgcatattatatatgtcccatgttcactttggggtggagatttaacatttacatgcattaaaattaagctatatacttcaaaaggtgaaaccgaagacacagaggcatcctgtgtgcatcctctgtaaatcagccacaaccaatccatggtggtcacttaccagaaaggaatgctggtcagttgtattgtcaaaaccacaaaaaaaggagtccagcaagtctttcaaaaggaatagttcctgtttaactcaggaaagaaagtctaaaggcaattagcaagggaagaagtataatgaggtatgtctgaccgcctatcctgtcatggctgggaatttagtttttaaggtttctctggggtccccttggccaagggggggtccattcagttggctgcggggcctaggatttaatttctatttctcactgctctgctgtgcacagcagacctagttgtctcctcaaactatctccctcccctcagaggacaaatatggccaccaatgttccaggccttacatggagacatgacaatgcccagcaccagaagataattagttatttctgaatacaacttttataagatggtaggaaaagtctattccagaagcccctctgcagacttccctacatgtcctattggctagaaatgtgtcacagacatgttgatgaaaaatgccaaactgtgtaaaatatttgaagaggtttattctgagccaaatgtaaggacaatgacctcaggaggtcctgagaatacgtgcccaaggtggttgggttacgcttgattttacacactttagagagacagaaactacaggcaaaaccataaatcaatatacataaagtttatattggtgtggcctggaaaggcttctcaaagttggggggtgcagggggagggttccaggtcataggaggatccaaagattttctgattgacaattggttgaaagagttaagttttgcctaaagagttcaaatcagcagaaagaaagtcttgtagttaaaataaggggggttatgggagccaaggttcatgttatgtagatggagcctccaggtagctgacttcaaagggaatagatggtaaatgtctcttatcagatatttaccagttaaatctctcctggatcaggaaaagatatggaaagggaagaggattctctagagaaagtaaatttttcccacaagagacagctttgcagggccattccaaaatatctcaaagaaatatatttgggggtaaaaatactttgatttcctttagggcctgttatttgtcatgtgatgtgaccagaggcagtttggagttggtatcttattgctataaagagtctgttctgtcaatctgaggattgctattttaatgttaacactggtcagttgtgcctaaactctacttccttcataacctgaactagtttttcaggtttctttggaatcccttggccaaaagcgggtccatttagtcagttgaggggggttagattttatttttggtttatagccccatctctgacaaagaaaaggggataaccaaaacctgttacgaccatttgtgattcaccccatggaggtgggtttagagttgaggctgggactagacttccctgaagtttatggcaaagagaaccatgcagagaagaactgagaaaaaaaaaacctttatctgagggatgtgaatctttaaaaattatcaagcccattgagacagcaatcacattctactcccctgcaaccacctgtttagctatgtattcatctcttaaaactgcttgctattgccacaagtagctataagtgtacctaataatgtagcaccagacaccataagccacactttatagttgaacaatgtatagcaaatcaatagcttatgttattttaatatacattcttggcaatggaactgcctcttctttccctttaaaattctacttataactgctgctaactggagtgcatattcatggcaacttgaatctgtgctcccaggctgcaatcttccaacttgacccaaataaactctctacttatattaattttgtctccacttcttcctttaggtcaacagaacaaaattggaatccgattatgtagaaaaaatggggaaattgtaattagacaacagactacaatgtctgctacacataagtactcagaacgttataatcaattaatacatgtttgttggataaatgaatggatttccaagcaaagaaaacataaggaggctaggaggtccaagatcaagggcctggcagattcagtgtctggtgaaggccaacttcctgattcatagacagccattttcccccgtgtcttcacatggtagaagaggtaaacagcttcctcagacctcttttgtaagggactaattccattcatgagggtagcccttatgacttaatcacctccagatgccatcaccttcaggggtaagatataaggaatttaaagagacaccgtaattcataaactatatattttgtcaaccttaaatgatgagattcagaaaatatgattaagtatagagtttactccagcccaaagcttgagaatgaccttctgatgaatagcagttacaagtggggtgtaaggaaaaaagaagaggcaattcctaaattgttaccaggaatttacattgaaataacataagctcttgattggctattcattttttgtttgtatcacaaagttcaggaacataaagatagtgggtgaggcagctagacaggaacaaaatgcttttacacagttgcccctgggcatgggttggaagaggcatgactgaagttccatactcatgactctctgggcctaagagagtcattttgcatacctcacatagctcagactactctgagctatttttcttttctcataagagaaaatgagtatgccatttgtgattttgtttcttctcaactctagattgatccttcattgcctgctctgttaaaatagagctaggtcctttaagtaatttttctttaccagatggcatgatggtaaactttgtcagtggacagcactggagagacattgcaaaagaaaaaggtttccttcctggtgggcatatgttccctctgcaggctcctgcacccagggctgcttttctgggtcctactaaatgggcaacttcaacattgtccagccaggtcctgcaacacatgtaccttcatcagcctttggttcctgcagtgcagagcagcaacagcacccagtggccaacagtttccttcccaccacaccccactcctccctcaggcaattttgctaccgagtgcccgcattgagacacctcaccatgaacagctttcccagaaacctaagaggaagatttctgcaaagttccagaaggaagatttccagcaagttctgtcagcatggcactacagtaacttctctgccattcagtgagacacagctgtgtcctcttcaacaaggtctggatctcaatcctggggggcctcttccttggatgctctagctcagccccagggaggagtagctgttattcctgttgtcttagtcagttcaggctgctataacaaaacatcataaactgttggcttataaacaagagaaatttgctgggcatggtggttcacgcctgtaaccccagcactttgggaggccaaggtgggcagatcacctgaagtcaggagttcgagaccagcctgcccaacatggtgaaaccctgtctctacctaagatacaaaaattagccgggcgcagtggtgggcgcctgtaattccagctacttgggaggctgaggcaggagaatcacttgaacccaggaggcagaggttgcagtgagctgagatcgcactattgcactccagcctgggcaacagagtaagactctgtctcaacagaaaaaaaaaaacccacaagagaaatttatttctcacagttctggaggctgggaggtccaagatcaaaggtctggcagattcagtgcctggtgagggccaacttcctgattcatagacagccatctttccccgtgtcttcacatggtagaagaggtaaacagcttcctcagacctcttttgtaagggacaaattccattaatgagggtagccctcatgacttaatcacctcccaagtccccatctccaaagtcaccaccttcagggttaggatttcaacatatgaattttggaggaaaataaacattcaaacaatagcacctatattctttagaggtgtctttgcttcttactagccaatcccttgttactccagtcctcagttatagttaataattctttatattaaacttttcctgttcaaataactgtggtctctatctcttgtggtttctgtatcagattggaccttgactgagacagagagtaatagcaaagaatcccaggccccactataaactcagaaaaatgatttagataagatcagattgatttcactttcagttcaacacataattatctacatcagcagatctcaaacttttctgtctcggtaccattttacacttttaaaaactatggagaagcttaaagagcttttgtttatgtggattatatttatcaatattaagaaattaaaactgagaaaattttaaaacacaagatacataagcacacatttcattaggcatcagatcaatgatatcattacatatccatgtggcatctggaaaactccatcatacactcatgaaagaaggagactgaaaaaggcaaataatatttaaaccttgtttttaaatagttttgaccttgtggaccccttgaaatggtctcagatacccccggaggtacctggatcacactttaagaactattgatctaaactaactttatataaacacaataactaagacctatgaagggaaaatatagaaaatatggcccttgccctctcagaactgcttagttgaagatatagagtatatattcatgaaagagtaaaataacaattcaattctgtatgtaataaactatcagtaagttctatcattcagaaaagtgctgtagttcaggctgataacaggctggagctcagcaaaaaaaaaaaaaaaagaaagaaagaaaaaaatggctttcattttataaaattcaccctccttatacagtagttacaaggagaaaaaacgtttcctttatgtacaaacctaagttccagaacaagctgaagatctctcaaaacacagcaatgattggctaagacactaaacacagccacagagctaaggaagagaaaagaaccaacactaagaatctgaaagactccataagatgaagccctttcatagtgagtctttagttacattgatataaggaaacttgtccaggtatggtgactcacatctgtaatcccagagctttgggaggcccagacgggaggatcccttgaggccaggagttcaagactagcctgggcaacatagtgtagacccccatctctaccaaaaaaatgtaaaagtcaactgggcatggtggcacacacctgtagtcctagctacttgagaagctgacatggaaggatcacttgagcccaggagtttgaggctgcagtgagctatgattgcaccactccactccagcctgggtgacagagcaagaccctgtctaaaaataagtaaattagtcttggtgtggtggctcacacctataatcccagcactttgggaggccaaggtgggtggatcacttgaggttaggagtttgagaccaacctggtcaacagggtgaaaccgtgtctctactaaaaatacaaaaaaaaaaaaaaaaaaaaaagtcagatgtggtagggcacacctttagtacgagctactcgagagactgaggcagaagaatcgcttgaaccctagaggcagaggttgcagtgggccaagatcatgccattgccctccaacctaggtgacaaaatgagactccatcaaaattaattagttaaaaaatatataagaaacctaaactctataaactaatgtttcttgctttaatcatttttctttatatatttttgatctttcaatttctttttattcctgcctgtggcctctatgaataatttctaatgtgtcttgactgaactaagcagaaagaagacttgtttacttctaggcgaggagagttagggaagtaagaatacccctagataaatgtgtactggtggcatcagttaatgctgttggaaaacagggcaatgaggcctagagcaggagcgaaaaaagaggagaggtagatgcttagtagacagagagaagctgcagtaaactcagctgccctaaggccagtctgagcatgtgatacattcaaagtaagctcaaattcaattgcaaaaagtttggaaagatgaaaatttttactaaaaatctcacagaagtgccgagggaggaattgtatgcatattaacacagcaaaacttcccaaaaatcctctttaccggtctttttccctaaagttttcctgaaaacctgcccaaataacttctccaaataacttcaccaaactctcaaggttattccattttctcatactcacccttctctccctccccgcaatcccgcccccaccctaccatcgaggccgtttaccttccttggctattacttcaagacctttcccccaacacacaaaataataatttaaccttcttctttgtttttgttttgtttgtttgttttgtgtgtgtgtgtgtgtgtgtgtgtgtgtgcgcttgtggcttttttgtttgtttgatttttgggggggggcggtttgagacaaggtctcactctgtcacccaggctggagtccagtggtgtgatttcggctcactgcagcctcaaattcccaggctcaggtaatcctcttgcctcagcctccggagtagctgggactacaggtgtgcatcactaggcctgacgaatttttacaattttttgtagcaccagggattcccactatgttgcccaggctggtcttgaactcctgggctcaagcaatcctcctgcctcggcctcccaagtggtaggactacagcatgaaccaccatgcccagactaacctcttccttaactcaacatagatggagagataagaaatgaaggatccttccttcagtgggtgggagaagtaaagggagaaagactgaatattcaaactttaatatttttgttcctttcaaacattctttttaccaacatttattcattaagttgccagacacagataatgaagtgtggtccctaacctgacactatggaatatccatccccattacaatcttctttttgctctttctttggaattcctttccaaagggagtgattcccttacaaaaggtaattttttgcttaataaagtgattattttacaaaaaattatccatggaatacttttacgtggttaatttccctcaggtatttaaactacgatttcaatctcagtctttaggagaaagagggtaagatgactgtggcttctaaaatttcctttgaaacaaagtcaaagatattaggaaagttatctcaggggcaccttgcgaataaatcatcatccaagggttttgagtaactcaaaagtaaaaaaaatagatttttctgccatataatcagttgttataaaataccgtcgacaaagaactgttgaattatctctttatatttagccacaaataaggggagaaagtaatagagaagggtctgaacaccacagatttatgcttagtaaatggaaattattttgaaaaaaataaagagtaagggcattaaaaatataggctgggtgccgtggctaacacctgtaatcccagcactttgagaagctgaggcaggtggttcacttgaggccaggagttcaagaccagcctggccaacatggtgaaaccccgtctctactgaaaatacaaaaaattagctgggcatagtggtgcatatcagtaatccagccactcaggaggctgaggcacgagaatcacttgaacccagtaggtggagtttgcagtgagccaagaacgcaccactccactgcactccagcctgggcaacagagtgagactctggttaaaaaaaaaaaaaaaaaaaaagaccagcctcggcaacatggtgaaaccctttctctacaaaaaatacaaaaattacctgggtgtggtggcacctgtctgtagtctcagctactcaggagactaaggcaggaggatctcttgagccctggaggtggaggctgcagtgagcatgatcacaccactgcactccagcctggggcaacagagtgacaacctgtctcaagaaaaaaatgtatatatatatatatatatatatatatatatatatatatatatatacacacacatacgttttatatatatttatatacacacacataacttattaattcctatctgtattaattgcctattgccgaatatcaaattatccccaaatgtaaccatttaacatttattacctcctagtctctgtaagtcagaaatccaggtgcaacttatcaggacccttcagttcagggcctctcaaaaggctgcagttgaggcaccagccctgtgtctctcccaaggctttagtcaaggtgatggccagggccatagtcacctcaagatttaactgggacaggatccacttccaagctcattcaggtgtttttggcaagattcagttcctcatgggtgctgaactcaagacttctgttccttactaccagttggcctttgagaggcccctcaggtcccagccatgtggccgtctctagagggcagcactcagcatagaggctggcttcatccaagtgaacaagtggagagaagacaagagagcaagcaaaatggaagtcacagtcttttgcaacctaatcagagaagtggcatcctattatttttttctctgttctatcaggtagaaacaaatcactatgtccagcccacactcaaagagagaggattacacagagcttgagtaccaagagataacttttgggagggagggatatgttcattgtcttgattgtggtgatggcttcacaaatgtgtatataaatcaaaacttatcaaacaattgatgtacaataaactgcacttgaattatgtacagtttattgtatgtcaattatatctccacaaagctgtttcaaaaataaagcattattttatctgtgtgcaaaactgaggttctttaaagcaggaactatttcaataattctaccatttcaccttaagaactctaaaaaaagaaaaaaaaagtacagggtctagcatggtggctcatgcctgtaaccccatggctttgggaggctgaagtgagaggattgtttgagcccaggggttggagattacagtgacctccactgcaccccagtctgggcaaaaaagagagacctggtctcaaaaaaaaaaaaaaaaaaaaatttaaaaatgtaaaaaataaaaataaaaagtttggacttgacagttctatggaaaatggaaaaagatgaaaataataatagtaataaaaaatacaaggttgtctactgcagactataagaaaaataggacttcaacaatcaggaaagacaaagtatctttctaatccagtggctctaactttagtatgcattaaaatcacttggagaatctgcatttctaagttttcaggaaatgttgatgctgctggtccagagaccatactttcagaatcagtgttctagttcatcagcaataatcaactagaaattgggaaagaaaaagatagcattcacaaatataacaagctccataaaatacatagaaataatccaaaagaaaactatataaaacctatatgaattttaaaaaaaatagtgaagggcatgcaagaagctctgaataaaagatataccatgttcctaaatgagacgatgcaatatttaaaatttttaaattctccttgaattaatatataaatttagttaactgcaattttttaaagtctcaaaaggaccttttacagaatttaacaagttaattctcaagttaaaatggaaaaggaaatacataaaaagagccaatgaggttttgaaaaaatgagcaattaagagagacttgtcctagcaggtggcaaaacatggaataaaaccatggaaattggccagccttacacctataatcccaacactttgggaggctgaggcaggcagaccgttagaactcaggagtctgaaaacagcctgggcaacatggggaaatcaagtctctacaaaaaaatgcaaaaaattagctgggcgtggtggcatgcgcctgtagtcccagatactcaggaaactgaggtgggaggatcacttgagcctgggaggttgaggctgcagtgagccttgatcacaccattgcactccagtctgggtaacagagtgagatcctgtctcaaaaacaaaacaaaacaatggaaattaaaacagtgtggtattggctgggcacagtggctcatgcctgtaatctcagcacttggtaggccgaggcaggtggattgtttgagctcaggagtttgagaccagcctgggcaacatggtgaaacctccctgtctctgtcaaaaatacaaaaaaaattagctaggcatggtccttagctaattagcacgtctgtggtcccagctactcaggaggctaaggtgggaagattgcttgcgcctgggacgtggaggctgcagtagccaagatcatgctaccatgtactccagcctgggtaatggagtaagactccctaaaaataaataaataaataaagtggtattaacttagatatagataaattaatatatataatatataataaataataagcccagaacataaccatttttatctggaaatgttgtttatgataaagtgacattttacatcacagagaacagatcactcaataaattaggatgaaacaggtgactttttggaatacataaaataaagttagatctctgtttctataactctgcatcagttaggcttctttatattgcaagcaattgatgatccagcccaaactgccttactcaacaaagggcccatttaactgaaagaccctgaaatagagcaattccaaatttaggatttgctttgagttggtggctcagtactgacatgaaagacattggagtttttgtttattcacttgttttatgttttctttttctgcctcttcattctgacataggcagtgtcagctgcttcctaagacttcaatggctgccgaatttgccaagctccaaatcttacacaaaactgccccaaaggagaaaaatactatcttttggtagctcctttatataagaaggagaaacctcctcttccagaatgcttccacaacctcttcttgtcattggctcaaactgtcggcttgaccattccctagcaggcaatgatttagtttacgcctgaaacaacaactggcttatctgaataaatctttgtggaaagagggatggaagccgtgcctggtggctcacgcctgtaatcccagcactttgggaggctgaggcgggtggatcacttgaggttagaagttcaagaacagcctggccaacatggcaaaaccccgtctctactacaaagacaaaaatttgccgggcgtgatggtgcatgcctgtaatcccagctactccagcgctttgggaggccgagtgggagtatcgcttgagcccaggagttcaagtccagcatagccaacaaaatgggactgcgtctcttagaaaaatgaattaattaagccaggtgcagtggcacattcgtcctagctactcaggaggctgtggtgggagaatcacttaaacccaggagttcaaggctatggttgtgccactgcactccagcctgggcgacagaacagaccctgtctctaaaataaaataaaatttaaaaaggcattttgtttagcaagtaaaaaattgtgagccactatgcccagtcctaccttttttattttaaaattataaaacagccatgggcttcaaggagaccaaactccttcccattacatgagaagaaatcttaattagactatgtccaaatctaaataatttcattatctttgcaataattggttcagctatgggaatatgatgtcattctagccaataagatgagaagaaaggaaatagaagagaacacagcctgcaagggggctgacagtatcccaacacagcttggttttgtgtgtgtgtgtttttgttttttttgagacagggattggctctgttgcccaagcagaagtgccttggtgcaatctcggttcactgtaacctctacctcttgggctcaagccatcctcccacctcagcctccccagtagctgggattacaggcccgcaccatcatgctcagctaatttttgtactttttgtagagatggggtttcaccatgttggccaggctggtctccaactcctgagctcaaggtatcctcctgcctcagcctccagagtgctgggattacaggtgtgagccactgtgcccggcccaaacacagtcttaaagaatgtcaatgattattgctagcatgatcagatggttattccaactgcagctgttcttctaaatatgcactggggcaaaatgctacagcttcagtcactggtatacagctttggagctaggaagtgttttttctactttccaataagcaaagtacaccagaagcactttgctttcacgtgacaaaaactgacaatggttggagcagagcatcccagtggcaatgacttgagattgtcacttagttccttctggatccctggacttgctctggttcttatcctctctgagaccctattctatagtttttgcctcgattctatggctacatcatggccctctaataactttctttttttacttagagttcatttctgttacttgcaagaaccctactagctataccgacttatttttttaaaccacgtatttatttcactgagtttttgttttgcattcagttttataatatatttatcaattttatgtcttatgtgcttacttgattttgttacatgtcagcagttcttttctaccacaacttcctcattcttaaattcttaagttttgacgagtctctcaatgtaatagagctcatctttaagaaacttttcagacagaacacatagatggtctaattctgagatcttttataactgagaatgccattcttttgacatcacacatgacagcactcccaccctcagtttctatgggtattgctttattgttttatggtatttggtgttactcagaagcctgaggccaatctgatatttttccgctgaaagtaaccatttttccacgttcatatacttggaagttttctcatatgttttcttattatttctgcttcctttgttatttttacctttataagttctacacagttagtctggactcttgcagttgctaatgacagaaaatcaacttcaaattgatcagcattcaattgtgggcaaaagaattcattgaagccagtttaagcagagagatacttactaaagtgtattaacttgctgcagaatgattggaagacttgtagcaggaggctggactttcaggaactcctggagctacattgaaatctacctcagcaaagttgctgctaccactgccgctgcaccactactgacttaaagaccaggctgcctttaagccatggtcaagaaagttgccagagtaggaagttgctgttgtcactgctggttgcacagagctaggaactgacaagacatcagagcttctgacagctgctgcaaaagcaccaaaatgcctctgccactgtgctgctggaatagccacctcataggacccataaccctcttccaaatctcattcagatgcatctatgtgatggatgctacatcccatgcagaaatcctcactgcaaaggtctatgggtaatgtagacttccatcttccagcctctgatgtacacgaagtctcattagtatggggttggagcagtattgagtgaaccaattgatagtgtctgccacactcactagaataaaacaaatttgttcacccatgtccctgggaaggccaaggaatagagctgactctagaaacaaatggaagcaaaagttcaaaccatgacacaggcattctttctctcttcctatttttcagttctgattttattcatttaactaacatttattaagcaactactatgttccagacactgttctaagtgctgggatgccgcagtgaacaaaacatacataagtctttgcccccttggtcctgttttctgggagagctttgttttctggcagattatttgaaaatggcagcaaaactagttcccagtagctccaagcgtataggttacttagtgcttgaaatatcacaagaagaaaggtttttcctcccccaaagccctataaattccacacaataaaaagattctaattggttttattatatgatgtatccaagaccaatcaggtattgaggggcatgtaccatatgtccactggatgtggagagactgttcccaaacacaaaaggtgctgaaaccacaaagatagagttgatgtccgtttcattcctaaactattcaggatcctacacacacacacacacacacacacacacacattttcatatactttaaaaagtgcccccccatgacaatgcaaatttttcttccacaaatgaaaacacactctctttctccccaaaagaagaaacctcaaaactcatctagtcaccatattgtgctctaaagtcccagaattttaggtctagatatgactcttcatttaataaccaatggataaattaaaaatataggctgggcacagtggcgagtacctgtagtcccagctactcaggaggctgaggtgggaaaactgcttgaagccaagagtttgaggttgcagcacgctatgattgcatctgtgaatagccactgtgctctggcctgaatactcagttttgcaatatatgaggtgaatcagaagaccacaacaaaacctcttatttgaaaactgagagccaatttccagtggccaccattctatagcatatacctgtgctgctaaaagaaaaagtaaggagtctgccctagcagtagggtgaatcttgcactgtcaactccatgagctagtaaccaaagccaaagatctgccaggtcctgaattttgaacccgaacccacagcccaatggctttttctctttgccacagaccttgatgctgtgcccatacgcctcgctcttggtttaactgtattgttcctggctgtgtcccaacaccccaagatccagtagtctttctcagaccacatcccagtggttgtctttagtagcagaattactgtcacctttgtagtgctgagaagtaacagcaggaggtgtctggaggaggcctgggggtcaagcttctaccacagccaggatctttttccctctttttttaaaaaaaaggtttttttttgtttgtttgtttttacttttaaaaatatttcttcctaattatgtgcttacttaaccccagccagttttatcttctgcaattcccacctgcctaccttacctctcactaactttagctccaggttcaagtagggaatagagtccttagacttctccaaatgcacatgatcagctgcttcttagttatcctacaggtatctcagatatcttgctggttacagacagaaagggcctctccacagagctatatgtcattccccttcagcatgctgtttattcagcatgctgtttaggttaaagccttcttgtttaaaaaaacagttgtatagagatataatttccatgccgcacaattcactcatttaaagtgtaaagttcaatgactttttaatatcttcacatagttgtgcatccctcaccataatccattttagaacatttttatcactccaaagaaacctagcactcacctctcaattccctcatccctcccagtccctggcaactactaatctactttttttttcttttttttttttgagacagagtttcgctcttgttgcccaggctggagtacaatggtgacttctcagtgctccctgcaacctccgctttctgggttcaagtgattctcccacctgagcctctcaagttgctgggattacaggtatgcgccaccatgcctggctaattttgtatttttagtagagatggggcttctccgtgttggtaaggctggtctcgaactcctgacctcaggtgatccgcctgcctcggcctttcaaagtgctgggattacaggtgtgagccacacatctactttccgtctctacagatttacctattctggacatttcatatgaatggaatcatataaaatgtggtgctttgtgactggcttctttcatttagcataacattgtcaaggttcatccttgtggtagcatatatcagaacttctccttttattgctggataatattcctttgtgtggatgtactacattttcctcaaccattcattagttggtggacatttggttgtttcttactcttggctattatgataatattgctgtaaacattcatgtacaagctttgatgtggacatgtgtttgcatttcttgtggaatacctaggagtggaattgctgagccatatgccaatagcatgtttaactgcttgatgaaggctgtaattttcttgaaattattaaaagcagccaggcacagtggttcaagcctgtaatcctagcactttgggaggccgagacaggcagatcacgaggtcaggagttcgagaccatcctggctaacacggtgaaaccccgtctctactaaaaatacaaaaaattagctgggcgtggtggctggcacctgtagtcccagctactcaggaggctgaggcaggagaatggcgtgaacccaagaggcggagcttgcagtgagccgagatcacgccactgcactacagcctgggtgacagagtgagactccatctcaaaaaaaaaaaaaaaaaagaaattcttaaaagcataaaaaatcatcaacttattccaatatctgtatattttctacaagtcactaaagcactagctatagaaggcacatgatcagatttctcaaatataacatgtgtggttaccctataatccaagtgttcagttcttagatggggacagaagaatccttattcccacttacatacctcaactcacccagttcttcatgttagggcctaagacttgctgcactccacttctagttaccaatatttatcttatgattgcaagtaaaccaaacagttaggtctcacataactgagaagtttgggagacctgacttcagatatagatggatgcaagggttcaaactgaatagagacagatgccagctttctacttttcagcaatcctttttctgctttggcttaattctcaggtgagcttgctctgcttgacaacaaaagtgctcttagaagctcataatttcagataccaaaagagatccgtatcaatctcttcataaattgctaactggccctccttggaggtgggggtggggattatttttactccttgttcaatttccaggtccaaaggaatagggtggtcagcctgggttacaggcccattcctgtggcaggaatcagggggtcaaatgattgctatacacactaggtatggcatgagaggttactgaaaggaaaatatgcctgcaaaacagaaaagaaacaactgttcaacactttctgtatctattattcaatctcataattttcatttttatctctttatcacttttatgggtttcctatgaaatgtttctcaaatttgccctatacatcatttattcggttttctgcaaggtgaagtctataattcaccttccgcactttggtttctgtgtagatttaaaaaaatgatttacgtatttattatttatttaattaatttttttagagatggagtctatgttgctcaggctgtagtgcaatggctattcacagggacaatcatagcacactacagctttgaactcctggactcaagcaatcctccctcctcagcttcctaagtagctgggactacagtcaacatgccactacacttgtatttaaatgtttactgtgagtctcctctgctctgggtattgggctgggacaaggaccctgtcttcagagagattactgtctaatggaggaggaagccaagaagcagaaaattacaataagatgatatgattaaggtaagctcatggggcttacaagcgcacagcacagacatccaacccagcttgggggtagtcagaggtttcctaaaggaggtgacatctttcaagaatgagtattgattacacagggaatgagggccaaagaaggaagggaatttcgggtgttggagcagtatgtacgaaggcatgaagatgtaaaagggcctgtcatgaaagaggaacaccagtgatttcagtgtgactgcgacgtgcagtgcgtggtgggcagcaagaatgaggctggtgaggagcacaggggccgggtcatcaaccacacctgtgtgcctgggggttcagagtttaacctggggcagtggaagggtttaaacaggagagtgtcatgatcagagccgcattttagaaaggcagctccagggcccttcagaatcaagaagattgtccaagagattactgcagccacaatggtgagagagggtgaggaactcaattatgaaagtgtggcaggtgtgtaaccttcacatgcccagctccttcttgtgattaagtcagaagctcacctggcatctcctaggagattttctctgctctcctagaaagtgatcttcatatagctaaaacctcctcacctttaagcatctgagctcaatgctcacattgagatgtcacatctcaaagaggccttcaccattctagggaagcaacacccccaaccatcagcactgacttaagtataatttccatgaggacagggagtcatctatcttactgttctctgtactccagagcccaaacagagtaggagcttaagagcatgtgtttagtgggtgaatgtcgaatgaactgaagccattctcatcttcaggcaatgtgcggaagttcctcgagcccacgctagtatagagaaaggctcttgtggcaaggtcatggttgaaaagacagaggttgcagagtcagaggggccttcagatatgaccattctctgagcatcttatcttgccttctgtgttactacagctctactggcctgaagtgtgttccttaatgtaatcaacaattagctctaaggagtatgaaactgcatttttgtcaaaaactatcttcctcaactacacggaaaaatccatttttagagtgaagaaacatgaggttaaaaaaagaagaagagaaggagaagacagagaaggatgaggaaaggagggtgaggaggaatagaaaaaggaggggtagggcatggtggcttatgcctataatcccaacactgtggaaggtagaggcaggagaatcgcttgaggccaggagtttgagaccagcctagtccacatatcaggcttttaaattttttttgaagataccttgtctttacaaaaacatttttttaaacagtcaggcatggtggtgcaaacctgtagttctagctacttagctagaggctaaggtgtgaggatctcttgagcccagaggttcgaggctgtagtgagctatgattgtatcactgtactccagccttggaaacagagtgaaatctgctcttaaataataaataaataaatgaaaaagaaaaagaaagaagaaggcagagccaagagacagaaagacaagagaatgatgtatagcattcagctacatctcttagactttgcaattctatgaactaacaagttgcctttggagctaagctaattttctttttttttttttgtaacagagttttgctcttgttgcccaggttggagtgcaatggcgtgatcttggctcactgcaacctccgcctcccaggttcaagcaattctgtctcagcctcccgagcagctgggattacaggtgcccacaccatgcctggctaatttttgcatttttagtagaggtggggtttcaccatgttgtccaggctggtctcaaactcctgacctcaggtgatccactcaccctggcctaccaaagtgctgggattacaggggtgagccactgtgcccagcctggagctaagctaatttacactggctttggggactttcaagtaaaaacaccctgacccagttaataataaatcaaataatcaatctatccctatacctatctactaatatgttcttcaaggacatagttgacaattcactcttctgatttaatttcctttatcttttctactctcatcttttccttgagatttaaaaaaaagccagagggtggaaaaaactttgcaggggcaattctcacagtttatttttgtgtttctctcaaatctccttacatgtttatgtaagatactactgtgggtctcatgttatccacagaatcttaaaagggattattagcatagctgtggctttctccctttaaaataaaccccatgttacttggaatttgtattcctcaagggaccattttttccagatacacatcatactaaatactttaatcaaatgtgtaatcaaaaatattttccattttacttcttttattcatttaatggatttatgttacccattctttttggaagataattaacttggaataaaggctcagcttttatattccaaaatatgaaaaaaaatttcttctttctgggacatataaaatgtcaatctaattgtgcattgtttggtatagtcatgtgtagttctaaggaatatgaaattatatatatattaatattaaattaatttttcctagggtatcactctcacgcttaaaagaatttggtatagggtatgacttgagcaggttgtatagatctttttagggctctcacattatttcaattatcactaattgaaatacctaattatttcattacctaatattgtcagataggtcccacatatctgtatctttgagtcccatggcaccaagctcaggagtggttcctgccttcaacacagttcagaaaaggtcttggattgaggcagaagttggttcagtaccagggagtgagctctgttcttactgctggtctctggtctgtctgcctaagccttggtctgtgttttcttctattgctgttttccttcccctgctttgcacacctcctcgttcttactttccctctgggtctagtttcccactggctctattttatggctggtcctgacttctctgctaatgcacattctggcttctattgctccatgggttgctgacccctgactgctttttaatccatccaggtcttgcatctagccacactcatttgtgctccacaatgctagtgctgattcatcacatctgtcaacacttagagataatgaagtggggaagctcagacagaatcaggaaccaaaagaaagatacaaactactgaaactgactccagaagaaatagaaagtctgaatagaactatatgtcagaaagatgaattaggaattagtaatgaataattagtttgtaattttttataatgctcataaagaaagacccaggcccacatgttatccccactgaattctaccaaacattccatgaggaataccaatttttcacaaactcttccaaaaatagaagaggcaggaacacttcccaaatcattctgtgagatcaatattacctagatatcaaaatcacaccaacataccacaagaaaactatagaccaatatctcttatgaatatgaatgtaactaggcaagaaaaagaaataaaagacattgagattggaaaggaagaagtaaaactatatttatttatttatttatttatttttgagatggaggcttgttctgtcacccaggctggagtgcaatggcatgatctcggctcactgcaacctctgcctcccgggttcaagtgatcctcctgcctcagcctcctaagtagctgggattacaggtgcccaccacaatgtccagctaatttttatatttttaatagagatggggtttcaccatgttggccaggctgatctcgaactcctgacctcaagtgatctgcccaactctgcctcccaaaatgccgagattacaggcatgagccaccatgccgggcctaaaactatttttaaagatgatgtaatctcgtatatagaaaatccttagaaatccactaaaaaattacagttaacaaatgaattcagcaatgctgcaggatacaagattaatatacaaaaattaattgtatttttatatacttgcaatgatcatttaaaaataaaattataaaaaactcatttacaataaatttaacaaaaaaagcacaaaacttatactctgaaaactaaaaacgttctgtaaagaaattaaagaagatctaaataaatgaataaaatgtcccatgttcatggatcaaaagacttaacattgttaacatgttactactctccaaaactgggcacggtggctcacacctgtaatcctagcaatttaggaggccaaggtgggcagatcactttgaggtcaagagtttgagactagcctggcaaatatggcgaaaccccgtctctactaaaaatacaaaaattagccaggcgtggtggtgtgcacctgtaatcccagctgctggggaggctgaggcacaagaatcacttggacctggtaggcggagattgcagtgagctgagattacgccactgcattccagcctgggtgacagagtgagacgctgtctcaaaacaacaacaacaacaacaacaacaaaatgttaatactctccaaactgatctatagattcaatgcaattccaatatcatctcacctgacagctttgaacaaatctacaagctgattcttaaattcatatagagttcaagggatccagagtagccaaaacaattttgaaaaagaagaataaagtaggaagactcatacttcccaatttcaaaacttactacaaagcaacagtaatcaagacagtgtggtgcaggcacaaggacagacatatggatcagagagtctagaaataaatttatatatctatggccaatcaactgatttttgacaaaagaaccaagatcattcaatggggaaagaatgtcttttcaataaatggtgctgagacactggatagccacatgcaaaagaatgaagctggacccttacctcccactatttttaaaaattaactcaaaattggttagtgacataatagaagagcaaaaactataaactattagaggaaaatataggggtatattttcatgaccttggattcagccatagcttcttagatatgataacaaaagcaagagcaacacaagaaaaaatagatatattagacattgtcaacattaagaacttttgtgttgaggggcttgtatctagactatataaaggaggctttcaggctgggcacagtgactcacatctctcacatctgtaatctcaccactttgggaggttgaggtgggaggattatttgagatcaggagtctgagacaagcttggccaaaatgatgaaaccccatctctattgaaaatacaaaaattaggccgggcatggtggttcacgcctgtaatcccagcactttgggaggccgaggtgggtggatcacctgaggtcaggagttcgagaccagcctggccaacgtggcaaaactccgtctctactaaaagtacaaaaattagctgggcattgtggcaggtgcctctaatcccagctactcaagaggctgagggaggagaagtttgaacccaggaggcggaggttgcagtgggccgagatcacaccactgcactccaacttgggcgaaaagagagagactccatctcaaaaaaaaaaaaaaaaaaaaaaggccatgcagtaatggcaggtgcctgtaatcccacagctactcaggaggctgaggtctcaacctgggaggtggaggttgctgtgagctgagatcatgtcattgcactccagcctgggtgacagagtgagtgagactccatctcaaaaaaaaaaaaaaagagttctttcaacttaataataaaaagccaaataacacaattttaaaatgagcaaatgtctgaatagatgtttaccaagaaagagatacaaataaatggccaataagcacatgaaaaaatggttgacatcattagtcatcaaggagacgcaaactgaagccacagtgagataccatttcacacagtaggatggctagaataaaaaagtcaaatagcaattaagtgttagcgaagacgtggaaaaattagaactctcacacactactagtgggaatgtaaaatggcacaaccactttggaagacagtctgggtgctcctcaaactattaaacataagattaccataagacccagtgatttcactattaggtatatgcccaagagaaataaaaacatctgtccacacagacacttgtattcaaatgtttgtagcagcattattataagagccaaaaggtggaaacaacccaatgtccatcaactaatgaacagataaatgaaatgtggtacatctatgtaattaaatgttactgggccataaaacagaacaaagtactgatatactgccataacatagatgaaccttgaaaacattacagtaagggaaaggaaccagtcacaaaagactacataccataggattccatttatataaaagtccggaatagagaaatctataaagaaaaaacctggattaatagttgcttagggcaggggaggacagggggaagacagtgagagagcagatagctaaagaatagggggtttcttctcgagatgatgaacatgttctaaaattgactatggtaatgcacatatttgtgaacgtactaaaggccaccgaatcacacactttaaagggtgaattttatggtatgtgaattatatctcaataaagctgttaaaaacaaacaaacaataaccaaatccacccaagggttgtatttgatgacttttcagaacattaaaaagctttgaacatctagtgcagattcctgaaagtttagcttcatggatctgtttattttgcaattaatgaaggttaaaggagcattctccagcctctcgaaaactgttacttgggagcttagaatttctagttatgaatctatgcacaagaacagcacctgtcatgtctttcaaaggaaaatgtatttgccttattaacaaatcaagagtactaagtttctatcaaaagagcagaataaaaaaaagattaaatggcttatttgctcattgtttagagaagtatgctagtgaataataggtttaaacttctgtaagagttactagcatttcaagttcttaaaaaaggaataatgcattaaagtccatttaaaacttctaaaagtgacatcaatgaccataaaatagaagctgaatgagtatttcaagttaaaattatttactagaccaactactggctataagcaattaaactaaatacagaattattgagatggggataagaagaaaataaaaatgtaaatcattttattacaggattaaaaaaagctgatgaaagagctgtaacaatattttgataggaggagaataacagaatcagttagaagcaaaactggagaaaggagaaaaggaaaagaaaagcctgtgtgaaatatttaactgggtgttgaaaaatatgataattttgataggctcactttttaaaactaattttctcacatgtttaccaatggctggatgtgcaaatggacaacaattttttatcttgtaataaaatgaattttaaaaatataaggtagggccaggcacagtggctcatgcctgtaatcccagtccttgggaggccgaggtgagcagatcacttgagatcaggagttcgagaccagcctggccaacatgacgaaacccagtgtctactaaaaatacaaaaattagccggatgtggtggcatgcacctatagtcccagctacagtatatacatacatacgtatatatatatatatatatatatatatatatatagagagagagagagagagagagagagagagagagagacagagagagagtatatagtatatatacataactcctgacctcgtgatccacctaccttggcctcccaaagtgctaggattacaggcgtgagtcaccacatccatccggtaatttttttttaaactctctcttgtacctgtatcttatgtttaaccgaaaaaggttgaaaattgagttgctagacttaatcattattttccctggctgaagggatagtgggaggggtcaagcctctaaaagggagatatctgggccaggcgccgtgactcacacctgtaatcccagcactttgggaggccaaggcgggtggatcaaaaggtcaagcgatcaagaccatcctggccaacatggtgaaatcctgtctctactaaaaatacaaaaattagctgggcgtggtggtgcatgcctgtagtcccagctacttgggaggctgaggcaggagaattgcttgaacccaggaagcggaggttgcagtgagccgagataatgccactgcactccagcctggtgacagagcaagacagcaagactccatctaaaaaaaaaaaaaaaaaaagcaatctctgcacactggcagcaatgtgaataaataaaaggactaaggattactgaatatttgtcagttaaagaaaagccaactcagtgtctataagaataaatcattcttgactattctttcagaaggaaagcaaatttacagagaaaggggagaaataatgaatttatttgatttttggaaaaatctttgaaaaattttcacaccaatagctattccttagttgagttagcctagggtttcactatgagaaaagaattaacatcaaggtagtagggcagagacattattaaatggagaagtgtaaattgtggtatttcctgaggaagcaattctgggtcagtccaatttaatggtttattatgttttggaaaagacagtaaaatctctacatttgaaaatgatactacatttttatggggagtgagatgtcaaaatgacaaggataaactaggcaaagcgaaaacagcagacaattttggcctatatataagttaacaagcacattagtgggaaaatcatccaagctctagttatacatggatttgattgctgagtcacaatggggcacaggaatctaggcgtcactgaggctgctttttaaagataccccaatgatctgttgacatttaaaaaatcagcacaaggttattggaaacaaggcaactgacattgttgattttcctatccatgaacaacatagctcttatgactcctctcagcacatttggctccgagacccagaagcatgaatagaaggagctggccatccagggcatgcttttctaccctgtgcaatcatatcacacagcatgaccatgcttatgtataaggacagaatgtgtgttggccacatcactggtaagaacccagacagcatttcttgggctctgatagtcaccagaaaatggaaggacgtttattgagaagttacaacgtgaaaggcactctgctgggtttaggaaggatatgtagataaattagacagtgtgcttacctacttgagctccaagcctactcagagaaataaaactattgcaatatggaggagttggtaattatgctgagaggtgtggttgtgggtgttcagaggaaagcgaaaccaaattctgtcatttattcatgttagttcaactaacatgtattgagtaccactattcattcatgtattaatcaatatttatttactactatgtgcgagccacttttctaggtgctgggatgtagcggtgaaaaagacaaggtccctgttctcatgaagttaagacagattatttttaaaggatcaaaatagatgtgataacatgaaatagataagtgctatgaagaaaacaaaacaaatggatgtgatggagtggctggaggttggtggttcctttatatggaatcagaacaagtctcccagagaggtgacgtctgatacctgttgattagaaggagcctgctgtgggaagacgcccaagaagagctttctaggcagagggaacagcaagtgtgaaggccctaaggtgggaaggagcttggtgtgcttgaaaatcagaagaaagaccagttatagctcagcaagcctggagaagccagacagacaaggctggaagaagaccttgttcttccttttgtggatccctcaaccctcatagcccaacagaaaaaaagaacatgtcagtaagtacatgataacgcgcagattgcacagatttacaaaggagatcaattttttttaaatgtgaaacaggagtgaaagatcataggttatgaattatattttcagaaagaactaggagcataatgctgaggaagagggactatggacactatggaccagcatacgacaaacacacaaaaatctggacacggggtggatgcggtggctcatgcctgtcatcccaacactttaggaggccgaggtgggcagacaccttgagtccaggagttcgagaacagcttgagcaacatggtgaaaccccatccctacaataaaataaaataaaaaattagccaggtgtggtggtgcatgcttgtagtcctggctactggggaggctgagttgggaggattgcttgaacccaggaggtggaggttgcagtgagccaagatcacaccactacactccagcctgggggacagagcaagactctatcccaaaagaaaaagaaaaaatctggacactaggctaagaataagctgtaccgtgggagcagaagcagctgcagaagtgggcaaagagggtactgtccagggctgggacaggggctgcaaggctaagctccttacactacagggtttgaatgatccctaaaaggtcaatcaaatccatcttcttttccaccagaaacctctcaggactcactctggggaggtgaaacactttacatgtcattaacatgtcacgtcttgcaatgtattcttagggctttgtttctttggattttttttttttttttttttttttttttacagagtctctgtcgcccaggctggggtgcagtggtgctatctcggctcactgcaatctccgcctcccaggttcaagcaattctcctgcctcaggctcctgagtagctgggactacaggcgcacgccaccatgcccggctaattttttgtattttagtagagacggggtttcacagtgttgcccaggctggtctcgaactcctgagcttgggcaatccgcccaccttggtctcccaaagtgctgggattacaggcgtgagccaccatgccaggacccatttatttggatatttagtcttcaagaggtctctgttacgagagaatggcagcaccttggtatgaactttaaatgcaattatagtccctccatctttataacaaggcaagagatagtaatgaggcacttgcagcttttgaatcagaacagagtaaagagattgctttaaggaggcagcattcacagccttgtgaaccaggtacactgttcatggacttgcctcattgtggaacctagagaaaatttattatttgaagtcccagtttcctcatctgaaagaatgtcagcctgagagatttgttacagagatttaattggataatttaaatgaaagtgcctgccagattcagtaaatgtgcaggggtcttttttcccactcaaacctgtggccccaattcacccaaatccttgaggcccactctgggtggggaatagggagtccacagaccctaaggagaaagggcagaaagaagatgagatcattaggagaagctggtactacttacgaggcattgaattgaggaaagatgtgtgaaaaatgaaatttatcttcattccaaaaaggattctgagaagagaaactctggaacttctggagtaatgcattttctcccttcttaatgcaggaagctaacacagacattggtttcaagggtgttaaaatataatagggctaaaatcatttattgccaagattttgataacaaaatccaaacataagaactagcaaccccacttgcaagaatttaaaccaagttaagctcaaatcaatgcacagtatatccaacacgggaaaacattttttacactgcctgacctgggattccagcaaacaatcttcagctatgtaaattcataggcccttttaataccatgttagtctaggttcacatcaattgtttcttgccaggaaaatgggtttttcatttggagatggctcaatgccagaccgaacaggactttttagagacattggaactctcaaatatcaccagtcacagtcaatgcaatttcaagctcatgcgattttagttcatgcaatcatttgaagaactgagaaggcagaaaggagggcgctggtatcagagggattgcaaaatctattgaaatggcatctactgaagaaggagtcaggtgacctatgtgaggctcttagttctattaataaaccaaggtaggacttaattggatgaagtgacagatgtctagtatttttcattcttaaggtacacacaacaggttcaaaccagcctagtagagattcaggcattcacttggtggattggccaatttagtctgaggcaaggaggcactcccaaacataccagactccttggaaatatgttaagtggtactgatgatggccagggctgccaaggatgtcaaatgtatttaaaagtgagtggagcccaagcctgctgccctctgggtggagacatggtcgatttcaggaggatatggttccttttttatggtgtgagcaggaggtccccagccaaggatcttacctgacacagacaacatcaagataatatgaagtatgatagagatgcagctcttgtctttgtgaaaatagtgagactggtgttatcattgataagagcagcatttgcctttttgttttattttctttgtttaattttcttttaggaagggcagtacaacattgagctgaaggcagactatcagctagattccctggatttcaacactggctctcccactggctaaatgaatgatattaggcaagtcacttaaccttcatgtacctcagtttccccatatataatagagataacagtagcatctacctcaaagatttactttgaggaattcataaacacacacatgctcacacacacacacaccacacaaactgtttagagcacgcctagcatgtggtaattaataaagttggttattatatttctgtgtggttgattaaaaaataatacatatttgctataaaacaaccagtatacaaaaaaattttaaatgaaaacaacccattaccatccatattctcactatccacaggcaatggcaacattttgggaaagaagtacaaggtagaaacaaccatttaactatgtaatatttattctttccttcttccttattaaccacaccttgattttgttgtgggtagcaaactatattttccagccttccttgcaaataagatcaggcatgtgactaatttatggcaaatggaagttgttgggtggggcttctaggaaagctccttaaaaaaagtctgaatcaggacgggcgcggtggctcacgcctgtaatcccagcactttgggaggccgaggcaggcagatcacgaggtcaggagatggagaccatcctggctaacacagtgaaaccccgtctctactaaaaatacaaaaaaaaattagccgggtgtggtggcgggtgcctgtagtcccagctactccggaggctgaggcaggagaatggcatgaatcgggaggcggagcttgcagtgagcctagattgcaccactgcactccagcctgggcgacagagcgagactccttctcaaaaaaaaaaaaaaaaaaaaaaaaaaagtctcaatcagctggattttattccattttgtcatcaatcttcctccttcctactgtctaaaacatgggagtgatggctgaagtttcagcaatcaacttgtaaacctgagtataaaaagcacaccatggggatggtggaatacaaaacaagaacgactaagtctctaaggacattatagaacagctgtatgcaccaggaactgcttgctatcttctggatctttcatttggtgagagaaaatctcttcttgttgaagccactagctattggtaatgtctgttttcatataactaaactagattcctgagtacttccattgtctctaccttgtattaaatcctctgtttcccaaaccacatggtttcctttttcttggttgattcccctgtgttggtgtagcatatcccaggtaacttcatgagaaatgtacatcacaggcaaactttttgagatttaagagtttaggtaaaatacttgtttatctgctacatcaaaggtcagaataacagtagcttaaataagatagaagtttgtatctgtcacataacactctgaacataagggcccaaggctaatacggtaaactctggcctattctattactactttcatcttcaacaagcagctttttgtggtccatattggctgcttccactccttctattacagctacatttcagtcagaaagaaagaagaggtagaaaaagcaatctcctttctctttaggacatgggccagaacttgcacatatcacttcagctctcatcccactttacagaacccagccacatggtcacacctagatgacaggaaggatcagaaatacagtcttttgcagggcaaccaatagaagccatacagcatttattactgtagaagaagaggccaggcgtggtggctcacacctgtaatcccagtgctttagaaagccaaagtgggaggaccacttgagaccaggagttcaggaccagacagggcaacatagtaagacctgtctctacaaaaactttcttaacaattaggtgagtgtagcagacccagtttgaaaccaggttaattttgccagagcttgtgtttcttcccctatacctctcagcctcccaacataagcaatccaaaatggccatatagtttatgccatatagtttactacttttttttttaaagatagggtctcactctgttgcctaggctggagtgcaatggcatgatatcactgcagcctcaacctcctgggcttaagcaatcctcctgcctcagcctcccaagtagctagaactacaggtgttcaccaccacacccagctaatctttaaaaatatttttagagatggtgtctcactgtgttgcccaggctggtctttgtcctcccaccttattcccccaaagcactaggattataggcatgagacaccatgtccagcctagtttgctatttttaaagcacaggtcatttctcaggggtactctctaataaagttatacgacgtgcctttaaaatagcagtaggccaatgccattggctgtggagtatcattatggacatcaaagtccatctaagtctatattacgttgcaacacagtggagtatcaaagccccgttagtgccctgcagtggtcactgtgtgaaatagcccactaggttttctgcaaggcctgtcgcctgcccacagggcaacacatggggctgccccagactgtttcttcctcctggccacacagtcctgcagtctggagtgggcagaggctctgcaagcaacattcctgggatgcaggaccatgtgccccgttgctgtatgttgctgcctgcacactgtggctgctgctttcttccctatctacaccctacagtttttagaccatcatgctcagatctctcaggcatgttgctgatggagcagaaattccaaattttgttaagttctcaaagcacctcctgttgagagagtgtgtctagtttttgaattccacctatttggaatctgcaaactgagtgttcattttgcagggtcagtagtggccttacatcatcaacaataaacattcgctgaaagcctcttatgtctagggctgtgggcagctacctatgtagtgtaattggatctcctctagaatcaggctctcaccctgtgactgcttaatgtagtctaggaggttatgaagccctcaacccagctgaatagagacattaattgacccatgactaaccagcttttgataagatgcttccctgtggcaagatgtggggctgctaaatttcgttgagacataggtagtccaaggcacaagcactctggggtggtgaggcattgcagtaggaagaatacaaggtgagtaggaacgctggaaagagtttattgaatacgtaccgtgtgtcagatgttctctatacattagctgctgtaagtcaggctccccaggaaacagattctgaaatggaggtctgaatgtagaggttcattgggaagtgatctcagcaccagtgcctgagaggactgaagtaaacaggattgggcagaggaaaaagtggaagaatagcacagctgcaatagaggtttcaaccaatcctcctaccggtagctggtccttcagaggtgtcctaagtggaagggagtgggccttcttgccctttctacacacaattgataagtcatcagatgccagatgcccctggggaggggcagaattttggacttaataccttcagctgaaggcaacttctggaagaggctcagttgtgaactgttaacaggtaactctcttgacaggaggggagggaggggaagagtgccttgatcctgaaagggtgatctgggcagcacaccacgacatccactacattatattatttcatccacaggacatcctatgaagttgtcattataattaccattttaaaatggggaaactggcctggcgcagtggttcatgtctataatcctagcacgttgggaggctaggtgggtagattgcttgagcccaggagttggagaccagcctgggcaacatggtgaaaccctgcctctacaaaaaatacaaaaattagttgggcgtggtggcgcatgcctgtaatcccagccatggcaggctggggcaagaggatcacttgagcctgggaggcggaggttccagtgagccgagatcgcgcccctgcgttccagcctgggtgataggagtgaaaccctgtctcgaaaaaataatttttttaaaaggggaaactgaggcttgggatgtttatctaacttgtctaggctcacatagctgggttagattgactaaaacctccatatgctttctactacactaccctgcctcagaaaggaaaaaataaggcagggagggcatggaaaaaaaaaaagctggagacagcttcacccactgcacaattttgtcagaaatggatcagaagatgcagattacagagtggttatgagcacagtctctggagctaccctaactggtttgtatctcagcttcattgcttaccaaccttcggcaagaatttaacctctccatgccccagttttctcatttgtgaaatggagataataacagtacatgcctcacagggttattacaaagcttaaatgaaagaataaatgcagcacatgccagggcctaggacagtgccaggcctataataagcccctggtaaactttagctactattataacattcccatttatggtaactcttttgacagcacaggaaatactctctttaggggctctgctgagacttgcctaacatttcaaagaatgatgcctgtctctgagcaccacacacagcctcatcaccagtgaaggctctggatgttccatggatctgaataattttaaaaacccagcttttaggtggtcagggtgactcctgaaatacgaaagggaacaagtgccaaccacacctacacctccaatgtataatcctggaggcagaataaataaaagaaaactttaaaaaaacagctccttattgtctgccaaacaaaataccttttactgaagtcaactttttagaaatcttggacagtgcatgagtggaagctattcaattctcaaagaagtctcagttgagttttgtaatccaaatcccacagccgaaggagaaagatcattaaccttattgctgcaatttcaccaccacttcccctggatagcaacactcagggagttaaaccctcagtgcatgtttcttaggtgtgtggcccatttgttactgtgtatcccccagccccgctggagccactcagtgggttctgccacagctcagttctgccacagctcagttctgcctaccatgtagccatgtgataaaaggacttggaaatttaaatcaatcactcctttaaaaaataattcttaagaagaaaatcatttaaccaagcatagtgggttaaattgtggcctccaaaaagatgtatccatttggaacctgtgaatgtgaacttatttagaaaaagggacctagtgcagtggctcgtgcctgtaaatcccagcattttaggaggccgacgccggcggatggcttgagctcaggagttcgagaccagcctgggcagcatagtgagaccttgtctctactaaaaataaaaaataaaaaaaaatagccagctgtggtggcgcatgcctgtggtcccagctactcgagaggctgaggtgggaggatagcttgagcctgggaggtcaagcctgtagtgagctatgatcatgccattgcactccagcttgcatgacagcatgagaccttgactcaaaaaaaagaaagaaagaagaaagagagagagagagaaaaaggaaagaaggaaggaaggaaggaaggaaggaaggaaggaaggaaggaaggaaggaaggaaggaaggagagaaagagaaaatagaaaagaaaaggagtctttgttgatagataagaatctcacgctgggtctggtggctcttgcccgtagtcccagcactttaggaggctgaggctggtggatcactcgagcccaggagttcgaggccagcctggccaacatggtgaaacacaatctctaccaaaaatgcaaaatttagctggatgtgatggctcacacctgtaatctcagctattcagaaggctgaggcacgagaatcgcttgagcccgggaggcagaggttacagtgagccgaaattgtgccactgcactccatcctgggcaacagagtgagaccctgtctcaaaaaataaataaataaaataaaataataaagaatctctagatgtaatcatcctgaataatatgggcaggccttaaattcaatgataggtgtccttatagagaatggcagaaggagatttgagaaacacagaaaggaaggccatgtgaagacagaggtagagattaaagttatgcagccacagctaagggatgcctggagcccccgaaagctgggagaggcaagggaggattttcccctagagacttcaaagtgagcaccgtcctgccaaatcttttattttatttttttaaaatttgaatccatttatacagacttatcatacatttcagaaatactataagaaaacagaaataaatatcattgtctttgaagaagattttcttttttttttctttgctttgggataatatattttttcttttttttattattattattatactttaagttctagggtacatgtgcacaatgtgcaggtttgttacatatgtatacatgtgccatggtggtgtgctgcacccgttaactcgtcatttacattaggtatatcttctaatgctatccctcccctctcccccaaccccatgacaggccctagtgtgtgatgttccccaccctgtgtccaagtgttctcattgttcgattcccacctatgagtgagaacatgtggtgtttggttttctgtccttgtgaaagtttgctcagaatgatggtttctagcttcatctatgtctctacaaaggacatgaactcatccttttttatggctgcatagtattccatggtgtatgtgccacattttcttaatccagtctatcactgatggacatttgggttggttccaagtctttgctattgtgaatagtgccgctataaacatatgcgtgcatgtgtctttatagcagcatgatttataatcctttgggtatatacccagtaatgggatggctgggtcaaatggtatttctagttctacatccttcagaaatcgccacactgtcttccacaatggttgaactagtttacactcccaccaacagtgtaaaagtgttcctatttctccacatcctctccagcacctgttgtttcctgacttttcaatgattgccattctaactggtgtgagatggtatctcattgtggttttgatttgcatttctctaatggccagtgatcatgagcattttttatgtgtctgttggctgcataaatgtcttcttttgagaagtgtctgttcatatcctttgcccactttttgttggggttgtttgattttttcttatacatttgtttaagttctttgtagattctggatattagccctttgtcagatgggtagatttaaaaatttttctcccattctataggttgcctgttcactctgatggtagtttcttttgctgtgcagaagctctttagtttaattagatcccatttgtcaattttggctttcgttgccattgcttttgatgttttagtcacgaagtccttgcccatgcctatggcctgaatggtattgcctaggttttcctctagggtttttatggttttaggtctaacatttaagtctttaatccatcttgaattaatttttgtataaggtttaaggaaggggatccagtttcagctttctacatatggctagccagttttcccagcaccatttattaaatagggaatcctttccccatttcttgtttttgtcatgtttgtcaaagatcagatggttgtagatgtgtggtattatttccgagggctctattctgttccattggtccatatctctgttttggtaccagtaccatgctgttttgattactgtagccttgtagtatagtttgaggtcaggaagtgtgatgcctccagctttgttctttttgcttaggattgtcttggcaatgcgggctctttttggttccatatgaactttaaagtagttttttccaattctgtgaagaaagtcattggtagcttgatggggatggcgttgaatctataaatttccttgggcagtatggccattttctcgatattgattcttgctatccacaagcatggaatattcttccatttgtttgtgtcctcttttatttcattgagcagtggtttgtagttctccttgaagaggtccttcatgtcccttgtaagttggattcctaggtatttattctcattgaagcaattgtgaatgggagttcactcatgatttggctctctgtttgtctgttattggtgtataggaatgcttgtgatttttgcacattgattttgtatcctgagactttgctgacgttgcttatcagtttaaggagattttgggctgagatgatggagttttctaaatatacaatcatgtcatctgcaaacagggacaatttgacttcctcttttcctacttgaataccctttatttctttctcttgcctgattgccctggccagaacttccaacactgtgttgaataggagtggtgagagagggcatccctgtcttgtgccagttttcaaatggaatgcctccagtttttgcccattcagtatgatattggctgcgggtttgtcataaatagctcttattattttgagatacatcccatcaatacctagtttattgagagtttttagcatgaagggctgttgaattttttcaaaggccttttctgcatctattgagataatcatgtggtttttgtctttggttctgtttatatgatggattacgtttattgatttgcgtatgtttaaccagccttgcatcccaggggtgaagccaagttgatcgtggtggataagctttttgatgtgctgctggattcagtttgtcagtattttattgaggatttttgcattgatgttcatcagggatattggtataaaattctctttttttgttgtgtctctgccaggctttggtatcaggatgatgttggcctcataaaatgaattagggaggattcactcttgttctattgattggagtagtttcagaaggaatggtaccagctcctctttataccgctggtagaattctgttgtgactccatctggtcctggactttggttggtaggctattaattattgcctcaatttcagaacctgttatttgtctattcaaggattcaacttcttcccagtttagtcttgggagggtgtatgtgtcgaggaatttatccatttcttctagattttctagtttatttgtgtagaggtgtttatagtattctctgatggtagtttgtatttctgtgggattggtggtgatatcctctttaacattttttattgcgtctatctgattcttctctctttttttctttattagtcttgctagtggtctatctattttgttgatcttttcaaaaaaccagctcctggattcattgattttttgaagggatttttatgtctctgtctccttagttctgctctgatcttagttatttcttgccttctgctagcttttgaatatgtttgctcttgcttctctagttcttttatttgtgattttaaggtgtcgatttcagatctttcctgctttctcttgtgggtatttagtgctataaatttccctctacacactgctttaaatgtgtcccagagattctggtatgttgtgtctttgttcttgttggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtgtgctataatttctgttcttttacatttgctgaggagtgctttacttccaactacgtggtcaattttggaataagtatgatgtggtgctgagaagaatgtgtattctgttgatttggggtggagagttctgtagatgtctattaggtccgcttggttcagagttgagttcaattcctggatatccttgtcaactttctgtcttgttgatctgtctaatgttgacagtggggtgttaaagtctcccattattattgtgtgggagtctaagtctctttgtaggtctctaaggacttgctttatgaatctgtgtgctcctgtattgggtgcatatgtatttaggatagttagctcttcttgttgaattgatccctttaccattatgtaatggccttctttgtctcttttaatctttgttggtttaaagtctgttttatcagagactaggattgcaacccctgctttttttttttgttttccatttgcttggtagatcttcctccatcactttattttgagcctatgtgggtctctgcatgtgagatgggtctcccaaatacagcacactgatgggtcttgactttttatccagtttgccagtctgtgtcttttaagtggagcatttagcccatttacatttaaggttaatattgttatgtgtgaatttgatcctgtcattatgatgttagctggttattttgcccattagttgatgcagtttcttcccagtatcaatggtctttacaatctggcttgtttttgcagtggctagtaccggtttttcctttccatgtttagtgcttccttcaggagctcttgtaaggcaggcctggtggtgacaaagtctctcagcatttgttggtctgtaaaggattttatttctccttcacttatgaagcttagttcagctggatatgaaattctgggttgaaaattctcttctttaagaatgttgaatattggcccccactctcttctggcttgcagagtttctgccaagacatccgctgttagtctgttgggcttccctttgtgggtaacctgacctttctctctggctgcccataacattttttcctttgtttcaactttgatgaatctgacaattatgtgtcttggagttgctcttctcaaggagtatctttgtggcattctctgtatttcctgaatttgaatgttctgccaactcctttatgtcagacttctggcctccaaaactatgaaagaataaactcctgttgttttaagccaccaagtttgtgacaatttgttacggcagccacaggaaactaatacaccaagattggccaactcaaatggatagtcttgtttcattgtttcctttataacccatgttttatatatctatatctatctatatataaacatatatatatatgtgctatccatcaaaatgtttataattttttttgtttttggagacaagttctccctctgtcacccaggctggagggtagtggtgagatcatagttcattgcaggcttgaactcctggtctcaagcaatcctctcacctcagcctccccagtagctgggactacaggtgcacaccatcacatcctgctactttttttttttttaaagatggggtctcactatgttgcccaggctggtctcaaactcctggccttaagcaatcccctcaccctagcctcccaaacagctgggattacaggcatgagccaccacaactggcccttgtttatgatttttaaatatattcagtaaattaaaaatacaagtcataaacagtatgatccaattttgattttgaaacaatacatgacaactatccattacccagtgagtgtttgcactacatatttttctgaataaataattagaaggctttaaacccatatagtatcaatggataggtcccagatcttattctcttgtccagatttgaggaagtcacttctgagattgagccagtcttcctcaattatgtggaaatattcagttgttttcccatcaatagacccagaccagagatcaaaaactcaaatatctatagtagccaggcagaaatattctttaaggatgttggtaccatagaagacattcaggtatcttaggtactgtggcaaactggaaagaacattcttgtcttgagttggagctccagctcatccccaactgcctgttgtcacagggaagtcaggctgaatgttaccaaatcttctgatttttaaagaggtactggaaatttcagtttttatatgaaaacttctgttttttaaacacaagcatctaattcacattctcttaaaacatttttcaggccaaataaaatccagaagctcagtcctttaagtttccacttgggatttagaccttcataaataaagaccatttcattcttcccagaggttaagaaatccaggtttcagaacacaatgcctaggcttctttgttggaagagacatggaaaaattcctctcattctttgctgatgagcctacaaccttgaacacaagacacagttaactctgtaatcaagttattctgccacgtgaaatttttcacaaattgtcctgctaagtaaacactgtgccaaatatatggtgtatctcaatgcatggtagatcattatcacaatgattagtatgagttttctcctcctcctttggatagtccaacagtagagataggggtaggataatgtggtacccaggaaatggtagaagagcctttatttctcaggccatcacagtagcagatgcttattgaccaagcctgcagggtctgttcaaaggcaaaggaccctattctctccattatgcttagtgccaagcagagtcataggaaacttccactgtggcactaaaggcagtggttcttggtgttcagtctggttccccaggaccactgctccccattcccatcaaatgtccaatcccttctggggtacaacatgggagcagctgttccacttagcccccttcagcctttggggtccctctacttcttggataatctagcacgtttaggaacctagggcttgagaggttggggaaggaaaagccttttaatgacaccagaaaacaaaagcaggctcacttgattgcttgaagtgggtcaaagaccaagagagaaaaattctacttattgttttcatgttttcttactgtaagaaacctaagagaaattaatctctcaatggatccagccaccacattatcatattcaggagaaatgtccctaaattccagacttttgagtctgccctagagtcagatctctgtctgccatttgagaagctaacaagccaagtagtgcccaggaatgtccataataaaccaaaggcataggcaagagaggcagagaggcatttgtgttgggaaggaccacaggaacactctcactacactgcggctccacaaagctttattctcctgcccaggtctagaggaaagtctcttgaggccaggatattatagatgacttctaggactggaacaatgacttgctcctagtagggctcaataaacttgttgcttaatcgtttctaagaagctgtgcgaaagtgagaaagcctcagtctctctgtttcagcttctccaaatgtgactaacagcagcaaccctgtctattgctgagaactgctgtgcagatgaaaacagacaaatatatgtagttttaaatgtaggcaatgtgcttgtaaatttgcattttgaaaagctagaaatgcccttgagtaaactgccaactccttgcagaaaagataaagaaaattttgttccgcccagaacaaaaagatcctggctattccattaaaacatagccttgcagtgttatctaagaatttgttacacactttgtaagctttgttagctagactgattagatagataactgtgattttgaactatgacatctattccaaaaggttttagaaacaacatgcattactatgtaactaaagattcaaagtaaacaggtcttttaaggtttatctaggctatgtaatgacaatacaaacgggcattttgataacaaagcagtattaggtcagcacttacaattcaatgtgagtctggaatttaaaataatgggcagtctgacatcctccatattgtctctgttctagctcaggagactatacagtctacttttcaaactccaaagcttaaggtgttagaacaaatgccttcaactgattgtttagacttttcactcctaggctcacttaaaaaaaattagcagtaatactatgttaataaattcagtcattccatgtgttttttttgtttgtttttttggttttttttgagatggagtttcgctcttgtcgcccaggctggagtgcaatggcatgatctcggctcaccacaacttccgcctcccgggttcaagcgattctcctgcctcagcctctcaagtagctgggattataggcatatgccactacacccggctaattttgtatttttagtagagacggggtttctccatgttggtcaggctggtctcgaactcccgacctcaggtgatctgcccacctcggcctcccaaagtgttgggattacaggcatgagccaccgtgcccagcccagtcattccatgttttgtgagggaaaaaaacttgaaaaaatattgaaataattattatgtagtactttaaaaatgttttccagacacttttaagacaataataaaataaaagaattatagagattgaggaaacctaaaagaaatagtcactggtctaattttacaaacaaagaaaccggccccagagttttgggtgaactgacctgctcaaactggtgttagcaaatcataaccaaatttgttgcaacaacagcaacaacaacaacaaaagaaaatcttttttttttttttttgagtcttgctctgtcacccaggctggagtgcagtggtgtgatctcagcttactgcaacctctgcctcccaggctcaagcaattctcgtgcctcagcctcctgagtaactgggattacaggtgtgagccactatgcccagctaatttttgtatttttggtaaagactgggtttccccatgttggccaggctggtctcgaactcctggcctcaagtgatccacccgcctctgcctcctgtcagatatgagttctaaatttctttacaaagaatcaatatgtcagtatgttcaattatttgccttctacttttaaacttaacttcctcataaagcaacctttttggattaactgctccaccctgactcatttcaatcacctgcaccaccctgactcattctgattacctactccacccagacaaattccgattaccagctctgtcataaccatttttcccgccaaaccactcaccccgtcactctctttaaattagccaatcggaattagtttagcctgtgcagtctaaccctagccaataggggaagaacacagcagcaggggccacgtgtgtcagggataagaacaccttcccctttcttgtccagtgtgcgctcaccattgctccatttgtaagggtgcacccttctctagaagtaacttgccttgctgagaattaaaaagaaaattttatattcgagtgctatttcttttgtagcaccaaaactttatttataacactcccaaagtgctgggattacaggggtgagctaccactcctggccaaaaaagtctattgatagagaattattttcttttttctttttttttttttttttttttgagatggagttttgctctttcgcccaggctggagtgcagtggtgcgatttctgctcactgcaacctcggcctcctgggttcaaggaattctcctacctcagcctcccgagtagctgggattacaggtgtgagccaccgcgcccggccataaattggtgtatttgtgtatgcacacttggataccaaaatccacggatattgaagtccctaatataaaatggcatagtattttcatataacccatgcacatcctcctgtatactttaaatcatctgtagattacttgtaacatctaatacagtgtaaatgctatgtaaatagttgttataccatattgtttggggaataatgagaagaaagcaaaaagtctgtacatgttgagtacagacaactttttttctgaatatttttgatctgaggttggttgaatccacagatgctgaacccacggatacggatggctgaccacggttgttactctttcacttcgaggcatcaggttttatcctttggatttagacaggactaggatatccatatcaattttaattccattacacttctgtcaattcaatttttttcagtaaactgttattaatacattttacatatacttttatcaaaactgggtgctgaggaaagaatacattcaagtcttggaaaatacctgccacaaaacctaaagagctaatcctctatgtcaatccaatcagccttatttcactttcatataaagcctgactttttcttttttttctcaaaaattaatcagtgtgcaataactttgtttttcaattcaaattaatgtattaattcatatctcaaaaacattgttaaaaacaactgagaaatatcttcagggaagtaccacataatattactaaaaaagattaaatcaataacatgataattaatatatcattttataacatgttattcaaacgtgctaagcaagataataaatcaatttgctgtttcaacaattttgaactcgaataagaaaatcacttgaatttgctttttgtctaacatcatttccatagtcaaaaataaatataaaataggctgggcacagtgggtcagcctgtaatcccagcactttgggaggccgaggtgggtggaacacctgtcaggagttcaagaccagcctggctaatgtggcaaaatgccgtctctactaaaaatacaaaagttagccaggtgtggtggtacatgcctgtaatgccagctactcgggaggctgaggcaggagaatcgcttgaacctaggaggtggtggttgcagtgagccaaaattgcaccactgccctctaccctcggtgacagagggagattccatctcaaaaataaataaaatacatataaaataaatgcaagtaataattcattagccaaaaaaagtaagaaatgtgcattaaaatgatctataacataaccacatttatttaagaatgtattccaatatcaaatggcaaatttcaacaaagcaaaaactttttcccaccaacgtgatactttgtaaaaatgtaatagaatgtgtgactaaacttttaggttatttgtgaagttagaggtatcataaaaggcatagtattcttctgaaaaatttagtttgatcaaactctggtgttcatttgttgagaaagaataagaaccaagaatacaaatcaaactccattaagaaaataaaaagacaagccacagactgggagaaaatatttgcatatctgataaaggatgggcaaaagacatgaaaagatctcacttcaccaaaaaagatatacagacggaaaataagcatacgaaaagaagttcaacatcatatgtcattagggaattacaaattaaaacaaaaaattagaaactactacacacctatttaaatagctaaaatggaaaacactgacaatacaaaatgctgatgaggatgtggagcaacagaaacttcagttcattgctggtaggaatgcaaatgatacagccagtgtgaaagtcggtttggcagtattttacaaaactaaacatactcttaattatgcagcaatggttttgctccttggtatcacccaaacttatgactaacccaaaacctgcatatgaatgtttagttaataaataacatatttatgccaataacatatagcatattattatttagttaataataaacatagcagcttcattctaatttctaaaacttgaacatgacaatgatttccttcaatatgtgaatggacaggctgtagtacatccatacaatggaatattattcagcactaacatgaaatgagttatcaagccacgaaaagacatagaggaaccttaaatgcatattactaagtgaaagaagccaaccccaaaaggctacatactatatgattccatctatatgacattctggaaaaggcaaaactatggagacagtaaaaggtcagttgttcctggagttgtgggggagagatggatgaacaggtggagcacaggagcatttcagagcagtaaaactcttctgtccgatactgttgtggtgggtatatgtcattagacatttgtccaaacccatagaatgtaccacacaaagaattaaccctaatgtaaactgtggactttagttaataataatgaatcaatattggctcatcaatcataacaaatgtaacatactaatgcaagatattaatcatcagggaaatgttgggagggggagaaacaagaagagatttgggaactctgtacttttcactcatttgttctgtaaacctaaaactgctctaaaaaacagtctgttaatttaaaaaatatcaaactctgtaattttgtttaaatatatgatcaaaatttccctatgaattaatgaaagaaaagtgtatgcattgctaaaaaaatccagaagctagcattttatttcttattaatcgaaagaaggaaatatgcaaaatttaataaataaaaatgagaattaggccaaagagggagaaggctagaagcttgaggccaggaggttgaggccatggtgagctaggattatgccactgcactccagcctgggtgatggagcaagaccctgtttctaaaaaaaaattgcttcattcaaaaaatatttttaaagatgagaattgaccatatttgaaataaatatttcatgatgatttgataatcaattctaactatattctttatgtaataatatacagcaagtccaaaataaataaaaaatttatccatgacttattcctgaaaaattgggtagtcatgaaaaacatttaaaatagtcagaatcattcacctattctgctttgggtgtttatagttgcttccctttcctttttaaaatttttttatttttaatttttgtgggtacgtagtagatgtatatgtttatgggttcctttctaatcaatgatacattttaggaataagtaattgaagaggtaaaaaataatcaatatttacatatacttaaatatattgacagtcactccttcataccaatatccttttttttttgtttttttttttttaggcagtcttgctctgttgcacaggctggagtgcaatggtgcagtctcaccttactgcaacccctgcctcccaggttcaagccattctcctgccctcagcctcccaagtagctggggttataggcacacgccacaatgcccagctagtttttgtatttttagtagagacggggtttcaccatgttggccaggctggtctcgaactcctgacctcaggtgatccacctgcctcggcctcccaaagtgccggaggcatgagccaccatgcctggcccaatatcctctttttttactcaccaggtgatgcattctttaacagctgccttatttagaggaaccactaggacagggccactcagattaaggaagaaagatgttaaacaacaattatcattactcctaccatcacactcaaccaaatatctcaataccaaaatggccatttctaatgctggttttactctcagaaataaggttttctaaatgagagtttctaagccttatctgggaaccacatcatcgtaggaaccttctctttggtgtcctaggagttctcatacccaaggccagcttgatttgggatggtgatgggtctttctttgtaaagtgagaaaaggcctatggtaagcacaagcacgttatcagcaagggttttgttttgttttgttttgttttttaagagaaaatattaaaagaaagttgaatgtctgacatggaatctctcaaaactatccaggcacgcttacgcaaaactaatttctctcctgttttccctctactgttctccttccacagctaagggggagaggggagtcctgaatctgattttttaaaaagtgcctccaggcaagtctgatgattaaccatccagtttggaaaccacccaacaatgtacattcattggggcttgatgaggtcactctccaccattcatcacattacttatggattaggctggcctgccagaaggaaaatacagcatattacaaaatttcatcgaaactatctaaatcactctcttgggctaaaatatctgcaaggaaatccaaacactcttctgtattactgaagtcctttgtttccaagtaacacatcaatttaacataaataaaaagaagaatttattttaaggacaataaacatctaaaggaacgcaacaccaaaactgctgcctggtctgaggagggactgcaaccaggcatttctttacctgtcttgcttgttttcttctccttgtgtgctccattcttttttcttgaagacagaggctgctccgttcctaaggcagatggtaatgccactgtccatgagttgtaacatttcctccactgaagagtctagctcagagagatctctccatcctttttccaaattcctgaagaagggacattgaatggcctatttggaataaaagattcactccttagttcagtcaactgaagccagaggggcagtcacatacaaatagggttgccggggatgacttcagcatgttgggaacagggaggggagagcaaaggaagcaattaagggagtcatcctgagaagagcaggagttctcccaaggtgtactactactacatcctgtaagctccggacagccaatgtggacaaggaaatcttccaaggtagcacttattagctactgtaaggaatgacgtcactgagcccttaccaccaagactattttgctgtaacttctagttttcagtaatgccattgataagttttgtgcccataggattctcattcctatatatgtgatctattttttcccctctctgaaagtcttcaggatatttctttatccgtgttgctctaaaacttcacgatgatattctaagatgtgagtctatttttatttattgctctgggcacttactcagggagccccctttttaatcttcattttaatttttttaaataaaaaatccccatttggaggtaatctcagactttttacaaaattgtaaatatggtataaagaattcccagattccccaaatgtaacttggtacataagcataatttatcaagactaaggaattaacaatacaatagcttatcctacagaccttatttaaattttgtcaactgtcctattaattttcttttcctggttcaggattgcagtggactgaatgcttatgtccccttaaaatcaatatgttgaaatgcgagcccccaagatgacagcattaggagctagggcttttgggaaataatcaggtcattatacgatttaataacacctctcctgtatagaatgtatcccagttgtaacttcagatttctccttgtgatttgattaatttgtctcccccattagaatataagtttcatgatgggagtaatcatgtcaggttgctttggtcaccattatattcccagtacctaaaatagtgtttagcacatattatgtcctcaatgaatatttattaaacaaatgaataaattcctttaaaacattttatgatgctgggaaccattgttaagagaattgtttttgcctaaaaactcaaagaacactgcaataccatcttccaggttccccgtgtggttgggcatggtgttgtaaaacagatgaaataaatctcaaacaaatgaactaccctgttaacaatgaggaatgtgttagccaaatcacctataactcattgtaactggccacattattatggagaatggccttagggacttgaacaaacttctcataacataccagagtctggtcttaccaggagtataaaatcaatgggtaattaactgaaccaagaccaggcctgcctccttgccccagcacagatgtgcactgatttcaagagggcacaatttatgtttcatggtgagtaaaggaggcttcagaccaaggacttgccaatgactagccatatggaagccaaactttaccctctcttttaaaagtgcaaagatggtgtcaaattcaacatttgtggcatttcttagagttttatgatttaggtttttgtttttgttttgttttgtgttttgttttgtttgagacggagtttcattcttgttgcccaggctggagtgcaatggcgcgatctcggctcacagcaacctccgcctcccaggttcaagcgattctcccgcttcagcctcccaagtagctgggattacaggcatgcgccaccaggccggctaattttttgtatttttagtggagacggggtttctccgtgttggtcaggctggtctcaaactcccaatctcaggtgatctgcccgcctcggcctcccaaagtgctgggattacaggcgtgagccaccgcagcaggctgatttcggtttttatttaatagaaaagcattgcatttatttgtaacagccaaaaattggaaacatttcaaatgtccttcagttgggtgaatggttagactgtggaacacctatatcatggaatacaactcagcagtaaaaaggaacacgttattgatatgcacaactcctccaatggatctcaagggaattatgctaagtgggaaaaaagccaatatcaaatacatattgtatgattccacttatataacattcttaaaatgaccagatgatagacatagagaacagattagtgatttccagaggttgggagtgagaagagggcgaaaggcatgactataaggtagcagtataatgaatctttatggtagaacagtcctgtatcttgattgtggtggtggttacccatgtctacactagataaaattgcacagaactatgtacacatacacacacacacacaactacatctaaaattggtgaaatctgaataagatctgtcaattgtaccaatgtcaacttcctaattctgatcctgtactagagttgggtaagattttggcattggtggaatctgggtgaagtatacacgaaacctccacatgacaggttgagcaatcctaatctgaaaacctgaaatctgaaatgctcaaaatctgaaatttattaaaacaaatgttcaatgcaatgtatttgcaagagcaaaacaatttaagcaatataaatgctcatcagtaagggatgagttaggccaattatttatatgcaatattaggataatatggaatgaaatgagggcatacccatgctaagctgttacaagtggttgccctgggagtaaagaaatacacattaactttttctttagatatttcaacatcgttatactacttttataatgtaaaaactaaaaatattgtgcccagaaaaagagagaaacagtcatttctcattatccataggagattggttccaggacaccctaaaatccacaaatgcttaagtccttatacataatggtggagtacttgcatataacctacacacatcctcctgaatacttaaaatcatcttttgggccaggcacggtggctcatgtctgtaattccagcactttgggaggcagaggtgggtggattacctgaggtcagcagtttgagaccagcctggccaacatggtgaaaccccatctctactaaaaatacaaaaattagctgggtatggtggtgcgcgcctgtaatcccagctacttgggagcctgaggcaggagaatcgcttgaaccaggaggcggagtttgcagtgagccaagatcataccattgcactccagcctgggcaacagagcgagactccacctcaaaaaaagaaaaaaagaaatcatcatttggttacttataatacctaatacaatgcaaatgtcacgtaatagttgttatggtgtcttttttagggaataatgaccaaaataagtctgtccgtgttcagtacagaaacaaccatccattttccccccgaatcaaaatctgaaattttctgagtgctgaaatgatgctcaaagaaaatactcattgaatcattttggagttcagattttttgattagggatgttcaactggtaagtataatgcaaatattccaaaatctgaaaaaatccgaaaaaatccaaaatccaaaacacttctggtcctaagcattttggataattaatactcaacctgtatttttgcaactttctgtgaatctataatggcttcaaaataaaaacttattttatgcaatataagttatttctagtaaaacaacattcagcatatatgtttgccttcatttacttctgaaatcccactaaatggagtaaagaaaagattataaacataaaagtatacaaccacacacccccaccccagtatgagaccatagaaatggagatgactgtaaaaatatagaaactggaaaatagatgtacatgagataactatttatagtaggtttctgtgaaaccgtagtagtagagatgaccccagagcaaggagcagtcagcagggatgactccattctggacaaggccactaagaagacctgttatgtaggcctggacaaagtaccacaaagccaagcagctatggagaacacatggctcgaggcattcgctggcctttctgtctctgaagcagttgcttagcaatgtgacaagatgccagacagttggagacccaagtaagtgttcacatgctggggggaagcagagggatggctgaatatggggctagtggtggatctaaagtctgaactattgggggccagacacagtggctgacacctgtaatcccagcattttgggaggctaaggtgagtgaatcacttgaggtcaggagatcgagaacagcctggccaacatggtgaaaccctatctctactaaaaatacaaaaattatctgagcatggtggtgcgtgtctgtagtcccagctactcaggaggctgaggcaggagaatcgcttgaacctgggaggcggaggatgcagtgagccgagattgcaccactgccctccagcctgggcgacagagtgagactctgtctcaaaaataaaaaattttaaaataaataaataaagtcagagctattgggaaaaatcaaatagcacaggggctgaggaagagtggtctcagtgcctccggtgtctgaggcttgctctgtggactagaagggagtagacaaacctgatttatagggccaaggttgggctggacacccccagtctaaatcaacagttttcaaactttgtaaagcagtggaacattttctccaaagtaaatcttaaataaaagtgtaaaccaccaaaacaaagtggggttgctctggtagcaactgcatccttgatttccaggcctcctgagggtcccacatccagatgttgaagcaaaaaggaattcaaaaatgcagtaattttctttattgagaagttaggttagaaacccaattttcaagtatgcaaattaactagaatgtctccagtctgtgttagatagaacctgaaaacggaaattttgaactagcacaccagtcaccatttccagtctgctctctcagcaggccccatggcccctgtaatttagctagttaaggcttttcctctggccaaacagctaaacttgagccaggtggacttaaacacatgaaccaattcagtttactgtctaaaaatgaaagagaaaagtctgccaggatcttctcctcgtccccacaaagttcccaagagcagaattcagccctcctcccctcccactacaaacacaggagagaggccagcccaatataacttaaaacagagcgaccctgcagccctctcagacaaattacatcaaaacaagtcaaagcaaatgcaactgtccttaccagttttgtaaaggaattgcctgggaaccattccttttcagacctaattaaaaagtcagttttgaattacagaacaagatggtatgagagccagtgttcaacaggcagaacaaacaaacatgcaaagataaaatgcatgggcttttacagagagctgctgccagcgacagcagaaatggctctctttcagccaagtctagggtgccctggaaaacttcatacctctccagggagacagttcccagaaacctccctcccctgcaaagcactcctataacaaataaataaactacatttcccaaagttctctttgctcaggcctggggctatattttaaaccactctgtaattgtcccccaccagaaaagcagaaatgtttaaatgtgacaaccttttgacatacagagttgactcagctcatttcaaatttcatcttatctccagtgtccttgggcatgttttaaaagataaaaataccaaatgtgaccaagatcgtcaaggtataatggaacaagggtccaatgtttttttaccctcaacgaatgcattatacttcatttagatcagcggtctcaaatattagcatgcgtcagaatcacctgaattcagggcttgttaaaatacagattgctgaaccgtacctccacaatctcagattcagcagatttggagggggtccgaagaatatgcgtttctagcaagttccaccggttctggattacactttaagaactgctctcagagattatctacatggtcaattccaaatctatcaagaaagaaggcacacagttactgatttctgcaagctttgaactagcagtatctttaaggagaagaccccagccatctctagcagtgtggggaagagtaaaaggcaaagcctctagttccggaagatccagaaactggcactgcctggtccagcattttcattttcccactgaggaaatgtaggcttagagggaatcaatttgtgcagtctcccagtgagtccgtggttgtgctgggacaaagtacccagttgtcctggcttccactccagtgctctggcccttgctggagtaaaatgggacacctgggcttggcaaggaacaaggacgccaacatgattctgattcatcccaatttctccacagccttctgccttttctctgcattggtaaaagtataatccccaacccaggaattttactctcgctttcgttcatgtcttcgtagcctaagacaggcagtcaaaatgggacagctgacagccacaacagcctttaattacaatatctggaggacacattaatgaatgtagacccatttatttacttttttatgtaccttgtctgtgcgacagcaagcaactagaatctcaggaaacaccaaccagacccaggcatcaatctgctactctgttattagaaggaaattagcctttaagaaaaattgtctaggcttaccaatcactcccaccagccaccaggggtcacataaatagaagttttcactggacctttctaattcacaaacctaccctcttccaccacaggccttggtagaacacataattcagcagcaagaatcccttgaagaagaaaagaaaacacctataaaactatatttttttctaattccagagacatgaaaccctttaggagtttaggccagggttcatgacaatccattatctgaaagcacagatgtacagataaaccattatttttgtaaagatacatcttctaaaacaccagtcagcttggcattgtgtttgtccttgaattgaagaacgatatcattttatcgtcctagccttgagcatggttatcaatgccagtaactaagaggcctaatttgaaagatggtcatgatgtccgacttacaaatgccttctactcagttaacagggactgctgaaagcaaatggcttatacattgttgcacaagtggaaaatctggcctcctaacagttgttaaatgtgccagctaagagcctctgaaggtcagtctaccagggctggggcagtgaccacagccacgtgctgcgccttttgcagctcagcaccgcatggtgcagctgttgtattggccaaagaaagtgctggcagccccgggagaaacagagacttaattcacttgcaggaactttcctgaaagagtcttttaaaaagcatttaaggcagaccaggtgcacttattttctttttaaatctcattgctttgtcaagtattctcgtttatggctccaacactctttatgtgcaacattaaccatcctttgttacattataaattataacgagaacttttataaaacatatttaatgataattcatgatttctaggtagattcctttagatgtataacatttaaatatccatggtatagcactcttgatatgtacatagcagggattgcaatttaggttgcctggggttttgttaaaagttttgtaagttgtgcagactttatctttaaataaaactgtgtgtgtgtgtgtgtgtgagagagagagagagagagagagatacacagtgcttagatataaacagtagtaaaagaaagctgattcaattcagtatgttacactgttaagacttccagctgtcaagtgcttccactataaacaggaggcgggaagaatgggatctagagggaatagagattgcataaaagtgaaacttcatgatgtgagggccgggggttggactcaagtcatcatctatttaggtgaaaactgccaataccctgaataattctaggaaatactctggtccttcactagactctgaaagtactcaggccacaaactctcccagtcctagcatgacaaaagacctccctatgccaataagtaaaaatgagtgccagagccatcctcaaaggtaaatatctggggtaggcagctgtttgcataatgtgattttaagtgtgacaagcacgtactccacccaaaaaaaaatctatgctatagacccaggtcacggatgcctgcaattctaccattagggagtatttccatcccagtcagagacttaggaatcatccttgactcctctctctccttctctgaccccattcaatcaatcatgaattcctccttcctagcttgactctgtccctttatcttcattccctctgacagtacatagttcaggtcaccatcgactcctgccaggatgactgtggttacctcctgacctgtctgtgtgcctccaatttgttctccacactgcaactgcaacaaatgtgatctttctaagatgcagatctgattatgacagtccccagattaaaaccattagctgggtcctcaaggccctcagaatgaagtccagattcgttaatggggtttacaagcccttatgctctggccatggctgaccactgtgggctctcctatgccactgcctccccgtcagtgcactcacctttccttagtcccttacttttgcttccaggcctttgtacacattgtcccctttgcttggtacactctccccgtttcctacctttgttcccaaagactgcatgaccctaaatttatccctactttagcactttcttactatgtaagctttatccatctgactctaattctttctgaattaggactatgtatttcacaaatgccagaactcttacttattcactactttatttccaggacctagcaaatacttgtctcatagcagtcactcaataaatatttgttgactaaatgaacaagtgaatcagtaaatgtcttatcttttattaacaacgttagcaattcacacttcagtgtgatttttcttactacagctctctaagaatatatttgagacggttaatgaaataaaggcagaattggctctggaaaaccaggggacagtataaaggcaatggttagccaagaaagaaaggcactgagaaggaaggtaagaacaggttctattgggattgcttagataggggtcctttctagataaaaagaaaatagcggctgggcacggtggctcatgcctgtaatctcagctctttgggaggccaaggttgggtggatcacttgaggtcaggagttcgagaccagcctggccaaaatgatgaaaccctatccctactaaaaatacaaaaattaaccaggcatggtggtgcatgcctgtagtcccagctactcaggaggctgaggcagaagaagtgcctgaaccgaggaggtggaggttgcagtgaggcaagattgcaccactgcacttcagcctgggtgacagagcaagacttgcgaagaaagagaaagaaagaaagaaggaaggaaggaaggaaagaaagaaagaaagaaagaaagaaagaaagaaagaaagaaagaaagaaagaaagaaagaaagagaaagaaagaaagaaagaaagaaagaaagaaagaaagaaagaaagaaagaaaaagaaagagaaagagaaagagagagggagggaggaaagaaaggaaagaaagaaggaaaggaaaggaaaggaaagaggaaggaaaaagaacttaaaaaaaaaagcaaccaaagcttgagttctgttcctgatttcatccccaaggttaccaccaagaaaggtggttttcctctgcatgggttgtacagtgaagtacccgcacttggcctgtggctccacccacagctggctcaatgactgtggcctgtgccatggagaagctgcaagaacaaggcagagtggactggacagtctgtgtcaccctggccaatttgaccaaacttatctagtcacagatggttatgaataattttttgcttatcacagcctttcggaaaagtattaaagtttcagcagcccatgcttcatgtattttcctccccaagtatacccttttacctataatcagtatagcggaaggataagatgtaaaatgtgttcactggtttattagtttgttatactactgacctcagtcaatcacccggtgatgtttctgggcaatacaaaaatatcttcttccttctatcccgtgatagggggtattttctaagcctcagacatgagcccccactttttttcctctctcttctttccttggtgaaccaattctacatactgatgatgcctaaatctaatacatccaccttgacctcataaacagaatccacccccacatatttcattgtctgtaggacattttcctttggacagctcatcaatcaattcaacaagcccaaactaccttgttatcttaccttcctccaaaaaaatatctgagccacagctgcaacatcctaactttttccagtacatcattaatctcctagtcacatgtcagaaaactcactccttccactagaacataaactgtcacctcatcaatgagggccaccttgactactccatttaaaatttcatctctatggccccagcattcttgattcccccttaaagtgctctgtttgttcccagcatttattgttttctagtatgctacataatttacctatctacttattatttctcattctgtccccaaatcttactagaatgtaagcaccactgaagacagagacttctgttcacagatatcatccctgtgcttataacagtgcccgacatacagtaagtgctcaataaatatttgttcaattaattcattcactctacaagtatatacttaatataacaaataatgtaacttaaaataccttactcctctaattggaatttacactctgtgaagtagaggtctttgacttctttgttcactgctgtgtccccagaatctagaatggcaccaggtagcaaaggtgttcaataaaaatctgttgaataaatgaacgaatggataggaactcattgagtaccttttagtaccaagtactaagtgaggtgcttggggattctagatattttaaataactaactatgatgcaatgggataaatataaataatagaagtaggaacaaaatggcatgggaactcaggagcaatggcactgaagatcattcttcacgcctgagtctgaaagaagacacagatgtttatctgctccctgtgccaggtaaagggccacaaagggattaaagtgtatggtatggcgcaatgtttctcaactgttatttccatatgagttacctggggactcttgttaaaacagactctggtttgatgggcctgaggtaagccctaagatttcacatctctaacaaggtgttgttgaggctgctggtcctcaaaccacacactgactgacaaatgtacacaactcggcacccatcccccttatttctttttactagactaaaattttgtctatgtatctaacactccctcctccagtatggagaggaagtggttctagtcccagctccagggttagactggatttgagcttggccaatcaggacaaggcattcttttgactgattactgggtgagaatgggaatgggaagtaaggatgcatgatctgtttaggggaaaggttttcctttctatgctgctgtccttaaacaaagaagcgtatggcttgatggctacaggcagccatcctccaacatgagaagcatgagcctcaagatgaaccgaatgccaagggtgctgagtggagagggggagagaacctgggtccttgatgatcacttagctgctgattgtgttgatcctggaatctactctacctctgatctttcaggtatgtgaaatgataaatatccttattgttcaagccaatttgaggtcaaggcttctacttgcagcagaaattatcctaatggttacatctgatttttgtttatttgtttagggaacaaatatttattgaatactactatgtcccaggcaccagaaaaataagacaggcataattctctaccctcgtaaaatttatagcctagatgataaattaatttgatagagttcaaatttctgagatgagcacgatttcattttaaattatttatattcttggatggggactacttctccctccctagccctgcccctgaaatagttctttattagtcatctctgccctagtacaactgccttcatcctaaaacagagctttgtctccttacgcttgaaaattgcaacagtaccctaacacccctctcagatccaatctacaaactagtaccctattaatcttcctaaagcatcaaattcacgagagaaaattctccagagaccctccattgcttaaagcagtgattttcaagcttgctttatgaaagcaaaaaactgtttcttcaaaagcaaaaaaggttattatacaaagtcacaatgtattaaatagacaaactagtgctgtgctgtagaagtgagggacacccagaatctcatcccctccccaaccccattcctacttcacttcccaacacacccacttcctgaggagtggtagagttcaactggtgccttcacttcacatagtttcacaaacagtagccttgtcatagggtaaaattaaaaatttccacttgtcattctattacctgcctctgttatctgcccacattcttgatttgaccaagtccagcctccccactacccttcaaacatacacactcaagtctttgcctaggctattacttgcatcagaaatgtctgggccaggtgcaatggctcatgcctgtaatcccagcactttgggaggcagaggctggtggatcacttgaggtcaggagtttgagaccagcctgggcaacatagtgaaaccccatctctacaaaaaatacaaaaattagctgggtgtggtcgctcatgcctgtaatcctagctactcgggaggctgaggtgggaggatagcttgagcccaataggtggaggctgcagtgacctctgatagtgtcactgctcttcagcatgggcgacagagaccctgtctcaaaaataaaaaaataataacaataaaaaaataaaagaaaagaaagagaaagagaaagaaagaaataagaaaagctgtgtgtccatgtctgtgtctatgcaaaacagatacacctccactagaaacctgaaaacaacatggaacacacactcccagcatccacatagcaggcatgaccaatcgatcccaatccatcagtctcacttcctctgagtttggtagctccacagtttgtttccatgcatcacatcagtcaaccactatcaatcctattatttaacacgcaaaagaaatgtctttttggccgggcgtgggggctcacgcctgtaatcctagcactttgggaggtggaggcgggcggatcacgaggtcaggagatcaagaccatcctggttaacacggtgaaaccctgtctctactaaaaatacaaaaaaaaattaaccgggcgtggtcacggcggacgcctgtagtcccagctactccggaggctgaggcaggagaatggcgtgaactcgggaggctgaggcaggagaatggcgtgaacccgggaggcggagcttgcagtgagccgagatcgtgccactggactccatcctgggtgacagagcaagactccgtctcaaaaacaaacaaacaaacaaaaaaaaagtctttttatcctctgcagtaaatacagcccttattccatcattttatggattcacattggcacttaattataaaagagtctgatgtgtgtgattccttagttcaattataaatgactggaggctaaggcctgtattttctcttctttcccctggatttttggctaagctgtagcctcttagcaggtattaaataaatacatacataatgaataaatgttgacaactattaatttgtgtcttctaaagcatactgatatgatcaccacaccatatcaaaacacgagacagccccttacagcttgaataactactttaggaatcaagaaatcagagctcttctgccccaggagcactgctaactagtcatgtggtccttttatcttctgggcctcggttttcctcacctgtaagaaggaacttgattatattatttctgagggtcaatattagggatgttcttcaggtttgctaggagaagaagcactcagattaccaggttgcctgtgggagtggagttcatcctccatgtccctagctgtattctgagttcctggacttcccagtcatggcctgatgccggaccttatggagaactggcacaacatttcctgccatggagtgtgactacccttctctgtgtgaaagcatcatcagtttattcctgtcaaacagactctgtcggtcgggtagagtttcacaacaaactctgttgaggcttttaacctcctgcatacctggcttcccatgattgtctttgcctaggacaccctggtctaatcagctagggccaaaacaatagggtcagtttcactcagggaatagtcaagccactttatgtagggaataactgatttgggtcatcattctcagaaaagggggctgtaggtgtggcataacctacagctccataaactcttttctctctctttctaaaatgttttatgagaattaaccaaatactgacaatcaatataaagagcattaagaaatgtgcagcatgaatgaaagattacattattcacttagcagtaatttaatctttctgcacagtagaaacgcatacagaaagacctagagaagaggctaactcacaaatggcaggaaaccaactccccaaaagactttttgggatccagagatcttaaacataatgtagtgttcctccagtatttaaaacgaaagaaatatttttaagagtacacagggagtaaaagtgttttataaccttctgacatgtagctaattcaaacacagcctgcctggtacgtgctcggccacagccagtaacaaaatctccagcctgtggaccaatccccagtcccctctcctaggatccagacacaagtgtgctttccagaatgggttggagtgtgctagcccacacatctcacttaagcagagaaatcaggggctgacccttgagtccaaggcctttggcaatggatacacttttataaatagaaagaaacaaaatatggcactatgttttcaactatcatttcaaaagcagatttaagaatgtcaggatcattactgttacacccagaagatagcacagaagatgccacaggatcacccaggcagcatttcatggggaaaggagcctagacttggctttcatacagccctaggattgaattcctattttgccttccccagtttgcaaaattttttgcaaagtgcttaatattaatagtagttaccattcatcaagcacagtaggccctccttatccatgggttccacatatctggattcaaccaacctcagatcaaaaatatctggaaaaaaattgtatctatactgaatatgcacagactttttttcttgttgtgatttcctaaacaatacattatattaataacaatgatttatatagcatttatagtgtattgggtattacaagtaatctagagatgatttaaagtatgggaagatatgcataggttaaatgcaaatatgacaccattttgtatcagggacttgagcatccttgcattttagtatccatggggagtcctgggaccaatttcccatgggtgctgggggataactgtactttattctgtgccaagggcatgatatgcataatgatatttactctttacaagaaccctgggaggtaaaaattattgggtctctgagatagtaaccttcccatagccagttaacgtgtaggagggaagccaagattcaaagccaggtctgaagctccttactgcctttcctattcatcctctctgagacttcatttcctcatttatagaatagctataataacacctcccttagaaaactgtagggagatttccattttgttttattgtaaacatgcctggaacatagtgattgcttaataactgttggctagtaatataaatgtatacatgaaatactgaagtcacaaaagggcctgctggccacagactggtttccttgatttccagtctgctatttatttatttatttttgagacagggtctccctctgtcgcccaggctggagtgcagtggtgcgatcttggctcactgcaccctccacctcccaagttcaagtgattctcctgcctcagcctcccgagtagcagagattacaggcgcccgccactacacccggctaatttttgtttttttagtagagacagggtttcaccatgttggccagccaggctggtctcaaactcctgacctcaagtgatctgcctgcctcggcttcccaaagtgctgagattacaggcgtgagccaccatgcccagccttcagtctgctttttaaaaacatttttttaagaagtctaattgaacattaccacaagcacaaaatgtagaattatatgaaatcgccccacatccaatcacacatatatagtttcccctccccagctttagtgaggtataagtgacaaaaattgtatatatttacagtatacaacttgatattttgatatatgtatacattacacatagttttttgtatattttcttctgctgttttcccacgtgtctttttttaaagattgttatagttttatattctttttttcttttttttttttctgagacagggtcttgctctgtcacccaggctggagtgcagtggtgcaatcttagctcactgcaacctccccccactgggttcaagtgattctcctgcctcagcctcccaagtagctgggattacaggtgcacgccatgacaccaagctaatttttgtatttttagtagagacaggatttcagcatgttggccaagctagtctcgaactcctggcctcaagtgatccgcctgcctcggcttcctaaagtgctgggataacaggcatgagccactgcacccggcctatagttttatattatattttttcacttagcattatcataaatatgaatatcataaataatatgaatactatgctacatcctatttatgcttagcatctttaatcacaaaatcagtgaaccattctggaatatttttttctcctttggatgagtttgggccctgtgtgagagaaatctagaatagaatcctcagctccaccacttatcaccacatgactttaggaaagttcttaactctctaagcctctgtttacttacttgtaaaatagggataatgattcctacatcagaggattattgtgaagattaagtgaggtaacacttgtaaagcccctatgcttttactattcacaataagcttttattaactctagctattcttaactagaggcttctccttcccccatccaaacagcattacttcacattttctgttaatcaatggctttagagaaatatgcttagagattacattggtttaagagagggagaggtgaaaggggagagaaaaagaaagcctgggagcgggaaggctctgctaggctctctgactgcacaccacacctgccttagaccttttcttgcaactcttgcaactgcaggagcagcaggggttcccaggctgaaattccattctcaggtagctcacagggcagatctggtcactgctgggatgtgtgggctgtgcccacctgctccctcaggcagcctcattccacactggctcccttgggatgaccgaagcctctgtggcctgggatagaggcagctggggaggtcagggcagctttctgtgttccgtgagagcttctcagttgtctgaaatcctcagccttcaaagtagagctgatccctacccagaaatgtgaaactgctgtgagtcaaataaatcattaataggcaagctgggaaagaatgggcagtaaagaagacaaagggtcaatcctaaccctcctcagaaggacggacttcacatgtgccctctacttccttactccattgcctgcaacacacaagatgctttttgctgcccaggaagtctccagaaacattccacacaattgagcactccctggttctggaaacactctattctcttggctgccatgatgtcatcctctcccgcgctttcttctgcttttctggatgttccatctctccctccttcgtctgccatttctcctctacttgacctctaaatgtcagagctccttacgggatggctttaagttctgtcctctttatgaactttccatctccctagatgacctcatccatttccatgatttgaaatatctaattctaaatttttatctccagctcagacttttctgagctctagacctatttgtccaataccatggatacacacatctccacttaaatgtctctaagatcttttgtaacttaacatttctgaaactcttgatcttaacaccccaatacacattcccccaaagtgtcccttcattcagtgctactctcctagtaaatctcagcgattcctatctgctcagtagttcaagcatacctgagacctagaagtcatctttgattcatcctcttccctcaccacgcccatccagttgatcacaaatctctctcaattcctcctctacaatatttcttgtgtcttcccactgtcaccgtcctggcccaagccttctcttctgatagctagctagctaatcaccctgagccctccatatggaaaccagggatcatttaaaaacatagtaaatggggtcatgtcactatcctacacaaaaatacttcaatggcttcccattgcacttaataatagccaatgtgtcaggcactttgcagagattatcatgcattacacaggtgcattatcttagtcttcacaaccctgtgattaccatcctattttacagataaggaaactgaggactggagaaattaatttgcccaaattgacaactagaacagtgtagagttaagatttgaactcagtcagtctgactccaaaacccaagcctctcaatcaccactgtcctgcctttcacttaagacaaaacccaaattccctaacataacctaaaagactctggcttctaccgcctctttagcaccatctccttctgcatctccatctttcagtgtgttctagccatgcgggtctcctttcagtgactctaataccctaaggggccatgaaaattatgtttactacaatttcattatagcacagggaaatggctaggatatgacattgaatgcactaaatgaaaacacataattgcttatatcatatatgcctgaatatgagcaactttgactattatacagtcccaagttatcctgatgaaaatattaaaacaattgagtttttatgggcaggtgatagaaaacttgaataaacttttagcaatggggatgatttttttttctaatgaatcccagaagagaatgctctttttagtagtcaaatcccagaagaaaatgctattttttagtatgtttaactgaaaaagcttatatttccacttcaatttaggaagttcttcttcttcttcttcttcttcttcttcttcttcttcttcttcttcttcttcttcttcttcttcttcctttttttttttttaagtggggccttgctctgtcactcaggctggagtgcagtgacacaatagcagcccaactgctgggttcaagtgatcctctagcctcagccttccaaacactgcattacagatgtgaaccactgtgcctggccttaggcaattatttttgacagaaggtatggaaactaatgttgcattataaagtcctcatcaaatatctcatacttaagcaaagaccccaaatcatagtttgtagatttactgcagctttcattcaaaatacgttttttatcatctgtcacacaggaaaaccctgatacctgatatcttcctatcagcctaaagaaataagaaacacaataggacagtgattatacttttaaatattagggagtttagagccccagatattctatatgcagaccactatgctcatgtttatgtcttttttttcttaagtgttagaaatgtttatttgtcaaaaaattatttaaaaatgggaggagtggagtaaaacaaggctaaatttcagctaatgctgtaccacgatcacaggtcagatataaaaaaacaaacaacacaacccccaatggtcctagcaatttcagaagattaacttcaatgttagagtccagaactaacagagaagagtaaaaggctgcttgccactacatggtcatttgaaagagaaaggagatgctgcaggtaggcagggagaagtattcaactcctagggaaagcaagataagaggggttccactgcacaggaaaaaggggatgccagcataatccttacctagggctgttcagaggctgagaatataaggaacagagtaaaaaaggctacagagactagtatcaggaggaaagaaaagtcaacttagaagaattaaattaagaaagaaaacatagttggtcacaaactccttttgtttactgaaacgtgaagcaatggaaacatcctggcaaaggggaccgcacggagcaagttctcatatatgcccgcagcccgagggttcagtcagcaattattctacctccagtttttaaaaggctgagtaccaggctcggtccatatagtgctcccgttcataccgggccatgtcgtgtagagaattccgtgtagctgctgaagcctgaaataactcactctctggcccataaccgtagccctctccaactgtggggagcatggctgcagcatgacgcggttccacaataggaggaagtggtggccggagcggcagccatagtagctgaagtggcagcagcacaagaacttggcaataggtatctgtcttagggattagcagaagtagagttgaggtggctggtcacagttgtactttggacttgaggcagatgggacatggtctgctctgcctagttacatgcagaagctgctgccgctgctgctactgcctcgtaagagcagacccagtatcgcttatagtagtggagtgctgcatatgcatcgttgtaatacctggattccccatagcccatggtgtaaggcgtgtgaactgctgcatattgttcattacactgctcagtaaagtctgccacacgacccgtacgatctactgggcactctttggaccagtgaccttctttcttacactgatagcagccacactggtctcccattccaggggcagtccgaagtcgggcttgtggacaactacacatgcattatcttgccttgaaactctgtgttgtcaaggcccctgacggtctcactgcgtcctctgaccactccatgtgtatgaagtgtatgaggacataatctttcacgatgtcacattcaatgactggaccatacttctcaaacttggcttgaagctcttggttggtacaagtgggactgatgttacccacgtgtaacttggttgacgctttgctcttattcttgctggcttccacgttgatgttcaccccatgaagcttgtaatgatgcaagttgtgtatggtatcctcagccgccgtcttgtcttctatgtgtacaaagccgtagttcttaatgatgtcacattccagcaccttccctactgcttgaaaagagagcggatctcctgctctgtggcctcctggggcaggtttctgatgaacagcttcatcatccggacaagcacctctgggtggcagcggcggaggtagctcctgcgtcagagagaaccctacaaaatcgtttgtcttgataaaagaaaaacttcagccgaattaaatttaaaagagtttaattgagcaacgaacgattcacaaattcggagccagagtaggatcagagaatccagcgcagccacatggtagaaggagatttatggacagaaaaaggaaagtgatgtgcagaaaacggaagtgaggtacagaaacagccagattggttacagctcagcttttgccttatttgaacacagttcaaagagttggctacatgtgattggtcaaaactcagagattggcacacgtgtgggctacggtctgtttacacctccacttgttatagttcattatgcacggagaaacctaggccaaaattaaaatatgtaaggaggcagctttaggctaaacttgatttaacaatcttaataagatccctgtccaaaggctcacatttctatagaagctacagtttttcaattccaaggataggtaaaaacagggcagcaccatgatctataaaatctagagttatggctcagagttagggccgtttcttggtgacattgtgatggtttagctggtctacaacaaatctatgagggcagaacttggaagtgttgactgccttcacggcatggaaggcctcagccctgtgcaccacagcgtggttgtgctcctgccccgtggtcagataggacacgcttgttcagtagtagttctcatggtctgcagcgcggccgccagtgcttccagatccactgccttccaggaatgccacagcaacagaggagggcagtcaggaacttggagcctggggctgcactcatcagacagccaagtcgttttggccactgatgcaaagatgaaatgtttaactatcttcttacaatatttaacttggtaatttagtttaaaatgcatatacaaaattgcaagtattaaaaaatgttatttttaaaaattgccttttcccactcacacatttcatgaaaacattttattcaaactttttaaaggcatgtttcatgtcagtgtcttccatcacctctaaagagatgttctctaccaattttcctgaccacctcatcttcacttctatccaaactatttgccacatagtacttttttcttaaaaacaaaaaaattattacaggctgggtgtggaggctcacgcctgtaatcccagcattttgggagactaaggagggaggatctgttgagaccaggagttcgagaccagcctgagcaacatagggataaccccatctctaccaataaaaaaaaaaaaaaaaaaattagccaggcatggtggtatgcacctgtagtcccagctactccagaggctgaggtgagataattgcttgagcccaggatttggaggctccagtgagccatgattgtgccactgcactccagcctgggcgacagagcaagattctgtctcaaaagcaaccaaaaaacaaaatttattacagaaaatttcaaacacaaatagaagtatatagaaatctcaaaaaaggccgggtgcggtggcttatggctgtaatcccagcactttgggaggctgaggctggcgggtcacaagttcaggagatcgagaccatcctagctaacatggtgaaaccccgtctttactaaaaatacaaaaaaattagccaggcgtggtggcaccacctgtagtcccagctactcgggaggctaaggcaggagaatcccttgaacctgggaggcagaagttacagtgagccgagattgtgccactgcactccagcctgggcgacagggagagactccatctcaaaacaaacaaacaaacaaaaaaataacctcaacaactatcaactcatggccaatgtttcgttcataatcctccatgccctccttcctgaattgtttttaagcaaatcccagatatcttatcatttcacccaaaaatatttcaatatgtatcccgaagagaaagctctttttgagaaatataactgcaatcacattatagtacctaaaaattaataatgccttcacatcattaaacatgtagcaagtgttcagatttccccaattgtgtcataaagttgtttaaattaggatccagactaggtccataacttgcatttagttgatatgttttttaattatcttttaatctatgggtgtcctccttcctctggctcttttttccttgcatgcaattcatttgttgatccgccctttagagtttcccatacctggaattttgctgactgcattcctgtggtgtcttgtatcatgttcctctactcccctttatctcctgggaaatagtaggtggctctggagactttatcacattcacattctatttattggcaagaatatttcttagcactttcatcaagaggctaattggttggttgtttttctttttgtgttattatagccattaatcatcactacctagattcactatttcagaaagggtgcaaaatggtgatactctgattctatcatttcttcttcatttattagctagaatacttctctaaggaaaaatgttctcttatcaacttttgattatcctaaggtgcagtcttcaggaaaggcaagataaatgtgtgattccttctttttattagttttcagaataatgggttggtttcctaacatccatcaagagtgacctaatgtctaggtattacttagttttctttttgggtgggcatgatggctcatgcctgtaatcccaaaactttgggaggccaaagtgggaggatcacttgagctcaggagtttgaggctccagtgagctatcattacaccattgcactccatcctgggcaacagaccaagaccttgtctcaaagcaaaaatggctgggcgtggtggttcacgcctgtagtcccagcactttgggaggccggggcgggcggatcacctgaggtcagttcaagaccagactggccaacatggtgaaaccctgtctctactaaaaacacaaaaattagccaggcgtggtggcaggcacctgtaatcccagctactcaggaggttgaggcaggagaaccccttgaacccgggaggcggaggttgcagtgagccgagataacaccattgcattccagcctgggggacaagagagagacttcttctcaaaaaaaaaaaaaaaaaaaaagaaaaacaaggctgggagaggtggctcatgtctgtaatcccagcactttgggaggccgaagtgggcagatcacttgaggtcaggagttcaagaccagcctggccaagatggtgaaaccctgtctctactaaaaatacaagaattagccaagcatggtggtgcgtgcctgtaatcgcagctattcaggtcaggtggctgaggcaggagaattgcttgaacccaggaaatggatgctgcagtgagctgagatcacgccactgcactctagcctgggcaacagagtgagactctgtctcaaacaaaaacaaaaacaaaaacttaattttgttttatcttatttgtgatatactactttttattttatacaggctcctggccgtggaatttttattataagctacaaccaaccagttataaactatcaggatagttgacctttttttcagtagataatcatattttatcgacagatgttgaatttttgagatagaattcacataccacgcaactcacaaacgtaaagtgtacaatccaatgttttttagtatattcacagatatatgtaaccatcaccacaatcagctttaaaacattttcatcacttcaaaaagaaatctccgtaatctttaactaccacctccttatctacccatcccctcccccaggcccaagtaacctatgatctaatttctgatctgtagagttccctcttctggactttcatacaaattgaatcatatattatgtggtcctttgtgactggcttctttcacttggcatgatatgttcaagggttatccatgttgcagcgtgtatcagtacttcatttctttctacagccaaataatattccactgtataaatatacaacatcttgtttatccattcatcagttgataaatgtttgggttgtttccagcttttggctattatgaatatagttgctataaacattcatgttcatatttctatgtggacatatgttttcattttgcttgggcatatacctggagtagaatatggtaatactatgtttaatcatttgaggaactgccagactttttttcaaagcagctgtaccattttacattcccactagcagtgtatgagaattgtgatttctccacatcctcaccaatattcatggttatctgactttttgtttccagccaacctagtgggtatgaagtagtatcttattgtagttttgatttgtccttctgtgacttataatgctaagcatctcttcatgtgtttattggtctcttgtacagctttcttggagaaatgtctattcagatccttttcccatttttaattggataatttgtcttttttattgagttgtaggatagataatttttctcatttgccacataggtatgtattaatataaccacttatactttttaaagtaatttttttaaacttactttgaaaatgtaaccaggacttaaagttgtgtagtaataacctcaggattaattattgactccatattaagttttttagtaacttttaaatattccagcagatgagctcaataaacgtgaagaactaacattggctgaagtttttttcaaactaacatgtcttccctaaacaataagttgttattcaaaacaaaatattgagaaggaaacttctatagtgtgatcaactttgtaaggacttgaacatatggtgactcttttctgaggaatatttttacgaaaatcctgtcttttattggatatatgtggtacattacagaatttacaactgtgttttaaaataaagcccatgtagcccgcattattggatgacattagtccctgtgcattactgctgggttgtgggagattgcagtgttaaatgacatcacacaggaagtgtttaacacagtctacgacctgcctgtgagaatatccttcttcaacttagactccagaggaaatgagtctttccactgaaaggtgttaaacatgtccctcccacggttacagtgctcaagagaaaactgactgggcagagagattatagccccagggagagcataggtgaatagcccactccagccagcttagtggtcagccatcgcacttagcaagggaaacagagctgacacatcacatggcttctggtgaggtccatatatagcaaggcaacaggccacaagcagttttgtggactgctggaagaaacacatgctggaaaaaggttaccactagttctttgtgaggaagaactagggtctggagtcagatgtcactgttcattttttgtagtttgttgcatgtaatcttgtaagcaaactctagttcttttcacaatgagcggattggtcgttctcaacaaattattgtcttcctcaagttctaaatttaaaaagctctttatgtatagataaattaggtagaccacaactaattgttaagtcaagattctgtttttgccatgatcaataatacatcagcagcctcccttacaaaattactaatgcagccacaaggatgtattactcatataaatattgtattgtatttatttatttatttatttattttggagagagggtcttgctctgttacccaggctatagtgcagtggcatgatattggctcactgcaacctctgaccccagattcaagtgattcttgtgcctcagcctcgcaagtagctgggtattacaggcacacgccaccatgcctggctaatttttgtatttttagtagagacggggtttcatcgtgttggccaggctggtctcgaactcttggcctcaagtgatctgcccgcctcggcctcccaaagtgctgggattagcatgagccaccatgtccaccccagaaaatattcttaatggaaatacaccaaaacaatcgtgttagtatattttgaatgggggccttataataagagtatttatcctactttttttctatttttctaattgtacataatgggaattttttaaaaaatgaaaactaataaaataaaaaataaagcttattcctaaatgattcaaatttgttagtttctatagtagtgctttccacccttgaaatattgaccaaaatagattacttccagtccaaataattaggttatagaaaaacattaagaatttgtctatacaacattatatgtgttgaggttttacagaactaagccctttttcctcacctgagtttaagaccaactgagagatagacacaagagtcagacagttgaagatcagaactttatcttgggccgggcaccgtggctcatacctgtaattccagaactttaggaggcagaggcaggtggatcacatgaggtcaggaattcaagatgagcctgatcaacatggcaaaacctcgtctctactaaaaatacaaaaattagcccgatgtggtggcgcacgcctgtaatcctagctacttggaggctgaggcaggagaattgcttgatcccgggaggaggaggtggcagtgagcaaagatcgcgccactgcactccagcctgggtgacagagtgagactgcatctcaacaacaacaacaacaacaataacaaacgaaaaaaaaaaaactttatcttgatcgctggtaaagctggattggagaacatggttttaaatctgtgacttacattttgccccaaattaaacgtgtctgcttggtcacaggaagagttggaaagccacaggctctcttcatagggatggaacgtgccccactaacaacactatgcagagaacagactaaaaaacatactctctgcaggcagccaggctaacagggaagtggagtccaagaggctgagtcatgcatgcccagttcttatgcccaaacaccagaggtagcgggggtaaagagagaccagggatgttactttaagaaaagaagtcttccattcagaactataagaccaagggaaatgaataatcctaacccacctgaagcaataataaatggtaaaaactccagccaggtaaccagggccatgtgatcctaagaaatagttttgagtggttgtgttttttttgttttttgtttttttgacaaagtctcactggttgtggtttatttgtttgtttgagacagggtctcactctgtcccccaggctggagtgcagtggcatgatcttgcctcatgcagcctccacctcctgggttcaagcaattcttgtgcctcagcctcccaaatatctgggattacaggcgtgagccactacacacagcccattttggctatttttgaaactaaattgattttaaaaattaggggttcacataaatggcaaaaaaaaaaaatcattaagcagaggaacctgttgtattttgaaaaacaaataagagctttcttttttaaaaatgtgcaataatattttcacttgatttatgcttctttcaaattccacaaattaaaaatgacttgcaaattaaaacaaaaattagaaaaacattgtcatgtctaacagaattctctctcccttctctaaacactacttagccagaaacagagaaataaaaacttctataaaagagggtagagaagctgttgtttgttctttaaaagttaattcagtgtgcaaagctggtaaggaaagcccatcctcttagctggagttgcataatcttcaaagaagagtccctggagagtcataaccagaaatgttggttcaacacacacacttgctgtgcaagactcctggccttcatccagactccttgggacaaggtgtccacatgcacctgaatgccgccaaggagatgccaggtaagaagattttcacataggtatttcagtgtacaaacctgttgcaccacatgtgcccactcaggtattaaactgaatccctttccacactgcaatgtgactgaacctgaggaaaataatcttccacaccaggcacaaatgaatatttctgcttaggagcaaccagaagtccaggagtgagaacagagttctccaaggcaattgcctctggcagccacaggctgagatacctggggtctgtctttactgagagaccttgaaacccttaagcctcttttggcctctattttctcatcgcaaaaacacggaggctggatttatcaggtgggaactgctttaagattctatgatactttagtttgtttctatccaaacattctcatggtaatccaataaattaaggtgaaatttattgcagtgattgattattcagttaaagccaattcaaaaaaaaaaacaaaaacccgagtttatcactatgcaatatgtccatgtaacacatctgcacttgtactccctaaatctataaagataaaaaatatattaaaaaaacaaaaaccagccaggtgcggtggctcacacctgtaacctcaacactttgggaggtgaggcaggcagatcccttgaggagtttgagaccagcctaggcaacatggcaatacctcatctctacaaaaaatacaaaaatagaggctaaggtgggaggatcgctcactcgagcctaggaggttgaggctgctgtgagttgtgattgtgccattgccttccagcttgggcaacagagcaagaccctgtcttaaaacaaaaaaatgaaaaaacctgtaagctacacttgtgtgcaagcacatgcctacacacacacacacacacacacacacacacactctctctctctctctcttcactcttaaaatacggggcttgaaattatttcagttgtttgttcacacaggcccaaattgctcaacactgggtttcatgttgccgctattgacatgttaattgtactggattgttttctgtcctctcaactgtcctcatctctctttaagcagaatggatttctaaacatgggtcctcaaaacaggatggtggagccagccccacatgcttgggggcatgtaagagctaaacgtgctgatatgctgaatatgtgcctgaaagatggatgtgacacaaggacaataaacagtggttgattgaaggaaaaattcctgaaaaattgaaggcaaatacatctttcactaaacagaatcaaattttatgtgttgtaggacaagtatccaggactacattttaaaaatgtaaatgtaaaaagaacactggatttaggtccaaattcatttctgctacttactgtgcaactttgggcaagatccttaagcactgtctctgagctttggtttcttctctaaaagtgtagattagacacccacctcaaaggaaagggtggttgtgatggttaatactaagtgttaacttgattggattgaaagatacaaagtattgatcctgggtgtgtctgtgagagtgttgccaaaggagataaacatttgagtcagtgggctgggaaaggcagacccacccttaatctgggtggacacaatctaatcagctgccagcaccactagaacataaaaagagagactggcctaacctcccggactatatctttctcccatgctggatgcttcctgccctcgaacatcggactccaagttcttcagttttgggacttggactggctctccttgctcctcagcctgcagacggcttactgtgggaccttgtgatcatgtgagttaatacttaataaactttcctatatatatatatatatatatatatatatatatatatagttctgtcctctaaagaaccctaatacaatggttttgaagattgaataggaaactataaaagtgcctggtatagtacttaatatacacaaaagtttttatttggatattaaaataattattttatcatttgagaaatctttttgaaatgcaaataataattaatgctgattgattgatatgtgtgtgtgtgtgtttgtgtgtgcgtgtgatttttaaaatggagtcttataaaaattttctccagataagacgtgttcatcattctgtcacacagggcacccaccactcagagaaaatatccatcctccgcccctccacacacatcaagttcttatccaaaagaagtttctcccttcctttttatgccaacatggttagctcatatttcctttactagtgaccaatatcattttacctatctattttaggatagcttttccagaaactatgaaaggcagaagaaaattcctcctgtttcaaagacctacaaagcagtagcagattcaccaacttctgctgcagatgctacaagaagcctttattcactgtctcaaatgcatttttttttcctgctttggcataaccctgcaaaagctaaggagagcaagtgtcctcaaaagaaagggagtgttaaaaccccgtttaaaaaaatacgaaaactggcccgtcgtggtggctcacgcctgtaatcccagaaatttgggagaccgaggcgagtggatcacttgaggtcaggagttcgagaccagcctagccaacatggtgaaacccgtctctactaaaaatacaaaaattagctgggtgtggtggcaggcacctgtaatcccagctacttgggaggctgagacaggagaatagcttgaacccaggacgcggaggttgcagtgagctgagatcacgccactgcactctagcctgggtgacagagcaagacaccacctcaaaacaagcaagcaaacaaacaaacaaacaaaaaaccacttcagcttctagcgtagtgctggacatgcagtgaaggatgccaaaaagtttaagaaggaaaatggaacaagcactgtgtctacagtcttcacaactgagacttagtttctcttcctgcagtgtaaatataattgccctccctgtctccactggttattgagaggaccacatgaccatgagtagcagcaatacattacctaagttattattattattgttattcatcatgcattcaacaaatactgagatcactgttctaggctctggggatatagcattaaatcatcagactaagatgtctgcccctcgtgcagcttcctaagtaattgtaagatatttttagtttgggaatagttctaagtagaaaataaacagagcaaagtaattaaaaacaaaacaaaacaaaacaataaacagggtggagatgggagtggttctaggttagtcagtcctttttgatggggatttgggagctgagtcctgagcaatgggaaagagccaatcatgaacagatgtggaggaggagcatctgttctgggaagagcatctgcacttcttcatgcaggttctgagttgggcatgagattgacatgtcaatggactagaaagacagcccatgttcttggagcacaatgagcaagggagagggacagaggatgaagtcagaaaacagacggaaaccagtgcatctaggtcatggtaaggattattccagaaatctgctgaaatgcagatgttcctgtttaattgccttgacacacaataggcacttaacaaatatttatattcattgatttcctacagacataatgtcttagataaatatgtgatctaacagtcatctaattgaccagggctctgagcaaatggcagatgtaccagcatagcctttttaaagaggacagtaatgcaggctgcattccagggagcagaatccagaggtgggcttctcatctgtaatggattgaacgtttgtgacccccaaaaattcatatctttaaatcctaacccccaatttgatgatggtatttggaggttagccttggtcacgaggatggaccgcttaagaacgggattagtacacttttaaaagaaacctcagagagctcatttgcactatttgtcatttgaggacatgggaaggaccagaaagaggccctcatcagacaccggatctggcagctccttcatctcgaatagcccagcctctagaaccgtgagaaaataaatttctgttgttcataagctatccagtctatggtattctgttataacaacccaaacaagctaagacatcatccatcttggaagaaaccgctcctatttcactgtaaattgcagattccaccaacaccctgccaaacaccaagaactgagctcaaggttagtgtcatgtcttctgggtgccaagacttcgaagccatctctggggagtgtgggagggaaaaaaccaacagctcaagacccattctctactcctttctagcaatgcaactttgagcaagtgaattacctagtaacaataaaggtaagtgttcatgtagtgctttctatagggcagacattgttctaaagaccttgtatgtattatctcattcagtctttaagaagggataataatagtgcctacttcataggctgagatgtgaattgcaaatcaatcaatgtttgttccctccccctttttctgtgaagactaaaatgtctgccttcaaaagcactagaagagataacgtgtatgaattgcttgctcgatagtgggtgcccaacatattatagctataataataatgatgttatcaagtctccctctgtgaagccctagtttagctggggggtcaaagccctgctgaatgacttgcaaaagtcaggtatttggggtatatcttgctgctaacttatcctagagactgattaagagcctggagcataatcaatgcttaacaaatattctttcctctctgctgagatccagaactacctgaaaaggtagctcagagaatacaacttagtatttattaactgtagaaaagaagatcgggtgtggtggcttatccctgtaatcccagcactttgggaggcctaggcaggaggaccgcttgagcctagaagtttgagaccagcctgagcaacatagcaagaccccgactctacaaaaaataaaaaattagctgtggtggtggcatgaacctgtggtctcagctactcagaaggctgaggcaagaggatcgtttgagcctaggaggtcaaggctacagtgagtcattgattgcaccactacactctagcctgggtgacagagtgagaccctgtctcaaaaagacaaaaacaaaaacaaaactttaaaaaagaaaatctaaacctttgtttaaggtgttactctccaatgttcaaattcatgcctcagcagagaatttgacaatcagaacatgaagaggggtcctggcacctctgtcagccacatcaggaccggcctgagagtaagaggcaataacagtgtcatggccaagcagaagaaagggttaggggagctggctaagggagatgggctcaaaacagtgagaatgacaccttgtaataaggcaaagaagtagagagtgttcataagccaagatttcgcaagcaagatctgcctgtgtaacagtttatgaaccctatattctgccatacatactgtaccatatccaacaggccccaggggataagagttgagggacccctcatatgcctcccttaccacagcctgccacaagatctcatcttagaagagggacattttgaggctaatgtctctatctccaaagacctctgtgaaatgccaaggtctgacttgagagaggtaatacatctgtccattcacctacccacaaatcagtgtgttgtcttagtagataagccagctctcatgttaggaaactaagagtagagttcagagataggacacaaatcagaaaaaccgctgtcagttctaaaacaggccaaaaaataacaataaatctgaggtttaaaaaaaaatcagaacaatggttgcctaggggggattgactgagaaggtacaagaaggaatcaggggagggggaaattctatgttgtgatagggagtaagttacatgggtgatgtatccatttgtcaaacttggaccgctaagagcccaagaactgaatatttcaatgtacgtaaattttaccttaaacaactcttaagaaaaataataatgcaatggaagagtggaggaatagataatatagagatggcagaatgagatgggtacatgagtgttcattatactattggatttactttgtatatgtttagaattttccatgataaaaaagctaagaaaagtcttaggagcagcagcaggtaggactggggaccaggaaggggctctgtgggatgaggaccgacacagtcaaaggactgcatggggaatacacaaaaatgttggggggagggaggaaggagccttttgtcccctgcacatttcttgtcaaatttaatcccacgtgttatatatgcttttgccttatgaatccaatctttttccatttcattttctaactgcataaaagaaagctaatattttcatgtgtttgcacaggccactgtattaatagttacaagcttcctaagaggagggcaactagaaggttacaacgtggtttaaatgtgtcccaggccagccctgctcataccaagtgagagaacttcagaggagagggacccacaaacctaaactgaaattgcttaagaaacttccatatgtagattgttgtattcccagaaatgattctcatcacacaaaaaaattggaggttggggtaggttagtgaatagtcttcatgtgtagatagatttctccaccaggggatagagctgacagaacgaggcctgcaaactcatggaaattagcagtaatgagacataaacagtcaaacctcaaaataacatctctggcctttagaatcaacacagctctcctgtcagcctgcacctggcccgtccggctgggtctgggagccagtggggttttaggccccttttaacagctgccaaaagcacattactcatggccgggaagttggccttttatgttgccacaagtggtgcagccgttgtttggacctggcggagtccattgtaggtttttctcagggatggggctttgttctttgatttttccagaagctctagtttgttcaaatgttacccatgtgcagtttgcaagccccccatgctcctgtgctggcctacagccatgctcactgcctggcagcatcctccagcccctggagaagcagggcaagaggctgaggttagaacagcagaaggttacaacctcaccctaagaaactgtttgacctgccttgtcagggtccaggttcttaacacagtgcaaagagctgggaggaggcaaattaacacaaaaactgcctcttacaggcatacctgtgaaactacaaaaaagcctaattgtaatacctctgtttgaaatacacccttgaaataagttggttggttggttgagtggttgggtgggtgtatctagttaaaagaatccctatatctatttagttgataagatcttttctgggtttctaagctgcagatcagcctggtgcaaatggatttagggtgaaatcctggtggaggtcattagtatctggtgatgatatgctcacaatattttagtgtaattatttgtctactatctatttccccttttagactttcagttcttcaagggaaggagttgtgtctatcttattcactgctctatcttcagggtctggctcagacaaaaccttcaaaaaaaaaaaaaacataaaactctactgcatgaatgaatatgttgaatcttgagagcttgtctggaggttctagcaggggagctcagctactctgtacccttgaccgaaggccggtcctcctctgtcggagatggtcatccacttcaactgagcgcacagcttcaggagagaggcacatggagtgctgagggaggaaggggacacctgcctagccagccagatcagctgaattaatcctggtggtcaataagatgacagatgtcacagccagatcacccttgcatgcaaatatgttgaatctttaatgttcaagttgttacagcctatgatggcctggaggcatttcatactacactgggtcccttgtggcaaactttgttagctgggtatccacagccatttctttcttttctttttcctttctcttattttatttttttgttttttgagacagtctcactctatcacccaggttggagtgcagtggcatgatttcggctcactgcaacccccacctcccgggttcaagcgattctcctgcctcagcctcccaagcacctgggactacaggtgcgcaccaccaagcctggttaagtttttgtattttttagtaaagacagggttttgccatgttggccaggctggtcttgaactcctagcctcaagtgatccacccacctcggccttccaaaatgctgggattacaagcataagccaccacgcccggcctatcaacagtcatttctatctcctttctccttctcactacagaggttggaaagcacccttgcagctaggggtagccagttctggccaataaggcttaagagggaaactgctggcgtatttctgggagagatattttgttttctgattaaaaaaagaaaaaaactcaaataaaatcactttctggcattgccctttcttccttcttcttgctgtgaatgtggactgtaaagccagacactgtgacagtcatcttgcaaccagtagtgacaagcatgaagaggaaaatgcaacacctaactaaggattgtagaggagaaataaaaatattctgggttattgggcttcagagagtcactgaatcatctctggaaccacctacctccagccttcttattaagtgagataacaggaacatctgtaatgtttgagtcacaattagtctcattttattttctattacctgcatttgaatatttcataactgggacttttcttacttccacattagatacatggacagcgatggtgttttattcagcttgttattcctgcacacctagctcagaacctggtacatagtaagagctcaaatattattaaacgaatgaacaaacaaaacaggaaacaaataaaaagggattcagaagtttatttattgctcttctattatatacaaggcactgctgatcgctgagtgagggctgttcttagaatttattatttacttgcatatttaaactatagtatttataaggcattggttacaaactattgtaattcttggctcttgtcctttgatttatataaattatggtttatcaaagtacatgctgtttgcttattttcttaatgcacacatactcattcattcttgaagctttaagaaaagtaacttcctctatttcctctattatgtttattagcaaaccctttttatgaaatatggaaactattttttcttctttgaaattagttaaaattggttccgctgaggattgtcaaactctggctgtttgctgacctcatttcatgtagagcactagggtatacaccatccatggggtttcaaaatgtttgatgtttgaaacttttaaattaaaaagaaatgtggagccttgatcaaatggaaaggttttaaatatatctaaagcaaattgtaatgaagcaaaatgtatacttgcttacagtcaatgacccatgttagaagaaggtatgaaataaaaaaagaacagtaataatgcaaatattatgttaataagtctggggattgagtttgtgggagttataataaagtttcttttttcctttcacgctgttcttcatcagagctccagtgaaacaagagtaataaaatttccatcaacaggtggcaacacttgtattgtttgctttttagagtaggccttgattgcatttcagaacaaatgcattgatagttggcaaagatgaatatgatatttttttaaagcaaccaaatccagaaataacctcatgcaaacataaaatgaaaactgtgacagaagaaatcatgaaaacaaacaaacaaacctaaaccctagcactacttgtgaacatggcctgagaaaccccacgggcatgtccttaagcacagaacgacggagtctccctaggctagaacaacccagaagcccacagtacaagggtgaatggtcactcaaccagagatataaataagatggaataccctttagctattaaaagtgttgaagtctggggtaccctccaagtcatggaaatgtgtatatggaataaagtgaagtgaaaaaccagaacataaaactctgtgtatatgcaggttacagttttgcaaaaacgtgtgtgtgtgtgtgtgtgtgtgtgtgcgcgcgcgcgcgcgcgcgcgcgttgacaatgatgggagagaatttggaaccatatcaatagttttacgttgagccagccagttctttttatttttttccccctgtggaatttgtttagattcatgatattaaaaaggaaagaaaagaaaaaccatagcactaaaaccagtcattgtaccctgaaagagttgtcaggccttcttgagttcatggaggtttgcaggttcagagagtccatttgaagaaagcagagaagcatgaagacaaagattccgtttttgtccctgaaaattttgtggaggctgttccccgtccttggcaggcctctgccttcttgtttcttcacactgcagtttagatagcagggagaaccttgtctgtttaataagtttgtgaacaaagcctgattgcttcccttgtcaataaataaacattatctgcttctgtttctctgctaaattgagtttttgcttaccctaactggttatataaaggctttatgtacacaggaaaaagaaatgacaaggttgtgtaagcaggcagccctgggtagagttgtgaagtcagtacagtttatttctatgggctccttcttcttctttatgcatactttccctctttcaaaggcccagatggctcctgaaaccactatgctcatcttgcatcaacctcgtaaggaaccaatggatttcttcccaggattctttaaatcaaaacaaaagagggactagcccaaggaatgatcactacagactgaattttgggcatggaagtgggtttatatttgagaatgacaatcttaagtcataccacataggcaacagtccttgtaaaaagccagaactgaggaacaaacctgaggcacagtttaatttactggcttaccaccaaacaattaaaaggaggtaaactcagtattagaagctaggtctgcggaaagcagaaggtgcaatgagaggctgtgagagttcagaggaatgaggatgaacctctctttctcttcccataggatagtggagcctggacactgtgcccataaaatgcctcagaattgttgctggtgtaaggcacggtatggtaccaacaagaagggagaggacaaaatcctctgattttgaaataatgagggacaaaggagaaaactactcacaccaatgattcaaagctaggtttcctctgaaatgtcatcctgtaatgagaatgatgttaaagtccaaaactttctcaaaagtaaccacaagaaggtcagattgaccagacagagtgggtgctttggggcccatctgctcccaaagtcattcatcagactcaatgctacttctctctatgtgcagggctgccattggtctcctgaaaacccataagaaatttttgatctttctgttggctcaacaattctgatttttctgcctggcttattgatagtgattgctcacatttcaagtaaaaactgcaaaataaggcatccagacttgttgcatcacaaggcaggaaaagacaattactgaaaatctaaagagagatacgtgactattctgcaacaagttccttagctctcccaagatcatggagcagattggcagcagaattggagagaaactgttttctgtactgtatgcctcactcactcatttacctgagggactcaggttttgaggtaatagagatgccaaatccttagcactttactgtatagaaggcagctccatagccttcaatgtcaggaataaaaactcattcaaacccctctaattttaaagattttttcagcccccttttttcatctgaaagttgtattgttgttggcccaaacaccactttttgattgcccttgctgcttgctgtgaatgcaatctctaaagcactctgtttaatctttgaatcagctcaggaagatggaattaccatccctggaaaactgcagtttagtttcaaggaacccgctgcagctgcaacaataagatggaaatgtggtttggaggaggcaaggattaaaggtatgggattaggaaacccttgtttgccctagtgagttgaatgaccacataaatcacaggctaaacttggctctgctcagctcatattaaagtatgtagcatcagagcctcctcataatcaggatttgtcatcttgagtatcaggatggaagatgcagatgccaaagaggggccgggggagaagagaggatgagaaggaagtgaataattttggagacagtgactactattttgataggaaccagaatgtctgcactatttcaagaaccacatataaggacaaaagctgttggaaatgtgccttctaacttcaaattgcgcctgaccattagaacgctgataagggttggggggagagcagctggaactctgcaggctgcttgggtttcttttcgtgatatttattcctagatcacatttgcagctgcttttatctgctctttagaagttcttatatttggggaatcattcattgtgaaataaaaacctattcattgacctggaaatgtgatttattagtcagctacagaactagttgtctattaatgcaaacatatggaatacggaacttttcattctacccaagatgccacttatggaccctcaagtttatcataccccgtgatgcccccatattagtgccctgggctaagacattgaaaataatactctcttcaagagaaagtaaaacaatacacacacatgcacacacacacacacatctataatgcagtaatatggacagggaaatgggaagaggtttttgaataagaaccaaagccgtaaaagaataaccagcaaagaaaagacaacatacaaatgcagttgtaaaattaaggccgttaagaaataaggcatagccagatcttcttaaaatggggccaaagcacattgggatttgggacaacaaaagaggaagttagggcagggtagaggaaactgactccaggatagctatggcatggtatgttaggacacagcaagcttaggtgtgctatggtaccagctggcccaaaaccagtaggcaaggcaaggtactgagaagttccaggcagcagtggtgggtggttgtgtggtgacagtgagaactgcaggggcatggggcccgaatgcagactaggctgtgtaagggccacagccaggcaaaatgaagtttatagtgtgtcctagctctatgcagagccaggagttctaggcaggataaccaagcagatcaagctagaatcaagatatctagatgggcgcagttctgacagaatgagggtgatgagatgatacttccactttagggctacattaggcctgtggctcaatctctgaatgtgagatcatgctggcaatccaactttatttcaaatcatactggagggcagagctgaggctacctgtcttgttcagggttggaccatgtgttggccctatagtgttatttgtctgctcaacagtccttcctttgggaataacttttctgtgattcattgtggtttgggcattgccctcccagtgcaaaagggtgggactatgtctcagatctggccagtcagattcctttattccccaacctacagtgattaatccagagatacgcatatggcacaagctgagccaaatcttctatggaaggtcttctcctactactagtgtttattgagtgcttaccctgtgctgggaacagtttaaatgcttcagatgcattatctcatttaattatcatataatttgataaggtaatgctattattatcacccctttacagataaagaaactgaagcaaagatagagtaacttgtctaagatcatacacctaggtggtagagatagactgtgtaactaggcagtcttgtcccagagcttgtgctattaacatgaaaggaaagacacacttccctgctctaggattgtaaactataatgatcacataacataagctggaactataagtgtccacgttcctaggccacagagtgggagctgtctgcagtagaagagaatgaggccatatattatgaaaagaagggaaagagatcctcatgatatggtttgagtgcctggatctaggcatgcctgaagctattcaactcatggacttttcggttacatggaccactaaactccctttattgcttaaactagctagagttgggtttttgtcacttgcaaacaagagtcctgactaatacaggcttgtctgtagggtacttcagtatgcagtggggagcctagagaagatgagaacaggagaaatgagtcagaatgtgttcaaagcaggttggcatcctacaacacgcatgccattgttgtggcattccacggctccagttgtccttaccttattattgtgccctgcttcagttgacggtctataaaccaactgtctctgcacagacacagtccactggagagaaatctaaagctaaagcaatgcaaggctatcacctcaccaggagaaaatgtttactctgccttatcaatacctggatttatagcatactgcaaataacctgtagaatgctggttgatcacaaaaaggccacacccaagaaactgtgaaaaaacaagacaattgcaaagcttgtgctttaaaatatacctatgcatctcctttaaaaggttgggggatttggcaattggatggttagttagtccctcaggaatagctagacagattcaatagttattccacctttgactagtttgaagtatcctttctaggttcctgcactgcagagcagtgagcctttgtgtggcttggccttgaggttaatacaagcgaaactcttagagctatatctggcacatagtaagtgctcattaaccaagcaccattcttttcttctcttcttggctttccaaagattctacaatactggtattacctttccaattaaaaaaattataataagttgctgattctccccaaaggaagcacaaattcctcacttggaaataattccctgcaaaactggctttatggaccagaagcaatttctaaacctgataacaggtttagaatgaggggggctttaacaactgtatggactactgggagaagctccaatcaatattcccacacatggacaagagttgagctgaaaaagatttttaattcaaaggtcaaagcttgacaaacaggccgggcatggtggttcatgcctttaatcccagtactttgggaggccaaggcgggtggatcacctgaggtcaggagtttgagaccagtctggccaacatggtgaaaccccgtctctactaagaatacaaaaattagccaggcatggtggcagatgcctgtaatcccagctacttgggaagctgaggcaggagaattgcttgaacccgagaggcagaggttgcagtgaactgagcacagcattgcactccagcccaggcaacaagagcaaaactccatctcaaaaaatgaacaacaacaaaaaaaaactaactagagaaactaaggcaaatgaatgccaagagtcacacagctgatgagtaacagtgttgtgattcaaagatcaggttgggagaccagatgtgctggcccatgcctgtaatcccagcactttgggaggccaaggcagaggattgcttgagctcaggagtttgagactagcctagggaacgtggcgaaaccccatctctgcaaaaaaattagctgagtgtggtggtgcaccactgcagtcccagctacctgggaggctaaggtgggaggatcacttgagaccaggaggtggaggttgcagtgagccaagatcacactactgtactccatcttgggtgacagagccagaccctgtcataaataaataaataaataaaggaataaagatcaggttagtacaattaaattgtgccagcctcttggtctcccttgacaatgaaattaattatatccctattttttagtgtgttataatctgagttttaaaatctgaattaattatcatgattttctctgtcttcccataaactcacttgaaaagcagaaagtgcttggtcagcaagaaccttcagaactttgtagctgaaaggaagtttagaaatcaaataggggtgaggaagactggattaaacagatgtctttaccgtaggccttctcagagtctttgttgtgctagcatgcactttgattctccaatatataacctttctcaaacttatttgacaatggaatcttttttcctcaaaattattaagatcttgaggtgtcctgaacaacatgtaggaagtggtataataaatctctagtcccatcctgggctcacattttgttctgtaaatcctaattatgtccctgtaagctgaggcctagagtgacaaatccttcatctcaactccctcactaccctggggaggaggggaaggcggttgtggggggaatgggaggcctactgggaactccaggttcctgttctctcaggccctcagcatgtagggagggagaagccagaaactgcagctgccgccccaggcccccaaactccattcccttcactgtagctttgaattcctcccatgtgtaattataaagtatgtgttcagttatttactttccctgttccatgcagagtgtgttactgaataatacagttcacaagtaaatccaacttttctgctgcaaggtctgaattaaaaagattataaccttctatcattccagttttaaaagaaaccactacttatgtagcttaaaaaaaaatggaaacaatgattgtctgtcctctcagaaatgcaagcaaaattgtagaattaagatgtttacatggattttgttgtttctaacagccttaaattgcctcatttaggaagggtaaaaaataaaatgcccatgtttcttggatttccaggaactgagtctggcagccggttcactgttgtcttctagaatttgaagcaagaaaaattacaaccaaactggtgtcaatttgctctatttatcttgggaattaacttcaaagcttaattgtcagagacagtgacctctatactcatgaaaatccccagggaattacaaaagcagactacttgagtggaatgtgaatgtcattctgagaacaggcctgcacagcgcctgaaggaaaatgcttagcccaagaaggatggagctgaccctacaagcttctgtacttcatttctcaacactcagatcaagttcctaacccacagcttctgtctgacccatgtttctgccactgagctggttccagaattgcctgtggatgtgccctgccacagagagatgaggtatccttgaaatcggctgagctcaagtgcaaccactgaccccactccactcctgaagacttccaaggagatagtgcagtggccaagggatgagctgaagtagttctgcttgtataggaaggcccctgggcagtgttttgtctggaaacttccccttaatctggcagaatttggaacaaatgtttggctgaaaccatatactatcaaattaatagaacaattgtaggatagagaacaataagtcagaaaacaaaaatgcaagcacacagctcataaagtctactttatggaagtaagtagaatgctgaaaaagtacacattgtgctctgtggaataaccactcctaccccgacccggcctgcgccagcctgatccctcatgcacataattaaaacaaaaggaagaggagaagaaaatcatttgagcaaataatgtccaagcctctgctgtggtcagtggtaaacccagatacccagcagataacatcatggttgtaatgaggtaacagtgaacagccaggagaggcactggcttttgataacagccatttttgttaagtacaaaaaactttgctgactggccccgccctaaatcattgccttgtaagaaaggagccctgtcagaacaaaaacaatcatgctgtactagatgactctggaatacacaacaatctcctttcctggatatgtcagtgcaacttaagagccccaactgtggttaagtatactttcttttactctaaaagatagagctccttaattgatttcgccttcactaatgaatggtccctcttgctccaggaatgttgttccttttaaccaaagcacaattttgggtggtactttaatgaaatgatgaggtaagtggagacttgcagttagcaaaccagataatccaaataaattctggtagtcagataccgaagccagatcaacgaaatgcctggatccccaattgatctaaacaggcctccaggatagttcactcctgatggtaacaataattaacagtggaaaatggaagagataatttgggaatcatgcagagtttatcatctcagattgggagcaagtgagaagccaatgaaaggggaaaaaaaaataagagaaaatactatgagtaggaaaacagtttttatgatttggcatctaagaaaaacaaggtagttgggagtaatgcttactgttttctaagatttatctattcttagttattcctaagcaacattttggatcaatagttctcaaacagccaatttaaggacccatgaaggctagtcattggaggaggtctttaaatatcaatagctggattcccaggtctagctctagagcaagtcaagtatataaccagggaaacagtactccccaggtttagtagataaacactcgactttcaaaaacatttggataggaagagataagcaataggaagccattgtaggtgtttaatgaatcagaggaaagtgatttaaaagggctttaaggaaattatctggcaatagaggcacagtggcctggagtagttgtttccaaatttagtctataggcatatcaccaagggaactatcttgttaaaattcagattctcattcaggaggtctgctgcattactaaacagcccccaggtgaggccaatgctcctggtcctccagccatacttcgaaaagttaggccctgggaggacagctggggttgaatggaattctgatactcagaggctattgatacagccaattactctgctggaatcaagtcaccactttttcccagagccaaattccagcttcaatctagactgttacctggtcataagagaaagagccttttgcctgaaatcagtagccccaggtctgtgctgtggaaaagtcagctagtttgaggaaattactttcctcctgagcctctgtggccacataggtaaaatgagagacctgggttatatcgtctctaaactacattccatgatcctaaatcctctaactccaacacatagaatggggtcagaccaagttacatggccttttctaactctgcaggttattaggtattgtattctaaagagtcagcatgagtattttacatcctttggtatgtttgttgtaaaacatatgtgtccttcctatgtatcagttgtgtacattactatttagacatgtaataacaccctaaaaaagcgaaatacatttgtatgtggggagttgataaaagaaaatactattgtatacagaccgaaaaacattatcctttatttttaaaatattgtaagcactggcataaacaaggcatagcttacagatgtgtgtaaatctgcacaaattgtgcacatttactatttggagggggaaatgtattttaaaaattgtttggactatatgtcctttttctttttagcagagtggggagtcaaaagaattgaattacagggtagaatataaaatatctcctttaaggaaataaatgtgtaataggaactatctatccaattctctcaggcatgggaagcccttggggctcatgtaaattgtatataagtatgtcttcagtgtcactccagatgtttttgcagggaaataatccctctccccatatattggcatcaacaccctgcatgtaacctccatactcaaacttgccccaagccaagcagcatcctgaagagtgattccaggtgagattggggagctctaggcccttcctgccaccctccttccatacctatgttactaaatatacttctagacttggaagagagaatagagcctgtaagtattaacacaggacaaggctcagaagcaaagttaacccaccaggcagagaggtcaggccaggacaattttaaatggtaattaagtctctccacacttatctttagagattgtccttgggctctggctgagcagggccttccctgctgtgtgtggggtctgcttgcagttttgactctgcccctctggggaacccaagctgcacatttttttctgcagcctctgactatgaggttatattaataaaaaggccattcctgcctttagcagttgccgaccaagtctgctttatatggcaacagagccaggaagaatccagggcttcagtacagggacttttccactagtatgtactgttttgtttcatttcctattccatcttccaaggaaaaaatgaagtcctgctgcagaagacccagtcactaggcccacctgacacctagtacatatctgacaaaaggaatgctgccatgtggtacaagtggccttccccaacaatccccagccaggttcctgaaacctctcttttccaagtccgacccaccttctttgttcacacctccccactctaagaagaaagctgcatatcggaagccacaactaagagtgaacaaaaaggggcaagtagtggcaatatgctcaggggttccaaagtagaatcctgccaatgcatatagtgcttaaaaccataaaagcagcaaaggtgtcagtgaaaacgatgtagaaccaatgacagtgattatggtgccaacacatataagatgacatatgtaggccgggcacggtgactcatacctgtaatcccagcactttgggaagccaaggtggatggaccacctgaggtcaggagttcgagaccagcctggccaacatggtgaaaccccgtctctactaaaaatacaaaaatcagccaggtgtggtggcatgctcctgtaatcccagctactcgggaggctgaggcaggagaataagcttgaacccaggaggtggaagttgcaatgagctgagattgtgccactgcactccagcctgggcaacagagcgagacgccgtctcaaaaataaaataaaataaaataaaataaaataacatgacatatataaagagcaaagcacaagcctagacatcctatggctaaaactgttggttgtctccctatatccattctccttttctttagtaatagaagtctgaatttaaactgggcacatggctacccagagtaaagactacatttcctagcctccgttgcagctagatatgcctggtgactaggttctgctttctgtggagtctccttagaggtgggggtggggggcttgccctccttcatgccttccttcttgctgtgggtcagaatgcagctatcttggaccataaagtaagagtcatggcttgaagttggtgaaaacacatgatagaatgagcccaagtacctgataatgaagaagctatccaccatattgatgctggcttgtctatatttatgtgggagaagtcaacttctctgttgtttaaacccatgttaatttggattttctgatacacacagctcaattgtattttaatacaatctccttcctcaaggcctcatacatcaatagtatccccaaattaattgcatcattatttcattagagaatagcatccaaaataataacttagaagcttaaaacaacctattcattatagattcactccatgtattctctaattgcaattaaaacaagattataatataatgcatggtactgtattcctacttttcagtaaaaaatgaaaatgtagacattttctcttggtaaaagtcttactgtcaaagcagatgagtaactttttctctaacatttgttccaacagcttaaattgtatactcttgataaccagataataggtattgagtcaaatttcttccccttggttttctctccaacttcttacatggataggaggaataattttgtaaggtcagttcatgttaatgggtaagaaaaagtcataactactaagagcattaatatggatccatgttatttatttatttatttttgtttttatttatttatttttttttgaggtggagtctcactctgtcgcccaggctggagtgcagtggcccaatattggctcactgcaagctccacctcccgggttcatgccattctcccacttcagcctcccaagtagtgggactacaggtgcccgccaccacaccagctaattttgtttttgcattttcagtagagacagggtttcactgtgttagccaggatggtctcgatctcctaagcttgtgatccacctacctcagcctcccaaagtgctgggattacaggcgtgagccaccatgcctggcctgcatccatgttatttaaccctcagaatatccttaatttgcagattcagacacagagggttcaacaagcaacatgacttgcccaacataatagagctattaactagggatcttggatccagggtttctgatgcatacgatatcataattgcctatttacttgtacatcttcccagtagaccatagctccaaattcattattgcgttcccagtacctaccacaaggcctaccataccaaacatcctcaataaatgtacattaaatgaattaccaactctaaaataccactctgctattgctcccttgctctgcaagtgttctacaaaccaatgcccttaatatattccaggtcactcccaggccatatggcttgtcaagagaatgtggtcaatgatgagacagagggggagcaggactagtgaacacacccatatgacacacttgttctccacactctcctgggcctgggcgggcccaccacgtagggcatttggatgtgtgcctcatggcctgggagacaacttgcacttagtgtacttttccaggaaaagaaaaagacaaccatggtctaacacgttagaaacactgctgcctggtgttctgacatcatagcatccacccagtttgattcctggaggcaagcccacttgcaaagcatgggccagggatggtatgggggaaaggacaagggaagaggggtttggtgactgaaaagtgaagtatgtggctaagacaagcagtatgagcagacactgtaaagagtggaggggggcttctcatactggtatgtctccagatccattgaagttttctgtgttttgggctcagaggcaaagataacagagctcatcacttcttataagaccagtattctttgaaactttgatctgagctggtcctgctccaaattctcccaaaaaactatgaggatggggccaatctagccgtctgcctcttcccttactcctcctccagcaagggtgccagaagaagaatgatttgttttttctctgtggctccttacagtcaggaagtgagaatcagcttgagtgagctatggtcaccaatcacaatgaagctacagtggaattatcacctggcatgaagtgaaataacatcattataaaatgttgtcttccagttggaaagccagaagttaagcctgtgctggcattcactttctaataaatgggctggcttaaacattgattttctctccttgacttataaaaatgactaaaaatgtaagacagaattcaataaatgttttaaagattgccattaaatacaaatactttaacaatttaacaaaaccaaggggatccaaccttaaaattccaccttccttgtcctcacttctacccccaagtcaggatgaaagttcaaggtttcaaacaatagcacaattgcctcttacctggtacatagtagacactcaagaaaactgttgaaaaggaattgtatgtgccttattagtcggtacttcacaggatttttagagttggcttgacttggattagattcaagaatagtgtattagccctccaggggaatattcacaggcaaacagctacaaggatatactacattttcctttgttaaaacttgtatctgcattcaaatattggccttggcatttcctaagggctggctgctttgaatgttactatatcaaaccatctgcactgggaagcaaaattctgttaagaaatagaatcactggtagtaaagagattaccacattcctgaccactgtaacatcttatattttgagaatccccataagaaaaggtcatttgaaaatagcaaccctttgtcaaagtggagatgatgaatacttttgtacaatttatgactatggtcagtatgaaaattcatttttgtttatatgcgttttcagtggcttccctgcactgactcactaaaattaaagcttaaaaaaaaaaactaaaaaaacttgaaaatagatgatgacaagaggcttccagttagacgggattttggggaggcaaagtgccttctattgttcactgcccaaaactagaaaatcctggagggaagcaaatggtccagtggaggcagctctttggccgaggagagaagttcaagtgaaggtcctagagagaaagtgcaaagtgaacaatcataagggaagttgacttggcataagaagactagaaagtgccagtgtcattcagatttttagttgggggagaagggagactattttatactccctcaagaaaagcaaagggacttgattccatcttaaggtgacaaatcaggacgccaatgctggatgcacttgaaggtggagagctaggcagattgaggcagcaggaagcagggtgggagccagtgtgcaccaagtgggtgaggggaacatgtgagtcagttccagctgtcctcagaccctcctgcccagcctcagggtaatccaggggcacagagactctgagccctggcccacccgtggtccctcggattttgacactccctcacccccagtgtcatgcactctgacctactgcagggagggttggcaaggtgtgggcaatgtgtgtcaagatgtgtgtggaaggtgtgcagtagacacacagaatccctaaaatgtgatgaaaataaaagaatgacatcggcacggacaaggaaggcaggcaagtgttacaaatagttagaaactgtaaaatgaggtgcgacatttccggaaatcagtcagatctagtattagataatactaattaacaacaactggccgtgaaagaaggcacccgcactttttctccattgctctccccaccatcttatgccgactccttgcggggaggggtacagccttgttcccctaggtatcctaagctcgtttccaagtacttgaaggtgcctttggaaagtctgatgaatgagaaataagtgagcgagtgaatgaatgaataagctgcctaaagcagatgcgtttatgcgtgcattctctcgagtgaaggaagaaggaagaggtagggacggaggaggagagagagcacgcgcgggaaagataaatcgcgcccgcccgcgatggaccccaatgtcaatctgatctaggttagtggttctcaaactttaccatgcatcagaatcacctggagggcttgctcaaacacagattgccaggccccactcccagtttctgacttagtaggtgaggccagagagtttgcatttctaacaagttccagatgatgcgaatgctgttggaccacactttaagaaccgctgctctagagggtaactcggacctatcccagcgtcccagggaaacgaaatctgcagtgagaaatggaacgtccaaggcaatcttcagccggccttttaaaaacaagtctggagacgggagggtagcgctgctcagctccagccaactcactgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactgcgatgtcatcggtaaacctggtcttccttgtcacggacactgaagcgcttggttcgaaaagcaccatgaattcgaagcagccttggacgcgggatcatgggcgttagcctggctctctccgacgaggcaaactgcaggagatccccttccctggagtcaccggaaggcgaaagcacgctctgtgcccgcgcgccgccccgggagcccgctcctaccccctcggcgtgcggcgcgggcctggagaccgcggagcccgagccgtatccagcttgtgcaggagccggtgcgcccttccgcccgctcctcccccgggaccatcctcacgctccagggtcgcggaggcatcttgcgactagcgaggggctgacggtggcctgggtggccttgcgccggctctgggctccgccgctgcggcagccgagggcctcagctgggaaatccaaacccgggctggacctgggctcaaggaggtttctgtccccaggctagaccaccacggccacggccacgcaacttgccctgagaccccgtgctcggccttcccactgagctccccttccctgtgactcagtgcctcgcaggctggtggccggaagggtgcctgcggctggctggcccggcccgattccgggtggcggggttcctgcagtgaggaacgaccctcagctcccgcagacgcgggaaggcccccgcgccatccgtgggagtggggcagcctgtctgcacgcggtcccctgggaaacccctctgcatctcccgcccggacaaggtccccggccttggaatctgcgccgccccgcacgcgaccgcctgcgaactccctgcgctggggtcagaactggtatctttctcctcctctggggaagtcagggcagcccggagtggcgtcgtgggtccgaaaaatccgtctcagaaacccaccaggagaaaaggctctggggtgggggacaccatgtggggctcccacaaaggacccgacggtgggtgtggagaagcttattggccctgagaataggcccaggccctctccacaggacccctaccgcacacgcgactctttctctgcagcaaaggggctcgggcccaggtacagggagccgctgggccggcggggcagctgttggccaagccctcacgcagcggagcccaccaccggtgtggccgccccctcagcccgcgccacgcagagctcggccggtgcctccagggggcgctgcggcccttcccgccggctgcggactgcagcccgcggctgcgctttcccacctcagccctgctgagagcacgggcgctgacgcgctgttttaaaagataaaattcttagccttttgcccttgtctccgcaccctcgactcggcctagtacacgcaatcctcctctgggttccccaggcgtccttgctactccagggccagggtgcacgcaccctgagcagagccaagctccctactcctccaggctctggcgaaaaacggccaacagtgcgggaagttcaaatgcaaaaggtccccgccccgcagaggcagtggaaggctgaggagaagggaggcgagtccccggaggtagtggctgggatccctggaaaaagataaggttttcacattgtattctttaaagattaaaagtttcgaggatccgagtccgagtgggagaggcgcgcggtccgagtgggagaggctgagagtcaactccagggaagtctgtgtctgacacctgctcgctgcttagctggcagagcctcctgggtgggccggggggcaggggcctgcgctgcgcgccccctcctcctccacctcctcctccgcgtttcctgtccctggccttcatcccggcctcccggggcgtaaacttgcagcggttggggttcaggcagccgctgctcgcgcgcccctcgtcagttagccatttccctgagagcgtccttggtgtcgcaagtccagagccgcgaggacagcagatgaccgggtcagcggaaatttcagagccagccagcagctcaggtccccggggccgcggcaggaatggaacggctccgcggagacagcctcgggggcacagccgggccactgcagactccgggacttccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggccgggccacgcggcatcccccaaagctggagctcgccgactcttccctaccttttcaagagaccgtagtcgtgcccagaacgccggcgtggcccagactccattttggaacttcgcaggctggcgtggacgaagtaaacacatttatggaaaaaccccggggttaggaggtttgcggaaagagggagcagctcgtggggttggaaattctgcctacccctcgggaaaaccaaacggttctgcac

SEQ ID NO: 254 - DNA, 275813 bp, Homo sapiens
cgagggtgtttcggggcgtccgaagcgggcgtgctccagcctgctcagcagcgagtggttggaaattagcaaagtgagagggtgcgtggcctgagggactcggggaggctgagggctttttttctcaacactgtgaagctcagggaaaggagtagaactgggaaccaagtaaagtaaaatcgtggcaagtgggcatagacctgaaatctccttcgtgagggaacccagaacgtgcagctcaatgtatgtttggaacgaacaggtgaaaggaagcaggaggaggagggagttctagcgaagacttcggagggaagcaacccatcccctgccacaagaaagcaccgccactccagtgggaacggacacgcgtgcacacagccacgagtgaggtttgaaagaggccccaccctccattacacctgtgctccaccgtggcccccagccaagtttaatctcccattcagcacttacttctggaagcttctttccctttccttcccaccactcattggcctttcaccccctagttttttgtctgtgtgtgggactgtcttcccccactccccttgactgaagttccttgagagcagcagccctctttttatcagggaagagatttgaagctcaggacattcttatccaagtaggtgctagccacctgggtagtcaagacagggccctgcacagttaatgtgaatcttgtcataatgccagggttattgttttgcaaggagccggtcatagaacactagattgcattgtcactgggaaataagctcattctattagcttgtttctcagctagcttatgtagaaatttgccacagttgttactgctgggcacctgccctggatctgatcatcaattatatcatctcttccatctgatggactgcacctcaccccttgctttttcagagctggcgaagctgggccaaggaaagcgatagtgccagctgagtggaatgtgcaggaagggaccgaggaggggcactatgtactggagaaaagagatggggtctccaggacaggggtaaggacactagactgagggcacaaaggaaggaaaccacaaggaagtagagtagggaagtggggagcatgctgaggagagaggtcaagagatggtgaccgctctctgcatgccccaaggagatggtgatgacactcccaagtccatgtgggactccctccttatgcgggcctcagtctgtcatcttccttggagcaggaccaaagtaaataagataaagtcacaatttctcatccttcttcactcaacttttctttgaggtgagttggcatttttgtaaaagaatgcattctctgccagatgcggtggctcacccctgcaatcccagggttctgggaggccaaagtgggaggcttgattgaggccaggggttcgaaacctaggcaacatagcaagacctccatctctgtaaaagaaattagccaggcatggtggtgcatacttgtagtcctagctacttcggaggctgaggcgagagaatcgtttgcacttaggcattggagattacagtgagttaagcgttctcctgtactgccatggtaggtgggtgttgctagccacatgaggatatgtgagccggtcaccagggactgcggctgactccccgagcacaaggacagtaagaataaacctccgattattcccctgcccccaaccccaacttcaattaaagagatatacccttatgtgactgacaaaaaagagccctgctctcccagagtcacatccccatacgccaaaacactcttacatataattattggtgcttcataaatggctgataaaaaaacttttctatcagggaatacaccctaccttattcacagcctcttatagagagctggcctgcccacagtctctgtaaggggcagttgtctcttctgagtgaccagtttccctgacctcccctcaagccatgactgaccaaggaagtcaatgtcaccactgagaagcaaggcgtagcctcagactctgagtttctaactctttccactttcctaagatggggttatgcctcatttctgagagatttccaaccctctgccatatattcctctttttgtgaggtcacttggggaggtgtctgcttcttagcaccagaagagctctctcaggacccagttgctgacccagttgctgcaaatgctgaaagtaggaaatggaggtcaagtgtaggccataaagattttcccactcctcctcttgaatcaggcatggccttgtgaattactttggcccatagaatgcggcaaagtgatactgtacaagttctagccttggtcttaagcctgccagcttttgctttcactcccttggagccctgagctagtatagaaagagatccagctgcaaggactggttacacaatttgcagggattagtgtaaaaggaaatgcaggtttccttgttttaaaattattccgaattttaaggcggtgacaacagagccctataccaagcagaggcttgatccgagctggtgcaggcatgacagccaggcttcctgatacatgagtgatgctatcttggatttctggccccaattcagcctcctaatggtcagcatgagagcatgaactaccctaggtgagaccagtagaagaacccagctcagattacaaaactatgagcaaacaaacggttgttattcaagtaaagctcactaaagctcttcatgacaaacgggtatagtcatgggggccgctaaggcctgggttgagattttatatagcaataggtaactgaagcatgaagaataagagtttgcagtgagtggtcacccaccatattccaggccctgtgttggtgcattgcatgtgccagctcacctgatcctcacaacacctttcataattcctttctacaggagagaatacagcagttccaaggacaagggattcgtaccactgctcctcactcagtaaatagcagagacagaatttgaacgtgagtctgactgattccaaaacccatgtaatatccctgcattgaaacagaggaaaatccaaggaaagtgcacacagcttggagactattggataggggtctgattcagtctttcctaaatttcctcataaatttgcagttgaagtatcaggcagagaaatgataaccaggtgaaagacccctaatgggacatcatgacatcacagctctgtgatcatcaaccataatccctagagggtcacctagagttatcctacaatgaggcttacttgggttttctgataggtataatactgagaaaatttgctatggttagctatgggtattcaccacttattttagtgtatatcatcccccaacaaaccacaggcacctgtgatcatctgggtatgtgttcaggaactatcttgcacccagaaagaacaagaattttttttttttttttgagacagagtctctctctgtcaccagggtggaatgcagtggcacaatctcagctcactgcaacctctgcctccatggttcaagtgattctcctgcctcagcctcctgagtagctgggactgcaggcatgtgccaccacacctagctaatttttgtatttttagtagagacagggtttcaccatgttggccaggatggtctcgatctcttgaccttgtgatctgcccacctcggcctcccaaagttctgggattataggtgtgagccagtgtgccagccaagaattaatttcaacattagactcagccagagttaatgaagaagctttccccacatgatggctcctcacaagaaatactatctatttataatattcattggctttacttgtctttaccaagccttcctgagtgtcatcagtgggtgagtgagtgtatggataggtacctgcctatctgtctgcccatggtgatgaacacatcactgtaggtcagcaatgacattgagtctaaatgctgttggccataaggaaaatagtgacattccctggctcagaggaaatgctggtaggaaagccatatggactagtatttataagtacaagctcaggggtcaaagatgctgaagttcaatgccttgtcctgtctcttactaattagtgatattggacatattgattaattgcataagtatgtttctcacttatctataaaatgagatgtatgagggctaaatgaaatgatgcatgtgaaaaactgaacaaggtgccaggcctaggacaagggctcaataaatgtcagcgattattttatttgatgaacaaaagaaggcaaatgttctttctttgatgccccctatcttttccctgtgtcgtttctctaaaaaagtatatgtgtgtaatttctatgccttccctccactctcccattatctaccacttcatcatcctctcactacccatggccactttccctcattatcttttctatatttcttccctcctcccctgaaatggggttgagcagggggagatcagaggatgagaaaaggcagggagacattggtggcagggtgacaatggagcaccacaagctgtctaggccatctagactttccctgaggacacttcagtatctctgagaataccattttctcaggactcctcacactgggagaaaccttagcaatcatctgatggtgtacttgttacagtagataggcagacatgtgcagtgcaggagagggccccccaccctgaccaggaatgtcaggtgaccatcaggtgatggtcacatggttgttacaccgtctctctcaaataataactggttgcagccagcaccagggaaaggcagtctccaaatagataggaaaaacctgaaagtgacaatcagcagcttcacaataagatctcaggaattgggcaggtgggctcaagcatgtgcactaagaggcaaagtggcggagtttaattggtaaatgaccttcctgtaggaatgctacgctggtaagggaagaaagcctcaagaaagcatctgtaccattccagcaaatacactgtgcatgctcccctcccaaatgctagcaggccactgcacatatggacagcccaccccaagggaagaattgggagaagtaacccaagaccccgaaagtatgccaacctgtaagaccgcaagtcaaaggtcaaactgtgcacttgatctcacaaggtgcccactcggccctcttccaaatatactctacttcctttcattcctgctctgaagctttttaataaattttcactcctgcttgaggactaagctctgatcttttcttatcttccaaattcctatctagggggtctggggagttatgccctacaaaccaaaaattctcatcagatgggttttatttaaccctatatattgtgactttttagtctgactctggcataatattacatgacaaaatcaaaatattttatcccataacatgtctctttggcatattttgaaatggccctgcaaagccatcctttgtaggggaaaatttgcatctgtaaagaatctctgttaacatagctagatatttttcttccaggcgctcccatctgaagagattaagagtctagcacctttttaaaattatttatttatttatttatttttgaaacagagtctcactctgttgcccaggctggagtgtagcgtcgccatctcagctcactgcaacctctgcctcctgggttcaagccattctcctacctcagcctcccgagtagctgggattacaggtgcctgccaccacacccggctaatttttgtatttttaacagagacaagttttcgccacattgaccaagctagtcttgaactcctggcctcactgtgatccacctgcttcagcactccagcctgggcaacaagagcaaaactccatctcaaaaaaaaaaaaaaaagttagaaaactaaactacaaggtccttaaatgcctgctccacagtattagccaaacatgaacaagatcccaggtgttaggccgggcgtggtggctcacgcctgtaatcccagcactttgggaggccgaggcgggtggatcacctgaggtcagcagttcaagaccagcctggtcaacatagtgaaaccctgtctctactaaaaatacaaacattagccgagcatggtggggtatgcctgtaatcccagctactcgcgaggctgaggcaagagaatcgcttgaacccgggaggcagaggttgcagtgggctgagatcacgccactgcactccagcctgggcaatggaacaaaagactccatctcaaaaacaaaaaaaaaatcccaggtgttctggattcccatccaaaagaaaaggggaaaccaaaccccctgcttccatctcacccaggatctcctgtcttcccaaagcactttaccgtctttcctgcccagctgttgaaatatcaaactgtaccaagattttggccatgatggactctgttctctgcacactaagagatttatcttcctgatcatcagtagaaatattaataaataatattggttgccatttattgagcagtgtgttaaacatccatattatttaatggatgtttttctagctgtgttttaaagttttaaagttgcagcatttgaatgaatgaatgacttctgagccaaagtgagaaaaagcaaacaagacacaaatgagttttctaaactatgtgtctccccgaaattagctctgctactttgcacaagtctcctttcctaagatcccgcttctcatctgttcaatggggatatgaacatctacaagtttatggtaaagtttaaaagcacatttgtctgatactaagagccaataaacaatcgttactttcattaccccagttggcaatttgagcagggcatgacagggagtttgggtgacaggcgataaagtaacggacattatggaaagtctgaaagaatgtaataaggataatatattttagatgtatttttctcttttatattttgtgaatgacttttcccctggttagcctaaggtaattcttatgactcagggaggtttgagattgttacagcaggaatgcaaacagaaaaaaaaaaaaaaaagatctagcttttgatttccaaatttgagttcctagaataactgtctttaaaattcagaggttggagataaagaaaaggattttctagattcctatcacttccattaaaataccaagggtcagaacaatgaacctgaattctaaagctattggtagagagaaatgacctttgatgtaagaggtgtccctactgcacagaaaagatggggtgtttttcctttccaaaccaagggaatgtcaggggaagaaaagatagagattaaaggggaaaagtgagttttatgtatcttggcttctccattcagggctgatatcacaagtagtagataaattgaaagaaaggaatcccaaaagaagaaaaagactgtgttctgctcctcacttaaaactcagcaaaagggacccccaccaagtggcccatgccaatatgtaacacagaaaggaaaaccaacagcatgggcctcttggcttggaggaagccaaagtgcacatttcttcagtcatactacatctgggttcatctagccacctctgccatgctgcccaagttcaaccccaatgagatcagtcatatacctgccaggtgccctggtggaaaactgggtaccatgtctgccctagcccttaagatcaaccctctggacctgtctccaaaataagttggtgatgacattcccaaggccacaggtcaccagaagagtcaaaggattacaatgaaactgaccattcagaacagacaggctcagactgaggtggtactttctgcctctgccgtgagcatcaaagccctcaaggaaccagagacagaaagaagcaaaacaatcaagcacagtggaaatgccatttttcatgacactgtcaagattgcatgacagatgcagcaccaatccttagtcacagaactctctgggacccgtaaagagatcttggagactgcccagtctgtgagctccaatgttgatgggcgccagcctcctgacatcatagatgacatcaaatcaacagtggtgcaagtaaatatccagctagctatgaactacgaaggaaaaaatttcaataaaggatcatttgacaactaaaaataaaaacacagcatggttatgacatagggtctgcatgagtgcctttgtgcctccttgaaaaagccagtttccccatgcacagatgtcagtagtacaagtcaaccaggtatccagagacattgctaaaagatgtcaataccaaatctaatcacagcataaggaccagtgtatacaaatctaaagcccactttctcctgctcactcctaaagctcactttctcacaacactgccaccccaatataccaagaaaccatctagaaaggagggcagacaatagccacttacctttaaaaacaaaaccaaactctttacaccaaaacttcttccatatccaaagagtctaaaatacagttagtgatgaatgtggatgtggagccaatgagtaagatttgatcagttacagaaaacaagtgaagccacatttactttgcacaaccaaatgtagtttgctaagtttttgaccccattatatgaagaagacaaatcatccataactctaccacgctaaacatccattacttttttttttttttttttgagagtttcgctttgtggtccagcctggggcgcagtggtgcaatcttggctcactgcaaccttcgcctcctgggtttcagcaattctcatgttcagcctcctgagtagctgggattacagccacccatagatttttaaaatacttctctttcacttgtcttgcataggcatgattattgcaaataactgcaatgcatatcagtcacaattttatatcgtgctctttgtaaaattcatcaaaattccttttccatgctgctgtgtgttcttcctggttaccaatgttaacagacgcataagctattagtcaaaactcttgtcattgcaagtatcataaagccaattccaactcaactgaagaaaatgggtatttaatggaagaacactggagttgctcattgacctacaagaaccacgcagccctgagggcctaaatgcaggggacgggggcttgaagtcaccagagttcttcactgctcattcttcctacagacatctccacataaatgtattaggcatttggccatgttaggtcattttcattagccacattttccaaatggggacggagggactaagggagttagatgtgactcactgcaggtgattcagctgctaaatggcattgatttgaaaaccagcatcttgattcagattggtggatccatacaaattgcaagggacaaaacttttcaaaaatatgtaagaatagtcacataggataagaatatatttgatttttgtgaggactacagctgaaggagaagagaaacatgcaaatggggttccatttcccacaccagggcagcttctgtcatctcagaatgcccacctggcatcttcctgacccttggctcacccacaaggaagttcatggcaatattgttttcagaagccaatattctcctgtctctacttgcaagaaaataactgagcccccccagtaagtataattggtgcgaacagtgatttattatatgcccagttctccagatggcctttcatatggaaatgatttttcctgaaaacagaaaaatatgggttttttcccttctcagcaggttataacaggtttacaatccactgcatcaaaactagaatcaaaaactttaacggagttcccttaaaacagaaacacaaaaaacacgttccatctggtaaataattgccggagttgcattcctgtgcattcaggcacaagctaactgctgtacagcataaagctgtgaaaatgtctaggcttaatggggaaacatgagataagatctacttaggtctatcatatactcaaattgcaaccttctgggatgctggttcatgccagactcaaatcacccataatctgatgggctagacagatgtgtaagattattccaggatatctgaaaatctcacatgtgagtacaaaaggctaggtggacacgtgcagcccttattctatgtgaatgaaggggaatgtttaccaagaaggtcattttcagatgaccatagttgaagagcaaagtcaaatgtggttctaagtgacatgtcctctgcctaaataacagatgagaaagtatatctaaaaaggcttatatcatcctgtgatggaatacttaagaatggggaaagcatttagcagtaaaaagtaagttaccaaaaggatttaatgcagttagtatgtagcaggttaatttcagtagatgactctaagttatgattttcatccagaaagaattattttcgtcagctttccaccagtggaacatacttcctcctaagctccctgcctctgaaagcataggcaggggagccgtgtattagagacgttgtggggaagatctccacatttggaaagctgaagatctgcagattaggggtgacactcaaattccttaaggggttgggcagataaattgtgtaaaatggtaaggcattagaaagtggaccagactgcagaggactggagaggcacagcccacctaaagacattcaaatttggtacagatgcttcttggcttaccatggggctactgtgtcccaataaacccacctaagtgaaaaaatgcatttagtacacctaacctaccaaacatcacagcctagcctagcctaccttacacatgctcagaacacttacatgagcctacaattgggctacatcatctgacacaatgcctgttttataataaagtgtagaatatctcatgtaatttattgaatactggactggaagtgaaaaacagaatgattacacggtacttgaagtatagtttctgctgaatgtgtatggctttcacgctatcataaagttgagtaattataagtcaaaccattgtaagttggagactatctgtatttaaaaacaaaacaaaacaaaaaaaaacccaaaaacaaaaatagactggtctggccaaatagaccactttggaaggacgtggcctatggatcaagaggatatttgccgctcctggactagcaaatccttaagccttctttgcctgctgagttctgtgatgtgtataaaaataatgcacttttatctaataagagccaaacacattaacctctgtggtaggagaaagtggagttgaacagaagtattgaatgtggtctccatcctcagaaaactcaaaactactttaaaataagatatgtccatacaaaggcagccaacaacggcgggcaaaaagctcatgacggctcattaggaagcatttctaactttgatctagatgggttcagaaagagccacagaataggcaaggcttgagtggggcttaaaagaacaaataggtctgacatagtggctcacacctcgatctctactcgggagcatcgtttgagcccaggaggttgaggctgcagtgagctatgatcacaccactgcactccagcctgggtgacaaagcaagaccctgtctctaaaaaaaaaaaataaaggatgaacattcagctaaatggagagtgtataggaggatagagttgttagatagtaataggacaaacaagaagcccaggggcgaggaggagggtcatgcttggatccttctgaacctctcaacttcttcctcagatcctaaaattggcttcctgtcacctattctgttctgagcctcctcctcagcctctggacctctcccttcttatgaactaaaaggtttcttagggtcacagttcccacagctgggccctaccacctgcagtcagagcccttagcgctccccttgtattcgcctggtacatatcccagcctcaccgcctgtttgcagacttgtcaacacagtcattgggctacctcttggacaatcacccttgatgctgaatcacccaagcaaattaattgaattttcaagtgacgagtgtaatcctaagcacttaatggtcagaagtgagggggcacaaactattttcggattcgaatttgtctttattatgtggtgtacacctttgttggggtactaagtgccatcagtaaatagctagcagcaattgatggcttacaacgtgccagaatctgtgctgagcccagggcatgcatgccctcccttgccaactcaacctccaaaatggggcacaatattttcccctctctcgagatgggtaaactgaggctcaggggttaaataacacatgcaaagtcatacaactaacgggcatggattcaaacccaagtcttctgtctccaaaaactgactacaatcacatgtggttgacggttatcactgcatgtgattgtaccattcatatggatgtgtaaatgcaccctcaatggcacagaatcacctgctggcctatcattggatgtaagcagctgccatctgccaaacaatacacgcatttgatgtatgaatttgtatcgctgactcttcagacgcagtagtcctcccttatccaaggtccaaatatatgaaacagaaaattccagaaataattcataaatttcaagttgtccgtgttctgagtagcatgatgaaatcttagccatcctgctctgcctgccggggtgtgaatcatctttttgtccagagtattcacactatagaggctccctgcctgttaatcacttagtagatctgttggttatcaggtcaactgtcgcagcatcacagtgcttgcgtccaagtaacccttattttacttaataatggcccaaagagtaatgaggtcagaatattgttttattatattataagttgttatcctttattgtaccaaatttataagtgaaactttatcatagatatgtatgtataggaaaaaaaaacatagtatatagagggttcagtacaatccatggttttgggcatcctctggggtcttggaacataccccctgtggattagaggggagtatggtaatgcagcattctcaccacatttgaatcatctgggggcactaataaaaaagcactgatgccttagcttcaatccccagagatttagatttaactggttttggtttgaatcaaacattggaatgctagaggagcttcccagatgatcctaatgtgtagagaacataggcagtgaatagttgctaggagtgagggcttggggtctgatttctgttaccataggccagctatgacacacctatgagtcttagttttctcatctataaaatgggaactacagaactgtgtactttatagcactgatgcaagggttaagttagatggaaacaatggaatgcaaaaatggtaaggttcctggtgccatccctaaaagcctcattgatccataatgaaatggaagtttatagtctcttaggcaaacacccattggttatatgagaaaatgtattctcctggctttctactcagactttctgacacctcagggtagaggagagggctggacaggcactcttgacaacctgctagctctttcagagatgtaaatgcaaaggcctttcagagctagacagctgacatacagatgtgaagtaactgggataagctatcagggctatttaaaaaaagggagacagagcgagcaggtatgatttgaagagaagataccccataaaagggcttaaagttcattaaaaataataattactaccaacaaagtgctagccaaacaaatccgtctgtccccacatgcagcaggtagggtgccagtttgcaccacgagtagttcacaccttcagctttagagattcaggtcagtggctcctccctgcttctgcacttgtgagctgagggcagctacttccccttccattggaagccagggggtttcaaggatatgtcggtgactatgaaggggcttgcagatgacagccagatttgttaaaggcagacaagcagttatttgtttaaaagttcccaccttacagagggcccatctctgtttcaggctagctgtgtggcctcacctaacttctctgaaccattgctcacatgtaaaacacggaaaaaattatccacttctcagggatgttgtgaagattaaaagaacaagagatgtagagtgctcagcacagtgcctctgctctgggaagcactccagatgtgtctgcttttgttgtgattttgccattcttcaacaaagttaaaagagcctcaagcactgtaagcattgtttctccccttgccctggtaaattatttaaatgacatggttcattctaatacattacctcatccctcctttgaagccacagtcaaaagcattgacaaacaagtttgagagagataaggagaggcaagataaaagatataaagtgaccaaaaagaaaaaaggtagataatttgttccttgtctgttctcaaggatcacaggtctggtggcttgctgaatggggtatggagagggaacacggtacacctcccacatctgtggcctgcagtggccccagtgagcactgggcagcacccaggcagagagaaggactttctggatttctctggggatagttactctcagtgtttccaagaataagaatccagcatgggattcatcccaccttcattgcattttgctttgctttgacatctgccatggagaatgcaaaaaaaaaaagttaggcctcataagacataaatgtgtcaatgctttggcctatccaggcccagatttgagttcagagaggccctggaagcctggactagtcctagaccaactttggttcttgggctttaagaaacagcattcattcacctgattttcaactggggaaccaccctccaccctcactgtcagtcactgtgctttggatgaaactgactttatccctgtcttcagggagtgggtgtggtattcaggcctggccaatcagagcatcacattcctctgatccagtgatagatagtgacccattgagaaatgggcatgtgaacccctcagagtcagagtgatacaaggaaactgtttttaagggctttgttaaggtataatttacataccataaaattcacccatttaaagtatacaattcaatgatttttagtaaattttcaaagtaaccacaaaaatctggtttttgaatatttctataatcacaaaaagatctcttgtgccatttgtaggtacaaggaaactttagcagagttattgaggaaaattcacctgttccttttgtctgggtctgtttgcaataatgattacaagagcctggatctacatagaacctgagaataaagcaaaaactgcttagtaaagagataggctgggcacagtggttcacgcctgtaatcccaacactttgagaggccgaggcgggcagatcacttcaggtcaggagttggagaccagcccggccaacatggtggaacctcatctctactaaaaatacaaattagctggatgtggtggcgcatgcctgtaatcccagctactcgggaggctgaggcaggagaatcgcttgaacctgggaggcggaggctgcagtgagccaagatcgtgtcactacactccagcctgggtgacagagtgagaattgtctcaaaaaaaaaaaaaaaaagaaaagaaaaagagagagagagatgtagagaagctgagtccggaggtccctggttgaggctctgatcaagctgaacctgaagtcagagcttcccctagacttcttcagttccatgagctgagaagtttcccgttgtctttagccagtttgacttgtgttttccatctcttgcaatgggatgaatctcgcctgactccaaaaatttttgaccagactctaaagattagaactggaacctttattaattgaatatcagacaggaaagcaaatctccagatttgctgtaatcaaaggattattttacatatgatcatagatgccattttacaaatgaggattcagccctgcaaaagtcaattgcttaaccaggatacataggagaaactggagaagtccgtgtaactctgaatttgattttgtaaccctgaatttgatcctgtctttcctcttgaagtaatcatcatcgtcgtcatgatcatcatcaccattacctcttacaaaatgtttactatgtgtcagacctatgctgagtacgtactgtataaatattaactcatttaatcttcacaactgccttatggggtaggtattattattattctcattttacagatgaggaaactgaagtctgtagaggtcacataacttctccaaggttatatagcctgtgagtagcagaggcaggatttggatgcaggcacactggctacagaggccacactcttaatctgtgcactgtactgccttttataaataaaaattaatctaacataagcttttaatcagtgttccagtggtctttcagctagagatactacctttttctgaacttatatttccgtcattataaaaaaataaaaagcaaaaacctcaaatattttctgtattttaagactcttcaattatataaacaatttttatctgatttcaagtagtcataaacttctgtgcttcttacaactttgttctgctcttctaaacacagtaaaagtaaagtttaatcatggcaaaagtctaatttttatgtcttcttgcagtaaaaaactagatgactgctctgctttattgatatttaatatgatatggtaatgatatttaatgtaatttaatatgaaattttacattttatatcagccaactgacaagaaagtaagacctggaagttatttttatgtagaagaaagatatgctgaattttaggaaattcagccagtggatatatacaagatggttgaggaggggagctgcaggcacggagaacagcttagaaggctgctcctgcaaatacagacagttcccaacttacaatggtttggcttatggtttttcaaatttatgatggtgtgaaagccatacgtgttcagtagaaaccacactgcaagtaccccataaccattctgtttttcactttcagtacagaattcaataaattacatgagaaattcaaactttattataaaataggtttgtgatgatgattctgcccacctgtaggctaaggtaaatgttctgagcgatttaaggtaggctaggctaagctatgatgtttggtaggttagatgtaagtgcattttcaactcacaatgttttccatttacagtgggttcattgggatgtcataacctcatcgtaagttgggtatcagtacctcagatatatttgtttagtatagggagtctgtacaagttacttgggattgacttggctcctggggcaacagaactttgttctaagttctaatgccattgttaaaatcaatgagtcatcaatagggcactagaggtaattgagaagctgccctattgggaggggtagataactagaaaaacagcagcatgaagtgtggattggagtacttaatggtggcacctgggcaaattattctaggcatgtctgcacagacctcaaatgatggaggtgggttagagttcggcttcccaaatcctctgtcagtgatctcttattgcagaaggcagcctggtacccctaagagtctaagacacagcttcagcggccctttccagttttctatttaaaattcttgtagaatttctgcttcactccctaggaaagcctatgtctgccttcgggatatgtgaaaatttgacaagaagtaaacaccttccctgttcaacataggccccaccttcccaagctctcatttctaggtttcttgttctttggtccatattcattctatgaggagatggtcaacatggctacgaactccacatgaactcagtattaactggttaatctactccatgaatccctacaaatacgggagcatgttggggtatggttcttgggtaatgtgtatgcattttgattgaggctgaggtttttgctgcaatcagtggtctagcctcacaatatccagtgtggtgggaatgtgtggctcaaagaggagaggaggatggagcttctggagaaggaaaggctttggagcaagcagggatattagagtctaacaagtaacagcaagtttcttacacttttgtgttcaacactttgttgctcattcatgctggaaaagaagacaagaaacaagccaaaattttcattcatcctcagattgtcttattctaacttggagacaaaatctggatttgaaccttgtttctgccgtttatgagttgtttgaactcgaacacatcaactaatctcaattacctcaactgcaaaggagcagttctgataacatccttcctgtctcattcacagggttactgggggaatgaatcagtcaatgtaatcaaaaatgctgcatacagacagtgtaaactgtgactgtcttgtaagagtcaagtgtcaataatgactgtcactttgatttggggtcaggattcactcttactgctgcctgttatgtacaatctcaagcagtgttgtttattattattctaagaatagcatagcttttgggtctgtattttacaaaccaaatattgtaattttagggataatggaatattaggggcataatggggaaagttgaaaaattatggtcagtggagagatagttaaaaaaaaagtactggaatagaagttaggagacttcacctagtacctcagtgatctggagtcatcatggcaccatgctgggcctcagtttcctcgatctgtaaaatgaggatgcttgatccattgtttcttaactaggaggagttttggaatcacctggaaaatccccaaaggtagaatttttgttttgtttcttgctgtgtttccaaggcctggaaaagtacttggtgtggggaagctactcaataaatacacatatattttatgaatgaataaactttttcaaaattcataggcctggttccactctgaaatcctcgtgcagtttggggtagagcctacatgtgtattttggaaaggcctttctgatcgttttgccaagtgctcctggctaattaataaccaccaagagccactaaactcaacaatctccaaggtcccttcacatgcagttgccacatttagcaaacaaaaatgcagagcatccagccaaatttgaatttcagataaacaatgaatacttttttagtgtaagtataggtcatgcagtatttggttgctgcaacttaaataaacataaccagataagacttctgcttagactgatagtttgggccagagagtggcaccttgaaactggcccagatttgaaaatcagacagagatagtcttggtttgagtctctgccctgatcttagcagattgcttaacttcactgggctccacaactacagtgtctaccctgtagagttggtgaaagtattagagataatagaggtaagatgcccagcacttagcaggcatttaataaagcttagctattattactattttttatctgctccacggggtttgaagaaaaataatagtatcaatgagactgttattggcaatactgtttactcgtaaattggcacttgaaataaccaagattatagttaacagttctaggtagagcttggcaaagttagattgaatgctgaccttgtattaaacaatacctctatgtctgggggaacaaaaccgtactaagtacagatcatccagaataaataaaggaaggaagtacttttatttcattcattatgaaatgtcatttgcttaactgacttttttgacgttaaagataaatatttgttcaggttttatagggtcactctctggggaaataggctattacttggccagcggaaatacttcaatcctgaccaggtttttctgacttctaagttaaaggcatcttcttcttctagagttttagttgtttctagacattttaaatacatctccactggttaaacaaatagacagtcaggcacagcagttcacacctataatcccagtactttgggagcccaaaaaaggtgggaggattgcttgagctcaggagttcaagaccatcctgggcaacaaagtgatacctcatccctactaaaattaaaaagaaaaaaaagccaggcacagtggtgcacacctgttgtcccagctagctgggagctgaggtggaagaattgcttaagcccaggaggttgaagctgcagtgagccatgattgtgctactgcactccagcctgagaacagagcaagaccttgtctcaaactaataataataataataacaataggcaaacatagcagtaaacataaaatgttcatttaaaaaattatctccagaaagatctatttggacaaaatctttagataatttcattatcaaatttaaaaagagatggctggaaaataaattgccaaagtttcaactgagcaactctgatattggcaaaaatacgttaagctccctatgtttacttcattgctcattcaacacatatttattgttgagcacatattatataccagacagtgtggtaagtgccagggactatgagtaaacagaacaaaattcttgctcttgtggagcttatattctgacacaggaaaacaaatataaacataataaatgaattaattagaatatagatggcaataagtgctacgaaaaaagatgaggagaacaaagatgagactatgtgaagggctaaagtggctttttttttttttttttttgagacagggtctcattctgttgcctaggctggcgtgcagtggtacaaccatggctcactgcagcctcaaactcttgggttcaagggatcctcctgcctcagtctcccaagcacctaggaccacaggcatgtgttaccatgccccatctaatttttaaacattttgtagagatgtgctcttgccatgttttccaggctggtcttgagctcttgggctcaagtaatcctcctacctcggcctcccaaagtgctggaattacacatgtaaaccaccgtgcccactcctggagtgcattttcttttttttttttagacagagtcttgctctgtcaccaggctggtgtgcagtggcatgatctcagctcactgcaacctccgcctcccgggttcaagcaattctcctgcctcagcctcctgagtagctgggactacaggtgtgcatcaccacgcccagctaatttttgtattttttagtagagatgggatttcaccatgttgcccaggatgctctcaatgtcttgacctcgtgatccaccctcctcggccccccaaagtgctgggattacaggtgtgagccactgtgcccggcctggagtgcaattttaaatagcatggtgatagtgggcctctctggggaggtgacatttgtggacaggagagaaagaaggagcatgctgatttggggcgagaaaagggaaacgtcaaacacaaatcacctaaagcaggagtgatatggtttggctgtgtccccacccaaatctcatcttgaattataactcctacaattcccacatttcgtggaaggaacccggtgggaggtaatcaaatcacgggagtgggtctttcccatgctgttcttgtgatagtgattaagtctcacaagatctgatggttttcaaaatgggagtttccctacacaagccctctctttgcctggtgccatccaagtaagacgtgagttacttctccttgccttccgccatgattttgaggcctccacagctacatggaactgtaagtctattgaacttctttcttttgtaaattacccaatcttgggtatgtctttatcaacagtgtgaaaacagactaatgcaaggaacatacctggagtgttccaggaacagccaggaggcaacgtggctggacaggagacagggaagaggagagtagtaggagaaaagacagagtcattattgtcatcataattgtgacagaactccacaaacctaacttccagttttgagtcttagtttatttactctgtgactgtagggaaatccttaactgcttaaatagaatgatagtacttaacttgcaaagcatcgatagttagagatttatttcacaaaactgactagagagaatcagtatagcttagccatgctgtcggtacttacgtggatagctctgggtttatatgctgatttacttactagatgtgtgtccttgggcaggttacttaaacctctctgtgcttcaggtttcctttctgtaaaatgaggcaactaataaatgcatcctttagagctgttaagggttgcctggacaactgtgaggctgtctgtgagagacagtctcacatcacatgcttaacatagtgattggcatatagaaagtactaagtaaatatcattatttattattatttgaaaagtttaagattaaatatattgaaatatgcatttaaatgtatatttgaaatatatatttaataaccaaaacatgcttttgagaaaaaatatcttattgttattaatagttgtggccaggtgcggtgtcatatgcctataatcccagcactttgggaggccgaggcgggtggatcacctgaggtcgggaattcgagaccagcctgaccaacatggagaaatcctgtctctactaaaaatacaaaattagccgggcgtggtgacccttacctgtaatcccagctactcgggaggctgaggcaggagaatcacttgaactcaggaggcagaggttgcggtgagctgagatcgtgccattgcactccagcctgggcggtcaacaagaacaaaactccgtctcaaaaaaaaaaaaaaaaagaaaagaaaaccagctgtggcctggtagccggcctccctgtctctgaatattcacatccttgtacagtcccttcccatattgtaccagggttggtttgtgcgaccatagaatatggcagaagtgatggtatgtcacttctgagattcggttataaaagacattgcagccaccatcttggtcattctttttgtctttctctccatccccacttggtctggagaaaaccagctgccatgtcatgggacagttcacgtgacaaaccttttgccagcaaccatgtgagttgctgagcctccttagaagagtgaagaagccttctcagaagtggatccaccagccctggtcaaggtttcaaatgacagaagcccccagtgacattctgattgcaaccttatcagagactgtgagccagaaccatccagtgaagcagctcactggatggttctcaggaactatgtgaaatgataaacatttatagtctcatgctgctagttttggggtaatttgcttttttttttttttttttggagatggagtctagctctgtctggagtgcagtggggtgatctcggctcactgcaacctctacctcccaggctcaagcaattctcctgcctcagcctcccatgtagctgggattacagctacacaccaccacgcctggctaatttttgtattttagtagagacagggtttcaccatgtcggccaggctggtcttgaactcctgacctcaggtgatctgcccacctcagcctcccaaaatgctgggattacaggcatgagccaccgcgcctggccggcaatttatgtagcaataaatactaatagtttacatacatttttttttcttttgagatggagtcttgctttgttgcccaggctggagtgcaatggtgcgatctcggctcaccacaacttacacctcccgggttcaagcgattctcctgcctcagcctcctgagtagctgggattacaggtgcacaccgccatgccccactaatttttgtatttttagtagagatggggtttcactatgttagccaggctggtctggaactcctgacctcgtgatccgcctgccttgacctcccaaagtgctgggattacaggcatgagccaccgcacccagcaatacattttaagttttcataaacttttgaatataaagaatttattgggctcaagcccaattctatcatttttgatctttaaagatcttcactgatccttggtagtttacaagcattcattttttatataattgttatcagtgtatacatcctacttcatatctgatttttcctcttagaattatttcatgtataccaatagagtacaagattcttagcatttatactggcggtatagaattctcccctgttactgtgtaaccacgctacctccaatagtcccttttgtacctggtttggtctgtgtgatgatagaatatagcagaagcaatggtatatcacttctgagattagattataaaaggcattgtgctaccatcttggtcattctaactttctctctctccccacttgctctgggggaaaccagctgccatgtcatgggcagcactatggagcaatacacgtgacaagccttttgccaacaaccatgtgagctgctgagtctccttagaagagccaagaagccttctcagaagtggatctatactggctgtatagcatcctgccccgctactgtatgtcacaccacctcaaacagtcccttttgttggaatttaaattccagtttttcaaaataataactggcacaataaaaatagtgcaaattagctgggcagtgtagtgaaagttaaatagatcagctctcttagatacataaaacacagataacacagaaggggcaagtcctcttaaagtacatagaccgtgaacaaatattgaacacatgcatttgttaaataagtgagcaaatacaaggctaacctaagacagcaagtgcaaagtaactaggtgaacttacttgtttagataataactttctagaattctgtgtgtttcctagagaaatacaggaatgacagctgacaataaagctttggaaaaatcctgtaagtaattgccttggctccaagtatcaaagcagaatttcggagaaggtcctcctgcactaaagtcattgtccccagactatgagtttctgcctccttctctttcagcattctcctcccctcctctggctgtcctttgtcagactctacaatcatggctagaagaaaaaagttgacttaaccgttctttgttgaaattcgggactatgttagagataccaggtctcaatcaaatacagccttcaataaaagactcttacgtaaccagatcctatgagcagagagccatcgtgcctccaacttagtttcttcagattggctggttttggtgctcaacttttgactttacccaccttcctgacaaagtgttgaggaccactaggtaagcatgctatcttcaacgttaaaaaaaaaaatcatgattgaaggcagctgcacttcatatatcaaggagcattgaatataactaactctaaaacttcatcaggtcatgaggttttattgacatcagtgtatttggcttcagctgtgataatcatgtggcgcagtctcttttcctccccgcaatgccttgcctcccttggaagactccctccaccccaccccagccccattcagcttcgttcagaaaaaccttcatttttatctcccattaaagtttgtctgatgaaaaggctctgaggctcaaatgacagctcagttgtttgaaacctgctgggttagagaatggtgctataaggttaagatcaaaaggtcaccaggtcagggtttccttgctgaggaagaaaagcttcagtgacagtgactcagtgtaaagttatcatcactagcataattaaacacacacacacacacacacaccacaatgcatacactgtcccagctggaaggggtcagggtggacttctggctctggcctccagcaacctgggttcaaattctgcctctaccacttggcactgtggcttcttgcagctatttgaacctctgtgagccccattcttcttgtctgcaaactgtagataataatcatgactaccttacaggagaagtaaattggttcagagaacacacttaactacagtgccaagcatggaagtaagctctcaataagaattattgattattaaaactacattcttggccaagtgcaatgactcacgcatgtaatcccagtactctaggaggccgaggcgagcggatcacttgaggccaggagttccagaccagcctggccaacagggtcaaatcccatccctactaaaaatacaaaaattagctgggcatggtggcacatatgcctgtatgtgccagctactcgggaggctgaggtggaagaattgcttgaacttgagaggtggacgttgcagtgagctgagatcgtgccactgcactccagcctggacaacagagcaagactccatctcaaaataaataaatacataaataaattcataaataaataaatgaaagaaataaaattatattcttgttttagttataacaacattttatatgtctctcaagccaaagtctaatagcattacaagttgtttttgcacatgtatcatctccctttaaaggacagatagtttcttgggattattcttatttttgtcctttatgaagcctaacccagcactttcagcacagcaggccttcaataaatatttggtaaataaataaataaatgttctaaataaagtggatctgcagggacaggtttgtacacataatccctctacttaggatcctagtagaatgacatacacattctgaatgctctataaatattttataatagtaacaatgatataataattataattatgaatgaagattactcttagctcaatttcctgaactagaattatgtccttcagccacggagaaaatgtattcatacagggttccagcttaatgtaaacagaattgtaacttgatttttaaaataactaaagcaaatgaaccaatgtgtcctttcctttcctttcaaacagttgtttccaggaaccagaagtgtggggctatcatatgcaagttgtgataaattaggtcttttccttcaacatttagtctcaaaaaaaagaaaaaaaggaaaagaagactccttaagggcagtatgaccatgggcaagggtgagggaacacacagctttccttagtaaatctcaagcctccaaggttggcgttggaaaggatctgcaggtagcaaatccagctgtcccactgtgcacgccctccccagttcaccttttctctgagggagactcattggtgctcaggtatgcatgtgactcttcacacacacacacacactcacactcacactcttgccaccatgacttccatttaatgttcaagaattcttctctcacagctctgtaaaatatttgagaaggacaaaaactttcaaaaaacccttaattataactgtagtatataaccatttttttaaatgaaattaaggagagtataaattggaaggctgaggtgggcagattgcttgagctcaggagtttgagatcagcctgggaaacatggcaaaacctgtcttgacaaaaaatacaaaaaattagccaggcgtggtggcgtgtgcctgtggtcccagctacttgggaagcggaggtaggaggatcagttgagcccgggaggtcaagggtgcagtgagccgtgattgtgccactgcactccagcctgggcgacagagtgagaccctgtattaaccccccacacacacacacccacacacacaagagtataaagaagaaaattacttctagggaccaccccagttccatccgtcccaaaggtctggtatgacttcggggatctctcgctggggtgtcttccttgctccctcctgacttgcttccttgctgccatataccctcttaggccctgatgggaaactcagggcacgagatttctacctgcagcatacccaaggctcattctgatccaacttactctgtgaggtttgatccttactgcaacttaatgaaagaggcacaggtaggtattactgccattttacagacaagaaacttgaggcttggggagattcaacagttgggctattgctatttgcacacaattccaagtatttagcagataactaattgcaccacacgaaggtctactacagaaatgggctgatggggtgaaactcggaaccagggcagatgctctttaactacaaagcttgtataacgcgtggtcatgttcagtattaatactagattagcttaactgaattctgagacaatggacacaagacaaattagatttgatgagaaaggagggagaggaaaggttctaaacatgggcatgctgtcagtaggatagtcctccttgtgacccacaactgacagaatggaggaaaatattttaaatcatatatcagataaagactagtatcacttatcagatatgaataaagacttcttacaattcaataataaaaagacacataatctaatttaacaatagacaaaagatgtgaatggacatttctccaaagaaaatatacaaatggccaatacgaattctcaacataattagtcttagagaaaagcaaattaaagccacagtgagatactacttcatagccactaggatatctataatcaaaaagaggataacaacaactgttggcaaagatttggagaaattaggacccttatacattgttaacaggaatctaaaagtgtatagctactttggaaaacagtttggtagttcctcaaaaagttgaacatggagttggctgggcgaggtggctcacgcctttaatcccagcactttgggaggccgaggagggtggatcacgaggtcaggagatcaagaccatcctggccagcacagtggaaccctgtctctactaaaaataaaaaaaaattagccaggcgtggtggcgagcgcctgtagtcccagctactcgggaggctgaggcaggagaatggcatgaacctgggaggcggagcttgcagtgagccgagatcacaccactgcactccaacctgggcaacagagcaagactctgtctcaaaaaaaaaaaaaaagttaaacgcagagttatcatatgaccaagaaattccattcctagatacatacctaagagagaggaaaacatgtttattcaaaaacatgcacttgaatattcatagcagcattattaataatagcccaaagtggaacaacctcagtgtccatcaaaggatgaatggataaacaaaatgtggtacatccacacaatagaatattgtccagcaataaaaaggaaagatgtacagaagccccaggagccacagccccagatgaagctggcatccctgggcccaattcctgctgccacagttccactattgccagcccccagaccttggagatcctccaccgccgacaaggctgctaccaactgccatccttgcagagggggctcctgcaaatcttttaccttgtacttgaagcaggggccagggaagaggactctggaaaggacatgtgggcctgagacaccttaaaaacaggaaaagccctgaggagcacgaaggggaaacttttttacctgtacccttttggggacttttggttaaaactgagaattacattgacatagatcaataggagaaatgcatacgaatttgtttaatataagttttgtgtggcataggagactttacaaggaaatgaagacccaaagatgcaattagagatgaacatgtatatactgatttagacaaagagaagtactttatgaaaatgtgacaaggaaaaggggcttgctagttaattggtgaagaagtggtgaagaggataaggattagtctaacaagtttgtttgtaatatttccctcagactcttcccctccttgatgatgataatatttccttctggtagagagagaacatcttttgcatgggaattttatctgctgcttttaagaaacagaaggaagggtagagtgatcttcttgcacctgctgttttttaagcgcctttaactcaaaatggtcaacatgctagagtagcatatttttaactccttcaagcagctacaacaaaatggggagaaaaaatagttacaactgtggcagtaacctacacgtgtcaaacatctctcatgaagcaaaattaacaagaataataaacaagtgacatgtcagctatggagttatcctcttactgaaagagatcccatagataataggaatttcaaaaaatctgtaatggaaactggctttaatgtaactggtaactccataaggctcttcactctgaaccactcattaacaagtgcttcagttgatgagcaagttggttcttatcctggactgcagatgccattaggtctctgctggccctatgctgatgaagacttttttaaggatgaaaatgagccccatgttaattcatgttcaactacagaaaacaacaagtgaaactttgtttgctccaaattggaaactgaaatatggaaacagcagtgtggaaggaaatttaacatatgaaggtgatttatcagaaaacgaaaaggcaaaggatactttattcaattatatttaaaggagggacctaaactgaaagccagaaacaacagaaaatgttgtagaatctttcacagaggagccaagtgaagtttttccataccctgattttctccctcctacggagcttcagtaccctggacttgcacagatgaggccctcacaaaatctgaaaattggaaagcaacaggggaaccttcagaaagctctattattggaaatggaaagattacaacatatgactatacaaaaagagaggtcaaagttacaaactactttctgtaccccagcagttactgaatgactttcttcctccaaagctatactgagagtgggacagccaaaactttctgattcactgagtcttcagacatctcgtgtagataaaagttgagaaaaaagaaaaaaaaaaccaatcgggttctttcaagcttgagcaaaatgcttcaaaatggatttggagcaatgctggaaaatataaatgaaattctagaccaccaactctaaaaagttcatccaccacaaaacagttggttgcaacttaggactttaaaactcttaaaagttcatttttaaatccgtggcaagaactttcagcaaggaccagacaacgcactgactggttaaagtggcctcaataaggtgtctgcccccaaggttttcagtaccagtctccatcttttcttgaaaatgagaagaaataaatcaaggcaccaagaaccaatcacaaactttataaaaaaaaaatagtgttgcatagaccattctatatttagaagctatttgttgccttcatttatagctaagggcttatgtattgactaaaaataattcttttctttcatatatctcagtgtgagcaaatctattccaagaagcccagctaaaatatggttcattgttcccagatacaggtattcgcccacgcacagacatacacacacacacacacacacacacacaccccaattgcttgatatgatatcgattggaatttgtgaaaattactgctgagagtattttaattttcttaattgttactttttaaaaaaatagagatgaggtctcactttattgcccaggctggtctcaatccaattcctgggctcaagctatcctcctgctttgggatctccaaatgatgggattataggcacaagcgcccagcctcgcgagagtctttatataaatccaagggcttctatgctgacatgtttgacaatctttcgcatgttatatttcaagaaatgtttcacttagtaaacggttctattcaaagattgttcttttgtgacagttttccagtataattctatcatcagtaaatggtataatgggtagggggaggaagaaagtactgaaacatactacagcatggatgagccttgcaactattatgttaagtgaaagaagctagtagcatgttgttatgttcctagttatatgcaacgtccagaatcagcaaatccatagagacagaaagtaaattagtggtagccagcggctgggagtagggaggaatggggagtgactaatgggtatggggtttcttactgggatgtcaatgtctggaattagtggtgatggttgtgtgactttgggaatatattcaaaaccactgaattatacattttgggagtaaattgtatggcatgtgaattgtatgtcaataaaataactaaattaaaaatgaaatttcaagtataaatccactaaaaattcagaatctgccatacttttgattgattcgttttgcttactcttgagggcctatcaatgtttactgactaaatgcaaagagggagaaataaaggagaggtgaaggctgggaattctggggatggagagcactttttttttttttttcttagagtcgtgctctgtcgcccaggccaaagtgcagtggcatgatctcggctcactgcaacctcagcttcccgggttcaaggattctcctgcctcagcctcccgagtagctgggattacaggtgcacgtcaccacgcccagcgaatttttttgtattttttagtagacatggggtttcaccatgttggccaggccggtgttgaactcctggcctcaagtgatccacccatctcggcctcacaaagtgctgggattataggtgtgagccagtgcacccggtcgagggcactatttatttatttatttttgagacagggtcacactctgtagcctggactagaatgcagtggctcaatctctgctcactgccgcctcgacctccagggctcaggcgatcctcctaccttagcctccagagtagctgggactacaggcgcgcgccatcgcgcccagctgatttttttttttttttttttttttttttggtgaaaacagaatttcactgtattgcccagaactcctggggtcaactgatctacctgtctcggcctcccaaagtgtgaggattataggcctgagccactgcgcctggccgacgagcacttttaaaatgcaggagtcttcctgcctctgatatctcatcccttatcaccatgcaaacaattctccttttcatagaagagtagacatttggggcggggtggtggtggtgggggattttagaaaatatctactgcatccaaatgccctactctacagacgaaaaagcaaggcccaggaggaggaaagagtttgcttactgccacccagtgagctggcaaaggcgctgagattcaaaatgagctttcctgccttcacatatcttccggctgccctttgcctattccctaaacagtcaggagccatcaagttcaggaatttgcaggtgtgcttcgctgtgaactgtggaaaagcagcgtcttctccccagaggcaagcatgtcgccttgtgaagtttgatggctcttcacttgcacactcacaaaaaagactgagcgtgtgtaacgccctgctggatgtgtgcggtgctagagagcttgggggtgaggggaggactctctcccttaagaaaatcagttgactgcagagctaacattgttttttgagtaatacctggtttttataaagtcgtcccttcagttcccaagctcctcttctgtttgttcaagccaccttcaatttgaaaaagactgaagtcacagcttctcaatccctactaatttctcatggacctactggattgctccaaatcgagtatttgggactgaactaggaagccagttcaatcctgagcccccgaggcaggcgttgggtcttctgtggagtccccagagacctgcaaccttctgaacacgcatcctcccctttccgccgaggactctgtcctgcagccgagccagggcgaatgcacggaggtcacaagggaggtgcccttggaggcgggaggtttctggccgccggggcgaccgtgctgacgaggcacctgcaggaaacagagctctgcacgctccggtccccctcacccggggagggagaggaggtacagaggcgctgggggaggacgtcgagcaggccagcctcgttgccagaacccccgccccagccggagatgggagcaccgcaccgtctcacgggggctggatttcttctccccttgcgggtgtgtgtgcgaggatggacgtggtaaatacgggttggcagaaggagcgaaccgcggtggaggaagttcttctgcttagttctcgccgcggcgaggcccgcgggccaggcgcggcgacgaaggtgcacgaaggtgccccgcgggcctggtggagttgcagcggcgcgcaggcgcactgagggccgcccgcggccggctccgcggtacaaagagcgcccccgcggggagccgggcgtcctctgggcggagggagcagccggggcttcgccggcccgcgccgttcttctcacgcgccgctccggggcgcagccacagctgtcgcccaccgcgggtgagaggcttgctggtccgccccggcttccccgccccggcggcggccgtgcggttcgggctttaattctggcgcttgccagccggggccgactccgccccctgcgccccgcccttccccgagctccgggtccgcggcggagcgagcgagcggccggcaggttgggaggagcggccgaaggtgagtgacgcggcggggccgtgccgcgccccgtgccgcggcgaggttgtcccggagcgcgaggcccctacccctgcctcgggctggccccgcgcggagccgacttggcgcgcgccggggttgcgcggcggccgtggcggtggcggagggcagcccccgcgggctcccgctcgtgcgggtgaacccggcggcctcggggcggtcctgggggggggtccgagaggtggcgtcggccccgcggccgtcggagtttggcgcgctctgcagcggcggcgctcggccggtctggaggagggagaggcgcgccgggcacggagcagcgagaaagttcgggccgggccggccggcgggagggtgcgggcgcctggctaccccggcccggcgctctgtccctcggatgcctctgggcccttccctagcccggggcggaacgggggaccctctctgaagcggctctccgtggagttggatgttgcccttcgcgggagggagtggcggtcaagacccctttatcctcggccccagaggggcaggtggcctcgggtcgccctccgccaactccgaggtggcttcggccggggctggagggcggggaggcgggggaggggcgtgggcgctgcggcctctggggcggcccaacccggcgcgggcagcgtgggtttccgaggtcccgcggttccaggtcgagggaaggtgtaggggccctgaagcgggctggtccccgaatgttgcgttttctgtgccgctttgggcaacacgcagtggcgctcgcggcagccacggctccttgaccgttcatctccttcacccgggtcccgtggaactttcagaggcaactgttcttggtggctcttgcgggtcagcacgagccgtgctgcacgagcgtgacctagtgaaggccttgggcgagttggcgttaacaatttatggcgtccgccagcgctcgctttccgcacgtggcctctgcggagggtcagcccatcttattaaatagtggattctattagaccctgatacccgaggctaataaggaagcttaatcatccagatgtgtaatcgtgcagttcctttcctcaccgtcattgccccccacctctggagctgaatggaaatgagggtctgtttgcttatattgaattcctgagtttattcaagttcatttttaggtggcgttaacagctaagtagctgttcatctgccagtttctcctttcatccaactttctctactaaaatgttgagcacgttttatttaaaaaaaattgaagtgtaataaacatataaatttactcttctaaggtcaaaattcagtggtttttaatatatccgtaaagttatgaaatcatcactaccatctgattccatttcgttgcccccaaaaagaacccctataccgattagcagtcattcttccatctcccagcccttctccctcattttaaggcagctacttaggaagtttttctaagatagagactgagtgagaaaactgagaggtgattaactttgatcctttttctgttactaggtttggggaaaggtgctgctgaagcaatggaagaaaaattaagtattggctgtcctatggggaggttaaaatgaataaggatggaagagaagctgccagtagaggaataattgcctcctgtagagacccacaagttgggaatacattttatccccttagggcacagggatgctttctgggctctagacttgcctagtccataaatcactctagtcgaggttctgcctcagcgaaagtgagttctgggtgtgtgtgtgtgtgtgtgtgcgtgtgcgtgcgcgctcggcagggaatgttagaaggaaaaaagactaggcttaaaagtaattttttaaaatatccaaactggccccaaagaaagaaaccaaaaaaccacaggcaaatggccactggaattgatacattcaagactagtttcatttcatgagtatcagttcacaaatagttctgagttaatgtgtgcatacattaactttttatcccaagtgggaggaggaggatggaaaaggatctagttgggggcagtgcaaggaactgggaagaggaatgggataatggccgaaaggggcagtgcttgtgggagctgaggactgttgagatggaataactatagggtgagcagattctgaaagagcagagtgggtctgtgaaaagttggacacttcactcgggctttttgttggataatgtgtgcatgttttaaaaatcatttttagtaaggagagttgaagctatccaaattatgcaacatccactacacttctcactcacccttcaataagaaaagtcaacttgttttcaagtgtttcgggaagttttaggcctgttgcatgggtgacagcttatgccatcttttttttttttttttggtaatttagaacattgacatagcgagactccgtctctacaaaaaaaataaaaaataaccggatatggtggcacatgcacctgtagtcccagctacttgggaggctgaggcaggaggattgctttagcccaggagtttgaggctgcagtgaactatgatcatgccactgcactccagcctagatgaccgagcaatatcctctctcaaaacaagatgagctgtaccataggtatacatatcccacacccccagccctgccgacggagttttgctcttgtcagccaggctacagtgcaatgtcacagtatcagctcactgcaacctccgcctcccaggtttaagcgattctcctgcctcagcctcccaagtagctgggattacaggcacctgccaccatgcccggctaatttttttttttttttttttgagatggagtctcgatctgttgccaggctggagtgcagtggcgcgatctcagctcactgcaacctccgcctcctgggttcaagcgattctcgtgcctcagcctcccgagtagctgggactacaggcaccgtgtcaccacacccagctaatttttgtatttttagtagagacagggtttcactatgttggccaggatggtctcaatctcttgacatcgtgatgtgcccacctcggcctctcaaagtgtcaggattacaggtgtgagccaccatgccagtttttgtatttttagtagagacggggtttcaccgtgttggtcaggctggtctccaactcctgaccttgtgatccgcccacctcagcctcccaaagtgctgagggattacaggcatgcgcccccacacttggctaatttttgtatttttgttagagacgggggttttaccatgttggccaggctggtcttgaactcgtgacgtcaggttatccatccgcctctgcctcccaaagtgttgggattacaggtgtgagacaccctgctcagccttttttttttttttttttttttttttttttttttgagatggagtttctttcttgttgcccaggctggagtgcattggggtgatctcagctcactgcaacctctgcctcccgggttcaagcgattctctgcctcagcctcctgagtagctgggattgcaggcatctgccaccatgcccggctaattttgtatgtttagtagaaacggggtttctccatgttggtcaggctggtctcgaactcccgacctcaggtgatccgcctgccttggcctcccaaagtgctggcattacaggcgtgagccactgtgcccagcctgtagctatacatcttaagagtacatcttcacaaattgtcacaaagtgaacataaacatataacaagtactcacggaaagaaccaaaatattgccagcattgcagaagtgcccctatactcttgtccaatcactgcccctcccgaagagtaaccgttgtgccaactgtggattagttttatctgttttcatgctctacacagactcacacggtatatagcttttagtatcctggtttctttctcaacattatatttgtgagattcagctgtgttgttgcttgtggctgtagttcagttattttcactgctgtgtaatattcaattgtatgactacaatttatcaatttttaggtttgaggggcatttacatagtttccagtttcttacatggtaagtagtgtgactatgaacattctaattctagtacacgtcttgatacacaatatccaatacaaatgtgtacatttgtacaaattctattcagaagtagaatttcccagttccaaactaggattcagtttagaggtacagtcatgcggatttctgaagtggttgtagagtttatacttctacccgtagtgtgagagagttctgttgtgtcctttttaaattggaagagcagtagatctgcagagtttggcaaatggacaaaatatgacctatttattattttttttttggaggcggagtcttgctctgtcaccaggatgagtgcagtggcgcgatcttgactcactggaacctctgcctcctgagttcaagcaattctcctgcctcagcctcccgattagctggaactacaggcacacgccaccacgcccagctaatttttgtacttttagtagacacggggtttcaccatgttggccgggatggtctccatctcctgacctcgtgatccacccacctcggcctcccaaagtgctgtgattacaggcgtgagccactggcccaatatgacctatatttaccccatcctagcagactaattatttgttgtcttcacttccagtgcttttccatgtctgttcatgtttttatgaagtcacaattctaatattcaattttgtattttgtttcttaacacagtatcttaatattgcttcagtctctgactttttaatccctgcatatgcctaaggatatgctttcatttaataatcctcttattagaaatgtgtgttaatttctggtgttttactagtacataccgttgtggaaatcatctttgtgcatatagtttttacctccctcttgggtatttcataaatttgagatttttgtttatgtggcttgggatctttgttaaactgctgcctgcagagttatccttgaacctaatatggaattgattaaagaaatcttttttatttttttgagacaggatatcattgtgtcacccaggctggagtgcagtgacaggatcagagctcgctgtaaccgtgaactgctgggcccaagcaatcctcccgcctcagcctgcctcccgagtagctgggactacaggcatgtgccactgcactcagctaatttttccttttttttttttttagttgtagagatggggtcttgctaggttgtccaggcgggtctcaaactcctggcctcaaacaatcctccctccttgccctcctaaaagtgctgggattacaggtgtgagccactgcacccagtctaagaaatctttaaattgctaatatgttacctgcaaaagggtgtctcattgggttaaattgcaattctgaaaataatggtgaggttgaccatgataacttctttaaaaatagcataaattgaacctttgtggcaatttcatttaggtatcactgattaattttctttatatggtcctgtttacaaaggtattgagccaagagcttgaaaggatataagaaggatcataccattaagtagttgattgtccagaaattatatctaataattaaaaataccagttaggcaaaattcttacacatgaccaaggagtgttcattctacaaatgcagtgcttgtttaagttctgagggagaagtctttcttgtctagatgattaggagctgcttcccccaaaagtaagacttgagctcagctttaaggagtctctagaaattggctagggagcagacatcactaaagagacactgagccttctcaaggagagagatcagcggtgcatagggagagccccggttgaccactggacagtggggttggtgatgctggcttccttactattctttttctggaagataccgaaaataaatgaactaatatataggccgaaaaaagtacttggaggattttgggagaaagctgtttggtacattcaagtcagcatcatggggtttaatggtaaacacctgccagagattagaatgcagtaggctgcttttttgcctaattatagatcttaactcctttcccctcaggtaaaattcagtgataatttctctaagatgaaggctgctagaccagccttcattcagaataagccaatatcacttaactttagtaaacagtacttaaatttgtattatgtgcaaggccctggtgggggaaatcagagactagaaagctaagagttcatagggaatgaatgtataatgatgcaaaattgtattaataggcaaaatgttagaaatactcaatatcgatacaaaaggttcactctggaaaggaaagggatggagaaattaatgctgagtagagagatctgggtgatatttagggggatttggccttgaaaaatgtgtatgggtgggaattagagtaaagggcactgcatttaggcaataggttttgaaaaagtaaaaggtggcagtgcttgacacataataccatggtcagtcataggcttggagacccaggtgaatggcaatttgagattgtacctttcttcctgtgacttgtgactgctgagccagcctggtgatctctgtggaaatattgtaggtgtaggcccaggctggctacttttaatctaggatctgttgcttgctgtgtgacctttggcacagttactaaacctctctgtgtgtcaatttcccatctataaacagggataataaaagcatctcctttattgggtacttgtgaggattgaatgagttaaaaccaactctgttggttgaggcagtcacctgtccagactcaagaacacttagaagggtggttggtatacagtaagttttatacatgtttgctgttattcccttaatttttgaatttctgaattatagaatttctaatactcacacatagtgtaaataatataaacaacaaagggtttaaaataaaaacaaaactcatcattcttgtctggtcccaactcagctacagtcttggtttaggtgtgataactgctgtttctgtttttagttcttctagtggttattttagcaaattaccccccaaaatttagtggctcaaaaatttgttttatggtgttttggattctgtgggtcagggattcaggcagggctgggctgggtgattctgctgctttcggtgttgactgaggtcattccctggtacccagctggtggatgtgctggtccactggctccaaaaaggctttgctcccatgactattgccttagtgggagtagctggaatgctgggctcagcaatgactgttgagcagagcacctacacatgttgacttcatttgtcttcatggcaactacatgtcttcatggtgacttcagcatggtggctccaggtagttgaacttgtgtggcagcaggcttccctcatgtgttactaagggctctccagagaaacataaccaatagtgtgtgtgtgtgtgtgtgtatgtatatacacacacacaagatttttaaaacaaggaattgacttattcagtttggaggcgggctagtcctaaatactgcattgtgggccaacagatggagacaaggagagtctagaagaagactgaaggaggtctgctggagaattccctccagctcagggaggccggtctttttgtttagttcatacctttagttgtttgcatgaggcccacccacattatggagggcagtctcttttacccatagttacctgatttaaatgtgaatctcatccaaaaacatcctccaagtcaacacataaaattaaccatcataccctgctacgagcaccttgggtaaaccagttggaagcttcatggccttttatgacatattatcagaagttaataacttcccttttgccaaactattggttgtagcacaaaacttgctcaggctcaagcagaggggacatcgacctgccacttgatgggagtgtcaaagaatttgcagtataaaatatactgccagtctatgcttgagttcataaatttgacagtgtctgttaacttcctgctaaggaagaagtggaatttatattccctcacacctctctttcctcttctctctgcctcctggtttttattagatatcttattatttttgccttattatttttagttgtcttcttttggttacctttctgatttaaaataaagcagtccattctttaccaggccgtagagatatggaaaactcaggtttgttgaagggtatggtgttggggagggacatggcagaaaagcagcttcaaatggttgaggcttgacaatgaggctcttgttaaaacactccagccactaaaaatgggaattgcctatgagtgtgtcctctttgtgagcctagcaggtggcataatttgacactttttattttttctctttggcttttaaactcagatacctgtttgcctttttcttccctacacttagcatttaaattatgaatgctggaagcaaatgatattttcaccaatgaagaatcttattacagacacatggttgagttgagtgtttgtatgtggatgtgctgtcagaaataagtgctctcttgcttttttcattaccaaagcaatcagttaattggaaacagagtgtcaggagccctgtaactctgttggaggtgttttgggttttttctttttttggattcatttagttaatacaattgagcaatggggcttagtttaactctcagaacacataactaatccctttttataattatcatccaagaaacatataagaacctctagtcttgttggtttgcattcattgtatattgcagatataacctcttttgatatttgtcttactaataaaatttgacttggttagtggcaagaatgtaaatttgtgtttgatatctgcataatatttttggctaaattttttcagatttctgttgttaattctgactggttcaccctttgaccttgggaaaaaatagaacaaaagcaattagaacaaaagtagatactttgggaggccgaggcaggcagatcacttgaggtcaggagttcaagaccagccatagccaacatggcaaaaccccatctctactaaaaatacaaaaattagctgggcttgctggtgcacacctgtagtcccagctacttgggaggctgtggcaggagaattgcttgaacccaggaggtggaggttgcagtgagtcaaaatcacgccgctgcattccagcctgggtgacagagcgagactccgtctcgaacaaaagttgaaatgaaacataaatactgtattcaccttttctcttttctgtcctcctcctctccttccctccttctcttactccctccctctcttcctccctctctctctccctccctccctcccttcctctctccctcccttcctctctccctcccttcctctctccctcccttcctccctccctctctccctccctcccttcctccctccctccctcccttccttccttcctccctccgtccctcccttccttccttccttcctattcatctcaatagagctgctttttcctctaaaaataatagcttcagggtagccctttttaggggatgggattatccctgttatgagatggttcagctcacttttctgccaaatactccctcatctcctttacccaaatggagccacagaccaatctgaccatcttggtgtcatatccccttctagtcacaactcttgccccgagggtatccttacttctaatatcatagatcaatttagtcagtttttgaactttatgtacctgagatcacagagcatgtactctttcgtgtctagcttctctccatgttatatttgtgagattgatccatgttgtatgtggttatgggttcatgctcattgctgtatagtgttccatcatgtgaatatactgctgttcatcctgttgtccatgaacgttaggtttctagttttggaccagtatgaacagtactgtcatgaatgattttgtatgtattttctggtgaatataggtacacatttaagttagatatatatctaggagtgcaatttttgggccatgcagttcaactggagtaggtaccgtcagagtggttttatcaagcggtattcccagcagtggtgtatgagtttcagttgcaccacagtgcttgttattgtctgttgtcttattttagctaatctggtaaacgtgtgttattgattccctagatgactaatgaagatgaacacctcaaaaagggttcatactttttattttattgcatagcaaagtagaaaaacaaagccagtttgaccgggtgcagtggctcacgcctgtaatcccagcactttgggaggcagaggcgggtggatcatgaggtcaggagatcaagaccatcctggctaacacagtgaaaccctatctctactaaaaaaatacaaaagattagccaggcgtggtggcgggagcctgtagtcccagctactcgggaggctgaggcaggagaatggcgtgaacccaggaggcggagcttgcagtgagccgagatcgtgccactgccctccagcctgggtgaaagagcaagactccttctcaaaaaaaaaaaaaagaaaaaaaagccagttaaagaattcatctagagacattgtatcagttctttaaccactctagcttttctgtttctctacacatttattgtgtttttttgttttagttttatgagagatgtatttcaaggaatttacttctaataaaaatttaaagaacagaagtttatggataactctactagttctgagaattaaggtatttaaaggatgaaactgctcatactgtattactctttcaacttttctaatttgttaactcagtctatttatttttgcctttcactttgacatttttataggagaatttgaatcatgttctatagtttccaggaattaaatttccacataaatgtaaaagaaaacttgagatcctgatgcaccattttttaaagggttttaaaaaggggaattgttaacgtagggataagctatatattgtgaggcttcgatggcagtgctgttaagttcttgtcacttcttagcaaatgaaatgcatagtttcaaggaaacctcacgtgtggtttgatgtgtttgagttcgttttgatttatttcctgttgacattttgagatttcttcctttagcttttattctgggcacctattttatcctctcagttgtttctttttaagacctgtatgcctctttaggaatccaacatgcagctgtcatctagctttgtacttctgtgcatatattccatcttcccttaaatattattggtgtattgctgatcaggggacagacacaaggtggtcttaaatatctgtaaggtacttacaggtgttgtttggcctcttggtggcaagactatgtcctgggtcagattatctaaagggtttttggagaattcaggcttttgaccttggaggcagaataagatttctctgcctccagagacaccaaacttttaactccttttggagttatacttcaggagtaggaggaaagtttgctgaattcctatcaagaaaaggtggttgagagacatgattgaagattgcttaattcatcacagtttctcagctctggcatgaaacagttgggagaagcgattcaaataactgctgatgaaagttgtatattatttttccttttttgaagtttagggaattcagggctagctcccaaatgagatcatgtgaacttagtgatgttctttctggtgggtctttattagagtcagtggggagggaaggggagcggttttggctgtagagtgggatctgaaaattgttcataatgctgggaatgacagaaatgtgggtgcgaagtgcagtgcagagacactggcttgaggaatagcaaggccttttatgatgggcccaggtgggaggggagttactaggttatacttcataggcattcaaaaatacttgttgaatgaatatggatcattttatcagtagcatactaaggctgtcagatctgcatgaagctattgattcactagttatcattatagtggcttagcagcccgctggggggtacctgtccttcaggtgattaggaatttcatgcctccatcagtgtaagtttgaacacttgggttacgaagaaatttgtcctaatgaggtttggccccagatgccctgccaggtgtgcatctgagtgtggtttctattcttcatcaccctctacacacacacacacacacacacacacacatccgtcttgtgttttttggtgggctcagagccacgagggagctattagttatccttccaaaattcagcaagctgtttgtgtttgtttttgtttttgttttgagacggagtctcgctctgtcacccaggctggagtgcagtggcgtgatctcagctactgcaacttccgacggttcaagcagttctcctgcctcagcctcccaagtagttgggagtacaggcatgcaccaccatgcctagctaatttttgtagtttgagtagagacagggtttcaccatgttggccaggatggtctcgatttcctggcctcatgatctgcctgcctcggccttccaaagtgctaggatcacaggcgtgagccactgcggcccggctgcaagctgtgttttgtcgggacggtttcgattagtttttaggctaataaagaacactgtttctttttgtttcttttttaggtttattttagccaacctgaggaaacaaaagcctactgttaggatattcatgggaaaatagggaagccttttttttcctttagtgaaatcctatgtgcctatagagctttttcacactttctagagaaggtaagcatctcttcctgagaaagagtggggataatatgtctgggctcaattctgcctgttgtagggaagggtgtgccggtgggtcaccttttgaggttaagaacgagtaataagaccttgaggattcttttttttttttttttttgagacagagtctcgctctgtcacccaggttggagtaaagtggcgtgatctcggctcactggaccctccgcctcccaggttcaagtagttctcccgcctcagcctcccaagtagctggaattacggagtcccccaccatgcctcgctaatttttgtatttttagtagagatggagtttcacattattggccgggctggtcttgaactcctgacctcaagtgatccacctgcctcagccttccagagtgctgggattacaggcatgagccaccttgcccggccaaccttgagggttcttagccatccccaaatgatctgataaagtagccttagtactgtggaaaaaagtgtcactctttcctgctctgtcaactttgatagcaaaaggaggaaacactgctaaaggggcttgaagtttatatagtttgtgaatcattttcttgggaacttttcaaaagaagtgttgtaaacctctgacctcacatccagtttgaccagataactgtgcttacctgttgaggcccatctgatttgagtcctggcttaaagcggttgttcacatgttgaagtctgtatttaagctccgctcccaggctgggttgtgtcatcccgagcctccccttctccctccttgacccccagtggcccagggcagtttttactttaccgtttcttcctggctttttacctatacttttcggccagacacttcaaggggatctgattcgatgtaggggaggggttcggagcatgggttctagaatcgaaactctactatttcctgcgaggtgtatgttttctttgcttctttgtgtttggaaagaaatattgatattgtcattccgtggtgtttaagtgtgtaaagaggaggagctgggaggaagatgaaggaagacctaggatgtagtatttcctgactataaaactccctaggaaaagtcctcaaagagccaccttgtttactttaggctagaggagcggagaaagggcggtgaccctgtatgacatacagtgaacaagagaggtggaactctggcaggaagtaaagggtagaggcaggctcagggacccaagtcttgtaggaaaccacaactccatgaagcctatatggagtttcttagcattgtctttaaatttttttttttttgttttgagacagagtttcgctcttgttgcccaggctggagtgcaatggcatgatctcggctcaccgcaaactcccccttccaggttccagtgattcttctgcctcagcctcccgagtagctgggattacaggcatgcaccaccaggcctgactaattttgtatgtttaatagaaacggggtttctccatgttggtcaggctggtctcaaactcccaacctcaggtgatctgcctgcctcggcctcccaaagtgctgggattataggcatgagacactgcgcccagtgtctttcaacttttactaggcaccttataattgtgtcttttcccccaaagcccgctctcacgacagcctctggatatcaagatctgtcagccttaacttagtaagtgttctgagtttctctgaacttccaacttctcaggatctgccacaaatttgcaaaaggtggtgttgaatatttttccttcagaaattaagtttttaattcttgtatattttcataggagtagctatgagaggagtcttaactttgggtattgtttttctttggcttctagagaaaagtttgagaggtctagtgattttcattaagttcttttttaagcaatcatttgtgaaactattcacatcctcagatcttggtaagatttccatgcagagcctaatactgaaaagctaaagaagaacctggactttttggaatgatttcgacctctcataaaatcccagacaattacatttccttattttgccaggagactggtatgccagttaagtttataacctcgatccttgttttatcctccatcagttagagattaattacatgcctttggaatggtgagctgttgagccttgtcgtctttgaacctactattgttctcaataaggtcttctaaaggtcagacaaacaagtcatttagatttttctcctccccttaaagcatgcatttataaggcaaaaacttaatgatcattcattccattccattgatcattaaaacagctttaaaaatgaagtggtttcattactcatattagtctagttatgctcagtgacttaaaacaatacattttaatttctagacttaatgagccactccactctgggacatacttatggcagagggtaagaaaagaaatgaccatagccgggtgcggtggctcacacctgtaatcccagcactttgggaggctgaggtggatagatcgcttgagcccaggaattcaagactagtctgggcaacatggcaaaaccccatctctacaaaaaatacaaaaattagccgtgtgtggtagcacgcccctgtagtcccggctacctgggaggtggaggtgggaggatcacctcagcctggggaggttaaggctgtagtgagctgtgatcataccactgcactccagcctgcttggtagagtgagaccctgtctcaaaaaaataaataaaaattaaaaaggaagtgaccagttcattcatagttattaacacttctgcttgtgtgtcacttctactcgccttcacttggctgaagaaagtcatatggccaggcctgccagcaatgtggtagagaagtgtggttaattcttccatctggagatgctataagtcacgtgacaatgggggatataatcctctttcagggaggttagcgaataattgaaaacaatataatctaacataatggaagactatatttaactcaaaaaatttaatggcctgtgttctgattcagaaatagtttttagaattggttaaatctgcactttgggttttattttgaaaagattatgcctcagaaatctgcctagatatggaaaacagggtctagtttttggacaggactgattaatcttttatgaattggagagctgtaccaacaacttggtaactttccattagttgtttcccatggctccagatctgtattttaatcaagaagttacacttcttcctctcttgacttttatatcttgattttgcatgcattgttagtatcctattggtcagatgatttttgtttaattgcctgatttaatatggttttggcagccaattaacagtggatgctactgtcaagagaagggtagagatggggccttttgacagaaataaaatttattaaggcctcatcagtctgtcttggtatttttctttcaaaaatgaaactgatgaactgttgctgatgttcttactaggaaatttctgtcttatataaaagatatgaaatcggaattctttgaagcaagatgacaaaataaagtcatacattgctgtgaggaacagaacgtttgtgcctcaattggttattcaccatctacatgttgagattctttttgtgggggatcttggccatttctgcatgttcaccctcacactcctttttatgaggtgtgggggccatctacttaggcaagagtcttaggtagcttctgtaatttttatgagaaagctgaagtctcttctgcttggttgacttttaaaaagtaggtgcaccaagcctcagctggtgtcagactgctgcacttggggttcttcctgagctcttaacctgcttccagctcttagtgaaaacttgtttttgggagatggtgttcattcatgaaatttcatcaaacactgggcacttggaattctctactttcttttccctccagattctttttttttttttttttttggagacagagttttgctcgtcacccaggctggagtgcaatggtgtgatcttgggtcactttaacctctgccttctgggttcaagcgattctcctgcctcagcctcccgagtagctggggattacaggtgtgcgccaccacgcgtggctgatttttgtattattggtagagatggggtttcaccatggtggccaggctggtctcgaactcctgacctcaggagatccacccacctcagcctgccaaagtgctgggattacaggcatgagccactgtgcctggctcagattcttttattgaatgaacgtctactatgtcttcagcttccattatttagaaatagagaagagtttaagaaacagccacaggcagctcatacatggtgatcccttttgcctctctcagtggcccttttttggagaactgttagaaaagttgctgtaggccttggtattagaaaatgttggcacatttcttgggaaaatgtttgatttgttgaataatgtaaatattgtaagagattgtgatttcctcattgctttgaccaaatttatatcccactgttaaaaagaaatggagaatttcatgatggttatttactaatttaggtctcattttacgattctgttttcccttttgctgaatttatttatttttaaattaaaggtaaatatagttacatctagttttgaaagatgccgcaagtgtttttggaccaaggttgggtacagatacatatatcgtggttccttcatgcagttgaaagttttaagaggactctgtgtgggggagtgcacatacacacagctggatagcactcctaacgctcctttctgtgctcactccgtctctttcatggttttcacaagcagagcatatgctctgtggcatactgggggtactcagtactctgtctcagtgctgagacttggagaaaggcattctttttgagcccttttgctcatgaggaagggggtcctggtgtaccccagggtttgttctccaggcctgggacccacagtggggttgaactggcagaaggcaaagaccataatggttacttctgcagggacagatctggaagggacttcatgctgacttttgggtttttaagttggtattttctgatgagtgactttggtatctcatagaattctgtaaactctaatgcactccttaagcttagcaatgtgtgcctgcctgtgctctcctgaccaccagcctctgacctaccctggttttcacttcattactcctcccttggtgctgacagctcatgggaattaagccagaattggcccaaaagctaaatgcctgcactgctgagctgtggtttcccatgaaaatgccttccctgagttaatgttagccttttgcttgtattgatggataatgcaaaacatgatcatctgtaaggtctcagttcttgatctcttttctgtagacactcattctcgtggtgacctcatcttctctcatggctttaagtgtggttgatattccaatcattatcacatttaggtctccagctctgacttttttctccagttccactctgtaaggcccaactccttccccagtatctacacccgagtgtgtggtggccacctcaaattcaacgtcacccaaacagaatttcttatttcccccaaactccttctccccacagacttctagtggtaaaacccctaaactttgtaatcatcttcactcccctatctcatacaccctacctttaattcagtagcaaatcctgtttcaccttcaaatatatgtagaatctgcatcgtcctccctctttccactgccaccatcctctctcacctcaattactgcactagcctgatacctggactctctgcttcccttgcaatccattctcaacagccatcttttaaaaacaaaagtcacattgtggcactgcgtagactctctgttggctccttgtttctatgggaggaaaagtttttacagtgaactccatggctgtccttgcccggtcccttgttattctgtagcctctcctgtgctcgcccccacctctgctcttccacaggtgtcccttttgcctcccttagggcctttgcactggctccttcctggggctggagtgctctgtcctcacctcagtgaggtccttgctcagatgtcaccatgtcagtgctgtgattattcagagttataacctgtcttctcctggcactccaggtctctcttaatccgcttggcctcttcttttttttttccatatcaaaaattaaccagtattattatggaatttacctattatatttattgtttattttcagcatatcccagtagaatacgggcttttccagggcaggaacctttagctggtttgctggttggtggtacatcaagctcctagaacggaactggaaacgcagaagacacttaaataggtatttgctgttaaatgagctgctgataaggatttactatgctgttcagaacccattatgtgaggaaatatatatttcagttcactgttaggaaaacgtttatttccttgatgaacagggactcccaacttacctgattccctcttctgctttggctaccaggatgccaggaactaagtgtcatgctcagttgtgaaagtgattggcttcaacttgctggtgaagtaatacaacccttcccttcctttcccttttccccagcctttacttgattaagtcgttctgtagttttttgttgttttttttttcttgacaataactctgccttttattgtttgacttttcaagtaactttttggagtgtatgtgtataagaattcaagtcaatcttcaaaggaagagaattcatttattacagagatttgtttatcttagcttacggctggttttattttagctttggccaggttggcaccattgtttcaagtagtatgtcacttattgtggggttttttgtttgtttgtttttgaaactgtgtcttggcctgtcacccaggctgaagtgcagtgctgcgatctcagctcactgcaacctccgcctcccaggttcaagcgattcttttgcctcagccttccaggtagctgggattacaggtgtccactacgacacccggctaatttttgtacttttaatagagacggcatttcaccatgttggccagctggtctcaaactcctgacctcaggtgatctgctggtcttggtcttccaaagtgctgggattatgggtgtgagccaccgtgcccggctcgttactggttttgatcagtgttctgaaatagtaattttgggtatgctgtctctctacaggcttctgtttgattgaatttcatttatacaggtattaacatgcttgtaaactactattgtctattgctttattgctttggttagtcaatcccaaactcttgctgccttttttttttttttttttttttgaggcagagtctcactctgtcacccaggctggagagcactggctcactgcaccaatctcagctcactgcaacctccgcctcctgggttcaagccattctcctgcctcagcctcccaagtagctgggactacaggcatgcgccaccacacctggctaatttttatatttttagtagagacggggttttgccatgttggccaggctggtctcaaactcctgccctcaggtaatccacccaccttggcctcccaaagtgctgggattacaggcgtgagctactgctcccagccaactcttgcttcttaaacccaaggaccctgatttctgacagaatatgtatacatacgtgtgtgtgtgtgtgtgtgtgtgtgtgtgtgtgtatttatttgagacagagtcttgctctgtggcccaggccaaagtgaagtgcagtggcatgatcttggctcactgcaacttccacctccctggttcaagcgattctcatgcctcagcctcctgagtagctgggattgctgggatgcgccgccatgccctgctaatttttgtatttttttagtagagatgggtttcagcatgttggccaggctggtctcgaactcgtggcctcaagtgatctgcctgcctccgcttcccaaagtgaggcatacaaaaagccgtagaatttcatatttttgagctggccagatttgtcaatggctctaataagtgttgcatttttatttaaggaggcatgtggtgatgttagccctgtgatataggagaataagcagcaaaggttgggctggtttccctgctcccctggctgccgtttctccattagaactggaattggggatttcacaaggacctcttggaaaacttcacagttagttttaaaaaaaaatgcatttgtcacccagaggatcaatatttttctaaaatttctaaaataaaggatcagtttgtttctgaaatttggttacctgaagccattgacaaattagttgtttcttattcaggttacttttaattgagttgtgcatgcaaacccacatgtatccctctctgcctctgaggagaatggggcctttcttggagaacacaaaagtaggaattctgattttattttgtgatcttagtcactttacaattataaaaattttggagctaatgagaaacctgaaaaattctgaagtcttcaaggagtgtgatcctggtgctgtctctcaggcatttctcccagagaacgggacggcagagcaatgactgttccccagcccacaggtaggagctggtgggcagcaccagcagcagtagacctagaagtcttagacttagatgtgatttgaaatatggcttttattatgggagcagcacacataagaccatcattggttctcatatgggaaaaacccttgaatattggctctaggacagattttaaggctgggtgtggtggctcgtgcctgtaatcccaacactttgggaggccgaggctggaggattgcttgaggccatgaattcaagaccagtctgggcaacctagcaagaccctttctgtacaaaaaaataaaaattacaaaaaattatttaaatgaaatttagcaatgttttatgtacgtgtcttctcatacttcaaaaagtcaagttgttctacaaaaccgtccatgaaaacagtagctttctgccctgcttttcccacctgattccctctcctcagaggaatctctcatctatcttctgatgttgaaccataagaaaatgctgatatttgactgctttagatctgtgaaaatgactgtatcttgagaaagcatgcttatcatgtcatttcttgatttttttaaattcaattttggatatttactttcctcacactgtggaagatgaagatataactcttatgacttcccccaacacgtctcttctcctgctgtaatattaatatgatttttgtttgattaatatataatgtttatagtattatttagactggaaataattcacagccaagacatgtaatttaaatatttccttcctcatacagcttttgcccacccagagttaatcattgttttgagtgcttgttttaagtacctgtcactgactcattcccaaactgaagcctaaccttcctttctgtgtgtttgcacacctcagggtagctgtccattcatcctttcttcctgaaggcgtcccttctgaagtttccaggccgttctgtaccttctctctgtttctcttccctggatactatggtatcctcctcctttgtggtttcttttggtctctggtttttgtgtgttttttgtttgtttgtttgtttgtttttgaaatggagtttcactcttgtcgccctggctggagtgcagtggcgcgatcttggctcgcggcagcctacgccacccagtttgaagtgattctccttcctcagcccctcaagtagctgggattacaggcaggcgccaacacacccagctaattatgtatttttggtagagatggggtttcactatgttggccaggctagtcttgaactcctgacctcaggtgatctgcccacctctgcctcgcagagtgctggaattacaggtgtaagccactacactcggctgctctctggtcttggtagagagcattggccaacagcttctgcacaaggttacaagggagatagtctccttgagatttggcatatctaaattgtcttttttttttttttcttttaccttcacacttactagtttggccaggtgtacagttctagtttgaaagtccttttccctcagaactttaaagagattgttcccttaagttccagctttttattaaaaaaaaaaaaatagagtttcccctcacttctctttaaaagtttttaggggcggggcgcgatggctcatgcctgtaatcacagcactcctgatcacaaggtcaggagattgagaccatcctggccaacatggtgaaaccctgtctgtactaaaaatacaaaaaattagccaggcgtggtggcgggcgcctgtatagtcccagctactcgggaggctgaggcgggagaatggcatgaacccgggaggtggagcttgcagtgagccgagatcgtgccactgcactccatcgagcctgggcaacagagcgagactccgtctcgggaaaaaaaaaaaaaaaactttttaggatttttctttttgtccaagtattctgattggtctttttgcattcatttttctgggcacacaatggccttctcaaactgggaacttaatgtttttcaattattggaacatttaaaaaattatatttagataactttccctcttttcattgaatttgcattttctaatgttggtggtccttctgggcaatcctctgattatcttacctttttctctcctattttctatgtcttggtctttttattccattttctggtggatttcctcagctttaccttacaaccattttactgaattaaaaaataacttttttttttttttttttttttttttttttgagacggagtctcactctgtcacccaggctggagtgcagtggcttgatctcggctcactgcagtctctgccttctgggttgaaggttgaagcaattctccagtctcagcctctcaagtagctgcgttacaggtgcccgccaccatgcccagctaatttttgtatttttagtagagacctggtttcaccatgttggccaggctggtctcaaactcctgacctcaggtgatccagccgcctcggcctcccaaagtgctgggattacaggcatgagccaccatgccattttcaagctaatatgtctcaatttttttttctttgaggcaggatcttatttgtaagccaggctggaatgcagtcttatgatcactgctcactgcagccttgacctcctgggcttaagcaatcatcccacctcagcctcccgagtagctgggactacaggtgcataccaccacgtccagctaatttattatttgttgtagagatagggtctcactatgtttcccaggctggtcttgaactcctggactcaagtgatcctcctgccttggcctcccagagtgctggggttacaggtgtgagccactgtgcctggcccatggctcagatttaaaagatgtaaaaggtgtatagtgaaaagccacccacttcctgtactagctaccatattctctctttacaggcaactggtattcctccttccagagataactctgttaatatatatatatatacacacacacacacacacacatatacacacacacacagacacacacacacatatatacactttttttttttttgagacggagtcttgctctgtcgccaggctggagtgcaatggcgccaccatgcccagctaatttttgtattttcagtagagatgggctttcaccatgttggccaggatggtgttgatctctcgacctcgtgatccacttgccttcgccttccaaagtgctgggattacaggtgtgagccaccgcgcccggcctcatacatatttttaaaatgtgtgtatatgatcatattctctctccctgtgaaatcacagatgataatagacttcatatattgttatgcatctttttttcatagaaccatgtgtcttcagactgctccatgtggaggtatgggtttctttttaaaatcattttaaagagcagcatagtatgattttaaactccatattttgtttaatcagtttcctattgatttgctacatccaacaatgctgcaaggggtaactttgtacgtgtattatgctcacacgtgatagtgccatgtgtgatgaatatggaattaccaggtgaatgcatatgtgcatttgtacttctcacagatgttactccagctgcctttcatggaagctgtgctaacttatgctctcacaggcaaggcatgaaagcacttgtttctttatatcgttgccagtacagtatgttatgacatttcttaatctttaccaatctgttaagtaaaaaatggtatctcatctgtttttaatttgcatttctcttaggagaatgagcatattttcataaatttataagagctgtttgtatttgtgtttctgcgaactgttcatatcctttgccattgggctgttaccaagttgtatgacattatacctaagggaaataagcccctcatgtgataagaattggagttgtttgcagtttgttcatcttttgattcgggttatattacatttttccatgttggtgaatttattagcagcttattttaaagtctttggatttaatatcatgaagagaaaaaggcgttccccatcttaaaattattatttttaaaatgtccagggtttcttttggtacttttgtagtttcaatatttttatatttaaattatttatccatattgaatttattttagtacatatggatccaagtttactttttttcccagatggctactggttttcccagtcatttattaatagtccattttccctctgactaaatcccccatgcctatgtgtctgtttcttgacttctgtttcttgacttctgttgtgttgctctgcctagctctgtgatgttgagctattcatgttttagttgtgacactattctaattgttaagaatatgtttgtattagggaggattgggcttgtattaaatattttattgttgatgttaattgtcagttttgtagtggtatttaaaaatgaattatgtggctgggagcggtggctcatgcctataatcctagcactttggaaggcccaggaaggtggagtgcttgagcccaggagttcaagaccagcctggacaatatgatgaaactctgtctctatgaaaaatacaaaattagccagacgtggtggggcatgcctgtagttccagctacttggcaggctgaggctgcagtgagtcatgattgtggcactgcactccatcgtgggtgacagagtgagacaacatctcaataaaataaaataattttaaaaaatgaattatgcaaactttaaaggaaactgatcatattttatgtaactcaaagaatgtttagggacctaggctggtaaaggtcagagttttctaactcaaggtttgcttccttttttttttaaatccctccaatgagggggaaacagatgctaaaacaatagtgagaagtacttaattggctgggtgtagtggttcatgcctataatcccaggactttgggaagcccatgcaggaggatcacttgaggccaggagtttgagaccagcctgggcaacaaagcaagaaccttccctctataaaaaatacccagatgtggtggtgcgtgcctatagtcccagctactgaggagactgaggtgcgagggttgcttaaacccaggaggtggaggctgcagtgagctgtaattgtacccctacactccatcctgggtgacagagtgagaccctgtctcaaaaaagtaaaaataaagtagtacttaatttgggatcaagatcggcttacaaatcagaacattcaggcttgaggaagagaaaaagcaattaaataggtcaacaattgcaaagcaaaactcaatttgagagttggataaagagatttgattgtggggactctgtcatttgagatgcaactcttggtccagtctcaggtgatgaaaatacagcatcagtagttaactggagtacagcagcattggtgcctttctttctgtgaaaaaagtctttatttgcctaagatgtagaaaagagactgtagtgaaccagagaccattttattctgaactgtggcagaataaaacgccttctggcgtctgtcctcactgttactctgaaatagcccatatatcgggaaaaaatgtggctgcttctgtgtgtgtgtgttgtgtgtgtgtgggccagattgttgttgtgttacattgtgataccaagagagaagagaacttttgtctagatgctcacctgagacatccacctggcctccaagcagcatgcacatgagtgaggaatttcaacaacttgtttttttcctgtaagataataagtgtaaaacattcattggacatgagcacaaacacagaggcgttatagactagactgtaaaatcgtctgtgggccactctgagcccctgtggtcagtcctttccttggatgactctaaaggggacttgggccccacttaggcataacggtgaacagagatttaaaaggagtttgagagcattcgtgtacagagatttaaaaggagtttgagagcatttgtctttttttttttttttttttttgagacagagtttcactcttgttgcccaggctggagtgcagtggcaccatctcggctcaccgcaacctctgtctcactggttcaagcgattctcctgcctcaagcactttttttttttttttttttttttttaccatttcaatcattttgagtgtatagttcattgatgttaagtatgtttacattgttgtgccaccatcatcaccatccatctccagaactctttcatcttcctaaatagaaactctgcacccattcaacccttaactccccatttccctccactccctccagcccctggtaacaaccattctacgttctaactgttttatttttaaatttagacatatagttgatactcagaagcttaacattccttatatgaaagtcttcaccaagctacttggcgtgagcatcttatttgccctttaagccttaccctgggaataaaatatagcctttatcactgtttttggaatatcttggaagtgcgtaaaactgcttcagtttattatgtagaagtgcatttccagatttctggagtgtggatcgaagattttcataccagcagtagggtctcaaccttgtttttcttatctcttggcaagaaagcaaagctggccattggggtataataaaccttgtgtacacagctgcaggagggaacagggaggtggctgtgcttggaggccgggtgttttgccgacgataatggggcatctctggcaccatgttgctggtcggaacagttttggagttggattttgtcctgcagtgatgtctttgaagaggaaagcacttttgaatatttgcattgctttgaagccagtgccatggagatattgtgacttattgccagtcagaggcaaagctgagtgtgtgaggttttgaacaaaggttgttgaaaaaaggagataatcattaattttttcagtaaaattcattgaaccccaagggcaatttggaggggtcatagctgtttttagaatctgttgctaatcactgtatatcgtagatattaagcctaggttaagagcattagtgtgggtacagagtttagatttgccagtttgtgactttaggcatgtttaacctttctaagtctgtttttccatctgaagaatggacatagagaaaatttatcactgggctttttgtgggggacagatgaggtaaggcataatgcatttaaagtggcaggcacagtctaaatactacctagtgctcctgcacaggcatagaaaatggaaaattgtttatatattttaccctcctccaaaacactcttagaccatctgatttttatttgacttatctgaatcctgaatagtttttactggatcatactctggtatctggactgtccctggtttgaaggtggtgctgctgggtgagaagccaaggatgagagaggctgtgttttggaggcccagtctgtcaaaactgaggtggcatttctagttcctgatagagtgagacagatgcaaaggtcatgggagctttgaacagtttctatgcattatgtgttgtttttcatcttctggaagtgggctggaatttgttttcagcagctaagttcattatgtagttgcctctaagccatgcctccccttttccatgtttgtgaaaagcaaaacaaaaccaccaggcacattatcttttacgaggacctggagattgactagctgacacccccagatttcacatttatgttgagataaggagaataatgtaagtcacccagactttttgtcattctgcatttttattcacagggatgaacagaagcttgcagattgggagaaaggggggggcagaaccagttgttttcaggtggacccaaataatgcatctgctttgataactgcctatctcgatttgcttggaaagggcatagagtaataaatagtttgtgggagtgtgaagaatgagcctttagactgacccaacttgtggaaattcagaaaatgcagaaatgtacgttcttccagcttgtgaatgttgaacaatggaattgttagaagaacttttgaaacttgttctttttttgaaagtattattgtgctcggttggctacatgtgctttggtctcaaaaatttgtgccttaatcacattgctggggaggctgtggatttcactatcaacagaaagtaatgtaagatgtgatatcttttcagcaggacctaaggagattttctcgaaagaaaaggggaaaatgccgctcttaagcaaaaaatctggaccatgttggcagacatacgtctttgaaacataccagcagagaattatttaatcatttgccccttagttttatcttgatcactcctagcgtgattttttccccctcttagttatgcagcagcctactggctgacatttaactattgattgttcatcctggggaatgaattactgtgatttatagtcaagggtacagatgtaaagagacagaaaggatcagatgtttctagtgccttttttcttcctctgatggcttctcccagaaacttgataaaagcaccaacactaaaacatgtttacaataagaaagctgtttattcatcttaagtagaaaattctataagtttatgtaaaattttgcccatgtgggaacaattagtcttttaatttgagttgtgtattgtaattccatggatggagatgggtggaggttgggccgaggggaagctgaggtaagaagccagaccagagaatttaaaatgatgtctttctttgaggatgccccctttgcccctcctgctgggcctcgcagccgtgggattggccacatcacttcctgtccaagttggcactgagagtggcacagtaactctgcccagtgttctcagactgcagtgggcaagtttccagcaatagagtcacccaaagaaacaacgcagcctcctttttttctttctctgttgcctagggcagttttcctcagacctcagtacctatgtcccttgcttttggaataaccccattaggtccccaaaccttgcctttgatgtatgtggcttcttgaggatcccctacatttgcatctgtttccttcccttatgcaaaggccctacgtcttccctgggagaagagtcctcgggggctttcctgtgggagaaaggaaggatctattcctgcccacacttctttctctccagatagagaaatagctcacatttttggtgcctactctgtactgggcactgtactgtgagttttcatgtgtgacctcacaggtactatgatcatctccaagtgacgttcagagaggtggtctgccccaggtcacagggctaaaattagtaacatgtaaggaaaatggctttactctcagcgtgagatgaaacagacaatacagtacacctgctgagtgacagagttgtccctgagttgttagggcctttgcccgccttggagctccacttgcttggtgcacagtaggcagcaaatgggctgtagaatcatggtatttgtgatttcctgtgtccttgacagttgagatattctctaaggctatttatgttctctctaccatgctcgtcacaagcagtcttctgggtcctcacaagcagtctttattgtttatatttctattaacaggtctgttcaaggcaacgtaaacctttcctaccatgttcctcaaaattcttccaagctccttcactacccaattccaaaaccacttccacattttttggtatttgttataacagcaccccacttccaggtactaaagtcttttagttttctattcctgctgtaataaaacccacaaatttcatgcttaaaacagcacgtgtggggcgcggtggctcacatctgtaatcccagcacttcaggaggctgaggtgggcggatcacttgaggtcaggagttaaagaccatcctggttaacatggtgaaactctgtctctactaaaaaatataaaaaaaatagccagacatggtggcgggcacctgtaatcccagctactcgggaagctgaggcaagagaatcacttgaaacccaggaggcagagtttgcagtgagctgagattatgccactgcactccaacttgggcaacagagcgagactgtctgagaaaaaaaatacacaaaagcacacatttttttatattacagttgtgtagatcagaagttggacacaggtctcactggaataaaatcaagaagtcagcaggaccagttccttctgaaggttttggggagaatctgtttccttactgctgcagcttctagaggttgcctgtattccttggcttgtgacccgtttcttcatcttcaaagccaccactggcaaatttagtcccttttacgcctgacatttcttctggctcctcttatgtgatcccatctttctgtctctgaccacagaaataaaagactttttaaaaagactcattagattgggtccatctagataatccaggaaaatctctccatcccaaagtccttaatcttaatgccgtctgcacaatgacttttgccatgaatgtaacatagtcacaggtttgggaattagaagttgggcacctttggggggcgcatttttctgcctgccacacatgataaggtgtagacacaatacagttaactctcttagttcgcagtcggcacccctttaagtaaagtgtgtggtttctaatcaagcattttattcagggtgcatctgttccacctggctggcagcacgcaccttgcaggtcaggtgtgagatgagcaagacccattggaagactggaagctacctccttctctcttttaggacaaggaagcgagagagaagcgaggagaccacttgagttgtgactctcctgcttatggtgaaattaagaactaaaactaaaacaacaggaaccctttcataacggaaatactgaagtataaaatgaaaccacctcctaaacaactctttttcctttgaaaacaaagctaagctgcgttgatgcttgcacctctgctcttgcgtgggaaaattggacccctctgtgacatttggtatgttactgagcagggttcccttggggaggacgagaagcctcctctccacttgacacttggaatttgataccagttcctgtctgacagctggttagcctgtcaggccctcacaagttaaatcttgtctcagaaaataatttgctagaagatcaaagcatggatgggataaattaatttttcaacaagccacaggtttgggataattgtctctcaagtgttgctaatgtctttgataaacaagtaatttgggggggctctttttttctcttgagattataaatcttgattgattcatatgttgaaaaagaactctgaaagcttgcacctaagatgaagccctggaataacctgaaataataataataggtatatttcaacacctgtgccattcggagcagtgattctcaacaggtgggggtgggagatcgatttttgccccccaggggcatttggcagtgtttggagacatttttggttgccatgattttggggaggggtgctactggcatctagggagtagaggccagagatgcccagaatagcccacaacaaagagttatagaatgtcagtagtgctgaggtggagaactcttgattgagaaaggagtgttttctattttacttattttcgtgtgtcttaacactattcctggatttaatttctttgaggatagggtccatccttttattttctcactcaacacaacaagttgccctgagtaggctcaaacatttatttactgttgattcccctctctcttgttaagctattcatccttttttttttctgtcttggagcagagctattgagggcagcactgaaaagcagatggtagagctgtggcagaatcaacatggttgggagagcggaaagaacacaagctctggacttctctcagccccttctttctcgtctgtaaaaaaaaaaaagttaataatagtgcccaacttaggatgattgtacttgagaaagatcgtgttgcaaaaaatggggatgtagtaagtgctcagtaatgccttctcaggcagctgagcaggagactgtgtgcaaggccctctatctcagggccctgtttttttgtaaaaagttgagtaaaggaggggcagacatcttacacatttcagaattgttatcagttctccaggaagaagagggaaagaaaaacatttatagcatttcagtaaagattactccatgattgacaaaacaattttgaggatcctaagaggcacattctgcctcaggctggagcagtttttaaaactaaattgacagcaactagttcaagttggaacagtcctaacttaattatagatacctgcagaggttccttcaaacaggtgggtttcaacagcgtggtgctatctagcaaaagctattgtttgcttagttatttgtttgagagtcagcttagaacataaggaaggagtcagagttggggtggaattctgtctctgattggatcagagcctccattttcctaattgtaatatggaaataatgattgtccctcagaggatggttataagggacaacatatttgttacacatttggcatagtaagtacttcataaatgacacctataaaagtttttgtttgaaaattttccagcttttgttttttatttatttattttttgagacagtctcactgtgttgcccaggctggagtacagtgacacaatctcagctcactgcagcctccacctcctgggttcaagcaattctcctgcctcagcctcccgagtagctgggattacaggcatgagccaccacacctggctaatatttatatttttggtagcgacgggatttcaccatgttggcccagctggtcttgaactcctggcctcaagtgatccacctgcctcggcctccctaagtgctgggattataggcatgagccatcatgcctggctgaaaactttccagtttttaaatgtcatgcatgtttttgctcaagaacgctttggctgtttggggcattttgtagttccatacaatatttttttccgctgtaaaaaattacattggaattttaataggaatagtattaaatctgtaggtcacttcggggagtatgaacagttttaacagtgttaattcttccaacccatgaatacaggatatctttccatttatttatgtcttcagtttcttttagcaatgttttatagttttcagcatacagatctttcacctccttggttaaatttattactaagtatttcattctttcttttttttgagacagggtctcactctgtcacctgagctagagtgcagtggtgcgatcacagcttactgcagcattgaactcctgggctcaagtgatcctcttgcctcagcctcccaagtaactgtgactgcaggtgtgtaccaccatgcctggctgatttttaaatttttttgtagagacatctctgcgttacccaggctggtcttgaactcctggactcaagcagtccttctgccttggcttcccaaagtgctaggattacaggtgtgaaccattgcacacggccttattctctcttgatgctattgtaaatgaaatcattttctttattttttagatagttcattattagtatatataatagaagtgctactgatttttatatgttgattttagtatcctacaacttcactgagtttattctaacaatcttttggtgaagttctgaaggttttctatatataagattatatcatctgcaaacagagacagagtaacttcttgctttccatttttgatgtattttatttttcttgcctaatagctctggctaaaacttctagtactatattgaatagaagtggttaagagtgggcatcctgttttgctcctgatcttagaggaaaggctttcagctttttaccactgagtatgatattagctacgggcatgccgtatgtggcctttattatgtcgaggtccattctttatacctaatctgttgagagtttttatcatgaaaggatgttgaattctttcaaatgatttttatacatctattgagatgatcccttgatttttatcctcgattttgttaacgtggtattagttaattttaattaatttgcatatgttgaaccatctttgcatcccagggataaatcccatttgttcatggtgtatgatccttttaatgtgcttttgaatttggtttgctggtattatattgaggatttttgcttctctagtcatcaaggacattgacccataattttattttcttgtagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggtttgtgatttctgattcaatctccttacttactattggtctcttcagattttctatttctgtattattcagccttggtgtaagttgtatgtttctaggaatttatccatttgttctaggttatctaattggttggcatatatttgtctatagtagtatcttatataatcctttgtatttttgtggtatcaattgtaatgtctcatctttcatgtataattttgtcttttagttcagctaaaggtttgtcagttttatcttttcaaaaactcctggtttcattaatgttcatttttttccttctgctgactttgggctgttccttttctaattccttgaggtgtaaagttaagtgtatttgagctctttcttccttaatataggagttgattgctgtaaacttccttgtagtgctgcttttgctgcatctcttaagttttggtttgttgaaaaacgaaaaaaaaacacaaaaaaacagagagctggaggcatcatgctacttgacttcaaaatatactaaaaagctgtcatcaaaacagcatagtagtggtgtagaaacagacatatagaccaatggaacagaatagagaccccagaaataattcatatttacagtcggttggctctttgacaaagttgccaagaacacacaatggggaaaagagagtcttttcaataaatggtgttggaaaaactgggcatccacatacagaaaaattaaacccctttctcacaccatatacaaaaatcaactcaaaatggactaaagattgggggcatggctcaggggtagaggatttgactgcaaaatggactaaagacttagtaagatccaaaagtataaaactacttgaagaacacacagagaaaaagcttcttgacattagcctgggcaatgatgttttggatatgacctcaaaagtatcacagaagcaaacatagacaaatgggattgtgttaaactaaaaaaaaaattctgcatagaaaaggaaacaaacaatagaatgaagagatggcctgtagaatgggataaaatggttgcagaccatacatctgataaggggttaatatataaaatatacaaggaacccatacaactcaatagcaagaaaataaataaccggattaaaaaaatgaacaggccgggcgcggtggctcacgcctgtaatcccagcactttgggaggtcgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaatgaacagaggaccttaatagaaatttctcaatagaagacatacagatgaccaacagatacatgaaaagtgctcaatatcactaatcagggaaatgcaaattaaaaccacagtgagtggccagatgcagtggctcatgcctgtaaatcccagcactttgggaggccgaggcaggcagatcacttgaggtcaggagttcaagactggcctagccacatggcaaaacctcgtctctactaaaaaatacaaaaccacagtgaggtatcatctcacatctactagaatggatattatcaaaggcaaaaggtaacaagtgtgttgggaaaatgtgagataaagggaccctcttagactgttgatgagaatgttagtacaaccaatatggaaaatagtatgagtatggaagttctgcagaaaataaaaactgaacttccatatgatccagcaatcctacttctgggtatacatccaaaggaattgaaatcaaagagatacctgtacttctgtgtccctcgcagcatgattcacaatagtcaagttatggagacagtggaagtgttcatcagtagatgaatgggtaaagaaaatgtggtatatgtgtacactggaatactcttcacccttacaaaagaagaaatcctgtcatttgcagcaatatagatgaacctattcataaatgaaatagccaggcacagaaagacagatactgcattttctcacttatatgtggtatccaagaaagtcaaactctcacagaagctgagagcggagtggtggttgtcaggggctgggagatgagcggtgcttgggagggcgttggttaaaggtaaaaagtttcagttaagttaaatatgttctggagatctattgtacagtgtggtgactgtagttaatgtatacttggaaattactaagagattagctctcaaatgttctcaccacaaataagtgcgaggtgggtatgttaattagctagatttaatttcacgaggtctatgtacatcaaaccatgtatattgtaaatatatacaatttttattttttaattataaccttaataaaagtgggaggaaaagtgataaacggtaataagcccttaaaggtaataagttaacttgtcacccaacgtatttattaatttttctatacaatgtaatgtgcttggagaacattgaggccgggcacggtggctcatgcttgtaatctcagcactttgggaggccaaggtgggcggatcacttgaggacaggagtttgagaccagcctggccaacatggtgaaaccccatgtctattaaaactacaaaaaaaaatagctgtgcatggtaacgggcgcttgttatcccagctactcgggaggctgaggcaggagaattgcttgaacccaggaagtggaggttgcagtgaatcaagatcacaccattgcactccagcctgggcaacaagagtgaaactctgtctcaaaaaaaaaaaaaaaaaaaattgaaaatccgcaagcttcagaagacacactactgcgtgtttgtccttctacggaagtcagtacagatctcaatgacttgttctcatttcaccagaaaatgaccattgtgcattatgctgtcagtgcagatggaaaactagcagcagtttacaaagtttccacttgaaaaaacataactctaattgatttaaaaaagtagttgattgttgcaagacttgacatttctctagttaatttctatgcctgttgttttgccccttaccgtcttcaaaatctgaatccaaatccagggcttctctattaggaggctccatatcatatctctttaatcctgataatttctcagttttttgtttcctacctacctggctattttcttacgctatctttatttgcttagtaaatataacatttcatgttctattttattttattttattttattattttattttttatttttgagacaatgttctgttgcccaggctggagtgcagtggcatgaccatggctcactgcaacctccatctcctaggctcaagtgatcttcccacctcagcctcctgagtagctgggaccacaggtgtgcaccaccatacccggctaatttttttattttttgtagagacagggttttgccatgttgcccagactggtctcgaactcctggaatcaagcaagccaccccccacttggcctcccgaagtgctaggagtacaggcaagagccactgcacctggccctgttaacttcttatgtcatttccccactttaatatatttgagggctagttctgtgtcatgtatgtattttaacatcactaccgcatctggtgcagagaggggcattctgtagtcttcgtacttcttatcttcactattgctgatgagccataacaaatttgagatgagcaattaatagatggaccggccaacaaacactatgtggaggaataagtgaggccaaagctgatggatgatgcaaagtgaggacgtaacatatttcgctggggaaccagacagatatgcagagtaagcgctctgataggggaagtacgggctgttatgggcgcttcatactgggaacattaatgggaggtggaggtcgtagttgaagctgaaacctgttgggtgaggtggagttcgccaggtgaagtggtagacttggggaagaggagaggagggggagcatcctgtgtttagaaccaaagagagtttagtgtgtgattattgggtgggggtgggagggtaggtcataaagggcctggtaaactgttaagaaattttaaactttatctcaagagttgtgggaaatcactggcaagttttaagttggtaggtgaagtgctggctggaggaatccctccagcttgggtatgtgaggatggcctgagaacggaggcacctgcagtaatcccccagtgagagacactgtagcctgagctgaccttggggctagaaaaaggggacaaatggcggctgaggaggagaatctctgtgagttgattgaatggggagaggcaaacatcaagcccagtgcccagacttctgggaggatctggctgctactcagtatggcggttgaggaggagaatctctgtgagttgattgaatggggagaggcaaacatcaagcccagtgcccagacttctgggaggatctggctgctactcagtgaaaggaagcctgggaggtttgggagggcagatggatgagctcatttatggacagattgagttcaagcatctacagatcattgaaggggaaatgtgagcttgaaccctgcatttgaagttcagaaaagagaaagagcagaatgaattgagttctgggagtctttcccatgtggatagtaactgcagcggatgaggtgataagatcacctagttagaggtgggggagcagaagagggcttagggcagaactctgaagagcaacctgcaaaggagactgaggaggaatggacagaaagggtggaggaaatcttcatgggtgcttttcaaggaggcagtggttaccagcattagctcctgcagagccaagagaattgagtcattttgctgggcttagcaacaagaactttcagggacttcatggcagcgtgacagcatatggagatgcagtactgttggcctgtacagagcctttttttttttttttttttttttttttaaattccctgagatgtagtctcgctgctctgtcgcccaggatggagcgcagtgactcgatctcggctcactgcaacctctgcctcacgggttcaggtgattcttctgcctcagcctcccaagtagctgggattacaggcatgcaccaccatgcccggctaatttttttgtatttttagtagagacagggttttgctatgttggccaggctggtctcgaactcctgacctcaagtgatccacccgccttggcctccaaagtgctgggattacaggtgtgagccaccacaccctgccagtacagagcctttgaagacattagaaaatgtgtgcctttctggatggacacagtccctggcttggtgagtggaccgtgcatgggacttcagctcttatgtgccaccttagctgggtgcacttgtttagtgtgcagaatacaccttccatgcgtggtggcctaggatatatctgcacttctcaatcgaaggcaatgttgcctcccagggaatatttggcaatatccgaagaaatttatgattgttatagctgaatcagagagggtaggtgctactgtcatctagtgtgtaaaggccagagatgctgctaaacactctgcagtgtccaggacaacccctgacaacaaagaattatccagccccaaacaccagttgtgctgagaaacgctggtgtctgtgaccctttcaggctcatgggaaaaggcggtcagagagggtgatagctggaggtgggtggacctgagaacaggctccttacatactttgctgcagtctcatttgcttgtggcagttttcaccttgcctctcctacctctctaccatagaactcttactcatcatgttataggttttcatttgtttattcttatgtagccattttcactattccctctcccacccccactcccccaagcagtaaattctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagcagctctcccagcattttgggaacaaatcaggtcattatctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattcacagaactgtctcggaaagccctgggtaagtttgaagagcaaagttgccttttctgttttcagaaatattttaccccgcaacgatgtgtaaatctaaagcctgtgcaagaatgaaaacgagcttgagtattaagatttggcacagtgtgtgcaagcaatgagactgggttaaaaacaggaagtgtcttaatttaaagatggtgatggggagacggattaaaataaactgctggccatgttgaatctgagataggcaagccttggttgtgggcacattcccttctgaattactctatgcagatatattttaggcctctttctattaaattgtctttcacatggtttcaaagatagggctagtgataagaattctcttcctgcatggtgggtaccattatataaacggtatgagcatgcttttcttgtgtctctgtataactgcttggtctggcactccacaaaatagtaaaacacatttctgcagtggactagcccatgctgtgaaagaggaaggtggtggtggacaaaaagtggtaagttttaggctgaaggatgttgatgttaaactttatttctgattatggcagtctttcatcatgtaatttaagaagcctgagatcatctgacttttttttatgttttttttctttaggactgcaggaagtgttgataaacatctgtttaagttgtctataccatgaaatccataatcttccttcataactatgatagcatatggttttctatagttaggaaaactatttctcatgtatttcatggtttggccaaatccttttattacattagtactaaaaaattccttaggatttctagagaaaataatatgtattatggataaataagggaaagtaagataattcttaaaccttagtatcagcagtcattctaaaccacattacacatcttcagtaaaagtggttacaaaagatttttctcacttcaaaagatccgccagggaagagtcccagctttttcttggtgttattttaggtattaactcaggagggcttcctgaaggtttgtcagtgagatagttggggggttcctgagctttttattgttgtacgtgaacttggtacttacttctttggcttttaaactctcagcagcacgtacagatgccctcacatgctttctgggatgactttaacgctaaatagcaggggtgtttctcaagaatgtttaagaaaagaaagcagacatttgtttgcacaaacagatatttgtgacttctgtgaaaaaattccaatagttgtaatataggaaatttttataaacaaacacccctaccaactaacccatcgtgtatttttatgtgtgtatagaaaaaatgaaaggatatactaaaatgttaattgcatagtttctctgggaattgaatttaattaaaatttttttatcaagatttttaaagttttataatgaccacgttatgtttatgtaataaaaataaaatagaggctaggcacagtggctcacacctgtaatcccagcactttgggaggctgagatgggaggattgcttgagtccaggagttcgagaccagcctgggcagcatagtaacaccctatctttatttttaaaaaataaaataagagagggggacaataaatgcaaatatataaatgacagaaattttatggtctggtcaaagaactatcattgcatgaaattatagatatggtcatgtaaggttaccttttttcattataattccaccaataattctaaagtttcttttctttttttttttctacttcttccacagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggaggacagttttttccttccttttcctattctggctccaacagctgtctcaacacagcccgagatggggagcagcctggcttccaccggcaatagctgtattgtgggagtgtgaaagagaagccaccttttcctccctctgcccaagccacctggcccctttgtcctttctcctcctcgtcctctgaggtatgagtggctgtgactgtatgacataggaactatgaagcggggtgaggggacggtttggtgcgtaaatcctcacgcaggtggcggttattgtctgtgtggaggaaataagcccggttcttcctgggactgctttcatttccctctagcttccagagggtaaaatgaaccttaatggaggttggggggtggcacgcacaaagtcctgggttgagggggcagtggtcagaaagttccctagggtaatatacaaaggagaattaacactggggacactgaggtgggttttggtcctttccacataactgacacctttcaaagcaaggacttgctttctcgtgaggaatgtcagcagtcgcaacaccactgggttggatgcaggataattattcagaatcacgagttacctgtttgcaagcaatcacattgcaggtgggataaataagcagacagtctgtggtaggttcccccaccccaaccgcctcccctccccccagggatactgtaattttaagtattgttttggatattggtaattctaaagctccaatcttaactgggttttatgaaagccgttatagggtgtttattaccaaaaaaacctccttcttatttaataatacagtgcctagccactcctttttccctgcatccgtacatgaagcctgattgcagatctcgaacagtatatttctttgagctaaacagcaagaacagataaggtatcttatcaaaacaccacgccaggtggcgtggctcacagctataatcccagcaatttgggaagctgaggtgggaggattggttgaggtcaggagtttgaggccgcaatgagttatcgcgccactgcactccagcctcagcaacagagggagaccctgtctctaataaaacaaaaacattacaccattgtcagaaagtgatttgttcttctttgttggattaaattctctcacgtgcaaggtagtggccagcagcctaagaagatacacaagctcttcactgtagatgtttggcggtgtgggagttacaaggttaattatgagcgtaaggcccaggcatcttttcttcctaacaatttcatttcatcctatttctttttccattctttctccgaactgtctatactttattaaagtcttctttttcccagactccagaataatttcctgtgatatgttttagcagtttctccaggaaaaggctccaggagtctttaaatccagccctctttctgctgtatctttgtgcctcacatcttgagagaagttgagtggtagaaagtaaaggaaagcagaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtttcataccagagtcaatctactagtttgcttggttttataggcgtgattcccaaattttgaatctgaagttagctgtcagtttaaattcagagggtccgcagttgtttttcaggtttttcttgattctgcctttggaaaccaggaagatgttgaatttacttttcatctgacaatattgcacatctgtgaacccaactgatctgaaagtgtttacctcttaactctgtgaagttagctggttattctggatggctgggacaatggtgaggaccgtttataatggttactctcacctgtgctccagacgctccacttggtgctagaaatacagcagtgaacagacatggttcttgcctccacacagcttgcagtttagtagggcagactgacgacattaaaaagataccatcggtgttgttataatggtgataagagttacaaaataaggggccaggtgcagtgtctcacacctgtaatcccagcactttgagaggccaaggcaggaggattgcttgagcccaggagttggagaccaccctgggcaacatagtaagaccttgtttctacaaaaaaaaaaaaaaatcaaaaattagctgggtgtgttgatgtgcacctgtggtcccagctactcaggaggctgagttgggaggatcacttgagctcagaaggtcaaggctgcaacgagctatgatcgcaccactgtattccagcctgggtaagtgagaccctgtctcaaaaaaacaaaaataaagggagcatgtaacagtaggatctaatctagcctaggcaagtacggcattcttgagaagtgacttaagacctgaaggactgatcgaattgtctgtgtgaagattggcagcgggtgctctgagggggaaaagcggaaatagcatatgcagacaccctgaggtagaaagggagctctggcctgcttgtgtgattactgtgggagaatgaacaggaagaagacgaaagtagaagcaagaagaccaattaggaggttccaaggacctgcctaactaaggtcagttagccggtgattgcccaagccaagactcaaactcatttttatgaaggccgcacaccctcatctcctcagcagttgttaaacaatatttgataatggtgttcatgtcaacctggcacatgtctagaagattcttaagtgactttttcttttcacatggctttttgaccttttaaatataatatgttttaatatgacgttattagctgcacaaaggaagggaactgctcatttgaatgaaccagaagaaacttggaattttgcctgccttctgcttcagccctgccaaaatgtaatttctttaattcatcaaatcacattcttgactaatctgctcaagtctgtactatgccttggcctttttccctgtgacaatttagggatctttaaagaaaatattttgaaatgttttctcttgatcagggtgcttgtggttaggtattgcatacactgcttttatttgcagaatgagctatttttctaccatgtgatcctttgttagaaatgaacatgattgtggctggccgcagtggctcacgcctgtaatcctaggactttgggaagccaaggcaagaggatagcttgagcccaggagtttgagaccagcctgggcaacatagcgagaccccttctctacaaaaaaattagaaaattatccaggcctggtggcacacacctgtaatcccagctacttgggaggctgaggtggcaggatcgcttgagcctaggaggttgaggctgcagtgagccatgattgtgttactgcactccagcctgggtgacagacagcgagaccctgtctcaaaaagaatgcaattgtaattttgtcacctttatttaaaaaaatcatttatcaggtggttgcaatgaaaagcaatttagttgtttacaacctctaccttccagggacttaagtgtgttcagaagtatttaaaatgaaataattatcttagctaataatgataaaattactgtggagcattgagggctactttgtgccaggcaatcagctttaaacacctttgattttctccctatgatgaggggtatactgtgatttttattaaacatttggggaaactgaggcttaaagtggctgagttttctaagagcacgcaggtggaaagtgatcaagctgagtcctcagcttcatatcttctcagggtccttgatcttccgcaccctgtagttctggttcattttaggcaattatcagaagtcacctcaaatgccaagaacctgtgtaacacaggggatgaagtaaatgtgagcaatgtaatgaagcgtttccttataaactgttgtaaggattttgttccagagatgaagtatgagaaaaatataagccaattgttcagtttcatattagtcaccctcttctactgaactttggtaaattcaaagcttccctctatacgaatttacttttataggaatattacaaaatctatactaagaaatattagaaaataacctgtacttaataggtttaatggaaattaaacccaaatataatggaaatctgaatgaatgctcatttaaaaaaatataatttatagcagtggttctcaaactttagcgtgcatttgggtcctctggagcattatgttaaaacacagatagctgggctccaaccccagaccttctgattcaggagttctgggactggcgtacaaatgtacatttttgacaagttaccagctgtatgagggttctccaaagagacagcataggtatattaggaaggagattcattataggaattggctcatgtgattacgaaggccaggaagtcccaggatgttccccaagaagtctcaagatctgccatctgcaaactagagaacaagaaggccattggtgtaattcagtctgagtctgagggctgagaacctgggagcacctggcgtaagtttccatctccatctgagtctgaagatccaagaaccaggtgcgctgatgtctgagggcaggaaaagatagaagttccagctcaagcagagagcaagtatttgcctttcctctccctttttgttctattctggccctcactgattggatgacacccatccacactgatgagcatccatgttggcggtcttaacccttttcccacttagaaaaaaagtgcggtttgtggccagtgcttatttaattttacataaacaggctgttggaggctaaagcaaatcggactgattttcagtgtgaaaataaaatagaaaatattatttctaaacagaactaacatcacaaccatctgaattatcagaatcatctatttcagaaaaatcggattcatcaaatgaatcttccatcaactgttagagaacgatgttaacatcactcataggaatgctatgttttctaggatttgacattttcagcaattgagaattactatattttgtaaatggaaatgccactactaaaaacagaatcctataaataggatgatgtcttttgtttccaaagtcgatatactagaacgatgtgaaaatttaaaaaacgagatctttcgtggcaaggttatcttggggtaaacactgcagctgcaagcaccatgggcaagtattctcagggcaaacaggaagagagttagtgaagtctactaattcaaatgctgatctcttcttggcacacccagaagtaatgttttaccggctgcctgggcatccgtttgcccagtcaagttggcacgtgaaattaacctgcataccaggtaatgtttctgctgctggcctagcgaccacactttgagaacaactaataagtcataagacagtagaacccctggatagtaataagtgctcgtgaaatgagctggccagtagctaatccctgagaaagccatttcctagtcttataccacgtcagtaatccaaagcaggatggcgatctgaagtcctgaagagtcaagggtgatacgatgactctatggagccatcaccactattgggaagacagtggggacacctgcctcccctaccttccacaccatgtacatgatggcacgtgacttagatgtgcaaactgtgcagtgtcagctttgtgatgataaactcttccactcagtctgctatgtatatggcatagtcactatactgctaaattaaataaatcaaatgagtgaacataaatcaggattcagataccaattaggtaaaatactatagtttgtatatgatggggattatcctttttctggaatgtttcagcatccaacctttgctgcgtttgtcttcttgcagtgactgagaattagctgaaataactgtaaaagcgtaagattcccatttggctggagatgaaatcacagaggttggtttactaagccttaagaaattcctttagatttgatgtgtccagacttgtactggaatatgaaatattcaatttgacaagatctgtgagttcctagtacatacgtgtttttagaaatgtgtttctcaaaatacaattaggaaaaaatccctttgaaatgctaaaactacctttagtggtgataaagatgccgacaaccccttctgtttaaataaaaacaaacaacttttaaccttcatgatgttataataacatcattaacttgtgtagacaaacatcagtgctcacatttaaagtaatcattaaacattttcagagttatacttaaaatgactttttaatcatactataaaatactgctgcaaagttgttggtggggtactaagttgtagttcttatttcttctttctctacagtctgttttggctctaccttggggggaaaatacccaaagaattgtaactgaatacagaagcattttaaaaaatcttattttaaagaggaggagaaattttagagctatttctgataataaacctcaaaaagtgagaagtattagaatttatcttggttaattttctttttttaattaacgagcatgcattgcttatataaaacttttctctgtatgtgtctgtatctgatgcagttagaagttcaatgtgagtttagtgattcccagggaagacttagggaaccttggtttctgagttgtgctctcctctgactacgtggtgagtcttagtctctggagtcagccagatccagatcttagtctcatggagttagccatgatcattttaaacttataattattaaagtgctatgatgtacaaaggtgcttatgaaactaaaatttgaggaattagatacaatgactatgcggttttgctttttagtaactgtttctcattacttcattgatccaaagtgagatttttaaagctaaagtccttgttccattaagataattctgtcatttgtccagttactctccttactcaaattgctagcccctttggtacttttctctctagctcttgccctgcttcatgatgttcctgaatagttttagttttctttgtttatttttccactttcttgggccagacctccaatttaattcttttagttgaatgagctgctttctcgcttgttacagactcacttagggctcattcctccctgccttagtcccagtatggtctcagtaatgacatgcagtatggggactttggactcctgtttgaacaaaccagctttgagatgataaaaatttgaatatgaattgagttcttgaagataagaaattgttaattttgttaggtttgttaatggcatggtagttactctaaaaacaaatttctgggcgagtgtagtggctcatgcctgcaatcctagtactttgagaggccaaggcaggaggatcacatgagcctgagaggttgagcctgcagtgagatgaaattgcgccagtgcacttcagcctgtgtgacagagcaagaccatgtctcaaaaggaaaaaaaaaaaaaaaaaaaatttattcattagttataaatgcacactgatgttcttataagtgaaaagatatattgttttggttttgctttaagattccagcaaatataaaacagaaaaagagggaatatattaaaaaggctggcaaaatatgtatcattgttgaagcttagtgatgggtgcattgtattcaatatagtattctcttttgtgtatatttgaagtttttcatgatagaaggtttaaaaatttagaacaaaaatgaatgtggaggttcaggatcctaccagatgtttctaaatgaactttaagtgacaatggggaaaaatgtccatatcatcctggagtttaaggcagggaattcttggtagggggctattgaaaaatagccaaactgttagtcaaaaatgtacatatgatctcatggccacagatagtaatgtagaagacagatcacgaaagtactaatccttgggtgaggaagaacaggagaaggcagcccaagaacttaactgaggccccaagaactaaggaaatctgttttgtaaaaggacctgtacggccaggtgtggtggctgacacctgtaatcccagcactttgggaggctgaggtgggaggactgtgtgagcccagaagtttgaggccagcctgggctggtttaattaaattagctgggcatggtggcacacgcctgtggtctcagcgacttgggcggctgaggtagaaggattgtttgagcctgggtggttgaggctacagtgagctatgatcgcgccactgcattccatcctgggtgacagagcaagactctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcattaaggaggagcatagcaaagaagtctagacctatgacttggagctgttctgttatataaataggatatccagagatagcaaactgctcactgcaggaaataggggaaatagaggataatttggaagaacaccccactgttattatttgtggcagttatgttctataaagtcgctgtggacataattagtgaatactgagccattgctcctaggggaacaatacagagttagattcctgtgagcctctggttataacgattttgtcagctgtcaaccgatcaatacatagccttgttttgcatgtgtttctgtttaaagataccttgtttaatatacattgttgattcattaacattgacctcatggcgaagagcactgtatctcatgcctaaatgaagcttagccaatgcgtctcttcttcctaaggcacatcatggccttgttgtgattaagaacattagacgacactaaggcatgatgtttggggctcattttaaacagcaaaatcaccaagaaacccacaaaaatgaaaaaaaaaagccctaaaaactagccacaaaagggacatttgttaatagtataagggctagaacaaagagtgtaggctggttttttggcttcagctgggtacatgtatgtggagtgactcaaatattttggtgtgtacttgcttcagtggcacatatactaaaattggaatgatacggagaagattagtatggcccctgtgcaaggatgacacaaattcgtgaagcgttccttaataaaaaaagaaaaaaaaattttggttctctccacctgtgcgcaaatgaccatgagcattagtcttggggttataaataagttttagtagatgaatttgcaaatgtggaatccgtgaataataaggatgtactgtattttttcatctttatttcttaattaacaactgtgatctgtattttaaatgagcctttttgggggagcttgataggcattgagtgtttttcccaaagatttgtcaccttcttgtgagttgtctagtctgttcttttggttttatagatttattctaaactaaaagttaatggtagttgccatttataatttcttgcagaggtttttgcagagatcatccatttaatatttttgtgcattgaaggttttaattgtacagtcaacactgtcattcacttgtgattttcattttttccaagcttagaaaacttgaaggatgatgacttttttattggagaggttaaaaaaaaaaagtaggtaaaagtgatggatgcttaggctgagggtggtgactgaatatgtggtacttgaaattgagtttgagtgtccaggcctggtttcattatatcttgggacacttaaaaaagtcttgcagaggcaatctgcttgaaaatgctgtataaaccttaaacctctaaattgtaaaatgtaagtgcataataatttctgatttgtagacttctgttgacaatctttcaagacgggagaagggtgaaaaagacggaaaagacaaacagatatttttcagaaatgaaaaacatgtacattttctgacatagggaatgagagatttttctaaatgtgacccagaaggctttcaggtgatttcctaacaagatttgagttttctcggattaaatatggttgtggctctctaccatgtgccccagtcttatctttgttatgccccttcacacatactctgttcttcacatactcttccttctgctggctagtgcttccctgtttctggaactttcttaagcatttttaccatgtattatagttatttgtattgtagttacgtgtcatccttcttcgtcttagaagagaagtttccatctgactccatgttttctattgtagaccctagttcagtgccttttaaacagcagatatggaataatcctctaatggaataaatggggagaagaagggatagtttgtggttacctgggaaagcagtgtggttaagtcagcatgggtttctcaagaacaagcctttcttgaattaacctcatttcctgtataaatcagatacttattggagagagaatttgggtaatgttgttgttagaggatatcagaataaaaaaactacatgtttcattaagttcttaggattttttatggataagttggaaaagcatgggcttgattgtaataagatagatgaatgtgttgcaggttgattaactgttgactttgtgcaattcactgccttgccagtgctattctaacttttccatcagggaactattaaggaagaggaaagtttatactttattttggagggtttagagggttgagggtacaggaattgaaggttggattgtgggcaggatgtagggagactttagaggcacagccaggagcgaaatgtctttgaagactcatgttttcacataaagatgcattcactttgtatttttaacatgcccatgtttgttttaaaatactttaaattatcaccagataaaatgtttgagtagccctttcccaatgtcatgatattctagtttgagaagagtggtctttgatcaagaaaggtggatcaaatttgtgtctatcccattgttgggagggaagctaaccaactggatgtcagacatcaggatagaaaaaaaaaaaggctgcaaaaagttgaaggcaatcaacatgaacaaatacacaattaagctctactgaatgcagcttcctagagtcgggggaaagttgcatgtttatagaatgggagacctggatcagtagcagctcttgttaaaaagattgaaggtttcagccaaccatttgatatgggtggccttctctggcagctttaatggcacagtactcagaattaaggagataatcatcccgttgttttctgacttcgttaggctacctccgagggcttgttttcaaacaagttctacattttaagagggtaagccagggaaataaatggactagaaactatgccctaccaggaatagttgaaaggctatcggggtggaaaggagagcaaagttaattctcaacttcaggggggcaggattggaatttatgggtagacataagaaggatatgtttttctatttcaatcaattaagaatttttgctttgtaaacacacataaaatggatatcatatactatttagtaatcacttttttcacttgatagagcatgtatatcttatgtaactatttgatatgttcatatgatttttaatggctacatagcatctctctgtatgagtgcactcttatttattaaaaccatccctgacagttactttggtcatttccaatttcttagtataaacaacaactctacaatgaagatatctcaaatacactcatcactgtgcatttgttgagttgtttccttaggacaaattcttagcagcaggacagctgagtcagcattggtactatttacttatggcttttgaatacttattgccaaactgcttcttaccagtaataggaaccgcatgtgttaaagaagtcagattaccccaaattagagatgttgtcataggattttggcagtgggttgaatgttggacagtgatctaaggctccttaaaaaatgcatgaaagttttagtgtaggaccagatgactgtttcatctagaactttcacatttcagtcttactatgtaagtcacactgttaaagaaaactgtcaagagtctgtaacagagaaaatactgcagacgttttctgtattcagaaagcactgtagaaattgaccaaggaagagaggctcatggcaggcaacaacgcaatgctgttaggttgcatgtatgatagaaatagtaaaggaatctttcagcagattaaccattttataacttaggtaagttggggttttccaagtaagtaaattgcattttctttttttttttttttttttttgagacggagtctcgctctgtcgcccaggccggactgcggactgcagtggcgcaatctcggctcactgcaagctccgcttcccgggttcacgccattctcctgcctcagcctcccgaatagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccaagtaaattgcattttctacaccctgccagagctgggtaacaactgcttctggggaagatgggaacggacaaaaagctgctctagatcatgttcccagtaaagagctcaaagtgattttgcacgtgttttatcctcatgacctaaagctcagctgcagtgagatggtgtagtgcactgagattatcagcaaaggggattccagcttcactgcttgagtaagccactgggcctctctgagctgtagtttcttaacctgcataggagatgaattaccaatacaagtcagagagttacagtgaggatttcctgagatgatatattggatagtactttctaacctgtaaaatgctttacaaatattagttgtcaagttagacaaccgatgctagtggagatttccaatttaaagctttctaatggatgaaagagctagtgaacttcatcacggcagaagttgggtctgattttgcttgattttgccttgatgtttggctcatagttgcaattcactaaatatttgttgaatgaaaaaaatgaaattagcatttcattgttttattaacacattagagaggcacccatgaaaatgtgtgcttctcatctttgtggagtaagtactgctattcattcttacaagcagggaagcagatccatcaattctcaaatcactctcacagccagattctgcatttttcaggtgatttctaattacatgaaagagattagatcaagtactcttttttggttatttaagaggaaagatggaaccaagcctgtgttctgtagctctattgtgtaaaatcacttcgagcaaatgaatgaaatattttgtcagactttttttttttttttacttactgacccttaatagaaaataattttatgtgtagccctccccagagtctctgttgccaggaagctaatgttgctatccctaatacggcaactttgtctatttttctgttctttgtgcattgtgtttggtcttaaactgtgaatattccattaactgagaactctgaacagccattgtgtaactggagtgatagtctgtgtcagttcaatgcattgtacttgagaataaacatgctgttttatttgtggtgggacttctctcattgccactagtaatatgttgttaactgaaaatataaggctattaataagcctcataagtactttgcattgttgaaacaatccttcagtgtaggatcacatgattttgtagatatgtatgtgtgtgtctatattttcaaataggcagtagacccattcgtttcttatccttgggtgtgaggtcagaagtgtcagtgaaattgagtccagaattgtagttatgcgtgctttcctagggagaggtttctcttctttttaatcagaatctcaaaattgctctatggttcagaaatgtttagggaccactgacgcagcaaattcagttcagcccggatagtttatttgatctgtggtgactgtgtcactagaaagtgatataaaatacctagactagcacagggcacacataggttctacacaaatatttgttggaaacccaataaaaatcactggtgctttttttctttcttccctgtaacacattatggcctgtgaacctctagaagacaggatctttgtcttacttagtctttggcagctgtgttaacttctcgcgtctgtctcctagtgtcatagaatgtgcactttctttctttttttttttttttgagacagagtcttgctctgtcgcccaggctggagtgcggtggcgcaatctcggctcactgcaagctccgcctcccgggttcacgccattctcctgcctcagcctcctcagtagctgggattacagacgcccgccaccacgcccggctaatttttttgtgttttttagtagagacggggtttcactgtgttagccaggatggtcttgacctcctgacctcatgactccgcccgcctcagcctcccaaagtgctgggattacaggagggagccaccgtgcccggccagaatgcactttctgtagcaaagtagaagttgtaaaactttttctcaccagacacccttatacatacaaaacaatctgaacatgtgtcctcaacgtagacacctagttataaattatatacgtgtacatatctctattgaggatatatgttcagattgttttatgctaatatgaaacatacatagttgcaatgttgagagatgaaaagtaatgttttagcatgtattgataaccatgatggctttatattaatattaaaagctatacctatttctgcccatgcctacttttggtgttctcataatctgagcatgcgctcagctctggctctttgcagccgctcttccacctcctaacactctttcaggagatgcccttactgttaactgcttattctctgtgcttcttaattcatattcttgagagtcagcatctaattgactcagttcaccttatcattccaggtcaactcatgtgagtctcattgacatacagtgttgtttttggcttctcttgggaagcccactctggtccacacaggtgactgcatgaagtgggaaatgaagacacttggcacagacatggctgttcaggtaacaaagagtgtgtgcagggcggcttcactgagaaggagcctggtgaggctggaatggtgactgctttcaccattagacaaatgtcagtgggtagagaagagagaccaaagtgtgactttagaaacagaaaaatccccttttcttcctttgcaaatccatacctatatattttgaagaccactaggcatgtcaggtaaactttcagcaatttaaattaatcagagagctggagaacatctattcctgttaagatctttcccacccattcaactccctgactagttactgctaaagagaaaaatggtagcagcttcatctttaagacttaagccatagttcttgcaatgggaaagtcaaccctaaagaatggtttcatgtttgctcccattctaccttgtgcagacagtagtttaaggatgtcttctgcagagcataacttgtgtagtcacccaaaagggtcttccagttcactgagaccatggtattgcagtaaagaaagagtttaattgacgaagaggtggctagccgcatgggagatggagttatcactcaaattaatctccctgaagttttgggggttgaggtttttcaaggatagttcggtggacaggggactatagaatggatgttgctgattggctggggatgccatcataggagtgtggaaaacagccctcatttgctgagtctgcctctgggttaggggccataggaccagttgagtcatgagtcgcaggtccaggtggagtcagccagtcgtcaaaaatgcagcagtctgaaaagacatctcaaaaggccaatcttaggttccgcaagagtgatgctatttaccacagtaattggggaagttacaaatcttgtgacttccagaacaatggctggttatcatttatacctacgcttttaacaaaacttttattttaggttcaggggtgcatgtgcaggtttgttaatatgggtaaactcgtgtcatgggggtttgttgtacagattgtttcatcacccaggtgttaagttaataatacatagttatttttcttcaccctctgcttcctccccaacctccaccctccattaggctgcagtgtctgttgttgtcctctatgtgcccatgtgttctcatcatttagctcccatttataagtgacaacgtgtagtatttggttttctgttcctgcgttagtttgctgtgggtgatggcttccagctatccatgcaaaggacatgatcttattcttttttatggctgcatagtatttcatggtgtatatgttccacattttctttatccactgtaccactgatgggcgtttaggttgattccatgtctttgctattgtgaatagtgctgcagtgagcatatgtgtgcatgcatctttatgatagaatgatttatatttcttttggtgtacacccagtaatgggatttctgggtggaatgggagttatatttttagaactttgaagactcatcacattgtcttccacagtggttgaactaatttatacttccaccaatactgtgtaaatgttcctttttctctgcaacctcgccagcacctgttatgttttgatttcttgataatagccattctgacaggtgcgagatggtatctccttgtggttgttatttgcgtttctctaatgatcggtaatgttgagctttttttccacatacttgttggccgcatgtgtgtcttcttttgaaaggtgtctgttcatgcctttgcctactttttaatggagttgtttttttcttataaatttaagttccgtgtaggtgctggatattagacttttgtcagatggatagtttgccaaaattttctcccattctgtaggttgtctgtttactttgttgatagtttcttttgctgtgcagaagccttttagtttaattagatcccatttgtcaatttttgcttttgttggaattccttttgacattctcgtcacgaaatctttgcccattcctatgtccggaatggtattgcttaggttatcatccaggtttttgagtattacatttaagtttttaatccttcttgagttgatttttgtatatgatgtaaggaaggggtccagtttcaattttctgcacatggctagccagttatcacagcaccatttattcaacagggagtcctttccccattgcttgtttttgtcaggtttgtcaaagatcagatagttgtaggtatgcggccttatttctgggttctctcgtctgttcccttggtctgtgtgtctggttttgtaccagtgccatgctgttttggttattgtagcccagtagtgtagtttgaagttgggtagtgtaatgcctccagctttgttctttttgcttaggattgccttctatgcctacatcttagcagaattcaggcccttctcataaccctaaccttgtggtgtttcattagctttacaaagttgatttagttttggaaagtgctattctcattcttgctttaaagttaaactataaactaaattttccccgaagttagctttgcccatgcccaggaatgacgaaggacaacttggaggttagaagcaagggtcagatatctcttactgtcacagttttgcaaaagcagtttcacttccctcttctaagtaccttctgcattgattggagccagcaaagagaacttttgcagcatttcttagtttgaatgtgccatataaatgaaacatgtttggaaatgtgaaaccaagtcatccatgagaatgttttcctctgaaaggcagcacttcttgataagtcccttcctcatggaactttggtgcagtgttggcccattttaaaatttattggttacccagggagatgcccgagcttatcagaattagagtctctcatttgagtacgttcttgcagtatagaagtttgcagatgttttataactttaagaggcccagtggtattgaatttagagttaatttttaaaactggctccaaagtcaccagcatggacaaaacttacagtcttccaaagagagagtgccaaagttcaacgcttggcattgttggtttttttttttctttgtgcccatatcaggtagctatgattatcttcattttacagagaagaaaacaaagctcaagagttaatttgactaaattcacagatgagtgaagtatgaggtagagagtgatcctgtgtgagaatagtttacatttatcttgatgtggttataaccactaccttatctataatgcatgttaaaaatcaacttctcaagattttttacaccaaaggcaaaaatattcaaatgttgatatagtcccttccattcatttttatatttttgtttaaaatcttcaacatcatacccagttttcaacctaactttataaagtaagcatttccttaatcttcataaacatgtttaagatatgtatcataatttaacaaattattaagtttctgaaatttttacagtagtgaggcagtggatgtatttatgtgtaagtctgtggggtttttttcctgtctctcccatagaggcagagacttgctctgtgacccaggctggagtgcagtggcatgatcgtcactctgttgcccaggttggagtgcagtggtgcagtcatggcatgctttaacctcaaactcctgggctcaagctatcatcccgcctcagcctgctgaatagctaggactacaggtgtgcatcaccatgcctgcctaattttctaaaatttttttgtagagacaaaatctcaatatgttgcccaggctgatctcgaactcctggcctcccaccttaacctcccaaagcactgggattacaggtgtgagccaccatgcctggccaaggttgattttttaaaaacattatttccttagtatgtgtatgattagaagcaaaattacaggtcagaagtcacattttaaaagatcatgaccacttaaaaaacccttaatatgttttgccaaatttatatcttttaaaaatgggatcgatttccacactcatcggggtatatttgagtatgtagctcactgtagacagagctcctggggagggaggaatggctctggtgctcttctacccacctgtagaggttcagctggggaccagctccactgtggggcattgggaggctgttagtgcagaggtatcttctcagtatctgcctgacacactactgtatccagctgcctgacccagtcctgcccacctgccttcctttcttcctgcctcccctctgttttatcaactttgtctcaaaaaacatagcttcctatctctatatgttcgtctcctatttatggtccctcagtatgttatagtgcttgctaaggtttgaatgtcccatgtgaatctcatgttgaaacttaacccccaatgtggcaatattgagaggtggggcctttaagaggtggctctgccctcatgaatggattaatccattcatggattaatggattaatgggttatcaggggagtagggctggtggcttttaagaagaggaagggacctgagctagcacactcggccgcctcaccatgtgattccctgtgctgcctccagactctgtcaagtccccaccagcaagaaggccctcaccagatgcagccctagactttggacttctcagcctttgtacctgtaagaaataaataccttttctgtataaattacccagtttcaggtattctgttataagcaacagaaaattgactgagacaatacgtatattctaattgtgttcacttttctttcatctagacttaccagaagtttacttctctggttggcttttcaaggaagcttttgaatttcacttctattttttctattaatgcattcattattagtgaagtattttgtaatcatttttcaaacagattgggtgttttttttttctcatttcaatatgtagttcacttatgttaattatttagggcttacatttttctctgttctcaaccttcatcagattccgtaacacttgatacgttgtaaggtttctgttttcattcattatacaccttccccaccccaggccttttcattactttcaacacagtctcgtattaggatttatgttttttaaaacaattatttaggagaatagaatagtttttttctccttgtattgggttttttgtttgtttagatgtctgttgtttctgtgatggctttgttttaatctgtgcttggagagtgctctctcattgctactttggagaatgtattattctttggcctagtatgattgtgtgtgtacatttggggacaaaatgtttttgtggagataatgtagacttaaaattttaaatccgtagctgtattttcgtcacaatgaaaatttgatgtccttagtaagccccgaatagaaagccttgacttgctttttgagcatagttaacagtgttgagataagagaggtttgctggcagttgcactgatggctgcactgttgtccagtgggcccagctgggtgtacagctcgccgtataaacagaaatctagacacaggtccctagaagcctaatctgtgacctagaccctgtctctgaggtactcttaccagaaagttaatctgttagaggatctttcatcagcataaaaggcagaaataattttctaaatgctgttgataaaatgtgagtgcatgctgcttcattcgattatggaaactgagcattggagacttattctcctttttaacaccacttgcctccagtaacttacactaattgtcatctataccaagcctttgaaaatttgtagtttttgtaagtttttaggaaatatgcatgctaattagataatgcctaaattatgttgcttttcatgtgaatttagtaaagtcatttaagacccgttggcttagtttttcatgagactttctaaacatgcttaatctctgcatactattttaataataatgtaagtttttgactttttgctattataatgggcagtgaatatatttgtgctgaaatctgtgtggaatttttttgaacatcattttcttactgtatattattagaggtgaaatgtttgggtcaggagttacaaacatatatatttttaaaaaactactctaaagatccttgatacattttgtcaaattgatttcttgtaaaaatgggaccagtttgcacctctgttgtggtatgagagagtgcccatctccttggggacctagccccttgatggttccagcactccatcgaaaaccagctccactgtggggtgttttgtgtgacatggtggtgtcatatgtcttctctgcaagaaaaggcattgttagcaaggcaaacagaaatactcgatacagttatgtataaaccagaggaagcctttgccagagagattgttgacaattgctagagggtatgataatgcagaagttacagagtgttcctttggcaacacgtgttaatggatttgttccagtgttggagccctttttaatgaaaattctcaacacctacactggaaaaataataaaataaaaagccttagtcaggaatgtattgcttgttaagatttagccaaggaagtcacatgttatttaacaaggtagattacttttttctttgtagtaggcaaggaaacagctatgcttcacttctaaataaaaaaaaaaaaaattttaaaaacgttttttaaaaagaaaaacgtgactaagataactgtctcattcccaggcactttttaatctcatataaatttacatttagagacttaacagtttggcttttttgaatgaatgccagaaatacagttggactatagagtctcagctgagaagcagacacatggagcaaggtatgttctgtcatttatcagaaaagttaaagaattcattttgtttaaaaggcagcacatagattattcagagagagaaaaatatgggtttataggaaaattcttatgtatttggtaaggactctgagtttgtactttagcttcatgtctcataaatcaagtcccaagttcaccaggtgatagtattcccaggttacttgtgggtgtaggtgcagaacaactcggaactttgtggttgggcatctttttctgccgtccaactttggaggttgctgggaggagatgcttattttccttttttagggcatttcagtttaaaacaaattaaaaatggaaagtcaatgttttccctccactaatacaactcttaacttatggttgtaataaacagtgattttttttttttttttttttctaagagacagggtcttgctcttttcccaggcttgagtgcagtggagaaattgtagttcactacagccttaaactcctgggctcaaggcatcctcctgcctcagcctcttgaacagctaggactacttgcttgtgctgccatacccagctatttcggatcatgaggtcaagagatcgagaccatcctggctaacacagtgaaaccccgtctctactaaaaaatagaaaaaaattagctgggcgtggtagtgggttcctgtagtcccagctactcgggaagctgagacaggagactggcgtgaacctgggaggtggagcttgcagtgagccgagatcgctccactgcactccagcatgagtgacagagcgagactccatctcaaaaaaaaaaaattttttttgtagagacagggtctcgatatgttgcccaggctggtcttgaattcctggcctcaggcaatcctcctgccatggcctcccaaagcactgggattacaatatggacataagccaccatgtccagccctacttttgcttttttgaaggacatgtgtgttaagcagaaatttctaaagtcagtgcattttttgcatcagaacatgttttaactcatgagttaaaacatcgctgtttctggcataacggtcttcccacatttccatctttatattaaaaatttctgaaataaaatttctttttgggctagaaaaaggtaagattggatcaagtgatccatttaggacttgccttttcatactttgcagtctcattactattatcacaatgtatgtcctaatacaataaagttgaggtttaaccaaaagttctcttttcttctggcatgctttgtgagaaaatatttgagctggtgtaaattgtaattactggcagatatggaagagagtctgacttggagtattcatgatgctgatatgctgctgcagtcagtcaagtgctgcgtgagttgatgtcattaccaaaggacagtctctataatcagagaataaagtataatttgtaaatgtggaggagctagaggaacaacttgatttcacttgtcactaaacttatctaataaataaaaatgaggatttattattattattattatttttttgagacagagtctcgctctgtcacccaggctggagtgcagtggcgcaatcttggctcactgcaagctccacctcctgggttcacgccattctcttgcctcagcttcccgagtagctgggactacaggtgcccgccaccacgcgtggctaatttttttgtatttttagtagaaatagggtttcaccgtgttagccaggatggtctcgatctcttgacctcgtgatccgccctcctcggcctcccaaagtgctgggattacaggcatgagccaccgcgcccggtcaaggattttttttttaaagccagaagtaatataagtcggtatcagtgagaaaaggtggtgaggatagcagggattaagtaagtcgcgggcattttatttttatcttaaagaaaatgttaaaatggttgacgttttctagctcaacactcccacccccacctcacccattgattgatggtttgctttcgaaatcctgagtgaaaagacaggaattacttcattgtgctgagagtgactgatgtcagaaggtcagttttcctacatttacaagattcatacacacttctgaaaggttttctgttagactgggtggactgtagatgaacagggcactttttgttttgtaattgcatttagctttaattagaggtttagagtagaaagctgagagttgcttggaggagccaaccaggagattaatgggctgtgcccatccgccgcagctctgtgcttccaagaagtttgccagggtaacctggatttgtctttattgtactggaaggagtcttgtcctgtagaagtagaaatcactgatgcatcactaacatcatgtggcctttgttctctgccgcacatgtttgaaaagcgcagctcgcacccactcttcccttaggaaagggggccgaagctctgtacctgtaacattccataaaggctaaggatcatgaggatgttgagtgggcagggccccagcggtctttactgaaataccagagcctgcactctgataatgaatgaggctcgagggaacattcctttggcatattttaatgcttgacctagttgactggggtgctctgggaaaatgagcctcacttcctgcttttccaccttaaattgaagtatggggtgctctgggaaaatgagcctcacttcctgcttttccaccttaaattgaagtatgtcatttatatgattgttaatattgaaatgagcagctgtaccactctgttctcaacagggaggaagcctttttatttgtaatgtttgaaaatattctttctcagccgcgcgtggtggcttatgcctgtaatcccagcactttgggaggctgaggcgggtggatcctgaggtgaggagttcaagaccagcccggccaacacaatgaaaccccatctctactaaaaatacaaaaattagccaggcatggtggcacgtgcctgtggtcccagctacttgggaggttgaggcaggagaatcgctgaccctgcgaggtgggaggttgcagtgagccgagattgcaccactgcactccaacttaggtgacagagtgagactccgtctcaaaaaaaaaaaaaaaagaaaaaaaatattttttctttttttaagtgtatatattttttaagttgaaacctgtgtttgccttgtctttatgcccacaggggaacttgaagtcattttacatatcaaaagcatcttctcaggttattctgaattttgagaaggctaacatttgctaggctttatgtttaaaaaaacaaaaacagaaaaagatcctgggcttctcccatcttgcttggcaaatgaggagtctagggtacttgtcttaaatgttctgacatatttcaattaaagcagtgaacaatattctcaaagacaaggcagcagctgatacttggtaatgtccttaaaactgcatagtaataaccttcagtgagatttgtataatttggagataagctccacttatatctgtaaagttaaagcacagagaaagttagtacagtatttgcctgaggtcagtcacgcagttggtgacaaaagccactattcttagtacttcatgagacttctgttttatataatagattacagaggccaggcacagtggctcttgcctgtaattccagcactttgggagactgagctgggaggatcatttgagcccaggagtttgagaccagcttgggcaacatagcaagaccctgtctctacagggaaaaaaaaaaaaaaaaagccaggaatggtgatgcacacctgtgttccagctgctcaggagactgaggtgggaggattgcttgagcctgggaggttgaggctgcagttagccatgatcatgtcactgcactccagcctgggcaacagagcaagaccctgtctcaaaaaaaattaattacagagatagtgttctagttaatagcaaggaaagaatggcttaagcaataagcttggccgggcacagtggctcatgcctgtaatcccagcactttgggaggccaaggcgggcccgatcacttgaggtcaggagttcaagaccagcctggtcaacatggtgaaatcctgtctctattaaaaatacaaaaattagtcagatgtagtggtgtatgcctataatcccagccacttgagaggctgaggcaggaagatcgcttgaacccagtatgtggaggttacagtgagctgagattgtgccactggactccagcgtaggcaacagagtgcaactgcatctcaaaacaaaaaacaataagtttaatgaatgattcccaaagtatggtctatggaccagcatcattcacatcatctgggaacttattagaaattttaaatttttaggccctatcagacctactgcttactctgaaggtgggagtctaggaatctgtgtttttacaaagccctccacatacttctgattcatgataaagtttcagtaccactagcttcataccatccttttataattttatgagtttaaatgctcagggctgctgagataacatacccttgggtcctgagtgtatacaaggtaagaagcagctggcagcctccttgaaggcccagcatagacaaccttactggcctcccttttaatatacagataggtaagaaagcagaagaggaaccaatatttgctctgctaggcactgtgcctatctttcccacagttcccttgcatttagccctcatgccaatcatatgcttgtcatagtgtgctccttatatgttttgggtacttcatcattttctagttgtaatctcagtcttgagagcaggctcagacgtttgcttcgattctttcactggcaatcacggagacttgacattgtttcatttaggggactgtacatttcctcatggggcatgcagtttgtgttggagatacagaaagcttcatcttgaacttggtgcttcttcctggaacagtaattttatttcaggtttgtgggagaggaagaggagggaccttgttttttttttgcaaaccatgacattccctgtacgtaccatgtacctggtgcatgataaataactgttaaatagatttctatactattaacagaaagcttgtattgtgtccggaattggttccttcaggtggtttcttggtctcactgacttcaagaatgaagccatagaccctcacggtgagtgttacagttcttaaagatggtgtgtccggagtttgttccttcagatgttcagatgagtccttagtttcttccttccagtgggttcatggcctcgctgacttgaggagtgaatctgcagacctttgcagtgttacaggtcatgaaggtagtgcagacccaaagactgagcagcagcaagatttattgtgaagagcgaaagaacaaagcttccacagcatggaagggaacccaagcgggttgcctctgctggctctggtggccagattttattcccttatttggccccgcccacgtcctgctgattggtccattttacagagtgctgattggcccattttacagagagctgattgatccattttacagagtgctgattggtgtgttattacagagtgctgattggtgcatttacaaacctttagctagacacagagtgctgactggtgtgtttacaaacctttagacacagagcgctgattggtgcgtttttacagagtgctgattggcgcgcttacaaacctttagctagacacagagtgctaattggtgtgtttacaatcctttaactagacagaaaagttctccaagtccgcacccgacccagaagctcagccggcttcacctctcagtatcatctcccagatagcttgtgcccacccttcagacttctttgtttaaggcagttattctcaaaatgtcccttgaccagaaacagcatcacttggaaacttggtagaagtacacattctcaagttccaccccaaacctcttgaatcagaaattctgagggtagggcccaggaatttatgtttcaacaagtcttgcaggtgattttgatttatgctagcatttgagaaccactggctttacgcatgagaagtaggattttaaaattgtactttttattataattttctgggaaagtaaagctgtttcacctgtaaactttgggaataggagcaccctgaagctcacaatggcatcctgcaaagccccaaagagtgctagttgttgatcattacctgtgcacacatcattccctcactcagagcccagctaggaggcctcctttcaccttgtaaccaggtcacccctagatgtgatcacttcctccacaagaactgagagagaagagaagaacaccagaggatactgaactggccatactggggcttatggtttaaagggcagaactgagccaaatgaggactcctcagaaaattgctttctcgttggatcaccccagaaataaatcagtaaaagcattcaccttttgttttatttgcttcaaacaaagtaggaaacattcttcttgctttatatatctagataccaagtaaggaagtatgatttggattcttgagtctctttattttatttttcaactgtgtgtgtgtgtgtgtgtgtgtttgcctttgctaagccatggagggtaaaaaatgaaatatattagcaacattgttgacatggaccacagacaattaaatgtttcatttcttattaatcctgaaagaaaaagccttttttttttgttgggcggcagggagggggtgcagtcctctatacaaaaatcttaaaaactaaatatatctattctaattgttttcccctggaacatcatcatagtttaggagtatatctcaatgttgattttaaaaaataaatatgtaaacagctagatttatgcactgttaaagcatcagtgcaagttttaggaaaaaatcaagcatgacaattgaaaataaaataaccattactaagttggactcttctttaccctcaagaaattgtacttggatgtttatgggagaaattattccaaatcctaccagttctgtcagaaaactaatattactctacataatcattttctcccacctctgtataatatttaacttttatttgaaatgtaggctcaagctatgctaaaaatcccatctcgaagatgacgagcttatccatggggaggggatggagggcagagcactctcataactctaggaatttgactgttatatcttgacttaataaatgtctgcagctgaaaataggaaaaattgactatatgcatgtttgaacacatagacataaaaaatgccagctgaagcagagtattccgcatgcaagccaagaaaaatcgggttcagtgaggcacagtttggcagggaaggcacactgaagctgcagggatgggaggtctagtaactggggaggtattcagttgagggctggtgccctccacgtagccttccccgacccacccaccctgggtctgcttccctctgcccccagtgtgggctcccgtagcacagctgggtattagcttggtaatggggaaaggatggtattcaactgggaatctttggcttctaggaacaaaacaaacttggggaggatgttatcaggatactgaagtcctccccaaaatccaggatcttcagagaaaacctaagaatcaaaaatagaaaagcacaggaagttgaaggactctgtctctgtgtgttgtccctgcttctctcagctccatcctcacctttctgcactccagctctgttgtgtcgtccacagcatgcaacacacagatccagctccatctggagcccgcctgtcagctcctcagccccaattttaaaaccctaggggagaagcatcttctcagcataggtctcacatctttatgtggtccagtgagccatggtgggggaggtaggtgggtgcagggaggcagtatgggaggtccacctctgaccctgtggcccagtcagaagaccccaaagagaggagtagcttgcatagatggaacaaaagcattctccctatgttattccgttcacatgttgctgtgggttcattaaccccacacttagaaagtaatcatctttggctctaagaaaatctggaggttggacctgaaaaacctcaggccagacagtgaatcagtcctggattgtgctgaattttctaatatgactccaccccatgaggcttcatgactgtcagcatctgctgtctccagtgatgctgtgtccgaaattggtgggttcttggtctcacagacttcaagaatgaagccacagacccttgcggtgagtgttacagttcttaaagatggtgtgtccgaagtttgttccttctgatgttcgtacgtgttcagagtttcttcattctggtaggttcgtggtctcactggcttcaggagtgaagctgcagaccttcgcggtgagtgtaacagctcttaaggcggcgcgtctggagttgttcgttcctccggtctggagttgttcattcctcccggtgggttcgtggtctcgctggcctcaggagtgaagctgcagaccttcctggtgttacagctcataaaggcagcgcggacccgaagagtgagcagcagcaagatttattgcaaagagtgaaagaacaaagcttccacactgtgggaggggacctgagcaggttgccactgctggctcaggcatctgcttttattctcttatctggccccacccacatcctgttgattggtcaattttacagagagctgattggtccattttgacagggtgctgattggtgcatttacaatccctgagctagacgcaaaagttctccaagtccccactagatcagctagacacagagcactgactggtgcatttgcaaaccttgagctagacacagagtgctgattggtgtatttacaatcccttagctagacataaaggttctccaagtgcccactagactcaggagtccagctggcttcacctagtggatcccgcactggggccgcaggcggagctgcctgccagtcccgcgctgtgcgcccgcactcctgagcccttgggtagtcaatgggattgggcgccgcggagcagggggcggtgctcgttggggaggcttgggctgcgctggagcccacggcatctgggggaggctccggcatggtgggctgcaggtcccgagccttgccccacggggaggcagctgaggcctggtgagaattggagcgcagcgctggcaggctgacactgctagggaacccagcgcaccctccgcagctgctggctggagtgctaagcccctcactgcccaggggccggccgctccaagtgtggggcccgccgagcccacacctacccagaactcctggcctacccagaactcctggcccgcgagcgttgtgtgcagccccagttcccacccacggctttccctccacatctccccgcaagcagagggagccggctccggcctcggccagcccagagaggggctcccacagtgcagcggcgggctgaagggctcctcaagcacggccagagggggcgccgagagcaggcaagggctgacagcacgttgtcacctctcaatgcctatcttaaacagaccctttacatggcattggtggcaagtgagactggaaattctttgtgaaatgcttgcatgatacaagagccttctcgtaaatctgttttaaaagtgtcctttattctgaataccattttgatccgtgatccactgatggaagtcaatgatgttgaactaagaaaatacataggttactagctatgaaccattcttcattagtgcacttgcttggtaatgggttaatttgaattgggaatgaatcttagtccacaaactagaggtgcagagaatattgcagtttgctaaatagacttaatcttgactttaagcttctactgctttcaggtagcagaaagattcacctcgattattcttggatttctttcccatatcaccctcccagagttgtgccaaggttccaggctttactaatgtcatgatgtcaggaaggcctgagaagttatccgtttacaccagtccctactgcttctgggctgcatttgaggctagggagggtgctttgtcagcatccagccatcctcctggggttgctgcacacctcagggtgcagccagagtgcaggtatggccatctgccactcagagtttcacagtcattcacttccaagatctcccttaagtgtgagagatcttgctatcttctcacctgcttttctcctcaagaaggtaagccagagccctcgacccttgtgaatgaggaaatttcagagagaaaaacattggaactccccctgccccagagttggtaactgctcaaatgctggctgccgccaggtggtgcaagaggcgctgcttctctgtggtcacctagcagcagtctcctgtggccagttccccacgtagaggtggcaactgcccttcttcatggctacttgctggaggtttgtgggaggaggggagtatggggggtgtgtgtggctttacctgccccaaattgtcaggaggatttgaggcatttctttgttgttgttgttgtttggctgtttccaaaacccatttggaaacctgttattccgtaagagtagccttcaaattcttaagcattttctataaatcttcagtgaactaataaaagtatttccttttcccttttctggcaatgggtagtctagttctgttaatattcctgcaaagaaactcatctaccagcctcactcacactgtgcacttttgccctcagaatcctcagtggctagcctaattgactacaaccagtttagatgatcagctaccttccttttgccattatttcagatgctgccttgcccatagcacaaccaatgcatttaaaaaataaaaacatttggggtgggagaactatgattaaataaaggagatctctgtagagtatggcaaagcttgcacacaactttaataaaaatatgctgtcttgagtaaccagcatattacagaggctctgtgaatgcctcttcatctagaatttcagtacaagctgtacataaaatatttatacagcacagtgtgctttgcccctcacaaaagcgtgggttcagatgtacactgttactatagacgtcactaacatataagccggtgaagaacctttaatgtatttgtaatgttagcaaagtatctgtcatcagattaaacttgtagtgactgataatgtagccttggctcctagccaaaaatattttttttgatatcagaatgacacttaatagtaaagatatgtcatagaggaaggggaagaagagaatttactagagaaacttaaaagactggttggtgcagaacctagtaacttggtttgtggctggcagaaatgggagtagtccctgggattacttctaaggaggaaattttactacaaacacagctgggaataattctgttaccaagtcttttttaggatcaatacagagcttatttgtaaaaattaaaatctaactatcactttattgtctatgggtatctgttacattttatctgtaaaagaggaatggaaatgcctgcctagtaggttcatcataaggactgagaggatacgggaccttattaagtcctcagtaagtagcagcaattttgcttttgtttttatgatgattacttccactcatgactttacctgcatgttctttaatcttcaaaatagattagtgaagtagtgatgtttccattttagaaataaaatacgctggggaaacgaattgtaatacacatgacaaagcttaatattagtatccttctatgaaggatccctcagtatccttatataaagatcctttatggctctaatatgcttcagttgattttgttccttgtaggcaaaagtttcaataaatatactgttttctctccattatcaaggatatatggattaatattaatatataaatatataaatccattatatagtaatatatattaacatatacttcctttattaatatcctggatatatgaaattaatatcttggatatatgaaaaggtattccagatcaataagatgaacacagtagtagaaaaatagagaacatgaacaagagtgtaaaaaggtgcgaagtgttcaaccccaaagatatgctaatcaaaatttaaaaattaaatctatacaatacaatttaaaaaataacattacccattgttagagggggtgtggaggagtgggtattgtcatgtgccactgggtcaaacattgtgtagggcaaattaacaatatcagatcctcacattttctgtacatttgaccttgaccttatcccaggcaaatacttgatggtatagtgaaggatatctttctcagcattacatatataatcaaaaataagaggtgacttaagtgcttcaagggaatttattaaaatggattattgatcagtcattaaaaatgaaagcatacaagactattaaatggtacagaatttctatcagaataagtgggaaaaacaagttacaagtaatatcatatgatttacttttagtgaaacttacatgcacttacacatttgtgtattatgtttatgtgtcatgcatacatataaaagtggaaggcggttcaacaaagtgctaattatcctcatgatttttattttttctttgatttttatgaacttacagtaaagaacaaagtactactttgaaggaagaaaaattattttttaataattcagcataaattacataggttatccaaagatagtaatatggtatttgatctgaacctagacttctgttctgttgatttgacacattttggtgtctttccttttatgttaaataagtaactatcatttacctacagcagaagaagaatataacttagcatttgagacttgataacatagagctgttgaatagttctgtaagatttgttagggaaccaaaaccaggcatgtgaggatggtgctggaagagaaaaggcgggaagggtttgcagtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgtcccttgacccttcactgtgtcttctactgattccccttagaactttcatttacccctggagcttcaaccatcatcttcaggtaaaactctagcaacaagtcatctttgcccgctgtgcatcatccttgctgccattgagagtttggtcttaaaatggtacttgcaattagaacacgttcactttgtcacaaaatctgacagacattggacatacttagaattcatatctggcttcctgagacagctgtcagattgtctaccaatggtctacccattgatgatggaacaagctccttgtatcagcctcaaataaaaatgatggaattaataaaagacgcttaccttaaggcacaaaggcctatgaatttcaaaaagcattgacagaaccgatccaaaaaatatgtagtttgtaaaaactctaatacaatccacactgaagtaaaaagcttaacttagaataatccaaatagtctttgtcagctggacagctaatcttggtgaacatggaagagtagacaataatgttaaggcattgtgtgagggttaaattgtttgcgaggtcggcattgctggggcttcggattcaaactgggccttgaaagagggggtaagaaaagtctatggggaactgatgggcacaaaggcagggtgtaagtgtttgttcttgggaaaatgatcagactaatctgattgaatagaagacgtttattggaaattaaaggaagataaagtagtgatagataatggaagaactgaaggtcaacaggggagtttatatgtgatggaagagaaaatcattatcactagggatgtagatgtaagaaaacgttaggtttggaagttataagacaagagaacttcaaagtttgtgggattctgtaaggtgggatgggaataagcaatattgttgagtacctgctgtgtgatctgtaaggcataagatgtcattattattttacagcaagctttggagtagatgtactagttcccattttatgcatagtgagatggaattttgagcagacatacttgtctaagtttggcagagtggctggaccaggattcatgcccagtgacatctgacttcaaagcacagtgaggatggagaatgttgagaccagttcttcattttacagtcaaggggatgggcccaggcctattcaaggttacaggaataggatgaaagcaatttctctgtaagagagagtggataggctgtgatctgcagagggtccaagttagaggctcttgttataaacagatgaggtatgccaaggaagttgggttcagcagtgtgataggagtgaaaaagaaggggtagagagcagctggacattcggggaaagtggtggtgactgttagtggaaggtaatgacgagagagatgacttgaaaacagttccgaggttttagtcccagggaactgccattaacagttttaggagaaaagccatgtgtgtgttatggagtggtctgagtaagtatgatagacattaaaaaatacataaaaatagagtggtatgcatgtgctgaattatgtttgtactaccaaacacacggaggaggagaacagaacagaaggtggaaagctatgagggatccagcgcttttctttgcagtggtggagagtcacgagagcaaatagctagcctttacctaaagcaaaagggactctttgcatgatatcttaggctcccttttattctggcctgcccctgcacccccagcaggaaagtggcttaactgtactttgatttccaaaatgcgtagcagtctctagtattgattcccctctcctgcagatctcaagcctaaaaatgagtattgttccattacatttccctcaaaaacatttctttttcctttcagaatgatggtcactatactggatggacttctgaactagtgaattactttcatcttttgatcacactaggaaattgtccacggagttgaaatatttattgcagtaatttctggccttacataattaagataacatatcgtttttttctttataactatcatgaagttgtcatgtttgtttcctttaactttgctttttagaggtacgaatctgttccctagtcttttatgctccaatgatctgttcagactgctcttgatctacaaatgtatgattgagaaaagacttttataggatgaaatatgagcaagctgttttactctgaagaataaaagtgaattgtattactctgcagattaagtcaataaataccccattttcataaacacaatatgcacagactagataatactagggaaacttgatacatcaaaaggagtattaagactgaaaaaaatggagatactcaatttattgcaggctttattcaataaacctagaaaatagagagtttaaatcaaaatctgttactctgtttctagagataatcaatgttaaaattgtactatattattttccaagtttttagaatatgtgcatgtgttgttgtgttagctttctctatttttgcaacttgagtaacatttattacatgcttgtgctgtgccaagctaaataccaagcattttatatatattaatttattctcataacccttggtacttttattatcctcatttacacacaggacaattgaagctcagagaaattagccaggcacagtggctcactcctgtaatgccagcactttaggaggccaaggcaggcagatcacttgaggtcagaagtttgagaccagcctggccaacatggcgaaaccccgtctctaataaaaatacaaaaattagctgggcgtggtggcacatgcctgtaatcccagctactagagaggctgaggcaggagaattgcttgaacctgggaggcagaggttgcattgtgctgagattgcaccattgcactctagcctgggtgacagagctagacttggtctcaagaaaaaaaaaaagaaagaaagaaagaaatgacttgcccatgttcacatagctggtaaacccacactggttcagaacttaaaccagtgagataccaaagcccatatcagtgggcttttttacatacttcttttccttaataaaatgcttatttcttttttctacagcatcattttaaatgacagcatagtattcagttatatggaaatgtaatggtttctctatcccatctccttttattagacatttatattgtttcttgttatttacttttagaaataacattgcagtgaacatctgtcatgcacatctatgattatttccttaggataaattgccagaagtggcattgctgaacaatgatagaatgtagcactcaggtgttgatgtattctgttaatttactctgttgatgtactgttttctcgaaaggccacaccagtttataatctcagtagcagtatattgaagtacctggtaactttcagctctcagcaacattggtagttagcaatttgaaaaaaaaaagtgtttgtttttaaaaaacattctaggtattcctttttaagtccatattatctcttgcctctaatgctgtagtagtcatgatctccttactggtttatttctatctagcacccactttgccactaacagaatcggatagggcacggactgtagagttagatgcctgggttcaaatcatgactgtgctgtgcctcaatttccccgtaagtaaaatgaaaatagtaataaaagccctctggtaaagtactttagaacagtgcctgacttttggtatgtgttcagtaattgttggcctactagtattgtcttccagaagtccctgcttatatgattaaaaaaacccaaggttatacttgtttttgaattgtaattattaccaaatcagtaaatcacagtagaaactaaagtgctgaccttgaagcattgttagtgttaacactgtgaccaacctgaagatcacaaattaccttccgtgactcagttgatgctgagaggtcagggatagagtaataacaggaataactagaatgttaaagtgctttatattaagctgccagtgcacttccacacacattatctcattcgatcctcacaacacagctgtgaaggagatggagcgggtattattaatctcatcttacagaggaggaaattgacttggaggattaagtggcttgctcactgatggttgtggaaatggtcagtggcagagctgaatgtgtactctgggccttctgactgtaaatacttactcttgatgcttcataacatcatgataagctaaggaggtgcaggtgtagatgcccaggtctggagatttgctggaaaagaaggagcaaaagaggatgccactgggaggagggagcagagttggggtaaggaaacttagatatactaaaagagagggaggtacccagcggggagagaggtggggaaggagtcataaagaaagggaaaaacagggggccaggacttccgtgactacagggctggctgaatagatcagggtggagggcttcatctttgagactgaaggaatgcgtcccctgagccaggaaggagggaggagatggagcaagtagacacaggtgatttgaaatagaaaggaacattaagagggctgaaggattgtggcctgaatgaagaaagaaggaagtatttatttctggagagtaaaagtggtaggtttggggttttagatttgagaaagggaaaccatttagagtatctgtgtgggaaatgggccaaggaattagaaatgcctgccagagacctctgcaggatgcaggaaggacccagataaaaacgtctgggctccaagtcgacagattctgtgaaccccttaggcatgctgaggatttccttgccagatgatgtaactatctgaggatgtttctttgtgagctcagtgctagacaggcacaggagcagtattaggatggaaacatttcttaattgcttgaggagtgaggaaaaaaacggcactctgcaataaccctcttgtttccaaataccaaagcagctgttgggctgtgctcctgtctaggtaccttttcctcaggagttaagtgccacatgatgatatttatggttgctttttagggggtacatggttttttaattagtgaagaccgagtagcaatagttttgttttgtgttctaatagcctttgttattatagtcagggaggtgaagtgaggagatgatagatgctttcctaatctgtgaaatgaggagttggactaggcaggtgctccccaaagtccctttctaacattaccattttctcatccaactccagtctacgctgcctcctctccatttcctcctttaccagacagtttagtgtgtctcaagttatattttatggtgctttagatatatatatgtatatttttgcttagagacttcatgcattattattagagacttcatgcagtatgtagtgactgtagaaaaatgaaagatgtatcgataaataaaagacctgttaaaaatatgtaactttaccaccattaaataaccactgtttatattcttccggagatttttttttttaggtgtgtatgcctaaataagattcttaaatacagaaatgcaccctgcttttctcagttgaaaattataaacctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagacagatgaacatcttttcatatgccatttatattcctttgtgagttttctgttcatatcctttgcccatttctccagaggggtatttgctatttttgttactgacttgcagcaacgagattttaaagatttaaaatttttaaatgtcttttattataaaagtatgttagttgttttgataatttctttgaatttttatactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataaggggatgtaaaggaattgatctagataagttagtttacttaggcctcagaacctggcctttaatcatctgtgcgcaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacgttttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgacttgagataggaattaaaattaatttctttcccaaatgaatagccacctgcaatttttgtagttcttgtttattagagagtccttactcaaagtatagtccttaagcactattatattgttttttctttcttctgtttgcttttctctccttgggtagtcctttgtgcaaaacgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatatggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttatattttgtaaaatgtcttaagatacaatgaaatggagaatccctgagtgtttttttgatttcctaaactctgatccacaattatagatgtgtctgaaggttcaaaaatattgaacgtgatttcagttgtttctagaatttaaaaaaattaataatttttaataatgacactttaaatgaggagaaggcttttaaaaccaaatataaaaatctggagagttcagattccctgtctctcctctttcaacctttaatgtataaaacaaatccttttgattcagccactgtgtattgataatggcttatttattacaatcagaggaattaaacaaagatatgtagatactttgtcatcttttcttattatagaaacagtttgattttaagaatttttattcagaacgcagattcgaaaagaaaaaaaagaatttttagaaaagttgccttttaatttaaatttcttgttttgtcctaataatcacattgaaatagccaaaacaaataatataaattaaaatgcaacgatggcccggcatggtggcacatgactgtagtcccagctactcaggaagctaaggccagcagattgcttgagcccaggagttcaagaccagttggggcaacatggtgagaccctgtctctacttttaaaatgtggtgattggtacctgttgagagaagggttaactgaaagttattcacatggcccagaaagtggctgaaaagtgctctttctggtgtgaatttctcttgctgtgaaagcactctgaaggggagacctaatgccattgcaggagcacttcagctccaaacttgagcgttgcaatcagaacaagaacccgaggaaaagcctgcaaaatgagcctgctgcgatatagggtgtgcttttggacagttatacataagaatttttttcttttttcttttttcttttgtttgagacagtgtctcactctgttgcccaggctagagagcagtggcgtgatcattgcttactgaagcctcaaattcctgggctcaagcagtcctcccacctcagtctcctgagtagctgggactgcaggaatgcaccaccacatctggctaatttattttttgtagaggtgaagtcttgctttgttgcccaggttggtctcaaactcctggactcaggtgatcctcctgcatggacctcccaaagtgctgggattataggcatgagccactgtgcccagcctcatgagaagatttatgatgatagatagaagaattattaatttccacagtttgacaaatgataacaaatagcttttacagtttgagcatcccctatcccaaacgcttgggactagaagtatttcggactttggacttttttgaatttgggaatatttgcatatacataatgaaattccttggggatgagacacaagtctaaataacaagttcgtttatgtttcatatacaccttatatacaaagactgaaggtaactttatacaatatttttaataattttgtgcatgaaataaagttttgaccgcattttggctgtaacctgtcacatgaggtcaggtgtgaaatttccacttttggtgtcatgtcagcattcaaaaagtgttggattttggagcatttctatttcagatttttggattaaggacgttcaacttgtatgccaaattagtaaatattttttgagttcctacccacatccctgtgtatgggctctagaagcagccatggtttagtttcctcacctgtaagggagggtgtagaacttcttttaatgtacatcactgtaggttaagttcgggtagagaaaagactaaaggcaaccaaggctggctgtcctctgagcccctatgctaagctgaactaggcttttgtttctggcaatggatcattttgctgtcacggagccagtgattatttaccacccctggttttgagtaggtttccttttcccctggcaatagctcttagagtgtttcacagagaggcaacgggattcagaagatgcccgtttacactggtaccactgtctcgttatgtcatggtaaagtaatgaagtccaccatcattactttaccagttccccattggtgttttggtcttccctatacattttttttaacttttatttatttttaatgagatgaaattcacataatataacaataggcagtttaataattgacaattcagatgtatttagtacattcataatattgtgtagctgccacctctctctagttccaaaacatttttgtcactacaaaagaaaaccccgtacccagtaatcagtaacacactattctctcctctctctcatccctgacaatcattaatctgctttcagtctctatgaatttacaattctagataccacatgtaaaataaatgttctcatacaatatgtgaccttttgtgtctggcttctttcacttagtatattcatccatgttgtaatgtcttagccattttatggctgaatagtccatggtacggatatatcataatttgtttatccattcatctgttgatagatttttgattttttccccaccttttaattcttatgaataaggctgctatgaacatgggtgtgtaagtacttgagtccctgttttcagttcttttaggttcatacttagaggtgtaattgctgggttatatggcaagtctgtgtaacctttttgcaaaactgttttccacagggccaaaccatttctagtcccaccaacaatgtacaaggttccaatttttccatatccttgcaaacatttattttccctttttaaaaaaattatagtcgtccttgtgggtataaagtagtattttattatggttttgatttatattttcctaatgattaatggtatttatctttccatgtacacattggccatttgtatatcttctttggagacatgtctgttgaagtcctttgcccatttaaaaattgttatttgttgttgacttgtaagagtgctttatatattctggatactagacccttaatagatatgtgatttgcacatagtttttctcatttttaaggttttctttttttttaatttttatttatttttttttagacagagtcttgctctgttgcccaggctggagtacagtggcaagatcttggctcactgcaacctctgtctcctgggttcaagtgattctcctgcctcagcctcctgggtagctgggattacaggcatgcatcaccacgcctggctaatttttttgtatttttagtagagatggggtttcaccgtgttggccaggctatcttgaactcttgacctcaggtgatccacccgcctcagcctcccaaaatgctgggattacaggtgtgagccaccacccctggcctccctatgttttcttctaagaagttatgcttttattttttatacttaggttgttaattcattttgagttaatttttcatatggtatggggtaggggcccaactttattcttttgtatgtagatatctagttttcccagcaccacttgctgaagagacagtatttccccatttgaatggtctttgtacccttgttaaaaatctattggccatatatgtgagattttatttctggactcttttttctattggtccatatatttatccctatactagtactacaccgtttttgattactgtagctttgtagtaagttttgaaattgagaagtgagagttcttcaacttttttcttttttttagtgttgttttggctatttggatccctttcagcttcatacgaatttaaggatctgttttttcatttctgcaaaaagggctgttggagttttgataaggagtacattgaatctgcagattatttggagtaatattgtcatcttaacaatattaagacttccaatccatgaatataggatgtatttccatttatttaggtcttattcttcagcagtgtcttgtaatttccagtgtgtaagtcttttgcctcctgtgttaaatttgttcctaggtttttttgttttgttttgttggttttcttttttttttttttttttttttttttttttgagacagtctcattctgttgcccaggctggagtgcggtggcacgacctcggctcactgcaacctcctcctcctgggttcaagcgattctcatgcctcagcctcctgagtagctgagattacaggcgcacaccactacgcccagctaattttttgtatttttaatagagatagagtcttgacgtgttggccagactggtctcggactcctgacctcaggtgatccgccctcctccatctcccaaagtgctagaattacgggcatgagccaccatgcccggccatccctaggtattttattctttatatgcaattataaatataattgttttcttaatttactttatgaatgatttgtatttattattattatttttttttttttttgagacggagtttcgcttttgtcacccaggctggagtgcaatggtgcgatcttggctcaccacagcctccacctcccagggtcaagcaattctcctgcctcagcctcctgagtagctgggattacaggcacacaccaccatgcttgactaattttttattgttagtagagacggggtttttccatgttggtcaggctggtcttgaactcctgacctcaggtgatctgcccatcccagcctcccaaagtgctgggattatagttgtgagccaccacacccggcaagaaatattatttttattttttaaaaaataatctctagtggttattttaaaattcaaggtaagaaccccactattcctccaaatattctgtagagtggtctctgttaagtttgatatacatccttctacatgttttccatgcatttatatacaaacatactttcttactgtgaataaagtcatatactttgtctaaattttaacttactattttacataattatagattgtgtctttctctgctagtttacttatttctcttaaatgctgcagagtaacccatcatactgatatgctacgtagctgacccttgaacatcatgggtccacttatatgcaggtccacgtgcaggtctgcttttatgcagatattttcaacccaacatggattgaaaatagagtacttgagggatgcaaaacttgcataaagagagaattgacttttcatatacgcaggttcttcagggctggctacagaacttcagtatgtgaggatttgggtatttgcaggcagtcatggaaccagtcctccttgtatatcgagggatgactgtactttgtttaaggctttattttaatgatcatttagtgtggtgttggtgttttatagtataaataatgcaacagttaacaattttatacccacatcaacgtatgtccatgtaagtctttaaggtaataagaattgctgaggcaaaaaaaattaccttaaatttttttaaagttttgtgttaggcataacacataatttactatcttaactgtttttttaattgcacaattcagtaatgttgtttacattcacattattgcgcaaccagtctctaaaactctttttcatctttcaaaacaaaagcgctatatctgttatacaacaactccccacccccctcttcccctggcagccattctactttctgtctctgtaattttgactattctaggtacctcataagtggaatcacacgctgtctgtctttttgtggctggcttattttacccagtgtaatgtcctcaagggtcatctatgttgtaacatgtgtccaaatttcattcctttctaaggctgaataatattccattgtagcatcacattgagtaattaaatgcttggaaagaaagaagaaaaagaagggtatgtctgactcttttcattcccatacaatgtggtaacatacgtaataatctaaatagaatataaataaataaaatgaagtccttttaggtatgtgtatgagctatataaacaggtatttttaaatgcattgtggatccaacttcatattagtaggtgaggaaacaactagtagcacataaatgcttcttgggcttcttgcacacttgccctccatacacctcacctcatgcccaacataactttcattatccctccacccattgctggcagtcatttttaaatagctttggattttatgccaaaagatcttctacttgttgacagattctgtgaatacccagtgttcgcttcttttgcactttccaagaaagatgagtttgggaatttgctaacatgttctaaagttaaagctttttgttctgggataactgaaaagtttagttatccaaaaggcagcccaccttcatttttcaggagggtcactgtgatgttctgtctttctgagtctcatgtctcatacctttctgtgctctgtcataattaactaaagcagaaggagggagatccttttgtaaaatgcccaaagaaaagaaagccagatggaagtgaggagtaagagtaaccacagttgctttcctcttccatcagtctttaaaaactttttattttgaaataatgttagatttagagaaatgttgcaaaggtagtacggggctcccatacccttcactcagtttctcctaatgttgttatcttacataaccatattgaactatcgttaatataattatcaaaattgggaatctaaattggtctaatacttccagctaaacaacagaccttactagcattctatccagttttccgctatcctttctttatgttccatgatccaatccaagatccacattgtattgagtagttctgactctttaaactcccacagtttgtgacagttccttgtcattccctgtcagttatttctggttagttattttgtggaatgactagatttggggctgtctgatgtttcctagtgtttacctttaagttatgcttttttttgttttgaaagaagaccacaaaagcaatgatgtatcttttttattgcctcataactggttacttgatgtcagtttcccttattgctagtgctattcgtgtggactcatcatggacagttacttcattctgtgggttataacccaatattatcatcattattttcttcttcaaattattctagctttggccactgggagctccttcaggctgactctgatgtccttttgacatgcttccatcttttttcaagtacttcctcacattatggcatcccctgatgctctaggctaatcttgtattttccttgccctacttttggaatcagtcacttccctaaggagcctgggtccttttactggacaatggtgtttagaaaccaatatctgagtaccagacgtgcacattgcaactggggtggctttttgtcttccatgagttttatggtgagctctttcctgtgaacatggttgtaccaggtctgaaactcgtttttaacacttctaggtagtcagtcactttgatgtaaagtcattttgatcacttaatgttgagttgttaaaatcaatgcacataccctgtagaaaaataggttctttatcaatggaatagattaactttttgtggaaaaatacttttacattgataggatagcattagcatccagacatttttgacattccttcaataactattcctgagtttctgactctcatttttagcccattccatttttatttattttattttattttattttttgagacggagtctcgctctgttgccaggctggtgtgcagtggtgtggtcttggctcactgcaacctcccgctcctgggttcaagcgactctcctgcctcagcctcccaagtagctgggactacaggcatgcaccaccatgcccagctaatttttgtatttttagtagagatgtggtttcaccatgttggccaggatggtctcaatctcttgacctcatgatccgcctgcctcagcctcccaaagtgctgggattataggtgtgagctgttgcacccggcccccattccatattttaatgagaatatcttttggttagttatagaggtaaatacctggatttacaatgtgtaactacagattcatcatcctataataaagtaactctttttgcataaacttttgataagttatttttgtccttataattttatgtgtgaagtctttacggtcagaggacattgacaaaatattttagattgaaagcctgttctccttgatgattcagtataacttcttttgactgcgcttttagttcttgcaaaatagatcttgtttagatgagattccagcatgactcctttgtaatttttcatatttttgctattacatctcaactcttgaagagctatttctgtgaaaaccaaacatgcagtcaaggcacattccacgtgtggctgatggggttatcatagttacaaatcatatttatccacagtgataattatcttccttagcgttttgttctacttcagagctcatttgtgggccttaccacctgtttcttacatatggggaaagagtctcttattctcttttggaatatagatctaagagtagatttatatcaggatttgaaagatgaatctttttcaaggatgtttttcctctggaccgtggcattgtgtaagaaatttccctactcatcccatccctggggcacattaatttggagatgatgttaaatgtgtcagagtgtggcacaaatctcaactggcagataaagcctagtattgaattgttttcagttcagaaacgtggctggctgactttgaccctgaatgtgtaaattatctttgcagcaataagaacttgaagtagctttgatagctaatcatagtatgataactcagccagaagaattcactaagagcagtttgtgtgtcttccatctaatgtaaaggttagtaatgtaagtcatattcttggtgcctttagacctagttatgcagagagacatcacattgacattcagtaattcttactcttaacagttccttaactctaaaatcatctttttccttacctttccctagttctagaacagcaaaatattttacttagattctatcattaattaatatactcgtttgaatttttctcttctaaaaaatgtaggccaggcatggtggctttacacctgtaatcccaggactttgggaggtcgaggcgggcggatcacctgaggtctggagtccgagaccagtctggccaatgtggcgaaacccaccccgtctctactaaaaatacaaaaattagctgggtgtggtggtgtgcgccatagtcccagctactctggaggctgaggcaggagaatcacttgaacccgggaggcagaggttgcagtgagccaagatcacgtcactgtattccagcttgggtgacagagcaagactctgtctcaaaaaaaaaaaaaaaaaagtaaaattattttggccttaccatgcttggtttctttgtctttgttttttcattcactttatgtttggggaggagaatggagtgtcagtgatttcagcaaaaagttggggtaccagttcataataaattagtgtctaagattaatgttacagctgatattcaaagtaccaaatacgttattgttctgattattctggtccttaaatttgtctctttcctggagacgtggtaaacaataatgatgattctaataatgaccatttattgaatgagcactatgtgtcagacattgtactggtgatgtggtttggctgtgtgtccctacccaaatctcatctcaaattgtaatccccacgtgttgagggagggacctgatgggaggtgattggatcatgaggatggtttaccccatgctgtcctcctgatagcgagggagttctcatgagatctaatggtttaaaagtgtttggcagtttcacccttgcacccatgtctctctctgtctctcctgctgtcatgtgaagaagaggtccttgcctccccttggccttccaccgtgattataagtttcctggccgggtgcagtggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggcaggagaatcgattgaacctgacagatggaggttacagtgagccaagattgtgccactgcacttcagcctgtgtaacagagtgagactctctcaaaaaataatgataatagtaagtttcctaaggcttccccagccatgcagaactgtgagtcaattaaaccttttttcttcataaattgctcagtctcaggtagttctttatagcagtgtgaaaatggactaatgcaattgggcaatgtctgacagtttgcaaataccatctcatttgtttttaatagaaacctcctgctgagagtggtggctcacgcctgtaatcccagctctttgggaggccgaggcaggcagatcacatggtcaggagtttgagaccagcctgaccaacatgatgaaacctgtctctactaaaaatagaaaaattagctgggtgtggtggtacgcgcctgtaatcccagctacttaggagactgaggcaggagaatcacttgaacgtgggaggcagaggttgcagtgagcccagattgaaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaaacaggcagagagcatcaggaagggcttcctggaggagaaagtgcgtacactcagtctttaagagcacgtgggaggaaaaaccagtgaagtcctcctgctgtagacagaatgatcagcctgggcaaaggtgtagaggggtaagagagcgttaaacatgaggcagctgtgtaatattgtttcctgtaatctcttctgtacaggtggagaggtagcaagagacccaaatgatgaatggctgtgagtgccatgccatagcaaaattctgggttttaaaagagaataagcatgatcaggctggggatgttgaggaggggaaagaagggggatagagatggagaccacccagtggcccgctctccctcagtgctttggattatggggaaatgaacagagagccactgtgcccagattttattatgggttgagcagtgatcaagatgggagagagaaatggtaatgggactaactggcccatacaccagatggcatttgaggggaaggccgggtctgtgttgtcagggggccctgtgttctgactcccttcccattagaataggtggtgattaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggggcggtggctcacacctgaaatcccagcactttgggaggccgaggtgggcaaatcacctgaggtcaggaattcgagactagcctgactaacatggtgaaaccccgtctctactaaaaatacaaaattagccgggtgtggtggtgcatgcctgtaatctcagctactcaggaggttgagacaggagaatcacttgaacccaggaggtggaggttgcagtgagctgagatcccgccattgtactccagtctgggcaacaacagcaaaactctgtctcagaaaaaaaatatatgtgtgtgttttataaacctataaaatatgtgtgtgtgtgtgtgtatatatttatatatttatatatattacatatatatatatgtttagaaaataaaagatgcagtatgtcagtgctttcttatgacagttgcagctacaaaggaagattaaagctttttaaaaagtagaatttttatctgtttgtggagaggactgaaaccagtaagctcttgaaatgttttcatcctctcatcaaatatatatggacctgccatatgccaggtactgttcttactactgtggaaatagcagaaaggaaaaacaaagtccctgctctcagaaggtttagaatgagataaggcaggctactgagttggcttaaaaactaagaggaaactagtgaagtgtagttgcccgttcacatttttatttttttaagtattttatgcccacggaaaactgtgggactgggacttgaattctaattttatgttttcttgggttattctttaaaacagggtcttagactagtaattaatacagtgtcactctctttcaccttcctcaattcctttgcatgcttgttaggtcattcagagtggcactaaggtaaactttggcatatcaaaatccacttgaaagcagatggttagcaaggggcagtgacttatgcctgtaatcccagcattttgggaggccaaggcgggtggatcacttgaggtcagaagttcaagaccagcctggccaatatggtgagaacccgtctctactataaatacaaaaattagctggtgtggcgacgcacacctgtagtcccagctatttgggacggtgaggcaggagaatcgcttgaatccgggaagcagaggttgcagtgagccaagatcgtgccattgcactccagcctgggcgttacagcaagactccatctcaaaaaaaaaaaaaaaaaaaaaaaggagatggctatgcttgttaaacactgtttcagttgagtacctctcctgtgggcttgttggttcttgtgcagattcctgctcctgcccaagtccaggactagctgcacatacctgcacatgtgcctcacccagtccaggacggctagccttgttctcttcacccagcccagcagcagagtgctaggaaactttgctggcagggctgtaagaacctctgtagtttcttcccatttccttgttctcctaacttactatgctgggaggaaataatatggtgtggtaacgattttaggcaaagaaaaaaagcgccgaaatggatgtggtggtaaaattaggccaatcttttggaagcaccttagcaacctcctttcatgttcttggtacctttacctggttgtattgtaatgttcatttttccttgtgaacatctctctgtgtgtgtgtatgtgtataatttatctagtaccatggaatctttgaaggaaagactaaaaaactttcagaattattattattattattattattttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgaaaactttcagaattataacaataagtttcatttgttgtatagcacattctacgtgaccatagaccaactctcctttatcaatatttgtgtattctcttaaagagctaaaagaaatcattttttaaaaattctttatatctaatgttggccaatgttacctataagaaaagatcattgtttcagagcatgtgagatgaagatgattgactttagggcatttacatgtgggaactgtcaaggtagttgaagtttacaagagtgggctctctctctagtcacttcgggaggaatgccatcatcaggacatcatcacgactgactgatttggtcagtctgtctttcatcaagtcagggagataaacagaattgaaaaattgttcacaaaggttgtcagttattagggtgtggctgacgaaccacacctgaagagctacctagatgaaggcaactcacagagttacttaacaacctccaccccagttgatggtccagagtgtttccaagggaggtgaactaagccaatgttgagactgagtgggataaggccatggtgacatgcataatagatgcattcatacacattgcttcaatagagcattttcttggatggaagcatgggaaataacacatgggcgtatactcacgcttgttgttagctttcggggtcactgctgatatccttccttgttcagttaccctttgggacttgaactcctgcaagatcgttgaaaatcttcatgttctcagaactcaaagggaagaagacttgacccctaacccttcagaaagctggctgaaaaaaaaaaagattgtccataaatagcaattggctttacctagtattatttaccacattattaaactgctaattgcagtggtgtttttataatgccactatattattttaatttagaaaacattttataagtttattgtttgtaaattaaatagatttgcttaacagttctttgggaattccttaaactttattgctagctacaagtcctttttaaatagaatcaataggctgggcatcgtggctcacgcctgtaatcccagcactttgggaggccgaggagggcggatcacctgaggtcaggagttcaaaaccagcctggccaacatggtgaaaccccatctctactaaaaatacaaaaaattagctgggtgtggtggcgtgcacccttagtcccggctactcaaagggctgagacaggagaatcatttgaaccccaggaggtggaggttgcaatgagctgagatcgctccactgtactccagcctgggtgacaagagtgagacgctgtcccaaaaaataaataaataaaataaaataatgaatagactcaatagacattgatcctgctaacatattttgccttttaatctattggtacttcttttattccctttaaagttaattctaaataaaggagaagtatcttaatttggttaatatcatagtttggaactatggcaaaattattttttctcaggctactttctagtaagtattttatatttattcactaaagaaaatttttaaaatttcaaattacgtagaattgtaccactctcacatagaaatgtttttatctttcttatacatatatttatgtggtttgatttttatttggaatgcttgttttacttgaggtgtcaggactttccactcatttatgaagcctttacaattataatgataaatactgttacattaatgtacaataatttataaaactgactttctcatgtttaaaatttagatcgtgtctaattctttgctactttaagtatcattgcagtgaaatcttcaggccataataagttacttccttgcgataagttcacaggaataactagattaaaggtatgaatacattttaatttggttgaacacttacgtttatcaaaaactctttacaaaagtaacacaattatcctaataaattagaatattagaagtatataagatgaaaaaacattctcactgaacttcagtcctgctctccaaagtgaaccatgatgagaccttaagcaaatgttatatataatgagaaaagatagtcctgaagaattgagtgatatggaagtgataatggtgtactatatgggtgaaaaaataaagtactggtttagatacatgatttaagaaatagaatcctgacagttccctctgtggataagccatagaggtgtccagtgttggtttaatatagcagctggtttgaccgagtaccctctgctgcgtcaggtaatgttaaatgatgtccatgcccccttgactctgatcaagacatggctacaacctgcagtttccagctttcctgggtttaagggccattgaagaatccttgtagataagagaagaattgtacattccaggaactggaggcatagctagccttggaaagctcggagggttagttgagacagctttagacttgcacatctgtgacctgagtatctttgagacttgatttcatcttctagacccagaggcagagatcatgtttgtggttatttttctgggaactgagactgggcaaagggaaagaggccagtacgcaagagtgctgtttataaatggttaacatcgtccccagtcccgtagaagaagaatgaaatggtattctcctgtttggtggttttatttgattgtttttgaattctttgtctctgacagaaggcatcttctgtatcctttatgttgtcactcactttattactctggcattattataattaggttaccttatcactccacctgccagccctatctccatccccaagacctgaagggacggttggcttgacatgtgaggaggttttttggccttcagagatgtcgctgtcagccccctgagttccatttgttagtattgggtccagcccacagctttctactaaaaacaacaggcaaactaaagaatcttttagtaagtcacagacaattgtcactgaaccaagagcccagcccacggggccagttcctcaccgactctatgccttaatttccaatgtgtaagcttggatgactacacttatctccaggattcagtgtaggacatagaaaaaagtacaggactcaagtaatgattgaacttggaataaaaaccttaaggcccatgtcctctgtctctcatgcttttcagatgtgtcttagtgcctgctccttgcacagaagctgaatccaaacaagccactgaggaagttacatttcacttcacttcttaataacataggtatgtcgatcccattagataggagtgtgtctaaaattcagaacctttgacactaattatctgactgtcaaatgacagtgtcattctattttgcaggcatttttgatagtttatcttcccagtaatatttttgtaatcttcatcaccttgaccatctaactcttttttttggagacaaagtctttctctgttgcccaggctggagtgcagcggtgcagtctcagctcactgcaacctccgcctcccgggttcaaccgattttcctgcctcagcctcctgagtagctgggattacaggcgcatgccaccacacccggctaattttttgtatgtttagtagagatggggtttcaccgtgttagccaggatggtctcgatctcctgaccttgtgatccgccagtctcggcctcccagggtgctgggattacaggcgtgagccaccgcgcccggccgaccatctaactcttatgtgcccttgcctgtacatataaaagtacatttaaaaataggattggctttcatttgcataatgaacacacatattacccatagtacctcccacacaaagccacctatgcctcttaaattgcactttgttaataggaaactatctgttgttttgtgcttttggcagctgtagagaaaatacacaaagccaggtgttgtggctcttgggtaagactgagaatgtgatttttgcaatctgtgtttttttaatagccagttattggagataagaaagagaaattcagtacaaagtctaagatgtcccagtgatgcactctgactgggtgtcattatctcaacaggaatgaatgtagttcaacagtatgtaggcccggtttcttagacatgatgtctgctgaaatggtgataaggtatcccacattatcggtgtttttttgaagacagcctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtcccttcagctgaagaagctgcttagaaatttaagccggacatctcaggcggccatactggaatggaatgtggaaaaggtagcagttatatgtgagcaatacctttgactgtgacactctttcgaaccccagtttagaccagcagcagctctcctaatggggagtcaagaagtagtaagagaccctaagagtcatataagacacaaatcacctttgcctgtgatatttgccatacatatgcctatggttacatgcagaggatcccaacaggagcatcatacacacagcaaataacactaatgtgttttatttatatgtaccaaattaaaggggcatacaaaataaaatttttaaatgagtgggtgaagatattgggacagaaggaagatatcaagaggaggaaatatggagtaaagatagaggtagcatgtactgtaaaagatcttgtaagtagaccagaataggccagtaatttggctccatgcttcctagcagccaaggcaaagaagtaattgtgaccagatacatagttcacagcatctttaagattcagtaagctagcaactcaagaaaagcacaagtagtcaccatatagggacaagtggaccatgctgtgaacagcacactagatagcaagtacagctgtaacaatcgttgctggagatagagcagagcttcagtcctttatgacaagcttgtccaacccatggcccacaggctgcatgtggcccaggacagctttgaatgcagcccaacacaaatttgtaaacttcttaaaacatgagatttttttaaagctcataagctatcattagtgttagtgtattttatttgtggcccaagacaattcttctagtgtggcccagggaagccaaaacgttggactcccctgctgtatggaaaatcgaatttgtttacattctcctgttgtattcatttttgaaattttgctaattcctaaaaggaatccacagagagcaaactctctattactaacttttttcctcttctcaatgtaaattaagtagtatttcaaatgagattaaaaacaggatacttcttgaactttactttaaaaatacaggttcatgagccccttaagttttgtgactttctgttgtaaaaaagactgtattcactagatggcagtgtcaccagccttttgggaagttaaatatgagtgtgactgtcctaagtactaaacatgggtaaaagtaggaagaccatttaactgagcataaaggatctcatttctgcgccctacaggaaagagtagttctcctttttctcctcccctcttatttgaggccgggaagaaggcgctgtgcatagcgctccaagcatctctgggtggcactggagggccatttttcacaaggagcaagtcggccagcagagtgctcagttcttggtcatgccagtggctgcagggtttccagccacttgtccttgcttctttgtttctgaactttcagtccggggcaggagttactgacaagagttcacaaaccagctgtgagataatggtgtattgataaggtacaaaagtgtgtttagcagatggggataatttttcgaccctcagtgtttgtttaaattgtttctagcatgaaagcaatatgatctctctcaggaaatgagattgttttctctattcaggtaataggatcttttacccatttccatctttgaggagtgattatatacttctgcagtttttttaaatgaaaaagatttatttttaaatcatactggcataaagttaatggtattttgttaaattttaggatttttacagcatatcttggctgacactgatcttggtcctatcctagtggcaatctcttaacagttgtgctgctggtgttatgagtaggacagttcctcattgtgtgggactgtctcgtgtgcggcagggtattctgcattcctggcccttgcccactaaatgccggaagtgcccctcagacatgactgcccagtaacactcccatgcatttccgtgtgcctcctggggtggggccagtactctctagtgttgaaaactgctgggctagagattttggtgtaggttgtgggccttgtggatttagtgaacatgatcttttaaagaaatgtatataaatgtactttatatttttaaaaaatcactacagcccatcaccttaaacttctgctcattcatatttatatatgtattctgattgtgattactcctacatacaattcttaatatagtacaaaattgtacatatataattttatggtacccatcccccccctgccctttttttgagacagggtctcaggctggagtgcagtgatgcaatcatggctcactgcagcctccgtttcctgggcccaagcaattctcttactcagccttccgagtagctggtaccaaaggtgtgcgccaccatacccagctaatttttaattttttgtagagggtctccctgtgttgcccagactggtcctgaactcctggcctcaagcaagtcctcctgcattggccttccaaagtgctgggattatagtcttgagctaccgcgcctggcatagtatcatctttttgataccaacatactataaatatattttattgcattttatttgaaactgttaatagacacataatttgctgatgaattgtattctttgctcttttagtccatctggcatcatatgctcttcctttttgctagaattccctctttttttctttctacagaagtatcactgggtgggagaaagccttacctgtgatggtttgagtacccacattttaaaattatgctagttaagaagagggggaataatgttgtttcttttctctttttcttatcaaatagactaaaaaggctactcaagggctggaatttgattcccacttgttcttgtggtacctagcacagagtcagtcccatagtatatcctttaggtaaagacttaattaattggtgtgctttcagtttattttccctggttggtctttgcatttgtccagttaacaccagcttctggatattagatcaccataaagtccaagacatgaagaacaaatgttatatattctctttgacatttaaagacagaagatagtggtagaggagatcccaagtgatacctaacctagctaaagacccatgaggaatgaaagaacgaacagggaaaacaactgctgaatccaggtggaaaaatgctggcctacttctggtccttggtatgccaggatccaaaggtggtgccagctgatagcatatgttcaacagctgtgttgatgccatttgcctgcccagacaagcctcttgaggcatgaaagcctaaggaaggtttctcatattaaggatcaacagggactcttctgtatccgtcctaccagtgtcacctccccacccagcatcagccgagcaccacatccactgaagctcaataaagaaatgtttaatgctgaagagtttcaatcaacaagatgaaattttcaggtttaggtaaacttaggaactggcttgggttactagacttccaaattttatccggtcctaccttattgcatgacataaccgtgaggactaaagtgaaggcttttcagcagtcacttcagtgagtcctcagcatttaggtgatactgtatcaactcgtgtctgaagcaacttggatttaagatagtagatcttgtgctgattattagaatggacatcctgaacaccacttaaattaccatcaaactgcatagccagatctttaatttacgaaacctctattttgtcacttctccaagctgtcatttaagctaaaagctgctgtctttacacatataaatcaaagaaatatttcatttatattcacttgatacctaccaaatttcaccactggaatttctgaatactttatatcctctatccttccatccaggcttggctttactaagtgtcctttctaagccactcattatcaatcaagatagtaattattctgcaagaccccaaatctcagtggctttcaacaacacacactgatttttttactcatatgctacacgtccattatttgtcagctgcagctgtgttcagtgttgacctcaacctgtgatggagcagcctctgcttatgtcgctgctgttctttatagcagaggaaggaaagaaagcaaggcaaagttccacactagcccttaaaacttcttcctggaagtgagacatggtatttctgctaccacttcattggttaaagcaagtcacaatgccacacccgagttgagtgagggtggggatatgtgattcttccttaggaaggagcaggaaattttggtgaatagtaatgtaatctaccacatgtttaaaatgcagtcccttctctagaagatctcagtagtctaagagagaataatttttttttaatatactaccgtaagtgaatgttaggtcagttaggtcgatttttttttcattcttgcaaggaatcattatgtctaataaaatataataaagagtttatggtatatttgaactgtccttaatgttattttactgagtccagttcttttggcagtggtttagtttctttaacaatctgtattctacaacttcactcgttgccttccttgtttaacatttatttttcaaaaccagacatgtcttttgtcttcaaaggataaatggaattggttaggagaaggattggggaggaggggggttgtggcaaatgtctaaaacctatgttttattcccttattttctcaaaaatgttagctcatgttcacacgggtttatctgtttagtctaagaagtagttacttttgctgtctggccaaagaggttcaggaccctggagctttgttctttgggaccctgaaggcagcctggcaggcagagcccagtatcacctttacagctacttgatggtgatcaagagccagctgctcttctttcacctggctgttgggggaggcacaccaatatgggtgggcaggaaaagttacttcccaggctgaaattttcccaccgtaaacttaggctgataggctgacagtctgcacctctcttcctcagcagacattccgatcagcaggccagtttgtgacgcgtgcatgtgcacacttcagattgcttcttccactttcctctttcctgctcaggtttctcataggagtaggctccatgtaagacttctgtcttttgtgaaaaagaaagcacgtatttatagaatggaatttcttactgaaagagggtgcgggcagaatggaggatgacatgaatcctgactcagtaacatttatggaaccactctctggatgccacacttactgtgggcagttaccaaaaaaatcagtttggcctacctgcctcctaatataatttaccctgcacacaaggcagtatcttgaaggttatttcagtagtacccacggaattctgcttcctttaggtaaggaaaagtattcccaagaacaaaatatacaggttaaagcccatgtaatataaaattatggcattcattgaagaaaatacaggctattctaattccagatcacatttatttatttatttacgagacagagtctcgccctgtcacacaggctaaagtgcagtggcgtgatctcagctcactgcaacctccacctgctggttcaagcaattctcctgcctcagcctcccgagtagctgggactacaggcacacgccaccacacccagttaatttttgtatttttactagagacagggtttcaccatatcggccaggctggtctgaaactcctgacctgaagtgatctgcccacctcagcctcccaaagtgcttagattacagtcgtgagctaccatgcctggccccagattacatttttaaaatgaagaaacagatattttctcttagtcaaaatacttatcggaacaattttttttaaagcaaagattgcatcatttaaaaaaacatattcactcctaggcatctgaatcactgcttcacatgcacagtagacattcgtgaaattatttttttaaatgatgatgaatgccagggcttgctttttttaaaaaaaagtctccaaccacaacatccaaactggtcatttgggaagtgatgcttccattcagtaagaaagctcctgcacactgggtgaacaggcggtgttttctcctctcatcgctgacatttaatacctgtcttgaggcaaaattgtctccaccttattaatccatggctcctcacgagccttaaaacagagaataaaacttgtcaaagaagaaaaatagaaaattagagaaaataacctcactacttattttcaggcaccttgtgacttaagaaaatgtttttaaatgtggactctacattttatgaacttaaatttagtgtctgttggtcaaaatccacaggacctttaggagagaaaatggccataactaagtacaagcctctctttttaaatgcttacccaggtcagttaaaagcttccttgtagttctgaatcctcagttcttgctttacagccaatacttaaaaggaacaggggagagctacagtgcttttgaatttcagagaggcctcttatttgtgcctcaagaatagtttgtataaatgttatatttcaagccacacagtacttaaaaccatcacactgtttagtttatctagttgggtagaagagggggcaagagaacaaagcagtattaaattagggcagcagcatcagggacaggctgatgtgagagcaccttctttcttgggatgggtagagtataattgtccctttgcctatcgtcagatttgggtggcccagttgctttaaattttgaaaacatgggagtattaacgcaaagaagagccaacattagttcagaatagctgaattcatcattcttttggaaccagttttgctactgtataatgataatagctcttcagcattcatctagtgagtgataaagataagtgatgatccacaagaaagtttacctttgacttgtgggtgctcacggactgcagaatgcagatgttcgtagatcagccgtactgtaattttcaaggatttaatatgcaatacattcctatattaagatgttgaaacattaaaatattaataatttgcaatgatttttaaatactttaaacaggctcttccactggtgagattgtttttccaagcagagttagctagtttaaattctttcgttgtggctgggtgcagtgactcacgcttgtaatcccagcattttgggagtctgaggcgagcagatcacctgaagtcaggagttcgagaccagcctggccaacatggcaaaaccctgtgtctactaaaaataagaaaattagcctagtgtggtggtgtgcgcctgtaatcccagctgctagggaggctgaggcaggagaatcgcttgaacctcggaggcagaggttgagccaagatcacaccactgcactccagcctgggcaacagagcaagactcccatctaaaaaaaaaaaaaattgttttgttgtattctcagttgtctatttcaggtctaggcaggcaagaaaactttgtcaggtacactggtgtcttccaaaatgtgcatcgtaccctctattactcagtgtcattaatcacatccattcctttcccaccctgtcttggaataggacattaactcttcaacgatctgccccctaaataaaacctgctttcttgggccatagtaaacaacacgtaattctttgcgagaaaagcaaaatagtgataattataatttttttttttggaacggagtctcgcactgtcacccgggctggagaacaatgaatggcgtgatttcggctcacggcaacctacacctcccaggttcaagcgattctcctgcctctgcctcctgagtagctgggattacgggcgcctgccaccacacccggctaattttttggtatttttttagtagagatggggtttcactatgttggccaggctggtctcaaatgcctgacctcatgatccagctgccttggcttcccagagtgctgggattacaggcgtgagccaacttttaaaaattaaaaaaatttttaaaaaccaactttttaaattttcaaaaaccaattttaaaaaccaatttttaaaaagccaacttttaaaaatttaatattggagcataatagaattcagcaatataagatttgattgggaataagaaataacatctcttttaaaaatgactacagccctcttaacaattttactcttaaccaattttggggtaccagtttactaattgatcaaattccagattggaaattagtcatcatttgattaaccagagttaagcctcttgaatcaaattctctaatttattatctcccatctgatctaaattcttttttaggggataaattgccaaaacgctttcagaatgcccagtactagaaatctaagctattcaattcagtctcttctctgttttcaggctcctttcctgaccctttggagaacctaatatatttagctaaaaatttttctttggggcctcacctaataaaggtaaatagaaaactgatagctatcacataacatacatattggttaataattgcaaccaaaagtaaattaataattttgagctatttatattagctctgccaaaattacatcattaaatttggccttatgaagcattgctgactgtagtaaaaacaagtgtgagcaaagtcttcatatgcactgagtctggtttcagttccacgtaatactgacttggcaagtgtggaaattctcatgtcatcattaccaaaaaaaagtgagttcacacagggatttctgatcaagtgacccattactgcgggaaaaaaccacacatacaaaagcctttgaccccagtaattttgtattggtatatttaccctgatcttaaactgcaaggaatgtccgcaattagagtttttctttgttttctaagtctgaaacttgataatccatttctgccttcccatgacgagtggacattcctccagccagtggtgagttcctctttccttcgctctcagcaagagcatgggttgccctcccatctcgtaagcagagcctaccacaaacgcagctcaaatctcagtttccagccctgcttactcactcgcttgttcctgaatccccacattacccatcatggcatcttactctgtagacttcacatgtgaactttgccctcgccggtggaaggggtacagtccagatgggagatgaaatccaaatgctccaccaaagggctttggtttgttctggggagccctggtgctgccgaagcctcttgggaaggaaggagggaagaggagaagaaaagatactaagtttggttttcattaaaaatttttccaggttttctttaaactgataggttcagggtctttttcatacaacagtctacttttagagcttttgttcgtttgttgtgtcatgggaatttataagggatggaaggaaaagggggacaaggaatggtctaatttcggtcagtagaagaatacctgaaacctgtttaaatttatttggaactaatgacttctacttttagtatccataaaagacttcccttggagcacaaagaagttaataatctgtgtatattgtcacttcatgctcttcttaagcgctgtgtgttggggcactgctctaggtgtggtgaaagactgctacaggataaataagtcatggtcactgccctggaaagaagcttaaaatccagtgggagtaaatgataaatgcataatgacctaaatgtcagatggatctagtacgtacctggaggattgcatagaagcatcctgacaagggtgccaagaatacgcaatgggggaaaggacagtctcttcgaagaatactgttgggaaaactggatatccacctgccaaaaaataaaattggacccttaacaccatatacaaaaatcaacttgaaatggattaagacttaactgtaagaggccgggtgcagtggctcatgcctgtaatcccagcactttgggaggctgaggctggcggatcacaaggtcaggagtttgagaccagcctggccaacatagtgaaaccccatctttactaaaaatacaaaaaatgagccaggcgtggtggcagcacctgtaatcccagctaatcgggaggctgaggcaggagaatggcttgaacctgggaggcggaggttgcagtgagctgagatcatgccattgcactccagcctgggtgacagaccgagactccatctcaaaaaaaaagaaaagaaagacttaatggtaaggcctgaaaccatataatttctagaagaaaacacaggggaaaaaagcttcttgacattggccttggcaatgattttgttgctgttacctcaaagcacaggcaacaaaagcaaaaacatacaagtgggactacatcaagccaaaaagcttctgcacggcaaaggaaacaaccaacaaaatgaaaaggtaacatacaggctgggagagaatgtctacaaaccatatatctggtaaaaggtcaatgtccataatatacgagaaactcgtacaactcaatactaaaataaaaaaaaaagtggaggtggggcaaaggaccttaatagacacttttccaaagaagacacacaaatagccaacaggtaaatgaaaagatgcttgccaggtacggtggctcatgcctgtaatctcaccattttgggaagccgaggcaggtggattgcttgagtccaggagttccagaccaacctggacaacatggtgaacccctgtctctacaagaaatacaaaaattagctaggcgtggtggcatgcacctatagtctcagttacccattagactgaggtgaggaggctgaggcaggaggatcacctgaacccgaagaggtcgagactgcattgagccaagatcatgccactgccctccagcctgggcaacagagtgagattgtgtctcaaaaaaaaaaaagaaaaagaaaaaaaaaagaaaaatggtgcttgacatcactaatcattagagaaatgcaaatcaaaaccacaatgagatattatctcacatttgttaggatgcctgttatcaaaaagacaaaatataacaagttttgacaaggatatggaggaaagggaacccttgtacgctattagggtgaaaattggtacagccattatggacattggtatggaagttttgtaaaaatcaactatatgatccagcagtcccacttgtggatatatgtttaaaagacatcaaattagtatgtcaaagagatatcttcacttccatatttatttcagcattactcacaatagcaaagatatggaaacaacccaagtgccatttatcttaggaatggttaaagaaaatgtggtatatatatacaggatagaataatatttagccataaaaataaggaaagcctgccatttgcaacaacatggatgaacctggaggacattatgctaagtggaataatccagacacagaaaaacaaatactgtatgatctcagttatatgtagaatataaaaacgttgaatccacaagccaagagtagaatggtgattgtcagggtctggggcatgggagaaacggtgagatgctggtcaaagggtacaagctttcatttataagatgaatatgttctggagattagggagcgtccttagtcttttccctctccatgcagagggtaactatgtgtgatgacagatgtgttgattaatttgattatgggaatcaatatgcaatctatatttatatcaaataatcacattgtatactttgaatacgtataatttctattaattattcctcaataaaattaggaaaatcagaagcatcctaaaagttgcattaaaaacaatgatgaaaacaggccgggtgtggtggctcatgcctgtaatcccagcactttgagaggctgaggtgggtgatcacttgagatcaggagtttgagaccagcctggccaacatagtgaaaccccatctctactaaaaatacaaaaattagtcgggcgtagtcattcctgtagtcccagctactcgggaggctgaggcaggagaatcacttgaacctgggaggtggagggtgcagtgagctaagatcacgccactgtaccccagcctgggtgacagagcgagactctgtctcaaaaaacaaacaaaaacaatatcccctttaaaaacgcaatgaaaaaaatagctgccttaccaagccaccagtgagagcccatctctgaggaaaaggggtgtgcagccggacaggcttcagtttaaaagcttaaaccttgacttggacttactttatgccctgagcaagctatttaacttttttgttccttaatttctaaattatgaaatggcagtggaatgaaatggaagatgaaattgtgccttgttcgatgccctggggtctgaaaggtgctcctaagggtgtacagcagttagcaccgttagcgtcctgggcaaacccacagcccgcagatctcttatttggcagcgaattcctgcagatcagctctaagagccagatttcctcatggaggaaaagactgctactgtcacgggaaagatttgtttaaacatattttttagtacagttttataagtccttatcaagtagggccagcccccagataaaaaccgttaagtatttatctgtaagccagaggttgagaataggaaacatttgaatctttaagaacttgagtccaacaaaaatactggctaacagcctgactgaggtgaaataaaccttgtttccagttttccagaaaaattgtttattactgggcaaatcttgggcctccaagattgcctatatttttgtttttcttttctcttaatctacaggaaacttctgggttgggccttctcatagttatccgttgttaaaagttctatatttctacaaaccttcttgtgcgaggagtatctggaaaaaaaaaacaacattgagatcactctttaaaaattagtgttttagacaggtttctggttttctctgctttgttaactgaaacagcccccatagaaacattctgaaagacttaatcaaacaagtattcagaataaaatgaatgggaagaagttttgagtctccttgatcaaacatggacctgtgctttaaaaagctgagcccctgagtttgttgcactgtgtacttaaagtctgtgacagtttagcctctttctaggctgcccatatctctcaccactcggttcatttcccggttttaaccactccccacggtccccagatgatcattttcatcctgagcctcttattcccaccttcagtcacttcagaaactcccctgcactccattcaactttctggacctcccctttaatgtttgccatttgtgcattctacagctcggtgcacttgttttctgacctcaagagtcaggagaggagctatcccagcttcaattcctcatcaataaggtacagaaaatactctctaggattactgaagaaatgaaataagcaactgtattttaagtattttatgtactgtaaaagcattgtgcgtccgggtgcagtggttcatgcctgtaatcccagcactttaggaggccgaggcaggcagatcatctgaggtcgggagtgactggccaacatggtgaaaccccatttctactaaaaataaaaaagttagccaggcgtggtggtacatgcctgtagtcccagctactcggaaggctgaggcgggagaattgcttgaattcaggaggcagaggttgcagtgagccgggtgacagagcgagactccatctcaaaaaggaaacaaaaaaaagctgtgccaataaaattatacttattattctagatacaaatattctgaatgctcctttagtcagattctgtgttttctgttttgtttttgtaattttcacttaggaggaggctgtacataaatcaagcccttagtaaatccttatttagtgaataaataaatactgccaacatctggccccagccctatttggcctcaaatttctgagggctggttaccactattgctgaaaatagaaaaggagaaacaaaaaacaaaacccaccaattcaggacagaatatatttgtgcttaaacaagcacacagtactctcacatccaccctcggtctccctgaaactcagacctgcaaaactaggatacaagctgtaatgacatgatgctttcacaatagcagattgaagttagactccagaagacagctttacagtgtgttaaaccagatagaagacaggcggctgctattggtgttttacactggtgtacatcggtgcttctcagtctcttcacattctaactcattccttttggtgttctgtgtagctattttggtctttatttcatatttatttgatttgctcttttcttgtaccctttattccaagggggaaaaaaaggtgggggttggacaacagagaatgaacagcacagaattcctttccttaaatactgccatcctgggaaatctagaatcatgaaatgtaagatacagattgtgccctagatcctcctgtcctactcttcattttatggacaagtccatccagaaacctgtgatggatgagggcagagcctggaagaaccccagtctccattccctcctccttctccctaaaccacaaagcctgatttgagtacccagggctacccaggttggaaatagaagtcctcatcttctgcccaggatttctcactcctagccacagagcttctgccccctcctagccacagagcttctgccccctcccactggaagcattgtgcccaggagaggacctttttctcttatctctgctggtaagcttgattatcaggatattcctggggacctagaatttaatctcttctccaaagctgctctttgatggtgttgagggtgtttttgccagtaatgaacaatcttcttgttttgaagctgccttttatcttgtttaatacattgtaaagttgtcttctggagtcttcttcagtctgctattttgaaagcatcatgtcattccagctcgtatcttggttttgcaggtatgagtttcagggggaccagagggtggatgggagagtgctgtgtgcttgtttaattaagcacaagtatatcctgtcttggattggtgggttttgttcttgtttttccctttctattttcagcaatagtgataaccagccctcaggaattttaggccaaatagggctagggccagatgctggcagtatttatatattcactaaataaaaatttactaagggcttgatttatatacagcccccgctaagtgaaaattacaacaaaaaaaaaagaaaaacacagaatctgactaaaggagcattcagaatatttgtatctagaataacaagtataattttattggcacaatgcttttacagtatataaaacacttaaaatacagttgcttatttcatttcctcagtaatcctagagagtatttcctgcatcttattgatgaggaattgaagctgggatagcttctctcctgactcttgaagtccgaaaacaagtggacggagctgtagcactaagcctcagcctgctcgtcttcaacctgctcctggctgcagagtcttgattgactctgcctgtctccagtgtgctttcattcccttcagtgggtaacttgtcagacctcatcttgtttttgagactttggtttctgtcttgccttcttcctaactttggtattcttagttccaaatcctgaataactcctgtaatgggcctcccagtagggggggttcctgtatttatattcacagatgtacgtattttaatagttaacatctgaaatcagtatacatcttaaagttgccatggaagttcatttcttcagtgtctgcctctgctcgtcacttgaggtgctggtaaactaagaccaaagtttagattccctgcttgagggcacttgaaccacagtggtggtgagttcagaatgcaaatgagagtaactactgacttaggattcaaatcttcaggggagattcctcccctctctgcccagttcccaggttgaaacatccaaggctctttgccatccctttctgcatggcgggtttctttgtggccatttggttccctggattcaagtggtccctgatacctgttcagtttaccatcttgggccgggcatggtggctcactcctgtaatcctagcattttgggaggtcaaagtgcgcagatcacttgaggccaggagttcaaaaccagcctggccaacatggcgaaaccccatctctactaaaaatacaaaaaattagctgggcatggtgatgggcgcctgtaatcccagctactcaggaggctgaggcaggagaatcacttgaacccaggaggtgaggttgcagtgagccaagatcatgccaccgcactccagcctgggcaacagggcacaactgtttccaaaaaaaaaaaaaaaaatcccatcttgcatgcttttcctttctctgtagtatgtaaaataatgtatgtttgtgatcagtgagatctcagatctgataaaatgcagtgttttgtcatgagagttgctcccagccgctgatggggttgccttgttcagcactttttagcaccaggggagtaagccatgttcttgctccccctccctcaggctgaggctttgcttgatcacctgctaagacaaaaaccagagtgggtcacgagtcactctctctcttcccccagccacagtggcagctgcctaacttggtttcttgctggtgcacacatgtgacagaaatacaatgttaataaatatttctacgtgtaatggagaaacaagccataaaagtagctgtttgccatctgctcagatacattattaggaaaggcaatgacattttatgattcagtaacttaactattctcctgccttctgtaaaggcccatcacatataaataaattataaacatccaaacacatcctgagagaagtgcattggtctctgaagcagaaacaaatgatacctgattctcccttctcccagaggagatctcaaacaactcagttacagtgcctcacagttgtaacctatagtacaaacgtgttggagatataacaccttgtatacgtatgtagagagaattggcataacaaagtagagaggagaattagacgaatgggcaccccaatcagtgattcagggagaggaccatattttaaacagcaggcaatgactcatttactgagtgttttctgtgtgtcaggcactgtactacgcactttgttcatctataagtggaagaatgcttgtttttcaagaacaaagggaataataagaataaaagtgaaggccaggcgcactggctcacgcctgtaatcccagcactttgggaggctgagaaaggccgatcacttaaggccaggagttcaagaccaccctggccaacatggcaaaacgctgtctccactagaaaatacaaaaattagcagacgtggtggcatgtgcctatagtcccagctactcaggaggcataggtgggaggactgcttgaggctgggagttcgaggctgcagtgagctgaggttgcaccactgcattccagcctgggcaacagagcgagactctgtcttaaaaaaaagaaaaaaaacgagttggggggcaggcacggtggctcacgcctgtaatcccagcactttggaggctgaggcggatcatgaggttaagagatggagaccatcctggctaacatggtgaaaccccatctctactaaaagttcaaaaaaattagccaggcatggtggcgggcgcctgtagtcccagctactcgggaggctgaggcgggagaatggcgtaaacccgggaggcggagcttgcagtgagctgagatcccgccactgcactgcagcctgggcgacagagcgagactcagaaggataaaaagtaataacctgaagagtagcttcgtttcaggtggaaggtgagagaggctgcagaaagcttagggctgggcgcggtggctcatgcctgtaatcccagcactttgggaggccaaggcggtcagatcacctgaggtcaggagtttgagaccagcctggccaacatggtaaaaccctgtgtctactaaaaatacaaaaatttagccaggtgtggtggcaggcgcctgtaatcccagctccttgggaggctgaggcacgagaatcacttgaacccgggatgtagaggagctccttgggaggctgaggcacgagaatcacttgaacccgggatgtagaggttgtaatgagccgagatcatgccgccacaccctagcctgggtgacagagcaagactctgtctcaaaaaacaaaacaaaacaaaaagtgcttagtcaatatctggttgttgattgtttaaggaaaaggccaagtgagggtatgactggttggtagaaatatgtatcttggtataagcagttctaggagtgatatgtgtcttttgctgctgttattgttgtttctgttcagcgttaatacgttttgcattgtaccacaaatatttccttactcctttgcctttgagacaaagggcatgagtttataagttgagttgaaaatagattaaatatatagtacagcctatgcccagcaagcagaattatctatgcaagttatgcagcccacacggaaaaagaaatgctgtgcggcctcattagcaccccaggatttgtggggctccccctgggcagccttaaccaggaaaatttcatagtctccttggcattccatccaagatttaagacttctcctttcatctccttgaggaccatcaactatacccttgagctcagccatcccacgcactgaggcttatctgtacttccagcccagacctccctcctaattccccactatacctgtgcactgaaacaccctcttaggatctccttcttccacattcctcctcctctaggcaaggcaagtcgttttcctcatctcagccagagcagtagttactgaaaactaacccaatatggtggcttctgagctcaggtgtctttcagtgactcctgctgcttccaaaataaagtccaactgtttagcttggcatgcaaaacctgtagtcatccatcccttgcatatttaactcctcacacaccccattctgtggtctcttcttccctttgcatctgctctgggtgctctttgaagactgtacttcctcccctttggggccaatttagtcatctttaagcctcatttcaggggtggtgtcctcagataacccttcttcacataccagtttgggttatctaccgctgtggctctatagctctcagctcacaccaataggataagtatttaacatactgttaaattacagtatgccatgataacttctcttccatcattctgtattgcatgagtacaaagactgtgtcattaatccctgtctccgtagcattgtgtctagcctttaacagtcacttaataaaggcaatgaaaaggaaataacatttgaccttcaatttaagtttgactaggtatggtcaaacgttagaaagtggcagtgaacttcttttgaagtcagaattcatattttcctttaacatcagatattggcagccagcttttccagattttcttggccaaaaatattactaaaattgcatgcccctagattttgatatctaggatgatacatctacagcatgtaattatttgtctcaataattgagctttaccttagggctctaagagaagaggttaaaggaatcagtggtttagtaattgtattgttaatcttaaaatgaaagttgaatggaaaatattttaaaaactggttaagaagataattattgagagcatggaaaagataattactacatatactgtaactggtgaagatggaggttttatgaaaaataaagcagcttgtaattttttacaacttctttcaaatgcaccttggactgccaaggtgagaggcaggggaggacattttcattccgtggagtcacactgaggatttatcttgtaattgattatcacattatctgctttgatcctcatgagataatgagagtggtgttttgttttgttttgtttttctttgagatggagtctctctctgttgcccaggctgtagtgcagtggtgagatctcggctcactgcagcctacacctcctgggttcaggtgattctcctgcctctgccattcgagtagctgggtttacaggcatgcgccaccgcacccggctaatttttttttgtagtcttagtagacacggggtttcgccatgtttgccaggctggtctggaactcctgacctcaggtgatccacctgcctcagcctcccaaagtgctgggattacaggcgtgagccactgctcccagcctgagagtgagtgttttagcaaagcaaaacggcagaggtaacatggccccctccctccacatcttatgaggtttcctaccattttctgtccaatcgtgactttttctacactcacttttagtgccccataagaaggatatttaatgaaaccttttatggactattgataagaacccaacccttgaccgggcgcagtggctcacgcctgcaatcccagcactttgagagccgaggcgggcagatcagaaggtcaggagatcgagaccatcccggctaacacggtgaaatcgcatctctactaaaaatacaaaaaaaattagccgggcgtggtggcgggcgcctgtagtcccagctacttgggaggctgaggcaggagaatggcgtgaacccgggaggcggaggttgcagtgagccgtgatcgcgcccctgcactccagcctgggtgacagagcgagactccgtctcaaaaacaaaacaaaacaaaaaaaacacctttttttgtcttgccattcaagttacttccaacagtgctaccccttctcccaagactcttaatgtagtctgtctgtccatagcattgtatccagattcctgaacctggcatatgagctctcaataattcattctgactcatctttccaggcttactgtttaaatatgttttatttattaatgtttgagacagggtctcgctttgtcacccaggctagtgtgcagtggcatgttcatagctcattgcagccctgaactcctagactcaaagggtgttcctgccttagcctcccaagtagctgagattacaagcacatgccaccacacctggctaagtttttatttttagtagggacagggtctccttatgttgcccaggctgggcccaactcctagcttcaagtgatcctctggcctcagcctcccacagtgctgggattataggcatgagccactgcactgagccataaatagatgcaagtcaaaatccaagaaaaccttgaaacaaattgccttacatggtaagaaaggtttatctttttcataagttcagaaatgaacttctggggttaattaatttgtaattgcccaattgcacacacaaagccaattcactgagactgtgatattgcagtaaagaaagagtttaatgaatgctaggccagcaatgtggaaaatggagttattattcaaatcaatctccccaaaggctcagagagttagggctcttcaaggatagtttggtgagcggaggacttagggaatgggtgctgctgattggttgaggatgaaatcatagggatgtgcaaaatggtctaatcctgtgccacctcacctgcactgagtccatctctggacttccttggttgagttatgagtcctggctcccggtggggtcactcggttgcctgaatgcaaaagtctgacaagcatctcaaaagactaatcttaggttctatagtagtgatgttatctataggagcaattggggaagtcacaaaccttgcaacctctggccacctgacttctgagcagtaagagattatagaaagtatgcttacatgttagcagaattcaggcccctcccattattctagtcttgtggcctttattagtcttacaaaggcagtttcagcacctgaacaaggaagggaatgagtttcagggagggactgttatcatccttgtttcaaagttaaattacaaactaaatttctcccgtggttatcttagcccatgcccaggaatgaaccagcctgtgaggccagaagcaagatggagttgaaccatgctagatttctctcaatgtcatcatttttgcaaaaggactttcagatttagtggcccactgatatcattaggggcccaggttcttattgtcacttcactctgccatccactatgcactggtacatcctgagacttgctctgcctcttggcaaaatggctacagaagtgccaggcatcacatctagacagggcatcttgtggctcttgtaggagtaaggaaacatttccagacgcaccctagagaacatcttacatttcactgaccaaaaatgagtcacatggtcctttacaaaccaatcacaggtaaagggaatgccgttattatggtaaccagcatgggggaacaggtggagagtcaaccaccaggactacagggcttccttttctccctttgtatgtccctcttccatcctgacctcatggtgaccctaaaaagtctgtgcctgcctaccaccaaacctgctctctgcccctctagattttaggtacccagccccccaggcctatacccgagttcgctttgctccatggaactttccttgcgcactccctgttctacccctttgccacctgtgtgaaggtcatatctctctagctggaccctgaggtcctttggggcatgcctgcgctgctctctattccttcatgtgcttcgtagagaaccacagaccctgactttatttgtgcaaaccttttccccaaaatgctaagactaataccacgcacagatggaagtactcttacatcctagtcatatcagccccttgagactggagctagtcttcaaaatggaataatagtgttccctttttattattagaatagtaagaattctatatgagtagaataagaaaaagttaatgtggcattcacaatttattaatgtcccttcatccatttacccacattcctttttattcttttttttttttttttttttttgagacggagtcttactctgttgcccaggctggagtgcagtggcacgatctcagctcactgcaacctctgcttcccgggttcaggtgattctcctgtctcagcctcccgagtagctggcggtacaggtgcacaccactttagtagagacaggtttcactttattggtcagactggtcttgaactcctggcctcaggtgatccacctgcatcagcctcccaaagtgctgggattacaggtgtgagccaccgtgcctggctttattccttcttaatgaggcacaaactcagtttctgcgtggtacatatagcctttagattttcatagttttactgtttttctgatattctcagacaaataaatggttgtacatcagaattattggaggagctttcaaacaatatgcctatccaagtatcaattaaagattcagtttcagttggcctgggttagggcctagggtgtttttgtaaaagttctcagggattctagtggcggccaggttgagagctctgctcttagatctttatatgcagaactctcctggctgagaattatcagaataatttcaaacttttcagagctcttatccagactgctgccatatattactgcttctcatattagcactgctgatcatgcagggtatgtcctggtttcttttgtgtttgatggctaaatatccaccttcccttttatctttttcctgcctggattgtaaacatctcatttctcttctgttccacagcattcaggacaatattaaagagatcatggaggctcagtcagttcccatcaacagagtccgaaacgttgtccacttcataacttgctgggcattctgtcctgtacacctttaaacaaccttcctggctgggtgcggtggctcacacctgtaatcccaacactttgggaggccaaggcaggcggatcacgaggtcaggagttcgagaccagtctggccaacataatgaaaccccatatctactaaaaatacaaaaaattagccagatatggtggtgtgtgcttgtaatcccagctactcaggaggctgaggcaggagaatcgcatgaacccgggaggtggaggttgcagtgagccgagattgccattggactccagccaggcgacagcgcgagactccgtctcaaaataaaaacataaacaaaacagaaacccttcctttaggcccagagagccaacctttccctcagagactgtttttaaaccaagccactttagactttgccagtccttctgtagtcccctattcaaaactttgtttatacctttcaggaatattttatctagtactttattgatttcatccagttatgtgccccttctctccattttttgacagtttctactttattccactcctccaacaactccttaatttctgctgtatcagcagagcctctcctaggtaattggaagagttgtccttctctcaaccctattctttctcaagtttgctattcccaggtcttctgttgccttcaaacactaccaagtagtctcattatctattcacaataatgatgtgaaagcttttgttccagcatttgttgaatgttcattttttctctggcctttcatcatctgtgacagtactttgtttagaaaatggagggtagggtggcacttgtatagcccattttgtatggttcaacattcatttcattgtgactaatgatgactgatagctgatgtcataagtagtgtttcttgcagcaaagtttcataaattttagcatgcatcacaatcacttggggtacttaactcaagtacgtattgctgggacttaccttcagggatatctaagtcaccaagtctggggtgaagcctgagaatttgtatttctgttaagttcccagatgatgctaatgctttatctggggaccacacttgagaaccactgtcctatgggatcaagaaataagccaggaacgagtgtatattttttctagttaaatatttaatgttaagatgtttagaatttttttagggaggtgcttgtcagatacttttcctaatagtgggtactcagagtatttcatgtgagactaccaatgtcatatattttaaaaactattagactgggacagatgggaaattgccttcagcataagaaaagccaatatttttcataagtcccaaaagcagcttttggggttggttgattcagtggttcaatgaaaccatcagagactctggttcctactctttattccactgtgccatggaccatgtgctggtacatcttcagactcactctgcatggtgacagaatggctgtagaagtgccaggcatcacatccaggttacatacagatgcacactgtttaatagccaagcttatgcagtatcagtaactattagagaaactgaaatggaggatccagaacttcttatcaaatataatccttaagatacaaacaaagcagtcattgaatagtttcttagcccattttctgtggcttatgatagaattcctaaaactgaatggcatataaagaaatttatttcttatagctatggaggctgagaagtccaagatcagggggacatgtggtaaacgccttcttgctgataccagtaaagcctgctgagctggagtgtcacttgaatcatattcgccacttttgctttctcttcctacatgggtcctgaggttttgctctcatcatcatcttgcctttcagtaaggtaactaacttgttaccctctgctatgtcagagagattgtttgtttcaggataaacatataaacagagtttcagataaatctcttatttcctggccactggggctcgagttatattgttagcaccagctctgtaaagtgcctcaatgtgttttttcaaccaaaggcaaaatatttggcaaagaatatgttggttctttacctccaggttctgggcaaactttgagtttccattcttttgagatagatggactttgttgtctttcataaacttgttaaatttgcgatctgcccttgaagaggcacttggttccttctaattcttttctgtagattcctctgattctccatcagcgtatggaaattttctcttctatcccttccagagaattattcttctctctgccattcaatttgactgtgttactgccaggaagagacagataaaagggcatcagcaatgtcgacaacttaggagtagttcattcctttttcctatggctgagcaagtggatttgactgtacttatttttgtgtattttaatatgttcacctgagcaaagtcagtgatctagaagcttcataaaatgaatagtgcataacagaaatcacacctcagtgtaagtcttaccttcctacaggagtcccataaaaacactcttaggacatgctttccccccacacatctgattgctgaacactttgtttcactaggcttcaacaggtctcttcaaagctgtcattttacttcagctgggattacattccaccctatttcacttaaatatacaccttccctttaattttctctcattcttatcattggcagtaatcagtgtggcaagagttcactttcttttcacatggagatttgatctttgattattttatttttatttatttattattattatttttgagacagagactcactctatcacccgggctagagtgcagtggcacgatctgcaacctcctcctccctggctcaagggattcttttgcctcagcctcccaagtagctgggattacaggcacacaccatcacacctggctagtttttgtattcttagtagagacagggtttcaccatgttggccaggctggtcttgaactcctggcctcaagtcttctgcccacctcggcctcccaaagttctgggattacaggcacgagccactgcgcctggcctgatcttagatgatttaccaaacagtgccacaccctctgccttctgtgtgtgtctcaggctgtaagtaaagtctccgtcttagtccattcaggctgctgtaacaaaatgctacagactgtgtaatttataagcagcataaatttattgctcacagttctgaagtctgggaattccaagatcaagatgacagcagattcagtatctggtgagggcctgttcctcaaggatagtgccttctatgtccttacatggcagatgggcaaaagagctaacaagcttcctcaaaccctttgtaagggcactaatcccatttgtgagggttctaccctgatgatttaatcacctcccagaggacccatccttaatgccatcccgttgaaggttgggtttcaaaatgtaaatcttgggagacacaaaacattgagaaccatagcagtctctcagacctcgttgtactcagcttcattttaggataactccacatttgagttaagaaaccaagagtttgtattcccaactctatgcttcatgaggttaaagactcttggcttctcattctcactgctcaggcaggggtagtccatctgaatggaaactcctttttggggggcacacatcatttttattttattttatatttctgagacagagtctcgctctgtcgcctgggctggagtgtgtgatctcggctctctgcagcctccacctcctgggttcaggcgattctcctgcatcagcctcccgattagctgggattacaggtgcatgccatcacgcccagctaattttttttttttttatacagagtcagtctctgtctcccagactggagtgcaatggtgtaatctcggattactgcaacctccgcctcccaggttcaagtgattcttccacctcagcctcctgagtagctgggattacaggcgcctaccatcatgcccagctaatttttgtatttttgtacagatggggtttcattatgttggccaggctggtcttgaactcctgatctcaggtgatccacctgcctcggcctccccaagtgctgggtttacaggtgtgagccaccacgcccggcctaatttttttttttttttgagatggagtcttgctctgttgcccaggctgcagtacagtggtgcaatcttggctcactgcaagctctgcctgccgggtccacaccattctcctgccttggcctcccgagtagctggacctacatgtgcccgccaccaggcccagctaattttttgtatttttagtagagacagggtttcaccatgttagccaggatggtctcgatctcctgaccttgttatctgcccgcctcggcctcccaaagtccagggattacaggcgtgagccaccgcgcctggccaccacttttaaatgtctgtgttgcagtgaaattttaaaagagagagctaaattttgatgtcagtttttaaatagatgctgccaagagccatgttgatagcccaaaccaattttccatttataccagtgatatacttcaagcctgaaaaatgtagtccagtgtgggaagaagccctgtgatggtgagaaatgcagtaagaaactgggttctcccatggaactgataattaatgcaatcagatatgaacagtatgtttaaggatagtctggacatgaatgtgtataatctgtctttatcagataaacaaataaaagtcttttacctaatcgtcgtttcctgagttagaagaatcctccttatcagatacctgctttggtcattggaaggaaagtagaacatccatcttggtggtgatccttgtttcttagtactctgtatatcctttccaagagacaggtttcttttatgaaatggctaagatcatctccaccaccatgaacaacatgcaaatggagctgctgcacaaagtttagggagttctaagcgttgggattccaaggcatattaccctgtactgaagaaactcggaacagaggcatcctcaaatcctaactgcaaggaagcgtagcctgtgtcctttgttgatggaggaatgattcagtgagaaagaacacagtgatttttttctctacctatcttacatcttactctcttgccatttcttgtaacaccttttcatcctgtcttaaccttcagctaccagcttaccctgatcgtaatgacaaggaaattcatacattttggttttttaaggactactttattaaggtataattcacaaaccatgcagtccaccctttaaagtatacgatgcaatggtttttagtaaattaacataatcgtgtaaccattggcataaacaacattagaacattttcatcaccccaaaaaagaaaacccatacccattggcaatcaaaagccgatttcctccccaaccaccacacaccccccagcactaggcaatcattattctactttctgtgtccatgggtatattaaatactgtgttgtaactggagataggatgcccatagtcagaaagcttgagctcacatgaactgttggcttggatttctgtgcggattaaaccagcttacttctgacacggcagatgctgggctttttaacctctttcctcattgtgcttcctgacttgttacctctgtatcataaaagcatgaaaggtcgtagaataaatgagtctgcagaaaactgcgtggttaagttaccccatttgtgttttacaaagatagcggaagggaataacctttgagggtcacatacaaaaagccatttcctcatcctccctaaccttaaaaagtcgacattatttttacagcagcttctctaaattgacttacacttgaacaaactaaaaactacaagaagagtagagcttagctggcaggcctggttttgaacaagtgtttgattttgctaatcttggtagtgcataaggtcacttttgtaaatttcctgtagaaaaattcttggttcttggacacactcagctactagaacagagagatggtttatattttttctatgaattaccagctgataaaattcccctcctttgagtgggagaaaaattcaagccagacaagaacttttgtggcaggtaactcttacttgaaatttatttggatttctagaggcaaattaatttctctctctgtctttcacaataaataggtgcctgtcaccttttttttttctctatctagtgagctgcttctatagatggaagaaagttagtccttccttttggtattttgagagttttatttttaggcctctccttggctgtcttttctccttgtaaagccagtgtcgaagtaatggcaatggtaagtatgcttagcgttctaaatttttttaatgcatgtttattactaagtaatttatctccttttcttctactttatagctccatattaaatatggtggcaccttttaataaaaaagaggaaagcctatttggaaacatataaaaatagcacaggataggtcatttttcagattctggtcagatcaccatttggaaagatcttattctttaaagcaaaagttttgaaccaaggatctgttgaagatggggagtgactctcattcatctccatcttcctttgaaatttcatacagattttttggtgtgtgtttgtgtgtgtctgtattttctaatgagaagatccataactttcataagcatcaaagccactgcctttaaatatctttttgattacttttactgtagttattgttttaagatctgctttttgccatttaaaaacatctttcaaatactagttaactcttaaatgtttttttgcagaataagatcctttttgcagtactttttgttgttgtttaatacctacccaaaattttggtccaagctctaggggcctcctcccgaagaatttggtttaaaagcaaaagatttttaacataaataaaccagaatttgctttttttctttttgatttttttttttttttttttttggtagtgatagggtctctctgtgttgcccaagctggtctcgaactcctgggccaatcctcctgcataggccttccaaagtgtgaggattaccggtgtgagccaatgtgcctagcattgatttgtgggggttttttgttttttttgggttttttttagagacagagtctcgctctgttgcccaggctggagtgcagtgggatgatcttggctcactgcaggctccgcctcctgggttcaaacaattctcctgcctcagcctcctgagtagctgggattacaggtgcctgctactgtgcccggctaatttttgtatttttggtagagacggggtttcaccatgttgcccaggctggtctcgaactcctgacttcagttgaggcacccgccttggcctcccaaagtgctgggattacaggcgtgagctgccacgcctggccttgatttgtttttgcatgtgagaaaatgtatgtcctagtgtagtgtggtgtgtcattagaagcatgatttgttcttaccaatgcagtgattacattggttcttctacattcagtagaatgctaataatgtggtaatgctagtcgccagtcttcttaatctctataacagaggaagcagaagtagagcagatcctatcctagccttgtaggtctagagaccgaactatagtgtcttctgggaaagcacttaaacaaaacacaggtttataaattgttatggtcactaatgtttcagtcaagatggtgactacctatgatttgtgtgtatgtgctacccttttgagaagcattaattagtccgttctctcactgctataaagaaatactggagactgggcaatttataaagaaaaggggtttaattggctcagggttccgcaggccaggaagcatggtggcttctggggaggcctcaggaaacttagaatcatggcagaaggcaaaggggaagcaggcacgttttacgtggccagagcaggaggaagagagaggagagaggtgctacacgcttttaaataaccagatctcacagtaattcactgactcactgtcaccagaacagcacccaggggatggtgctggcccattcatgagaactctgcccccatgatccaatcacctcccactaggccccaccttcaacactcgggattactgttcaacatgagacttgatggggacacagatctaaaccatatcaagcattaatattactattaacctgtgtgaaaaggaactgaattctgctgtgacattttttgtttaagaattaggcctagcaggtgtggtggctcacgcctgtaatcccagcacttcgggaggccgaggtgggcggattgcctgagctcaggagttcaagaccagcctgggcaacatggtgaaaccctctctctactaaaatacaaaagaatattagccaggaatggcggtgtgcacctgtagtcccagctactctggaggctcaggcaggagaattgtttgaacctgggaggcagaggttgcagtgagcggagatcacaccactgcactccagcctcagcaacggggcaagactccatctctacaaaaaaaaaaaaaaaaaaaagaattaggcttagggagtgcatggtggctcacgtctgtaatctcagcactttgggaagctgaggtgggcagatcgcttagggtcaggagttcaagatcagcctggccaacatggcaaaaccccgtctatacaaaactacaaaaattagcaagccatggtggtggacatctgtaatcccagctactgagaagtctgaggcaggagaattgcttgaacctgggaggtggaggttgtagtgatccaagatcataccactacactccaggctgtgtgacacaatgagactgtgtcttaaaaaaaaaaaaaaaaaaaaaaggccttaagataaaaaacagtgaaataaaagaagtcatatttttaagaaatgaaatccctaatgtttaaaaattatttaatgtataaaattatcaatttttatacattagggatttcatttttttaaatatgacttcaggctgggcgtggtggctcatgcctgtaatcccagcactttgtgaggccaaggtgggcggatcacctgagatcaggagttcgaaaccagcctggccaacgtggtgaaaccccatttctactaaaaatacggaaattagccgggtgtggtggtggcatgcacctgtaatcctgaccagccagctgagatcgtgccactgcacttcagcttgggcgacagagcaagactccatctcaaaaaatgtgtatattatatatatatgacttcatagacacacattggtctatacaacaaaaacaaagcattaggaaattatctcatgatttagccacaaaattaaaagatttatttcaacaaacacttattgaatgcttacccatttgactggatgatgcgtaggaataacaagaggtctgaggcatagtagtagacccatggagctgatagtttcagggcagggtagacatctaataaagtctttgtttccttttgtaagtttctctaagtttgtttaggatacctattttgacagccatacagatcttcagaaaatagggattatcaccagacaccacaaggaaataggtggaaaaatatttaaaaataaattgtaagccaagcatggtggcccatgcctgtaatctcagcatgtgatttgggaggccaaggctagaggatcacttgaggccaggagttcaagaccagtctgggcaacatagcaagacctatatctacctaaaaaaaaaatttaagaaaatttaaaataagtaaataaattgtagtaaaaatgtaggttatgtttcttcgtctgaaaataagctattctgaaaagctaagctttcccaatggtacatgagttctctctctaattatatcttctgtattcctctctcacttgaataattttcttttgaaaactttctgaagttatatgctttcagactttgtaaaataatatgttgaacatgattaatcatctctcagttaggttcattattttcaatcatattattgtattgtgctgtgataacaatgtccctagaaactggacagtttatagagcagttcgcctgatcatttttgttttttaagtatctttttttttttttttaaagacagtctctctctgtcacccaggctggagtgcagtggcacgatctcagctcactgcaatctccgcctcccgggttaaagcaattcttggtctcagtctcccaagcagctgggatgggactacaggtgcatgccaccacgcctggctaatttttttttgtatttttagtagagacagggtttcaccatgttggccaggctgctctcaaactcctgacctgaagtaatccacccgcctcagcctcccaaagtattgggattaccggcgtgagctactatgcacaccccttaaacatcattgtaaaaatcacttcccttgctataggaatttggctttgagttactaggccttccagaagccatccccatgactttgttatctggcctaagccataggtggggagtggggagggagacatccaaagttaattagaaccaagtataaatttgccatggatttaagccttctgtataagataaattcatccatagtatttttggattactttatttacttgattatttatttacttatttgattatttctgttctcattaattttctaattatgactagacaactaagttctgggtaagatatgtcattattacgtaatgatgtcttattcttggcattataaatgactatactgtgttgtagttttattatatttatgacatatgagaaataaataataggaactttaagaagactctatcacttcatatctctttggtctctttctctgtctttaacattggtcaggttccaaactagtgaaaactacagaaacaagtgcagttttctagtatagtctttcatcttacgaaaatatatttaatccccactcttttttaagtttcactttgccttaaggggagtggtcttaagaaaactcttagtatagttgtgagtatccatagtgtcaaatgaggggaaacattgtaacaatgttaggagccaaagttctcaccacaatctcatcagatgtcctgagctattttttacttgttaactcagaacaacaaatactaaagaaagtgccaaacaacctcaattcttctggctcacacttatatatagcagagatacgaaatagcccgcaatcccagatcttccatgggtaattttgggaaagtgtttttcatagagatgttgaagtccatggaaatcaggtagaacactaaaggacccggttgacccagtacattgcaaccctctgctctcatgtgcacctcacacacagccagtctacggattagagaccaccatttctgggggttgttatcttttttttttttttttttttgatacagagtcttgctctgtcgccaggctggagtggtgcagtggtgcaatcttggctcactgcaacctccgcatcccgggttcaagcaattctcctgcctcagcctcccgagtagctgggaccacaggcacacaccaccacgcctgggtaatttttatatttttagtagagacggggtgtcatcatgttggtaaggatggtctcaatctcttgaccctgtgatccgcctgccccagcctcccaaagtgctgagattacaggcgtgagccaccacgcctggccagttcttttcctttaacttgtattaactgcatagtagttagtttctctttcttctttctttaataggatcatctcaacatatttaaaaactatgccgtatatgtataagatttgccacctctgggtcattaaatggcatcacagacatagaaatgtaccaattccttttttatgaaatttatccattcatgcaaaagaagtatgataattaaaaataattttgaacattgggtatcctaggctctgagcgcgaggctctcagaaaattaaaatgacatcatcatcgtacttgcaaagcttaaagcccagtggggaagagcaacatgatagtaacaaaggtagagtgtaataagtgcggttgcagaatcgcaggccaaggggagctcacgtctttgagcttcaatttctttatctgttgcgggggagagtatctcatgaagctgttttgaagcttatctaagacaatgcatgtgaaaacactgtaaaattataaagctgcggacatgtcagttgtcatgtttggtttaaaatagaagctgggagactctttattctgaaaccatgtagataatccagggatgagactctagttaaagtgaggaaaacaatgtacttgcatgtcaattgcagttcctgggagaatgtttgtattattaggagactctcattccagaaatcattttgttggcatttatactaagtggcgatgacactgagaacagcacagcttcatctgacatctgacgttattgtcagcctttcttagtacccatggtatgtttttactgtatctcgtgaataagataatatattaagtctcctggcatataaggatatatgtaagatacgtgttgtatagttggtttctagagtgtcttcatagcagtcttccagtatttctatttattgctattccctctccacctctgtttctttcccattagttctttacaggtagggagattatatgtcccagtttgcctgtcctggtttatgtctcttgtccctacatcccatctacttaacattttaacaccctcgaaagcgtcccaatttggacctcaccttatctggtcaccctggctcaaagcatagaagaaaattaaatgaagagccagcaaattagtgaaattgtacagatgtgtgataactgacttcagtcactgagctgagctgatttacagagtgtggatttggtccagtaatatcttggaatgcagcttacagatgtaagtaagtagtgcctgattatagctacacactatagcaggtttcctaatgagctgttaaaacgaaagcatgtgtttgttcactgtggcacagaacagtagctttgacacttcagtagttttcaccatagcatggcttgttggggcttgaagactggcattccttcttaaaggcccatcaaggttttcattcactgtgagctatgtgttaagctggtactgatctcgtttttgaccatcattcacccatggcagccaaccagggaggtgtaaaatgcttttgtccccctgcccacatatgcacctcctttggtgtgacccatgggatgacagttgcgatgcagcttgaaaggatggctctacattgcagcttctctgcgtcatccccgttgcccttttagaatgagaaaagaggattgaaaggttcaaaagcctagagagaaaattctgcagtcctgtgtttttctgagcagagggaaaggtgctacttcgtaagactgcttgcaatccccaatataatagaataaaactgtccctactgccagcattaatatgaaatttgtataaaggtggagggattactttactgttttattaatatgcaatcccaatattttcattgcagggcagcttgcaaattcattgcaaattatgctgagttaaaatcaaatacataaatctacctttctctgttggcagctgtattggagtttgggattggcctctgtgcttattagagccaaagaatgtatattatttaattcttgcaaagtgaaagtaaaagatcaggaaataaagacaaatcaggggaatggaacatttttagtgcgattcctcttttactctccagcaagggaaagtggcttaaagatctctgttaaaacagtgcttctcacactttaatgtgagactcttgttatgtagattcttactcctgggtctaggatgggggcctaagattctgcatttctaactagctgtagagcatgctggtgctgctggaccacaggccatgacttgagtagcaggttgtcaggaagtgtgtgcttcagtgggctgtgactctgcatatccctgttgtgaaatatgcagatgagagtggcacacaccagaccctcaactggcaggaggagctgtgttttagctagaggttagggtgagagggaccacccagacttgtaaagcttaagtattgtccccggtctctttaccagtcttaaggtatccctaacagaggcccaatgttcctgctaatgaaatgaataaagaaatgttgcagtccatggatttgtaattccagtaacggcttattttacatctattaaaggctacaaggaaagaagtggagggaagggctggaagactaagaaaataggaaatgagaagaaatgcacaaaggagagttgcatttcctcctgcttctgtcaaaggaaaaaaagatgttatgtgccttctctttccacctctaaataaagcaacagggccaccactaactagtttgtgtgactatattctggctatttaacctctgctatttcacaaaaagtcctcatctgtgaaaggaggaatttggaatcgggacagttttcggaaccccttcaattgttaaagcatagcgactaagaattttatggtcatacaacactaaaaatcatacatatgtccttaggaatggggttttatttctgtaagagcacctccaaaacaagtggtgtgttaatacatgtgcattttatatttttctttatattctttgttctcttccttttaagaaaatctagtttgtttcattgcttcaaaattcctgaaaaattttctgtctttttatataatacagagttggctgtgttaatttctgcttccatcatactaatttaggaaacgtggcctaacagtggcaggaatagctagaactttcttctgtgacttactggcattttccctaagcatctgcatgtgttgggtgtatgtgtaagtaccatgcattggatacatcctctgttgaaaggataaaggaatgcttgttcgttccacaagttaccttggctccaactctgttccatactcagcctgttctctcaacacaatgatgtcttcagtcttaggacagaagtctggagttcattcacatctctattttgattaattgttttacacatcaggctccatataatgtagtggataatgaaatgctctaagtgagttagggattttcagttcttagacttgtggatgagagaatttcaaaaattatctacaaatttaccaacatagataatgtttgtatgatatacagaggttgagttttataaaatataaattgctctgagccagaaatgaaaaataaatgtagaatcccatgataaaaaactaaagttgctatattaaaattaatagtatactgggatttttgaaacattgttttgaggatgtgtttactatgttcaaagcaataaatttaggaatggaatctagtttcattagccctgctataacattttggagagaatataaattaatacctgctttttgaaggacaacctgacattatccattagaatgtgtaggccctattttcttcatctcacagattcatttcttgtaatttacccatttataattaattattgcaaatatgtgtttggaattattggacaggtacagaaagctatatgtagaagtacattcatcagagtgtttgcagtgtgggccaggtgcgacggtttactcctgtaatcccagcactttgggaggctaaggcgggtggatcatctgaggtcaggagttcgagaccagcctggccaacatggtgaaaccccgtatctactaaaaatacaaaaaaattagccagacatagtggtctgcacctgtaatcccagctactcaggaggctgaggcaagagaatcacttgaatctggtaggcagagtttgcagtgagccgagatcgtgccattgcactccagcctgggcgacaagagcgaaactgtgtctcaaaagtaaaataaagtgtttgcagtgtgaagaaacaatctaaatattcaacaataaaggaaggtcaaatgagacaaagatgaaaggggaatactatgcagccataaaagagagatgtggttgttatcttaggaagatgactataatatgaagttaaaagttacaaaggaacatttgggaagaatgtataggtacatacatgcttataaaaccacaagaaagaactgggaagcaatacaccaaagcgttgatagtagtagaattacggctgattttttactttctctgtcatgcatttctttattgttgaatatttagtactagtacatggagagggaatagaaaacttaatttggaagggatggggaaaaagtagccaccctgggagctgagttagaggagaacacagagcccaggtgtttcagcatctgttccggcgttggcggtgggaattctctgaatagtcctcactgtgccagagaagctttctgcgcacagctgggtcctgtgaggcaagacctgtgtcctgctgactcatacacagcatcccatatggccttaactttatttagcaacgtcagctcaaggaagccttgtgttccctttgggcccaggatttagaagagcataatcatagaatgtctgtcaggcctggaagtgtcattagggctgtcctagtctggacatgaagagtctgaggcccagagcatttaagtaacgttcccagagtcccagaggtagttcgaggccaactggaaatgaaaatgcggttcccaggctcgtggtctctctagtgctactactttgcttgtctccaagctctgctctggtggatgagtctccagttctcacaagcagtttttaaggccagagcaaaaggtttccaggtaagagaattttttttgtcatataagagaagattaaattaataggacttttgttcagatctgcattcagtgagatacatggaaattcagaggttattgactttccttgggtctggcctcttttggatatttaataaaggctgcaaaacctttcccttgaacgatgcaagtttgctgaaaaccacaaaactttgcatttgatttcggaggtttcaagagccctgtaaagcctgtccctgggttctgaatgtcctttgtcttgtgctcccctgttttcaagcagttcttttgcatttggaggtaacagaactgtgatctggtttggttttcatacctttgttgcagatatgttttcttcaaataaaaaagaaggagaggatagcaactaggaagatgaacaagcctcatcacattggatacttagtgttgtctttgtgtttacagttgctgttagattgtcattccaataaaagtaaaattatgtaatactttttaaagctcccatcacactagcacaactgctttcattttttgcagagtgtgccaccctgttcctttccacatggatacttcctggttacagccaaagactgttcattatgccctttcatgcttccacatgaaagacacaaactgaggctgaaattgagtggcttcttaccagaaattaggtatttgaataagagcagatcgtttttacttaaaagatgtaagttttgaaaatgaccacatgcagcagttaacacactgatgactggacttacctgaagagtctctgattcagtagcccgttgtggggcccaagcatttctaataagtcctcaggtgatgctgacatcactggtccacggccagactttgagaaacagtggcccagagaataacagtcttagaaggcagggtgttttccaaattttgctgaagacaagaatcagttgagaatgtttgttagaaatgtaaattttaacaccatgtcagactcactgaatcaaaatctctgggagaatcttggaatagtatattaccagatctggaggaactactattctcttgctatcaggtaagccccatagagtgtcacttgtttgcaaaccactcacaggacaatagaattttttttttcaaacactaactcaaccagaagggacaatgtaatatatttaccactcaatcgtttctcatccattgtctgctttgaccctatgagcccatgagcacctagcagcatccacatttttaaatgaattttaagtcacccttctaagacataaatatttttgtttcaggtaccaatatattgtttgaaagagataccagaatacctgctttctgagaatttcctcaagttttactgagttcctttttaataagcatagtcacaatatgcatttgtgtgtgtgtgtgtgagagagagagagagagagagagagagagagagataaagggaggaaggaaaaagaaatgtggttttctgccaagttcaagttccctagtgatggtgatgctgctgatctcggaacacgttttgagaaccactggaatagaccaataactctcaaatgtagcagttggaatctcctggaggagctttgaaatatacttctgctcaggtctcacccccagagattagttcaattggtctttgatgagacctagacagtaattctaataatcatccagccgggcgtggtagctcacgcctgtaaccccagcactctaggaggccaaggcgagtggatcacctgcggtcaggagctcgggaccagcctggctaacgtggtgaaacctcgtctctactaaaaatacaagaaattagtcgggcatgatggcacacgcttgtaatcccagctactcgggaggctgaggcaggagaatcgcttgaacccgggaggcagaggttgcggtgagtggagatcactccattgcactccagcctgggaaacaagagcaaaattctgtctaaaaaaaaaaaaaaaaaaaaatccaagattgtgaaccattactgtaggttgctccagataaaaggtaatgggttaggaagcttaagacttgatgaggaaaaataaaggttaaaccagtgctccttccacttcagtgtgcatacaaatcacctgggggtcttgctggaatgcagattgattctgtaggtctagggtagggcccaaaatgctgcttttttaaatcaagtcaggcagatgctgctaagattgcccaggggtctacactttgagtagtgaggtggttagaaagtgttgacctatgtaagtgcttatcaacacacagtttttatatatttttacgtagtatagaacaaataaaagcaatgtcattgagatttcagataccttagaaacaataaatattttgccattaatgactatttcccttcccttgatggctaaaacgttttgtttttgcttctccctacctgcttactcagagtttcaatcaaatgtttgtaaattaattttgctttagtatgacacatgtagtaacaggcctttcccctttgtaactgagtcccaggattcacggagtttgaggatcttgccttctggcttcctccttgcctcagaccctgccctttaggggttactgccctaagaggctgaaagtttagtaatgccccagagcctcgttgcaggagctagtcacttttggcactttcttgctgtcagaccgcaggctctgggagccagtcttcttgggacatggcttcatcctgtgtctctggcttgagcccaacctttcaggcctgggttaggggtgaagccttttatctggcaggtcccacagtctggcgcctttcccagcgtggtggagttgagaccttgctgtcagagcctgttcagaaggagagagggagagacaagaccttcgcgtgaggaggaaagagtttaagtcccgtctgtggaatctgtttcccctggcttgttgaattttctcagctgaacatggcagaagtggttgatatttgaattagaggctatgaaagtgtccttgggaaatgggtggggctgagccagtggtcttcccttttgcctctacctcatgctgaccaggggacaaggctctgtctcctgggtgtggcctgtcattggtcagtctgtgaccatactgctattctccaaggcattcctcaacagaatgggatcaggctttttcagtcatttcccatttttaaaggacatctccatggcagatgcccctactccctcccggtgcctgaatatttgcctgtctagcgtgggtaggtgaacgtcagcagaactcttgaagaatcactaaagggatgtgcttgtcctagcaggagagcctgtgacaataaaaaagcagagaatgttctgagtctcctgtattaaaaagggaaaagcttaagtgaggtttatttccactaaaggatagcaacataaggcagcttgacctttagtgtgactggagcaccgtaaatgctacttctacttttttcctttttttttattgtggtgaaaaacacatagcatagatttgccctctgaatgtttaagtgtacacttcattattgttaactgtatgcacaatgccatgacagatctctagaacttttccatttcacatgactaaaatgctgtgctcatcaaacaactctgtttccccctgtgccagccgctggcaccaacctttctactttctgtttctatgactttaattacatgtatgtgtcatagaaatttggctttttgtgattggcttatttcacttagcatagtgtcttcaagtttccattctattcatgttgtagcatgtgatagaatttccttttttgtaggctagataatagtccattgtatgcatataccacattttccttaggcattcatctgttaatggacttttaggttgcttctgcatgttggtcattgtgaataattctgtagtgaacatggggatgcaaatgtctcttcgagttcctgtttttagttcttttgggcatatacccagaagtagggttcttgaatctcatggtagttctatttcttatttttttgaggaacctctatactgttttctgtagcagctgcaccattttacagtttcaccaacaactctcaccaatgtagggttccagtttctctacatgctaccgatgctttgtttttttgttgttgtttgttcttgtttttttttaatagtggccatcctaatgagtatgaggtgatactgtggttttgatttggttctgcctttttaaactccaaattcagtctctggttacagcttttcccataaccattttcaggtgaggtgcgtatgctgcgttggtaacataaatttaacattgtgagagcttttatcaggcagcaaattgtaaagccccttctaggtcagacagttgacctctgtaaagcttaagttaggaacttttatgttcttaataaaacacaagaaaatatgggaaatttccatttggcatgagcctttctgttttcttggtggtggtggtgtgggggtggtataggctctccctaaattgcccaggctggaatgcagtggctcttcacaggtgcaatcatagctcactacagcctcgaactcctgtctcagcctcacaagtactgggactacaggcatgaaccaccatacccagttccattctgctttaaacagtggaaaaaatacatgtattttttaaatggaagggttggttatatcttcaatgtgaaatcctctatgtgaaatctaaataaactattcctggaatgtccagtgtcctttccccgtgatgataaacaaagcccagagctgcctctctttaaagatagtaagaagcctatgcataaacaaaacacttaaaaataagatcatttattttattttactcatccgcttaaacccatcaatgacttttaacttagaagaaaacctagtcttcctactatgaccaacaggactaagcaaatctcataacctagcctctgcttacctctcacttcagcccaacctactctttccctctcttaaaaactcagtagctgaaatatatggagctctttctggccccgagcctccagaccttttaaagaaaaaaaaagattgtaattttgatgaagaccgcattgtcaatttttatttctatggctcttacttttggtattatgtctagacctctctaagccctaggtcttaaagatcttctaggttttcttaagttttatagttttttttttaattttagatttaagattcatttggaattaacttttgtataagacagacggttaagaagattcattattttgactatagataccagattgctgtagcactgtttgttgaaaagactttccttccttttctgaaagagtttttcttttctgaaatgcctttgtcaaaaatcgcataggcacatctgtgtgggtctatttctgggctgtatgctgttcctgggaccatttttaccttccacctttcccctagttaactcctacttatccttcaggtcttagtttcaatgttgtttccgtggaaagacccttaaggaccacccattcctatacatctgcataccctcaacttcagtcctaaggaagggtacctctgttattctcactcaacacctgtttttttctccttcgtagcatttagcataatacgtttataactttttttgtttgtgcacatatagttcgtgcctataagcctcaaaaaggcaagaactgagtttattttgttcaccactgtagtgcccagcactgtgcctattacatgctgagttctcagtcaatatttttgaataaatgagtgaaacaaagttaggcttcctgggggatgttttctaaatccctaggtatcattttcttaaaattagaggatattcttggctcttggagccttagggcataatttttttcccagttaacccatctttgaagatagggattttgagaacttttggcctacctcagggtcacctagcgggttatcaaaatgcagattgcagggccccaaacccagagttcctgcttcagtaggtctgggatgggccccaaaatttggatttctaataagttcccagaaaataatgctgatgctgctgttctgggaacccactttgagaactgtattagtctgttcttgtactgctatgaagaactacctgagactgggtaatttataaagaaaaaaggcttaatcgactcacagttccacaggctgtaaagaagcatggctgggaagcgtcaggaaacttacagtcatggtggatggcgaaggggaaggtggcacgtcctatgtggtgggagcaggagaaaaagagggaagaaggtaatgctatgcactttcaaacaaccagttctcgggggaagtccgcccccatgatctaatcacttcccaccaggcccctcttccagcacggaggattataactcataagatttgggtggggacacaaatccaaaccgtatcaagcactagtgttttaacgttaagaatctgaagaggcccgagtcactgagccgccactgccaaggactcatctcccccttctcccgccaccgcccgcttttgcagccatttccactgaggaaaaacaatcgtatgtccacagtccagaacctccactctttccacccctttgctgatacaagtaagggtgatacctgtcctgctggcactgaggattatatccatataagaattcatccaacagagaaatggcaggaagacccttactactgtccaagggactgctgatgattatgataaaaagaaaccaatgaaggcatttaaaaagaaatttgcctgcaatgatactgtaattgagcatccagaatatggaggtcattcagctacagggtgaccagcacaagaacatgtgccagttcctcttagagattggaatggctaaggacaaccagctaaatgttcatgggttttaactgctgtggctcgctgaagcttgaatgaggttttccttgcaatgagtagaatttcctttctgtcccttgtcacaagtttaaaaacctcacagctttgtataatgtaaccatttgtggtctgcttttaacttgacctagtgtaattccttcatgcagtaaacttgaaagagccatgctgtctagtcttgaagtccctcatttaaacagaggtcaagcagtaggcgcctggcagtgtcaagtctgaaacaaagcaatactgtcatgtttcagccacacctagacccctaagatcatagacaactacgtctggccagaagctcctccgctctccctctgcagagttccctgccctaagagactgtcaccacccgaacaatcctcggtgaatctaagaggagaggatggggtaaggcagcaacagcaactctaccactggaagggagcctttggtggtcaaagaaagatcccctggtgtctataacctgaccaggtgcagagttttagagaggcccccttcccaatagcgaggtgataggacatctggcttgccacaaaggtctttttgaccagacatgccctagctaagggatgtccaaacaccagaatgtgagaccaaccttccatcaaagttaaacctttgacaagggaacaaatctcaaaactgatgtaccagtcatgtagctagctgtagagcttgcaacttaatggcaacagctgtccaatttcatggaaagtaaccaactggttttgaggtttgtttgtttttttcccctccagttttaatgttatgtgtaatgtatttaaaccccttttttaaatttaagttctagggtacatgtgcacaacatgcaggcttgttacgtatgcatacatgtgccatgttggtgtgctgtacccattagctcgtcatttacattaggtatttctcttaatgctatccctcctctcttccccctccccacaacaggccccagtgtgtgatgttcaccgccctgtgtccaagtgtgctcattgttcagttcccacctatgagtgagaacatgcagtgtctggttttctgtccttgcaatagtttgctcagaatgatggtttccagcttcatccatgtccctacaaaggacatgaactcatcctttttaatggcggtatagtattccatggtgtatatgtgccacgttttattaatccagtctatcattgatgggcatttgggttggttccaagtctctgctattgtgaatagtgccgcaataaacatacatatgcatgtgtctttatagcagcatgatttataatcctttgggtatatatccagtaatgggatcactgggtcaagtggtatttctaattctagatcgttgaggaatcaccacactgtcttttacaatggttgaactagtttacactcccaccaactgtgtaaaagtgttcctgtttctccacatcctctttagcacctgttgttccctgacattttaatgattgccattctaactggtgtgagatggtatctcattgtggttttgatttgcatttctctgatggccagtgatgatgagcattttttcatgtgtctgttggctgcataaatgtcttcttttgagaagtgtctgttcatgtccttcgcccactttttgatggggttgtttgattttttcttgtaaatttgtttaagttctttgtagaatctggatattagccctttgtcagatgggtagaagccaaatgatgagtgaactcccattcacaattgcttgaaagagaataaaatacctaggaatccaacttacaagggatgtgaaggacctcttcaaggagaagtacaaaccactgctcaacaaaataaaagaggacacagacaaatggaagaacattccatgcttatgaataggaagaatcaatattgtgaaaatgaccatactgcccaaggtaatttataggttcagtgccatccccatcaagctaccaatgactttcttcacaaaattgggaaaaactactttaaagttcatatggaaccaaaaaagagcccgcattgccaagacagtcctaagcaaaaagaacaaagctggaggcatcacgctacctgactttaaactatactacaaggcttcggtaaccaaaacagcatggtactggtaccaaaacagagatagacactaatggaatggaacagaggcctcagaaataacaccacacatctacaaccatctgatctttgacaaacacaagaaatgaagaaagcattccctgtttaataagtggggctgggaaaactggctaactatatttagaaagctgaaactgcatcccttccttacaccttatacaaaagttaattttttttttttttgagacagggtcttgctctgtcacccaggctggagtgcagtggcgcgatctcagctcactgcaatctccacctcctgggttgaagtgattctcctgcctcagtctcccgagtagctgggattacaggcacccgccaccacgcctggctaatttttgtatttttagtagagatggggtttcaccttgttggccaggttggtctcaaactcctgacctcaggtgatccacccaccttggcctcccaaagtcctaggattacaggcgtgagccaccacgccaggcctaaacccttatttaactaaaacttgttttcagaaaaaaataaatctgaggatgtgttacatgtcccccttttacttagtgacagtcccaggcacacacgagcttgtcattaacaatattcatcaatttaagagttgatcagagaaggtcatacaagaatccaatctcagtggaattaaaggaaaaatttttgctaagcagaaaataaatgagaactgtacatttaaaataaataaatgaacagaaagcctttcaaatcgtactaaactaacttatatctgtggctactacattgttgttctttaatgcttaaataggtaaaagcactgatgttttagttgaaactaccagcagtaggaatgcttgctcagtaagagcaagaccccactaacacagtcatatttataaagtcaaggtttaggtgtctgccagggtctgttttccctaaatctattacaaacaaatgaaagcaaatcagtaaatactgttttaatgtacctataccgagtcataaaattattttcctcccaagtcaggaagaaacataaagttggttaactgaaaaagagaaagtttaatcattctgattttcattctgatgctcttctttagactatctattgctgctttcttttgtagcagaacagctgattttccgcctaggttttcatgatctgataaaccttcaccatagacagtttcttggaaagaaactctggaagtgtcagttatctttaaatgttcaggaagctgcgtgggtctcagacccagctggagcagagccagcacgggattctgaaagcatttgcaggctctgagatggttttaacctgttccttggcagtgcagcccttgtgtacactcttggaaagatactgatgtttactttcatgatgtagaatggatgagcagtgaaggtttctaggaaggttgaacacactcatgcccactttgggacacaaggaggcagatgctctcatgggaactcttcaaataaggtcgtatggtttggctgtatcctcacccagatctcatcttgaattgtagttcccataatctcgtgtgttgtgggagggactcgatgggaggtaattgaatcatgggggcagttaccctgattctgttcttgtaatagtgagttttcatgagatctttacacttgattaatgttaactgtagttgtcctactgatctatcgaacaccaagtcttatttcttctaagtgtatttgtacccattaatctactgctcttcattccccatccccactacccttcccagcctccggtaaccactagtctactctctatcctcatgagattcagttttgtagctcccacatatgagtgagaacatgcgacattgtctttctgtgctttgcttgtttcactgaacataatgacccccagtttcatccatcttgctccaaatgacaggatttaattctttttatggctggataatattctattgtgtatttttaccacactttctttttaaatatttattattattttgtagagacagagtcctgctatgttgtccaggctggtctcaaactcctggactcaagcgatccacctgccttggcctccacattttctttattcatccattgatggacacttaggttgattccatattttgtctattatggatagtgctgcaataaacatgcaagtacagatctctcttcaatatattggttttctttcttttagagaaatactcagtagtggaattgctggatcatatagtattctacttttacatttttgaggaacctctgaagtgttttctatagtggctgtactaatttacattcccaccaacaatgtgtgaggatttttctttctctgcatcctcaccagcatgttattccctgtcttttttgataaaagctattctaattggggtgagattatacctcatcgtggttttgatttgcattttctggataattactgatgttgagcacttcttataccctttgttcatttgtcctctgttgagaaatacctgttcaggccttttgccctttttaaaatcagattaatgactttttgctattgagttgtttgagctccttatatattctggttatttatcttgtcagatgggtagtttgcaaatactttctctcattctatgggttgtttcttcaccttgtttgagtgtttcctttgctgtgcagaagcttttcagcttgatgtaatcccatttgtccattttcgtttttgttgcctatgcttttgagaacttaaacaaaaaatttttgcccagaccaatgtcctggagcatttccccaatgttttcttttattagttttataatttcaggtgttagatttaagtctaaatccatttgtatttgatatttgtacatggtgagagatagaggtctagtttcattcttctacatacagttgtccagttttcccagtgccatttattgaagagactgtcctttccctgttgcatattgttggcacctctgtcaaaaattagttggctgcaaatggcatggatttatatctgggttcactattctgttcagtcggtgtttgtgtctgttttttatgccagtaccgtgctgatctggctactatagccttgtagtatatttttaagtcaagtagtgtgaggcctccagctttgctctttttgctcaagattgctttggttatttgtggttccatataaaatttaggattgtctgctctgtttctatggggaatattgttggtattttgatagggattacattgaatcagtaaactgctttgggtaggattgtcattttaacaatattctttcaatccatgagcatggaataatatcttctccattttttgattcatcttctatttatttaatcagttttttatagtgatccttgtaaagatctttcacagctttggttaaattgattctcaggggccaggcacagtggctgacacctgcaatcccaacacttcgagaggccaaagcgggagaattgcttgagcccaggagtttgaggccagcctgggcagcatagtgtgacctcatctctaaaaaaaaatcaaaatattagccagacgtggtggcatgtgcctgtggttgcagctacttgggaggctgaagtcagaggatcgcttgagaccaagaaatcaagactgcagtgctcactgcattggtgacagagtgcaaacctgggtgacagagcaaaaccctgtctcaaaaaaaaaaacaaaatattcctgggtattttacattctgtgtagatacaataaattagattactttctttctttttcagattgttcactattggtatatataaatgctactgaattttgtatgttggctttgtatcctgcagctttactgaattcacttattacttctaatagttttttggtttttaaaaatagaagatcctgtcgtttacattcaaagcgaatttgacttctttctttccaatatgaacacctttatttttttttcttgactaactggccaggacttccgctttatgttgaatgaaagtagtgaaagtgcacccccttgtcttgttccagatcttagtggaaagccttttaggttttccctgtttggtatgatgttggctgtggatttatcatatatggcctttattattttgaggtatgtttcctctgtacccggtttgttgagggtttttatcaaaagggatattgaattttattgaatacttttcagcacttattgaaatgatcatatggtttttgttcttggttctgttaatgtgtatcacatttactgatttgcatatgctgaaccatctttgcatccctggggtgaatcccacttgataatgttgaatgatctttttaatatcttgctgaattcagtttgttaatattttttgttgaggatttttctatctgtgttcatcagtgaaattagcctattgttgtcttttttttttttttttttttttttggtggccttatctggttttggtatcagggtaatgcccgccttgccggatgagtttgagcattccttcctcttcaatttttttttttttgaagactttgagtagaattattatagttcttcttgaaatgtttaatagaattaatcagatcctcgacttttctttgataggagagttttaattatagctttgatcttattacttgctattggtttgtcgaggttttctctttcttcgtggttcaattttggttgtatatgtccaggaatgtatctttgtcttctagatttttcaatttgttggcaattgtctctaatgattctttgtactcctatggtctctgttgttttgtatcttttttgtttctgattttatttatttgggtcctctctttttagttagtcttgctaaagttttgtcagtttttttttaactaaacttttgttttgttgatcttcagtaatgttttaatctcaatttcatttatttttgctctgatctttattatttcctttctcctagtaaatttgggtttggcttggtcttgcttttctagttccttgagatgctccattattagtccattattaggttgtcttttggtagtctttcaacttttttgatgtagatgtttattgctataaacctccctcttagtactgtgtttactgtatcccatagatttggatatgttgtgtttctatttttatttgttttgagaaatttttaaatgttcttatttcttcatcaactcattgtttattcaggagcatgttgtttaatttccatgtttttgtttaatttccaaaggtttttttgttttgtttttttttttgagatggagtctccctctgtcatccaggctggagtgcagtggtgcaatctgcaacctccacctcctgggttcaagtgattctcctgcctcagcctcccaagtagctgggattacaggtgtacaccaccacacccagctaatttttgtatttttaatgagacagggttttgccatgttagtcaggctggtcccgaactcctgacatcagatgatccacccacctcagcctcccaaagtactgggattacaggcatgagccaccacacctagcccaaaattcctcttgttattgatatctagttttattccattgtggtcagaaaggatacttgatatgatttctacttttaaaaatttgttgagacttgttttgtggcctaaaatatggtttattctggggaatgttccatgtactgatgaaacgtgtattctgaatagttgagtgaagtgtgttttataaatatcagttggacctatttggtctgatgtgtagtttgatacaatggtttctttgttaattttctgtctagatgatctgttcattggtgaaaatggggtatttgacgtcctccactattattgtattataatctctctctctctttgtatctattaatgtttgctttatatacttgggagctgaatttcagtccatcaaatgtattaatcagttctaagatttctgtttgattttttgaataatgtctctttgttaaatttctctgataaatttctgaatggagaattaccgttttgtttcttgttttctggttgttttgtaactcttctcctcctttcttcctgtcatcctttatggttaagtgactttctctggtactatgttttaatttgttggggttttttttagtgtgtttatcataggtttttacattgtggttaccatgaggcttatagaaaacatcttatagataaaacaagttattttaaagagatgacagcttatcttagataagcagtccccagtctgttttggcgccagggaccagtttcatggaagacattttttccatagatcaggcagtggggatggttttgggatgaaactgttctacctcagatcatcaggcattagatcctcataaggaacgctcaacctagatccttcgcacttgcagttcacaatagggtttgcactcttatgagaatctatgctgctaatgatctgacaggaggtggagcaggcagtgctgtgtgacctggttcctaacatgcgacggaccagtactggtccatggctcaggagttggagatccctgtcttagatcacaaaaaaaagaataaataaaaaactttaaaacaaccctccatctttaattccatcccctgacattttgacttttgtgggcctgaatttacgtattttgatattgcctatctcttaacagattgctgtagctgttagggtttttgatagatttgtcttctaggtgtcatactagaattatgggtaacttatgggtggactgcacatgacaattagagtatttgaatattctgggggtttctatacttgatgttacctgtaggttttataccttcaaatgttttctttttgcacattaatgttttttcatttcagattgaagaaccatctttaacatttcttgtaagacagatctagtagtggtaaattctcttagcttttgtttgtcagaaaaagactatctctccttcatacttgaaggatatttctgctgtttgctggataaagtatttgaggatagcagggttttttggggttttttctttcagcactttgaaaatatcattccacttcctcctgacttacggtttccattgagaagtgtgttgccaactgaagtggagtttctttgtatgttatatcctccttttttcttgctgcttttagtatcctctttttgtccttgacctttgagagttttattattatatgccttgggtgtagttttatttgggtcaaatctgtttagtgttttctgaccttcctctacctggatatttttctcatattttggaaagttttctgttattatttattgagtaagcttttttctacccctcactcttgctcaactttctcttgaacaccaataattcttagatttggtcttttaaggtaattttctatatcttgtaggcaatctttgtataatatatttccattcattttactttttctcctctatgtaatttcaaagagcctgtctttgggctgactgattctttcctctgcttgatgcattctgctgttgagagcctccaataaatttttcagttagcaaatatatttttcaatttcaagattcgtttgattttttatcacttcaatctctgttaaattcctctgataagtttctgaattgcttttctttgttgtcttggagatccctgagtttctgtgaaactgctattttgaattcttggtcagagagctcatgaatcaccatctcattagggtcagtcactggttccttgctttatacatttggggaggtcatggttccatgttcttatggatatatgtctgtgtctttgcattaaaggatttattatttattccaatcttctctgtctagtctgttttggtttttactggtatgtttgcttagagattatttgtaatttagctgttgaatttcttacacatttttcccgctaggtcactgcctctttttcagcactaaatggtacttaaaacccaggtttgcctctgttcttctagcaaaggatcagaggattgcctggctggaatgggggaggttgcaaaggagctatccctgtggtatggaaaggctggctaggagttcatgcccaagagacctgtggaatctacctcctacagcatagtgctgccgaacacccactctgatttggcgtctcctttggttgagttacagagcggagcttccagggctggagatggtaatcctgcctccttcctttgtgtccggctgtccacagggtggtatctcccttcaggcactcctgatgcttctcatgggttgaggcatggataggtctcctgccaaagaagccaagatggtaggcaagttgtgtgtccaacttaatctcactttttccagtgtagaatctgagttgggggaagttttacatgtgcttgataccaagcagattgggggaagggtgtcacagatatgaaaatctgattctcttactgtctgctggagtttttttttttttttttttttttttttttacttctcagtggccccaggaactgaccgattctctttcatgagttctgagagattgctggtgataatctcgatggtgtatatttattttggttattctgtggggagaagtgaagccagctttcatctacatttttaaagtataattcttattttgagtggcaagaatctgattccagtatcctgccttagtttttatgcatttttgaaattcctaccattgcatttagaaccttctacctggtggagttttttttttgtttgttttttgtttttcagttttggaagtatttgattttttgaaacagttgacattcatataaagaacaaggttgataatcaagcctgctctagtaattctgtgcagtctagaaaagagtgtactggggccgggcgcggtggctcacacctgtaatcccagccctttgggaggccgaggcatgcagatcacaaggtcaggagatcaagaccatcctggctaacacggtgaaaccgcatctctactgaaaatacaaaaattagctggacgtggtggaggctgaggcaggagaatggcgtgaacccgggaggcggagcttgcagcgtgccgagatggcgccactgtgctccagcctgggtgacagagcgaaactccgtctcaaaaaaaaaaaagagtgtactggttaagtactgagaagcatttcctgtgtgtctcatgtaagtacttcaggctcttaaatgtgttactccaaggaataaggttgcaaatacagttgctctaaaaacatattataccagcctggccaacatggtgaaaccccatctctactaaaaatgcaaaaattagctgggcatggtggtacacacctgtaatcccagctgcttgggaggctgaggcaggagaatcacctgaacctgggaggcggaggttgcagtgagctgagatcgcgccactgcactccagcctgggctacagagcaagactccgtctcaaaaaagaaaaaaaattacataaaattccgagatgcagctttcttatctaaaaaggatttgcgcaaagcctccttgcagtaagcatataggtaactaaggtgtctaccttacgtatatgcatcactcatttatgccctaagttctcatttgttaaaacaatagtgcccttactctaaatcacataatcacaagagccctagggctgaattgctcagctttaaatgtcagcactgtcatactagctgtgtgatgtgagcaagttctaaaactccctgtgcttgtttcttatgtatacaatggagagaaggggtagtactttgtagggttgttgtgaagtttaaacaaggtaataactgttaagtgtttttaaaagtcccttgaatgtaacaattgcatcagtggtaaggtatgcatttttctcatatggcctctgaaatgaggatgtgtcttataatgaatgtaatttcttaataagcattttatcatttagtgacatcttttttattagtagtacttaatgttacactttgggtgacattttatatttcaataactaatagtaagaggtctattaacattagctgccatcaacattaccatcaatattatcatcagcattatcttgtttctaactgagatagtggcatttgatagtttagcagtgctagagtatatatcaaatctcaattttatctaactacttgtttgcattggtgtatttttatcaaagttctagtgtgctgtttttcatatttgtatcattttagctaatgtaaagtatttatggggtcagctcatgcaatgtttccgtcattcattgtaccttacttggcgatctactaaaacatgcatcagcatccttcagtctcccgaaataaatagacacaaagacaaattctttattttctctgttgatgtattttcctaaatcgtttcgcaggagtggtttctttcttagctaggagaactaagccaccattgtaccacttaagatttactggtttgcactgtcctctgagggagaaaagaagcaatttattgatctgtaacacaggaatggactgtggccaaaccttttctggtttatacaatgcaccgacataagaatctgcatagcattaagaagaatgagcactcacaatttgaggccgcctgtcagcatgaataataactgagaaaaatcaatacacaatatacaactgttctctttgcacagacactgccaggattcacacccagtgacagtgtcttcttttttttttttttttttttttttttgagacagggtctctcactctgctgtgcaggctggaatgcagtggcgtgatctcggctcaccgcaacctctgcctccctgttcaagtgattcttgtgcctcagcctcccaagtagctgggatcacaggcgtgtaccaccctacccagctaatttttgtagttgtagtagagatgggattttgccatgttggccagcctggtcttgaactcctggcctcaagtgatccacccacctcggcctcccaaagtgctgggattataggcgtgagccaccgtgcccggccaacagtgtcttgttattttaccagtgatatgcttacagttcctaattttaggcttcctccttattttggttttattgttcagtttggggaagggtgggaggcaccaatttggatctgagaaaaagatcttctgccagatgaaagagtttcaataacaggagaggaccttgggccaaagtttattaagcttgactaggaagattctgggcacatctccatccaaataccttgacacatacttcattcacccctagcacatgcagcttgtcccttcttgtcttctgtttgccttcaaggttttacatggtggtatttacaagccgttatggagcaagagtgcaaacacacaaggctagcaaggggccagtaaacagggtttggcttagggttttgtggttgttagcttttaaaagcatacttagttgaataattccagaaactgggcttctttcctttgccccttcatttgcccctccctctctggtcttcccagtctccacttttttttttgtttaaataaaactgcgtttgtcagaaatgtatagacattcactcctattcttaaaagacagtgtttatccctaatgcctgccttttgattcagccagcagtgactgtgcacacagaggttattgctctccaagttcaatgttgtggacctgaaccagtgcctctgtttccaagagaaagtcaggtgattaccccttcatcagggagattggagccatcctatccttctggtgtgtcaccagccagaaactaaggatcagcagggagtggatggtttagaatctcctctctccaggtgaacacaatgctagtcagtgtagctggaaaagccacgcagcgggcaggcttgtcagaagcaatctgtttaaaaaaaaaaaaaaagagagagagaaaaaagggtccttttgaatttacactgagttgctttcacagtagttagctttgaactgtggtgcaaacccatttaaacaatgagggaaatttcactaagtggcaagaaattctcaccctgtgtgatcaaagcaatcagccatttccttttctttcctttttatttacttatatttctgaccccttataatcttcatgattgtagcctgatagtttccttttttgaatagcatttaaaaaaataccttttcttttccctgagggttttaaagcaaataagacagaaggggtctaaatttttagttttgttttttgagacagtctcgttctgtcgcccaggctggggtgcagtggtgcaatctcagctcactgcaatctccgtctcccaggttcaagtggttctggtgcctcagcctcccgagtagctgggattacaggcgtgcaccaccagccttggctaatttttgtattttttagtagagaagaggttttgccatgttggccaggctggtctcaaactcctgacctcaggtgatctgcctgcgtcagcctcccacagtgctgggattacaggtgtgagccaccgcacctggcctaaatatttatttttaataatgattattattacaaaagtaagaaaagagctaaaatccatgatttcatcacccagaggcaaccaccacagtgaacattttggtacaattacttctcatcgtttaaatgtgtacatatacacatacatatttttaataaaattaggtttaggatagtatacagttttgtttttcttttaaccaacatactttgaatattttgccttattaaaaacttatatgatttcaatggctgcattagaattagtgtatacagatattattttggcattctgttgttaagaggtcatgtgggtttctgaattgacactttaattctcaacttagaatttatttctcccaacttcttctgatttcatgggtctagagtcagagtttgggcacaatggaaatgggatttctatatgtactgttgtttactgtttgctagtatttttcgaaaggtatttgcaaaaaccaaaggggaaacagtatacttttttgtatttttttttctttttttgttttaaattttgtgattgaaatataagtcttattatggtaatctcaggtaacttttaaatagaaatatcaatgcaaaatgaatatattgcccaatgtggaccccggtgtttcagaactatgtgccatgctctatcattttgttactggaaaggggtcttaatccagaccccaagatcttggatctctcacaagaaggaattagaggtgaatccatagagtaaagtaaaagcaagtttattaagaaaataaaggaataaagaatggctactccataggcagagcaggagcgtaggctgctcaactgattatacacacagttacttcttgatgctaaacaagaggtggattattcttgtgttttgcaggaaaggggtgggtagttcctggaagtgaggggtcctcccctttttagaccatataggataacttcctgacattgccatggcatttgtaaactgtcctgctgctggtgggaatgttttttagcatgctaatgcattataattagcatataatgagcagtgagaatgaccagagatcactttcatctccatcttggttttggtgggttttggacggcttctttaccacaacctgttttatcagcaaggtctttgtgacctgtatcttgtgctgacctgtctcatcctgtgactaagaatgcctaacctcctgggaatttagacttaaaataaaggtctcagccttattttatctagcccctactcaagatggagttgctctggtccgaatgcctctaataatttgaagtttatccaacggcacagtgggagataatgaatttttgtttaagaggaggaggactgactggatcagatttgtgctttagaaaggtggttgcatgtaagaaagaggcgttggtagaaagacttcggatatctcaaaagaatttccatgaagttaatctttttaaaaatgtaaacatttggtgcaataattgctttgaaattgcagttgaataaatgaactttttgaaccagaatttggaaaggaagatatgcttaaaaaccaaaaatatttcgtagagtgctacacattaggaagtcatttgtatttggtgaccactttcctaaaatagtctcatttctagagaaccaattttgtttcccatagattattatgtgtagagaccccctttcagtatgtagccactggtacatccgtgggtgttatctccatactgccaggtccaatgcagtcacctcctggatctatagtctttctccccccattccgatttcctttctctgttagcagtcatctttgtaaacagaagtctaagatttagtttgtacattttttaaatgatccattttgatggggctctctttattgtttcaggttgaatgcctttgagaacttgatgcataaaatttgcatgactcctcactcctttctggatctctcattggactcaagccagcatggctcacaccacaaaggttaacggcagtgcctcaggtaaccctgtgctctggagtttgtgtgttaaatgtatgtcttttctcaaactaattttttattctctttaataatgaacggataatagcaagttgcctagataactaggatttcaaagcaattttctgtccattgaagtttgggtttgttttgttttactctcagaaaatttgcttttatcttagagtcttgcactgaaatcaattgagtaaattattacctaagtcaattctgttgaagtgttgaaagacaaatgtaaatactgaatgctgatgcaaatgtaatgtatactcctcttgcacttctttctgagggattgaatgaggagagaggaaattagtttggatgcttaaaaccaattcctagtagccactcccaagcagcttttgtttgatgttgctaaacaaagagaaaggagggaagagaagtatatattctgtaaaatgattctcttaggaatatgcaacaagccatattatgaatcataaagacctgtatttgaattcttattttggttatattagagacttacatagtttcactttctgttccaatattgcttctgtgagattcgggagaaatctgtacacgaaatgcagagaagatcctcctaagagacacatcaccatagggacaacctgcccaaaatggcgtgccaagtgttcatttcttttttgagttatgtgccaaatagctgaatgagtaagaatagtaattgtctatgcagaaattttttctgagcgtctgagtccagactcctacgtctgctggctctgaacaccttcaaatgacaacattatatactggagcaagtgtagaattggagccaggaaacctgaatttgagtcctagttccagcactaaccgtgaaatattgggcagggctatttctccacatgtaaaccatcggtaagtatatccacctgccggtttaggaccagtgagcgcaccagaaacatacttagaggagctatgtaagccgtaaagcacttttgaagacaacagcaggaagtgacctctaaagtgggcattcccagcccatgaatgtgactttttattctagcggtctcagctgcaattatctcctctgggtagaacactataacccaaacccagataaactcagttatttgttctgggatgactgatctttccctgtccattccatttttgaccttttttactgcccagcttcttgagacttttatagattctgctgtgggactgctatcaataataaagacatgaatgataatatctaacattcattgaacacttaaatgcaccatggtgcctaaaatgctttgcctgcattttcatacttaatcctcacaataatctaatgagattaagctattattttactgtcatcatcatccctatgtaatgtcacagagaagttcagggacttactgtaaatgaagtaagaaaaatcagaattatgggcagtggctcacacctgtaatcccagcattttgggaggccgagggggatggatcacccaaggtcggtagttcaagaccagcctggccaacatgacgaaaccccatctctacaaaaatacaaaaattagccaggcatggtggcgcatgcctgtaatcccagctacttaggaggctaagacaggaatggctggaacctgggaggcagaggttgcagtgggcccagattgcactactgccctccagcctgagtgacagagtgagactccatatcaaaaaataaaataaatcagaattatgatgactttctccagtaaaatatttggtgagagaggagattgaaacattatgaaatttcaagtgtagtgggtgggttttaattccctctgatgatgtggtttcctcccttgccctccatttgcttccattcacatgctcaggggaaggggtgtttaagattgttggtgcctcaagacctcaaccttcttctggtgccttgggcaaaatcctttcttcatgggtttagatacctaccccactaattcctttccaacttggtttgttctgtacttaccttttttctttgttcctgagatctaataagcaagctgtaacttttccttcccacctggtatcctgcctaacaggtctgggcattgaggttgaaggcaaaagaaagctctccgatttgtgactttcagggtgtcagagtatgaattgttactgcagacagttatctggactgtgcaggggaagattttttacttattctagtcaccatgacccatgtacatctataagcaaatctaattagagactcaaccataaacagtaatatatatgcaaacatacatatatgtgtgtatgtgtctgtatatgtatatacacacatagtaatatatacatacatatatgtatatacaaacacaaatgtgtgtacaccatatatatgacactcatagaaaaaaaaaatttttttttgagatggagtcttgctctgtcacccaggctggagtgcagtggcacgatatcggctcactgcaacctctgcctcctgggttcaagtgattcttgtgcctcagcctcccacgcagctgggattacaggcccatgccatcacgcctggccaatttttgtatttttagtagagatgaggtttcaccatgttaaccaggctggggttgaactcatgacttcaggtgatctgcctacctcggcactttgggattacaggcatgagccaccgcacccagctgaaaatttaaaagtatagatgtgtgttgtattgtctgaaaaccaaaacaaaagcaagaattactggtgataataccacctagaaataaatgtcttcctattttttatatagttgtcaaatgttatatatttcacatggttgagaatatgttaataaaaatcattcctttaccttttcccactttgtattacaaaggaaacacctctccaatgtttaaaaaaatactcaatgtaagagatgcgggttataaatacacttctgtgcatgtaaataacatttagagaacctagatgaagatgagataaagagggcttcatggcagctagtgagggccaattactggtctcctatgagaaaaggataagctatttgggtttagtaggagtttcagatgtggagtaaattatatgtttcttcaatttccaaaaattgctgcttgggcttcatagagcatgaggggaaatttcatgtgacgatggagtcagggcagtggcaaaagaagcactttccatagtgttagtaataaaacaagcaaaagaggagcctctgggaaagggcaaaccatgcccttggcacaaaatacatccgacgactgatcatctcaagttgacatccccatgtaacatttaaatgggataaggggtgattcacaaccttttatactctgacttccccttggagtccctcacggaggctgggtaaaagaaactgcttttaaaacgagctattcattaatgctgtaatttgtaaaatgtattatgccacacttcagacatacaaaatgtgtgaaagttatataacaagcacctttgtacacactacttagcttaagaaataaaccttattaatataggccagatatacatgagcacctactacgtgctgttttaggtactggggatacagcagtgaaccaaagaggcaaaaatttctgccctcaaggattgtacattctagggacagttaaagtctcctgtgtacacggttgccagaagaaaaaatactaagcacgtgttcatcgtttatctaaaattcggtttaatggtgctccactttcgtgcgcggccctacctgtgtaccccttgcagattgcacccctgcccttcctcaccgccagcccatcaaaatcaatcttccctcgtagtgttacctctttttcaccagatcctccatcctacttctcttgattggtacagtactgttttcattaattcaaaacattttaggccagatggggtggcgcagacgtgtaatcccaacactttggaaggccgaggagggaggattgcttgaggccaggagttcaagaccggtgtggggaacatagccagactccatctctacaaaaaaaaatttttttaaattagccaggcatagtggtatgcacctgtagtcccagctactcaggaggctgaggtgggaggattgcttgagcccagtagtctgaggctgcagtgagttatgatggtaccactgcactccagcctgggtgacagagccagaccctatctctaaagcaaaaaacaaaaaacattttattatggtactgctaacagtactgcagcgtcttttgttaaggaggtaagagcatcataaattgctcttgactgttctctcatagccagctaggaagtaaatggtgattgttggttaggaaaatagctgtgtttctttggggtgtagggatgaggcagtctgctttttccccaagtttctgaatcatgttgtaaactgaatgcactgattgatacctctctaaacactaatgttgtgaaactttaattagagcttagatatgctttagaagccaaataacaagtggcttatttgtgaaagaaagataataatagctatcctaccttcttcacaaggtggttgtgcagggaaaaaaagaatagctgtaaaaacactttttaaaacacaaagtgctggtcatatgtcaggggatagcaccattccccttgttctcttgtccttgtcatgagccgctgatcaggaaacatcccaggtaccctcatgtcaggccctgctggacgccatgatattggggccagagttgtattaacatcctcattaaacccagttaaatgacataaatggatgagcactgggaggtgactttttatgcctgctcttatcatctttatttttgctactagttgccttccccaattgattatagcttttccctcatgctctttctttttttgcagcctggatatatattttttcagacagatacatatttatttattaaagatgcttattgaattgcattaaaatgttatttaggctgggcacggtggcttacgcctgtaattccagcactttgggaggccgatgcaggtggatcacctgaggtcaggagctcgagaccagcctggccaacatggtgaaaacccgtctctactaaaaatataaaaactagctgggtgtggtggtgggcgcctgtaattccagctactcgggaggctgaggcaggagaattgcttgaacccgggagacgaaggttgcagtgtcccgacacagtgctactgcactccagcctccatgacaaagtgagactccgtctcaaaaaaaaaaaaagaaaagttatttaaattaatgataacataaaatttgacaggaaaccagaagagaagaattactcaaaattccacactaggtcttatttttagtatttatttttcatgcttttcaggctaacaaacttaaacacagtttcaataagcttttataatttggatatcagctcttgactttaacattctttgcatttttccaagtcttcatggaaaatagttttcaaattattattttcaatgactgtataatattccttatggtgtttctaccagttgaagtattctttttttgtttggatgtttggactgcttccacattttccctatggtagatgatgttgcagagaacatcttccctggtcatttttctcctccttttttattatttcccaacaatttcaaagaagcaggatgactgggttaaagggcacaatgttttcatggctttagtaactgttgtggggcttgaatctcgttatcttggtcagttatttggctccagcttttgtctctatgctgatcttaaatgagtacaaaggccactgataagaccgggtcagccagacagagccaggctcatggcagggtaggcagaatgctgcagtgcggtgcaccccactctcgcttgtgtaaatatttttctgggcaggagcgtttctcaaacagaactctgagcccactgcggtgaacctgatagcaggaattacgtgctatttgtcaagtataagactagtttgcagtgactggtctggctagaacccacctggtgttttctgagatcatctgtaaggaaacacacagcacagcagaggcagtgtgcgcccgtggtggtgagtcttagacctgtcatctgtgttagcattaccccgaaggcagagagtttgctgattagaaactatggctgctttaattcatgggtaccctccgtgacttttcagggtctcctggttgaatgaatttgcagaaggattaaaatgtgtgttcttatttgtgctttgtattctcccataagtagtgtgttggaggctattagaatagctgagagggtaaaacataaacacataggtaggagcctgacataaacacataggtaggagcctgccataagcacgtaggtaagaactaaaagggtgtgtttccatttcagttgtccagccttccttccatactctcagatgacaaaacacaagttgctgagctcacacagctaatgactaagccagaagttggacatggagaacatttttcctttgttcaaggttatttattatgttgacatttaaaatcagaagtgtgatatctgtgaagttctgattaaacagatcaagtgaaaaggatgtagttcagaaaactgcataaaaccctaaagtacagtgtttaaaaataaaacgtcctccctgatagggattatgttggtaagttactttttttcttagtatggattatttcaaattaataaacatattgttattcctttatttattgcatcatacagcttcatcctagtattagtgtgtttaataattgcatttaattagattatgcatttcaactttcaatgaaactgtagctgttagtcttttgaaggctaatttcacgctgaaatttatagatgaaataattttcttatagtggtggtgtttgagaagataatgtaactacttcttagatttcaatttcataacccttaaaatgttgggaccacctacaaatgggggacaccctgggttttgaagtcttgcctgtgtggttaatcagaacctcagaattcacccagcccccggagaggttttgaaaagcccctggctcatcagagcttgcttgtttcataaactcttaaggctttgttttaacctgtagccagcttcgccttataagctttcttgccccaagccttgagccagtcataatggcttaagcatcagatttcagacaggcgattagctctccagctaagccaagaaaggatgatttatcttccagtgagtaccagcctatttgagtgtaggaaggagaaaaatctgtgctcctgctcctgggtactgggcaaagaaaccctttggttggggatttttgcctggtaccaactttataggtgccaacaagaaagaaagaaaaaaacacatacaaaataaacacccaacagggagattcgctgtgttaagaactcgagctgttgctattattctaagagactgggtagccagtcaaagggttaaaacagcccttcctacaaggatttgaaaactctgtgctctgctcttcctcagcagacttctcgttgtgagtattggcatttatttctgattatgcacttcccctctttcttgaatgagttgggtgggctagctgagcccatcaaaggtatagctcatttgcttccttttccagggtttgccttcttcctgtgtctgggataatttcagttcatctcctttgtgcagtttctgagaaaggtttgtatgggcttagaggaaaatgatcgtgactaaagctcacagtcaccgctttggctccttttctataaaaggtggtttgatttgatctggcatgaaaaatattatcataattctcaaattcacagaaacgataagttcttgctctttcctgaccaaaaaaaaaaattaattgcattgggtagacttctctaataaaacctttaaggagacccatccaggaaatcagattttataagattcattcaaacagttgtagaaattctaagttcaaaaaccaaaagcagactcttttctttttccttccttggcttctctgttggatatttttggagtgagccttaactgagttactcatttccacatgctttaggaaaagtatgctcatgttttacaggctaagcctggttctgcttttgagctgcagttcattatgaatccggaaaacacaggtttttgaaatgcggcccatttgtacatatagcattagtcatctcagctggtagttctatacgatgagttatctcaccacttaaaaataagtacgctgctattttgagatttaaaaatatatatagtgaccagatttcttaccctagttaaagcaagccatggctgaaactcagattaaacaatattctataaaaatgagagaaggccactctaatcaacagatagaaaaacagaactatagacataagggagagctgtgctaagggacaaattgttggatttgtaggatttgttcgtatcctgaaagttaaatctttgtactcttaccttgtttatggccagatttgcctgatccctgatttccctcccaactggatcagaggttgtggaattggaatttcaccatacaaacctttacttaaaggaggtagtactagagtaaccatttatgggaacagtttgctactaatagttactagtactgagtttattttagttcctttttcatgattttattccattggaaaagttttctctcagggatcttttctactttggacatgatctctgttaggcagaatcaaaagatagctgtgtggctttctgaatttagtctcacaatatttggtttagttgataaatcccatccatcagctttgcaaataattttgtgaaaacattgattcagcttgtcctgcccaattttcccatccctgcccagtttactgagtgccttttccatttgcatccactgtccattaggccaaggcgtttgaagtgtttctgtacagcaggtacatttaagactctccaggaagaaagggggaagaatattccaaactgaaaacatcaaagagagagatggggtatttccagtaacttatatgcccagtgcttaatatcttaaaaaccctactcatgtgcatcagctcttacttttttctaactaaaaccagaaaaaagttctctcttcctctgttctcagtatccccctcatgtaagtctgtctacccaacacggtgcagccgatttatttatttttccctcagcatttttaggtggattgactgggatgctttattcaactcagggacgcaccacgaatatgttttttggggcaacccgtttggcatgttccccctcagctgtgaggacaaagactggtttgtcttcttgtgacctggcagaggaggcagaagtacctgctgagcttatgcagcatgtaccccaaccggtgccccacctcttcaagtggtgaatcagcctgatgatacactgatttttagaacacgctagggtggagacctggaagtctgtacactggtcggggagggagggatggtttgcatgtcaaaccatttcaacaatgcagcttacaggaaaaaaaaattaattgcaaaacactgtgatgccctttgccaccagatttttccattagcaccacactttatacagcttccaagtctgccccagggacaactgtttggcagtgtgaggggaaatggcagcatcacgtcataagtgcaatgattgttacctatgagcctatccggtaagggatctgagtgggcccaagcatcacacacgtgctggagctgagtgttctctgaggaacatgctaggatgttacttgggtgctagaaaacagcagctggaattcacaacacctcaggacactgattgtaaatgaagaatcctgagactaaacatcttctagaaaggtaaagggggcttagggctgggggcttttcctctgggctcttatcctttggtatgttgtccctggatgctttgagatgagactttgcagatactgctgaatttcttttcttttctttttttttaatactgctgcatttcaattggggtgttgtttggggactactggaaggaatgttatgaaactccatagaaatacttcaattcagtgagttcattcattcagtggctcacttttaaatgaccatacagatgtatttggcagaatacatctttgccattttccttctttgtgtaatggaccagccccgaggctgcgagcattggtccttctttgcctttttctccctgctttgtggttttgtgtatgtaaggatggctggcaagattaaggatcattgagctttgtattttctgttatttttctgtctccccaaacattttcactttcacaaactttaatctctaactattattcccttatcttaactctgaacttttgttttggacttattttgtctgaaatcatggtctatttccgtttcttcagttcttgtgtctgtaaaaatcacagtaggccttaccggaggtccatgactacaggtactcagagaccagctgtatccaaagagttgtgtaagataggggcatctgctccctcccagtgctgttgcccagccccaccctgccctgttccccagttagtgtctttgctttcttgacctggatatctttcccatatctattaatataagcccttcttatccttcaagtcttgctgcctctcttacctctcccaacaggcattctcagatactcccaatgggagttcctctcttcctcttctttattccttttattctgttattattctattattatttctattaaataattgccatcagttgcttttaattaagagttacggttgtgtgcgtcactaatcttataaacttgagtgttttaagaggcaagaatcatgtcatcttcttcgtatgcccaacaatgccttgcttagtagtccttgtagagtcaacagattcaatgttcaaccagcaaatatttgcagagcacctactttgtgctggcatgatgctgggcatataatacaggtcaaaaatcaggcccagcacctgcctaagaatttgtgggcctgagccctgccagttgccaatctgatgtgctatattctttgcagttttcttccagccttttcccgtaagttcccagttggtcgctctgtgaattcatgtgtgacacttcacctgggtgtgtttcctgggtgaacagatggcttttactgtgtcacacacacactcttgcgttctgcctcctctcgtgaaagttgtagttatctgctttctctccctcacttgctctaaggcaggcttaagatggtgttgttgctgggtgtggtggctcatgcttgtaatcccaacactttgggaggccaaggcaggcagatcagttgaagtcaggagtttgagatctgcctggccaacggggtgaaaccccgtctctactaaaaatacaaaaattagctgggcgtcgcagcgggcacctgtaatcccaactacttgggaggctgaggcaggagaatagcttgaacccgagaggtggaggtcgcagtgagccgagatctgcacttcagcctgagcgacagagcgagactctgtctcaaaaaaaaaaaaaaagagtgagaaagaaagatggtattgtctgttaagtgccttgggttccagagagaggtgaccaggtatgttgtggctgtcttaaggggaagattattgtcaggggccatttggaaagttcttcctggctgccatggcctttcattgctttttgtggcatgttagcagcacaaccagatagggaggaggtggtactccagttggttccttttgtctcaggcttattctctggtgcagcttggtgggctggttgcaaccgtaggtaagaacctgagctggtagcccctgggggtatggctggctggcctgctttccttctttcccactgttttcttgggaaggtctctacagacctcacctcttttaggtgtgaggagataaatagtccttattatcccttatttacagccttcatagagtctttgtagtaatctaagttaaggtcttaatgttcttatttagttctgtgtccccccaattcatttggtattggcttttcttaatgctgatttcaaatcttggatgaaaatatattatgagaccatctcttctttagatgtgacaaaggtaataaccatggggcaatccagactgtgaagaaagcctaaggtgtagaaagcccatgcgacactagttttaagccttcacatgtgtttggggaaatgcgtttgttgaataaaggataagaagacagaagactttttatttttcttgtcttttaaggtaggaccatcagatagcatcgtcttcctaaagtcactctcctgacaagaatcagacccctctgccggggcacaccctcctcatgtggaaggcagggtggcctctccttggaaaatctcccctcatgttaagtcttctgagcggatcctgctaatccaggcatgtaaaggaggagtcctcatccaagacccaacatggtgcacacctcacaggaggaggaatggaaaagcaggcacctttgctggactttccttttaatcccctaaatcctgtcacaccctaagactatgaaagagatgggtggagaagagccttggtgctgtggaaagggccatacccactttctccctcattgcagctcacagtgtaggtctcacacccatcccaagcacctaaggggaggggtcggttaaagcagcacaatacagtatttgaactcttcaggggtttggggaagtccaatataacagaaataacccaggccctcagcgtggggtagcagagcatcctcctttcactctgtctctttctaaggcaaatactcataggtagagtttttgcaaggtaagcttacctgagccagaaagggtgggaggaatgtgagattgttttgattgttgtccttgggttttgttgttgctgttgttattgttgtttataagaactacaagaggctgggcacggtggctcatgcctgtaatcccagcactttgggaggctgaggtgggtggatcacctgaggtcaggagtttgagaccaggctggccaacatggtgaaaccccatctcttctaaaaatacaaaaaaaaaaaaaaaaaaaaaaactagctgggtgtgttggcaggcccctgtaatcccagctatttaggagactgaggcaggagaattggttgaacccgggaggcagaggttgcagtgagccgagatcccgccattgtactccagcctgggtgacggagcgagactctgtctcaaaaaaaagaaaaaaaaaaaaaaggctacaagagagaatgtccctagtttatggcttttcagtaccaaaatagtatgcattcagcagtagagtaagcagtagcagtagaatagcaccatgcttatgcatgacataagcttcatctgtaaaaggctgaagtaatcataccttgctgtagggttgttgtgaggattaaatgagttcgtgtatgtataaggcacctgcagcagtggagtccagaagaattgtgcacagtgggtggtggggaaagatgagggcagggaacattgggggaggaaagtaaattcaatggatgtcaggaaataggcatcttgacctgtccacagtgtaattcaggccaccactcactacttaatttaactttgttcttatctctagactaatggagcaggctctctgggggaaaagtgttgctgcagtaatcctgttaagtgtaagaactgaaggttcaggttgaagtctcaaagttccaaagccaccatcccagggataaagactgtgctggtatacgctcagccagcctggtaccacagaaggcttttgtctccagcaggttccttttctcactgggcgtcaccttttctggctactctccgcctgtcagaggccaagccttgagtatatcttcatcttcccacatcttacttggcttctttctttgtatgtatattgaaagagtaaaggcagataggtgtgtgtttctctcttcagtgggaacctttgtgactgatggtttccaggcagaagaggttcaaatttttaattgtttcccttcccaacccttgtcatcgtctgataaaggactaggcatttatttgcatacaatgactttttctggtggacctcaccttcacagaagcacagaggcaaacacccatagggtcagatacaagctactttagcaaaatgattgactttgactgctttatgtaatctaaactcttaccagaacacaatatttatgaatgtagcagatttttttttttgcaggatcaagaaacactacattcagtactttattcgtttaacttttaagaacaagtcttttgatagttttaaaattgtatgtgtgtgtgtgtatatatatatatatttatttattattattttttttaatagagacaaggtctcactattttgcttaggctggtctcaaactcctgagctcaagtgatcctcctgccttggcctcccaaagtgctaggattgcgggcatgagccactgcacccagccgatattaaatcttagtttggaatataataatgtaactaaataataccagaatttttttttttttttttttgagaccagagtctcactctgtcacccaggctggagtacagtagcatgatcatagctcactgcagcctcaacctcccaggctcaagtaatcctcccagtctcagctcccgagaaactgagactacaggggcaagccagcacacctagctaattttttttttttttttggtagagacagagtgtcactgtgtcatccaggctggtctcaaactcctgggctcaagtaatcctccttcctcagcttgccaaagaattgggattacacgcatgagccaccatgccccccaaaaagggttcttttaaatgccttcttcacctttgtctaagtacattgggtaaatgtggcactagttgaacaagatttactgaattttatcacagggcaggcaggcaaagccagttctaaacaataaaacagagatcaacaaagatgacggatgactctaaatagcctgttttgtaaaattcaaaacgggacagctgtgtagagagaggcacagttttataagaattcactggacctgcctagtttggctcatcttggtgcctgcacatgccctgccttattccatttactttccttctgtctcatctcctactggtgaccacagttactgatgggagaccttaaaggtgattatctttgagacacatactttcctgtgtgaagacacaaagattaaactctataagaccatggcacttatttgggcttggggcttggtttataccaaataaaccaacagattaaaaaataacaaactaaaaacaaagtttcaagtgccaggtattttgaaatagcagatccaaataatttcatattactttacacaacaagacctccattagtaagagatttgggttagattttttcttccttttttttttttttactttaaactttattgagctgttttacataccatagaattcacccattttaagtgtatggtttgataagttttagtatatgtggacagttgtatatccacaatccagttttagaacatacccataacactaaaaattctcttgaggtttatgttatcatttacttttgacagaaatgttttcttctgcttttgaaaaaaaaaaaaattctgggccatgtgtggtggttcatgcctgtaatcccagcactttgggaagccaaagctggaggacttcttgagctcaggcattcgagcccaacctgggcaacatagtaagaccccatcactacaagaaaaatacagaaattagctgagcatggtgtcgtgctactctggaggctgaggtgggaggatcacatgagcccaggaggttgaggctacagtgagctgtgattgcaccgctgtactccagcctaagtgacagagtgatacactatctcaaaaaagaactttttttttttttaggtaatgaatttaaatcattaggggaacataccattcttactaactttttgaaacaaaaacaaaggttgctcgaagatgttatgaataaaatgtttaagagtatgagggtacagagcaagggaaggaggcttgggcctatggtttacgaatggtgattgtttttagccttctaattatatgttgcattaaataagaagaaaccaaaaaggaaccacttgcctccattccagcctcggttcagcataaaactcaatcatttccttcacaagccagctgctgtgctatagctcaaattgtaacagagagcctttctctgcagtggagggttagggaaagagggagtaagtcagcacaaacaatgaggaaacatttgctgcctttctgatttcttcctagaattaacaggcttacagctgcatttctaggtcagcatttcatatgcctgaagagtatgaggatagtttgaaaaatcagaaggaagatgagagagggctttgcctcttttttaagatcttgctagcagttttgtttgttggtaatttttgctgtctcactgacgccaagagtcctggaattaaaccccgtggccagcaggctgttagttcgtcaggaaattccaaatgggtataaataaattctctgcaacagctcctgggctctttgcctgctaatgtgtggagtccctttaatgctgagggaagtttgcctgagacctggcttcctgctcgctgaaaatcacagttattttgtttctgggtgggtaagtaagaatgcccacaaaagaaagagaggaggagagcatgatgtttgggtgggggttggtgaaatataaactcgagctctgtgtgttgtgaaaaagatttgcttttacttcaagctagaaagaataacccagtacttgatttttggtccagtgaaaatttcagctttacctatggctttaacataaagatgtcattgttgcaggagtgaatggttgtacatatatatatgctaagatttgagtttttgagtttaaggtttagttcaattcaataatttccttttttgttgctaaatccatctttgggtatttgttttcagctctgtttttccaatagggagttgctcaatattcattaaagctggcttcttgtataaacactataaaacaaaataaggacagggattcatacaaatactagctttccactaccaccccacctccccctggccaaaaaactgtaatgttttgttagaaaagcctgttttatccctaagttagccagtgctccttttctgcttttcacagaattactctctgaactggcacatttcttttttacgcttagaacagcatgttacttttgaagaaagtttggaaaataacagtccaagctcattctcttctgtgcatgcatgattgatttgggctgtatttcagcaacaacttttaaaatgagacagtggacattagagagcagcatagttggggttgcacttaggagcccatggcattttggctgttttgagacagatttggggtaaagagttgctgcatcttgtagttggcactgaacactggagaagagggccactgtataaaccgcaaggcccctgttaccatcacatgcctccctagcacaatgtgccctttattaagacaggccgttccactactgagaatagtaaccctttccgctgtcttcccctcactcttacgtgcagcctggcttctggcctcttaacccatgcccagagtagaattggcaatacccaggagggacactgcactggggattgttaggtcatgccagttaggatgcagctggaaaggtgctgctgagtgggacgtgcagaggggaagactgcaggctctgtctgcctgagctcatctggtctgacacctgccgtgattcatttttcttcatgccatgttaagaaattttgtatcaagtctagtcgacagttactcatagcctggaagcaactttggaaatcagagttccactgacccccctcattttaagggtatgaatcacatcactgcattgtatgattccagggctctcttgcccatggctcgtgcatgaactaggaagtgatcatagttcctgttcttgttttatgaaaacaatagtataccttcccccaacctaggcaggccattcaggacgactaccctggaggtgctctgggtggcttaaagcaccgtctttgcacagtgtgttagagagcactgtgccctgaggacttcgggagagctgcagaatgagtgttcagaataatcggcactcacctttgccctcatgttgtgagatggagatattttaacctggccataatatgctttaaaagttggggggtgtttgtctgcttttgcttttatttccttcctgtgctggactgggactcccccttatctaactggtacataccactctgcccaagcagtgcgtgtgcacacacacatcccctacagctccctgctggcatctccttcatacactcttaagaagaagaaaccaatgtagaactcaagattttagcagacttacttggtcttgaacaagtatcacaaataccttaaaccctgacttcgtgggggggggggcaaggtatagaggaggaagggttctggatcctctctggggggccagggttgtgttcttctccagacaacagagggtgatccagtaccactagtagtgacaatagaacccacccattgttctaagtgacaacacactgatgcaggtactattattttctcaaacaattggaatatagtctaatttgccgacagctgcaaagcagcagagccaggattcaaacccaggcagtctggccccagagtgcctgcttcaaatcactacatctcttcctctgttatacttattcatcagtagatgcctagatgtggggctttacacttcagcagatactaagagggccatgtaccaagcgccaagtactgaggaatacaaacataaatactgcttgagggccaggcgcggtggctcatgcctgtaatcccagcactttgggaagcccggctcacgaggccaggagatcgagaccatcctggctaacatggtgaaacgccgtctctactaaaaatacaaaaaattagccgggcgtggtggcgggcgcctgtagtcccagctactcgggaggctgaggcaggagaatggcgtgaacccgggaggcggagtttgcagggagccgagatcacgccactgcactccagcctgggtgacagagcgagactccgtctcaaaaaaaaaaaaaaaactgcttgacttctgcctcccctagacacttagagtctggtagagaaacacaggcatgtgcttgctaactgtaacacagttccgcgtatataggcaaagtgacttaggaaacaagagggaagaaggggaccagttattcccaggacagagcagttgagggtaagtagggctttacaaaaatgaggtatctgggttgggccctttaggacaatgcagctgattttgacagatgggagagtgtggggaagggtgtgctgggtagaggggatagaatgagcaaagatagataagcttgaaaatttctcagtacgttgaggtttggggtggggaggaacctgggaggtgctggattggggctaaattgttgacatttcgtgccacagaaaagagcttttaggctttcttctttaaagtggagctcctggcacatcactttgcaaggatagtgattgagaagttgtagacgtttccaggaatacctgaaacaaatgtaaaatttctcaaataatatgtaatacaggaaagcaaagccatctgcccctgaaaacaggctgcatatttgcagtatgagtaacagcagagtctgggctgtgctccctagtggcaggctgactgcactcgtgcaccctaaggacattgatgcacagatgaagaaaggaaagacagaaataaaatttatttttaaataattttaatcgtacataaaaagagctctcatgtcttcctcacccagactcagatttcccagtggttaacattttaccgtatttgttccatctgtgtgtgtgtgtgtgtgtgtgtgtgtgtctgtgtgtagaaatgcagttgtcatgtctttttggcctccttccatctgaaaagttctcgtttttacctttttttcatggccatgatggttttaaaaagagaggcctgacattctgtagaatgtgtttcaggcagggtccaggccatgccttcttggcaggacagtgcaaaagtgatgctctgctcttccccatgcagatacatgatgtcaactttgatcacctggtcgaggtggttatttgtcagctttctcatcatagagtcaccatttttttttatgattgacatttcatgccacagaaaagagcttttaggctttattctttaaaatggagctcctggcacatgactttgcaaggatagtaattgagaagttgtagacgtttccaggaatattttctggtgagatattctgagacgacatcagtatcttagtctttagtaggaaatctctacccactagccttagctagtgattcctacctgaatccgccactgttctaataattggtccatggtgattttctgttgacataattccttgtatatattagttggtattcctacatatttattatagcatgatggactcacaagtagatacctattctctggattgtaacttgttactatcattaatcatattattttcatgctcaaattatcctagatttggctagtgggggttcaaaagagtttgaatcaaatatacccttgacactggcattaaatagccaatctgatgtgtgctgacgattgagactaataactggtaggcggagggtgttatctgagttctagatatgtatttatctcagacagtatgggttacctgcaacaagatctgtggtaggcaggccaacagtaacactcgggaccctagaggcaagccaacctgaaattcagcttgtcagagaccatctggtgggtggaagttttgcgttttcagagtatattgtttaagttccccaggcctatcgtctacctttagctttccctgttggccaattcaggccctggtcagatgcgggtggataggtacacaaagctggaaacagcgtgctgcccgcctttctctcctgcctccagagacacttgttggctgtcagggtcggtgttgtcttagcctcacaggcattttcagtccttgctcttcccatcctagagtttcaaacacagagcgagtctgtgttctgcatctcaacatgctaaatcagaacctggattccctaaaatgttgtctcctgtttcttcctgccctcactcatgccatatccgtccttcccaggttagatttctcatacttcagtgaccttcagaaaaggaatcccatcacttttctctgcggtgagtcatccattggtttaaagaaaaaattttcttttttaatagcagaatgaggtaacagagccctagaagacaagcccagagaccggatcctggtctccagctcagcccagagtagctggaatttgtcagaccttctcagtttcctccgaagtattaggggcagacagagtcaaggctacaggctggctagcccagatgcagacagtgtcaaagttctcattgtggaataccaccagaacttatcttactattaccacttaccatctaattgggtaggtaaaattcatatggtgcaaaggagtttgttatacctagacaaaaattcatggggacttgaataatccatggaaaccctaatggagaatgctgaggagaattttaatctccagcatctagccagagcaatcttattaaaatgcaaatctgatcatttcactcccttgtttaaaacccttcaatagcttaccaatgcatctatgatgcaaaaacttgatccccagggtcctgtggaattagggctctgtctgtcccctttctgcctcactgcagtctttgcaaagtcctcttcccagttcttaaaagtggcaggttttgcatatgctctttcctctgcctagaatttctgccatccctccacacatccccaccacactgcccggtggactccttagctaccgctcccttgaagaaccctccctacccgtagcctaggcagggtccctgctgtgttccaacataacgcctgcattgtgctttcacaacacttaatacagttgttatttatgtgatcacttgtctgtctcctcctatacttcgtaagttctacccagacaggctctgtgtctgttttgcttagcacctagccgtgtttggcctattgcaggcacttaataaatatttgctgaatgaaagaatacatccatctttcagtgtaacaactgcatcttccttacatcagcaggaacaggtagatgtggaagatggagctggtatggagaagggtagtgatgggagacagtggaagatgtaggagtagtgtgcaggttaatgtctgttaaaaaagtccagataagattatctgtgagaggaaatccaaagatttgtggggagaagccaaaaggagttaggaagggttaggagtacacgaagcaagaccacattctaacttaatcatataaacaaaccaagcctgtaaaattgcagttatgctacatatgtgtcaactgacctgatatttcttaggaacttctggcatatacttttgctttctttaatgttacaattttatttgcatgaagtgtttaggtagctttttaaaacagctatactagcctgggcaacatagtgggacccccatctctataaaaaatttaaaaattagccgggtttggtcacacacatctgtagtcctagctactagagaggctgaggcaggaggatcgcttgagctggggagttcaaggctgcagtgagctgtgatcgtgccgctacactccagcctgagtgacagagcaagaccctgtctctaaaagaatgaatgaatacatacttacctacctacctacgtataacctgaagaggtattggtgaattgcagtaggcagtataaactctgtgaggagaagcatttcaggcttcttagaaaaagcctagcacgtggcaggtgcccatcatttgaatgcctgaatgaacgggttttatctgggagggaaaagagcaggcttaaaaacaactctttggtaaatgcaagagcaaaagaaaatctcatctgttatacatttcctttaaaccagaaggaggaacactcatattgctaccctttttattgtgtgttctctaacaaatggtgttcctcacacaaatttgatacaggtagcgaagctgctgggtctcaaagagcttagtgctaacagtgtcatcaggagataccacctgctaaacccgttcagaaggacgctgttgtacttcgctgtcttcttagaacactttccactcctggaaaagttgatgtgctaacttaattactctcatactctgagtaattagcttcatgagaacttgcctctcttcctgagttcatcctactggtttgctttcctgctgacgtgggatctttttgactgctttgaacagcaggatgcttacactctggggcttttaaatgtggaaatctgtgataattatgtacttctctaggactgactcagctcttcaagcaaaatcttcatgcttcatgtgagaggggacaataacattaatgggaattagcaaagttcttcagtttcaacagtcaggtgtggtatctggcgaagaaaaacacataaatagtgtgtgaaagttgtggcacaggggtgtaattatttttcacagcaccgtcagtcagtaactgggcctagagtgtgcagcagtgaaatcagaacaaagaagtcagtgtgtcctaattaatagataaagtaataatatcaaagtctcctccgttttaaagtccacaggacacattatttcaccccagtgctttttgctcatattaaagaatggctcattgtggtagagtatgtagaaagtattgaatgcttttctttactcaaaagtggcattttttatcacttgagcacttgagcgtagtgttattggccccaataggaaatgaaagacttgaagactacagatttttttttgaaatggagtttcactcttgcccaggctggagtgcaatgtcatgatcttggctcaccacaacctctgcctcacaggttcaagcaattttcctgcctcagcctcgcaagtacctgggattacaggcatgcaccaccatgctgggctaattttgtatttttagtagaggtggggtttctccatgttggtctcgaactccccacctcaggtgatccagccgccttggcctcccaaagtgctgggattacaggcatgagcctccgcgcccaatggaagaatacagattatatggccaaaatttcagttgctatctgtgaatttttattcttctcgctgtccccagcacaggctttctcagcctcagcgctactgacattatgagctagataattctttgttgggggaaggagggcctgtcttgtgcatggcaaaatgtgtgcagcagctctggcctctacacactagattcgggtagcaccccaagcagcgacaacaataaatatcttcaggcattgccaaatgtcccttcgcgggggcaaaatcacctccatgcctcgtttggttggtttaaaagaaaaattacctccagttgagaatcactgcaagcaggttagtactcgactagtttcctgcgatctaatcttcttcctggtgagtacgttaatttttatgtctttcaaaaccatgtattatttggacagcaagtttagtttcattaaaagttaaaatcatatagtactttatgaatctagatgaaatgatttttgaaatatccataactccatttcactttgttaatgcagaagaattgcaagcaaatttctcactgttcttgaggcagtaaattgggcccctctcacagagcactaagttttataggagatgaatatataaataaggagcagacttgccatcagtttgttgatttcaccttttctctgaacacagaggaatttggtctgaacttggagagttttctttaatcgatgccgttgcattggtgtttggttaccccaaattgcagagtgtgcaaacttagttgggagcgagagggaggaaatggactctgtgacccttggtgtctaggagtgagttggctcagagatgatgccaacctaagacaacatggagcccagtgttagttagcaggccatccacttaccttgagacgctggtataaattctggcaatgccagctgtcatgtagctgtttgcttcacttctgcctttaattacttttctatgcaccccatccccactagactgtgagccttgtgagaacagagactttgtccattttgttcggtgcccccagctccgagaacagtgcatggtaaatagtaagtgaagatccatagaaaactagagagatagagaaagagagacagagacagaaagcagaaattaattcatgtgcctttattatcaatatcaattataaatgtaagtcgaatgtgtgaataaatgttttattcggtctgcacttcccactgggtattataacattttaactggtcctattgaatgtagcctctttccctacgtcagtctcacgcacgcacaattgtcaagacgatctttgttgatgccttttagcccctagtttcagtggaaaaacttgccctgctccaggatgtgagattggtggcctctcctgtactcatcttcttccccttgtctaaccttggcattccttcagcagcaccaacaggttctgtcctggctcttcacctttttactctggtcatttaccttgtcttcagaactcatctctcgttaactcggttctgttttgatcactagtttacatactttcatactgcattgtgttttggttttttggagtgggggcggggttgttgttttttggggttttttcagacggagtctctctctgttgcccaggctggaatgcggtggtgcaatctcggttcactgtagcctccgcctcccaggttcaagcgattctcctgcctcagcctcccaagtagctgggtttacaggcatgtgccaccacacccagctaatttttgtattttcagtagagacagggtttcaccatgttggccaggctggtctcgaactcctgatctcaagtgaactgcccaccctggcctcccaaagtgctgggattacaggcatgagtctccactcatggcctgcattgttgatatatgcctttgtcactgatctcaattagtgttaagggtgtttggtagtcatctctcagctagactatatctgattttatttcttaaaaatttttcctcttactccttccactgaataggaccattttctgtagccaattaagctttcaataaatgtttatataatgaaagtagaggtggtgccaggagcagtctccaccactggatttccagacattcaaaaaatttttgtaaacaccagggacagccctccaattccagaatatttagttggaagctattactctcaggatttcagttgcagatatagccagtggaattttgactgtgcaaaagcaggcatagttctgttagtccaaaaaggcttagttaagagtctctttataacccaggtagatttttttttttaaactgctcttttttttttgagacggagtcttgctctgtcacccaggctggaatgcagtggcgtgatcttgacacactgcaacctccacctctctggttcaagcaattcccctgcctcagcctcctgaatagctgggattacaggtgcacaccaccatgcccagctaaattttttgcatttttagtagagacctggtttcaccatgttggacagactggtcttgaactcctgacctcaggcaatctgcccacctcggcctcccaaagtgctgggattacaggcgtgagccactgtgcccggccaaaactgttgtttttatacttcctcttgatcctgaattaataatttaagttttattgtaacacttttccagttaataatttagcgtctttctcctttttaagatctagtcttaatttttgagagggaaagggggaagaactgtagtacctgttagaattcagtgtaactccaagtaaacaagacccaaaacaaacgatagctaaaacaaaatagacctttatatctttttcacttaaaagtatagaggtaggctttttagaaatgttatagtagctctgatccacaaagtcctttgaggcccaagttccttctagtacatcgttcctccacccctagatatgaactcatgtttcaaagttacactagtgttctagtcatcacatctgcattccaggcagcaggatggaggaaggcacaaagaagaacataggtgaaaggattatttctgtgtttcttaatggaggttcctggggtatactacatgacacttctgcttacagacttttatttgcccctattagtgtggaaggaggggataatgcatactaaagaacatcaagctgtctttgccatggccacccctattcattcacctcccaagtgaactttctcattttattgcagtcaattccatttgccttccaaacagagacttcttgtaatatattttaagacaaatgcccaggccaggtatagtggcttacacctgtaattccagcatgttgagaggctgaggtgggaggattgcttgaggccaggagttcaagaccagcctgagcaaaatagcaagaactcatctctattaaaaataattttaaaaaattaaaattagccaggcgtggtgctacatacctatagttcccagctactcaggaagctgaggcgggaggatcacttgagcccaggagatagagactatagtgagccatgatcgcaccacgtcactccagcctgggcaacagagtcggaccctgtctcaaaaaaaaaaaaaaaaaaaaaaaaagagcaatacccacgtgttgtaaaaattataaaatataaagaataaaaatcatctataattccacaacctaaagataacaactgaaacaatatcatggaagaaatgtccttaacactaatatttaacgaacaacttctgtcttcagagcatcaagatgtttttcaaagtttattatcttattctgttggccaggcacagtggctcacagctgtaatcccagcactttgggaggccgaggcaggcagattacctgaggtcaggagtttgagaccagcctggccaacatagtgaaaccccatctctactaaaaatacaaaaagtagctgggcgtggtggcacacgcctgtaatcccagctcctcgggaggacgaggcaggagaatcccttgaaccagggaggtggaggttgcagtgagccaagatggcgccactgcactctagcaagtttattatgttatactatatattcagttatttattccttcagtaaacgttgtcagacatctcctttcttcccagcatgttgataattggtgtgtggttgggagaggaagcaatgaaaaaaaaaatgtatattttttttgggggggtgggggcggagatgaagttttgctcttgttgcccaggctggagtgcaatgtgtgtgatcttggctcactgcaaccttcacctcccaggttcaagcgattctcctgcctcagcctcccaagtagctgggattacaggtgcccgccactatgcttgggtaattttttatatttttagtggagatggggtttcaccatgttggccaggttggtctcgagctcctgaccttcaagtgatccaccctcctcggtctcccaaagtgctgggattacaggcatgagccagcgtgctctccaaaaaaaattttttttaattaagttttttgctctctgggtgcttatagtctggtacaaaagacaaaaaagtgttttcgtcttgttaaagttgggaaataaatcagggactcataagtgcctaatttatgttgatgtatgtaaacatacactagaaaacaggatattaaaaaaataatgacaccgggtagttttattgtagaataatttttaccatggacaattgtttgtgaaaatgacaccttgaaaacacatcttacttttttacttgctggagaatgaaacttgaattacaagtcctttgggtagcctggtttgagcagtattaggaaataagcaagcctaacttagttaaattctaacctcttctgattcccagaagtccaaagttcatttgggggtaatacaacgtgatacatgctttttgtgatttctacaaggtgaactaaagaaataactaaagatggaccagttaggttttggtaaaaactgtgataagttttgttgtgttttaaatactgatgttgagtcagttcatctttcctactgaaaatccttaagtgggaaaagtatagaaaaagtaggagttacaccaaaatattaacgcttgccacttgatggtaggatctgagtgccctttttttacgttctttaaattatctgtatgtggcttttttttttttttaatgttttacaagcatgtactactttcgtatctggaaaaaggtttgtttttctttcattttttaagaagaacttttcatcagtggcaaaggctcagttgaaattaatgataaaggataactacttgccacgtgtcataagcccagggctgagaagagtcaggcagtgctctggaaccagtgagtgctgcccggatcctgagaacccgcagagaacagtggggctgattgtgcctctgcacctcctcaggtgaccgagggctgggcaggaggacacagactctttcatgaagcagtgactagtataggaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggtaggtgagctgcgagcggcgtggggcggccaccgctggccgaattccggggggcctgggcgaggggggccggccgggaaggtgcgcactgctgggccgcttcactccaccgcaggcctacgggagtccagcttagacccgccggctcccacacacacatcccgggaggcccggatcagcctgcctgacagccaagctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggaatttcagacagtcctggagacaggtctggctgctgcagcttctctcctgttaatggaatttcagacagtcctggagacaggtctggctgctgcagcttctctcctgttaatggaatttcagacagtactggagacaggtctggctgcatattttgagtgatcaccttctccatgtggagatgaaagttaaaagggaaagagagaaggacagctacgttcttttaacacgagcacaagtttccaggcacagccctcccgaccagccctcccattcttaggctagagcatgactgctgctgggcacttctttcacatagaattcacttcccacacgtgttagaatcgaacagctagagcaatttaatattgttttaaattgggacgtaaggaatatacgtcctttttattcctctgcttggcaatcttatttttgtactttctttccaacatttgggaagaaagcgggcagatggaagcagaagtgttcttcacagcattcacactgtcgggtgtaaatgttcggcagtgctgggggttgggagggcagacagcaaccaggtttgctggaagttacttcaaactggacagcagtcaagtgggtttgtatactcaggagagggcagggagactgatggcttacattttcactcattgcttttgagttctttccatagctctaaaaatgcgcagcttattagcgtggctctgggaaaacaacacatgacctgatcctacaatttaaaaaaataaaaatgaccttgcttttaagtttgaaatgcatagcccaggtcagcgacaaggtctgcgctttgaaaggttcttgtgtttcctcttttaaatgtctggtttagccttaagtagtatttactgagtgccacatgatccagtggttggagtatgtaggttttgcccttatcttcattctttgcatctgtttgaactcatgacaatacaaaacaaggtgttcctgggatagggaatgttttgtccaaaaggagtcaacacggagaaaactcttcctacagttaagacagggtttggttttgtttttaaatgaggagagaaactgagaagtggaaaacacaaaatagagttgaagtctttcctctgtgtgcttctactcatgctgccagagttaatcactaaatatcccatgccccagctttctcagccggggaggtgccaaggcaaattgtaagcccatggaggtagtcaggagctgagtgcccttgacctccatttagaaaggcagcccagtctgcaaaagacagcagcagggacatctcatcccaggcctcctggttatgctgctgactttgtctgtctgctactgacttttagtttttttgtgtgcctcagataacactttgaaaaacaggaatcttaatgtctgctgtctatattccaagagactgtagatgaccaatgaaattatctactggacaatgctttcatgtcttttttttttttttttttaattgagacggagtttttgctctgttgcccaggctagaatgcaatggtgtgacctcgcctcactgcaacctccacctcctggattcaagcaattctcctgcctcagcctcccaagtaactgggattacaggcgcctgccaccatgcccagccaattttttatttttagtagggacgaggttttaccacgtgttggccaggctggtctcaaactcttgacctcaggtgatccacccgccttggcctcccaaagtgctgggattacaggagtgagcaccgtgcccagcctttcgtgtcttttataatgaattcttttaaaaatatttagtaaggacttactatgtgcttgtctcttaatcattatctctgagtactgatggacataaagatggaaaaagatggaaatagtagacattttagactacaaaagtggggaaagaggggagtgagggttgaaaaattacctattgagtacggtgtgcactatttgggtgatgtgtacactagaagctcaaagctcatcattacacaatatatccttgtaacaagcctgcacatgtactccctgaatctaacatacagttttaaaaaataatacaatcattatctcattacattgtttttaagcctgtgagttaaatatttgcatctccatttttactcagggagaaactgaagttaagagaggtttattaacttgcttacccaagccgggcgcagtggctcacgcctgtaatcccagcactttgggaggccaggttgggtggatcacctaaggtcaggagttcgagaccagcctggccaacatggtgaaaccctgtctctactaaaagtgtaaaaattagccaggcgtggtggtgcacccctgtaatcccagcaactcaggaggctgaggtaggagaattgcttgatcccaggagacggaggctgcagtgaaccgagatcatgccattgcagctccagcctgggtgacagaatgacctgtctcaaaaaaaaaaaaaacaaaaaaaaacaaaaaaaacttgcttacccagctgttgtagatccaggttcaaaacataggtgtgtcaactcttaaaatcataccagcttgctgtactgcaacaaacacaaatattagtttttaccattaggtgtattgcatgtcattataatattcttttctccctcttctaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagaggagagactccattaattcattctttaattcagcaaataattattgaatttgagccaggtgcaatggtacacatccgtagtcccagctactctagaggctgaggcgggaggattgctagagcccagaaatttgagaccagcctgggcaacatagtaagacctccatttctaaaaaaatatgaagtaaaaatcattattacttggattcctactctgtctcaagctataggctgtgaagatagtgtgaacaaaacagaacagagcccctgtccctgcggtgcttacattctaggtggggtgcaggatatagacagtagacctataacatgtcaggaggcgataaatactgtgaagaaattaactccggttatgggaacagcgagtggtagtggtcagggtgagggctgtttgagatgaggtggtcaaacttggagagaagggagtcttttcccactcattttttttttttttttttgagacagagtcgctctgtcacccaggctggagggtggtggtgccatctcggctcactgcaacctctgcctctcaggtacaagcgattcttgtgtctcaacctcctgagtagctgggactacaggtgcccaccactatgcccagccacttttgtattttagtagagatagggtttcaccacattggtcaggctgatcttgaactcctgacctcaggtgatctacccacctcggcctcccaaagtgctgggattacagacatgagccaccacacctggcccgataggcgcttacatttttgtctgtcttattctttctcgtattcattgggattcctgctcactcttccttcttgaaattgaagctaataatcagaaagccaccctggatgattttatggcttacagtaattccctgtgagccttaccaacctgattttgcttgtgaccatgtgcactgcctctcacagtgtataacatcatcctcagcttaggaccacactgcctggcttccgtttctggctctccaattctcatgaatcagtgtgacctgggaaagagtgtgcattagattaattttacatgaaaatgtgtgatacagacttaagccatccacagaaattccagtctttctattagtgtctgatggggcaatgattaaaatagactgaaatatattatttttatatcttcctaggtttccactttcaaacctgaattattgttagttttcagtatctgtgctataggacagttagtttgttgtggaagaaaaaaatgaatatgacagctcatgtgtggggtttttgccttttagaatccaaagagtctaataaacatacagggaagtcattttagaataaacaggattaaaaatgatctgtagactcaaacagagtctgcaagaactcatgccatgtctgctttgacatccttttaaaaatcatgatgtcagatgaagtcaaaataaaattcttaaatacctccagacagatggcacagtggatcatccattataaaagcattttgttcccagccttcctccctcctccccaaactggggtttctatttcacattcttgccagaaatattcagctgtaaccctgaagtaatttgctgaccctctgagcacggagaccagggagcaagttcggtctggctgtgtgacagtgttttttggtctatttccagtcacactgacatgccacacatcactggttagatccaaccctgctaacaaacacctaattaatcagctaaaatacagaagacctacagcacttgtgaacaaaacaataaatatttttaacagcacttatttagtcacaatggcagcccctctcagagcacacaagaacaaattttaagtatttctgtaatgcacatcatatttgtgttttcaccattttgtttaacgttctaatgaggaattaattaggttaggaaatgaacgcagagtattccatttttgttatctggcatttgtcatgtggactgaaaattaaagcaacttgatatagtaaagtggagatgctcaacacttagaagctttgagaatccaggtggcccagggtgcactgtgcattcctgtgcacaccataccatagagaatagcactcaccacagtctagaatgtatttctgaaccaaaagatatactggagtatagaagggtattcatctcaatgtttgttttccccaaataaaacagtagggaatttgggtctgacacctaccaaaaagagcatataaatgatcacttatatgaacctaacacagtattctaatttaaggaagttgttcagtttgggctctgaagctagacagtgtgggttcacattctttctctgtcactagaacagattgtctttgttccttcacagggttgtaatgaagattcagtgagtcaataggagtaaagcacagagtataaatgctcaatgaaagttggctgacgttgttgttatggttagagtatttccagaaatagaaatgtagatctagaacaaatgatgccacacagaaattgtacaagtggtcttttgttttcagcctaaatttttatcttcattattctgggtgatgcccctacccaattattatacctctccaactaaccattgtatcaatataaagaagtacatagataacaatgggaaacacaaaattgataaatgttcagtccagagtcattcagaatccgtgtcaaagctcaaaacgaagtatattagcggccaatccatagaattctgttcatttctcctagagttgaagatttgatgatggtgtcacttttcagtatgcaaaaaagtgttatttttagcagcatcataatgcttaacactatatttaatttcttaaaattacaactagagcatgcatcataagaaattaatagttcaagcataggcaacgtagtgagaccttgtctctacaaaaaaattttttttaattatctggtcatgttatcctgtgcctgtagcctcagctactcaggaaactgaggtaggatgatctcttgagcccaggaggttgatttgaggctgcagtgagctgtgatcacaccactacactccagcctgggtgacagaatgagaccttgtctgtgggtgggggtggtggggggagattgtgcacggtggctcacacctgtaattctagcattctgagagctgaggctggcagagtgcttgagcccaggagttcgagaccatcctgggcaatatggtaaaaccccgtctttactaaaaatacaaaaatttgccaggcgtgatggcagatgcccgtagtcccagctactcaggaggctgaggtgggaagatcaccggcgccctagaggtggaggctgcagtgagccatgattgtcacccactctagcctgggtgacagagtgagaccctgtctcaaaaaaagaaaagaaaaaggaaaaagaaattaaaagttcagaagagcatataataaaagagttaaagcctccctggcacactcctgtggtagcccgcgtgtgtttggtatttacagatgtccatgcttgcacgtctgtattttagaaacatatatttttgtaataaaatttgaatcatacatagtccgcctctttgttttttcacctaaaaggtcacgaacatttttctaggatttgagagacaatgtcttggttttgatggaattggaacctgatagtgaccagaggtgttctgtattttttaattcctgatagtatgagtttaatgcatttaatattttcttttataaaataaaaaagttaagaggaaatgagtttctgttataacaaaaatgttggtaaaaaaaagtttattcttcctgtaaatcagttggattgttttcgtttgaggcatagattagtgttttctttttttaattactattttcttctagagagggaagaggagagagaaaattccagataaatgacttacagatactctaaaaatatataactgtctctgagcaaatacaaacaaaactataacagtggaatttaactgcctgccccatgatttatagaacattcatctctcatactgaaaagacctgctttttaaaatcagcttccgtatttatactcttagttatcttagttcatcaaaagttaatgaactcgaagtcattcccataactatgaaagtaagttgtagacaagagatctgagccaaagcaaaagtagtcattacaaaatacgtttctaggtagttttctcctcgttcaaataatatatcatttacctgtcttagcacttggcttcttaatcactttcttttaatgctcaaaagcaccaaaacaatgcaatccaagtgtttctgggaccctgcagatataaaaatatgatgtaggtagtggaaggcctagaagtcagaagagctgacctctcatactggctgtgtaggtaacttgctgtgtcttttttttttttttttttttttttttactcttaagacagggtctcactctgtcacccaggctagagtgcagtggcatgatcacagcttgctgtagcctgaacttcccgagctctaaccatcctccctcttcagcttcccaagttgctgggactacaggtgcatgccaccatacctggctaatttttgtatttttagagacaaggtctccccatgttgcccaggctggtcttgaacttttgggctcaagcaattcgcctgcctcagcctcccaaattattgggattacaggtgtgagccaccatgccaggccactgtatcattttagaaagggagattgtggacttccatggcctcctgtgtcaaataaatagggtgagattagtttttctcctacagtcccttcagcaggattattctgtacaagtgtgagttaactgtttatgttggtgaccacacatgtattagcattcaggctgaggtctgagaggagagcgtagaaacaacatatttgtcctttctcctctatcaaagctacatgcttttcctcacaaagtagtatgtaccaaaaaagaagatggtccttcatgaataatctctactgcctgttccccaaaccatcatttgggcttaaagagtgaattcatgctcgagcccttttttttttttttttttttttttgagacacagtcacactctgtcacccaggctggagtgcagtggtgcaatctcagctcatcgcaaccttcacctcctgggttcaagtgattgtcctgcctcagcctcctgaatagctgggactacaggcacacgccaccaggcccggctaaatttttttttattattatttttagtagagacggggtttaaccttgttggccaggctggtctcgatcttctaacctcatgatccacccacctcggcctcccaaagtgctgggattacaggcgtgagccagcgcgcccggcctcaagccctttttcttaaaaacaaacattatttcagatccctttgaatttttagtcatactttgggaaagtaacctaaatatttgaaaggactccataatgaattggaaatttcagtcctacctgttctcaatgagtaagtttagatgttctttaaaaattaaatcagaatgtcaagctgaaaatgtggcacagctacatggttagttagctggctacactcttcttttttgtgttttcagaaagttcttggcactatcaatacaaatgtagatcagcataccagaacagttggaataggtgaacagagcaacttttaaaatccattttaatatatttttttaaattgattttctaacaaatttggaaacccatggctatataccaataactaatacccattctggacagataaatgttacacagaagactggagaattgatctctttaaaacccattcagctctagttttgggtgattttttttttctttttttaagagatggggtcttgctttgtcacccagactagagtgcagtggcatgatccgggctcacgccactgcagcccccaacttctgggctcagggctcaagtgatcctcccaccttccagctctagtttcactgaattatttttcttgtaaaacagtttgcttttaacattcctttatgtcaaggacataaagttttcattttaagtggcttgtttttcattatagtcatctcatttgccttagaatttaatatatggataattataaaagctaagtgcacttcggaatgataattaatgcatcaaaggtgttcctcttattttccaggacactgagatttctgtcacttgttgtcctttagtgatcactaatctgaccaagtcgtaaaatgaggctcatgctttattggtgtttatggctgttataagtttgagttaatgatagaagacttcacagttgcccactctgctgtccattaacttcccagttgtgcctgtgaaaaccgttgccacctggtgagaattttgagcatctagaccagagtgccagaattctgaaggtgttttgtaattactccacatgttgctgtcgttttgttttgttgagacaaggtctcactctgtcttccaggctggagtgcagtggtgcaatcatagctcaccatagcccctaactgccaagctcaagctgtcctcacacgtgaacctcccaatagctaggactacagacacttaccaccatgcccagctgttttttgttttgttgtgttctgtttgttagagaggggggtctcactatgttgctcaggctgatctgcaactcccaggctcaagcaattaacctacctcagcctcactaagtgctgggattacaggcgtaagccaatgcacccagcctgttttttgtttttcctcagagacggggtttcattctgtcacccaggttggaatgcagtctcaatctcccagcctcaaaccatcctccagcctcagcccctcaaagtactgggattacaggtgtgagccactcccagcctgtaattactcctgtttttatccctattgttcagggagcatttactttctgtttagtatgaacatctaccattagtggcccagggctgttaattaaaccaccagcagttcctaaaaattcacatggatccaagttgatgggttgaaactagaggggagtctaaattcttaatttcagtagtcagcttttatattggttaatttaattcagtggatctcaatcctggcagcacaatagaatcacctagggagaagtttgaaaatactgatgcctgcaattggagacactagttgtattaccaaggctttgactggaatggcatgtttacagagtgctttggggaactgaagttgatctttagagccaatggaagccccttggaaaaactgacctccctcataccttgtcctttacagggttcctaacctgtggtaagtaaagaatgtcactttctgacaagctcaggagccccacgttattttgggacctcgggaaaagaggaagtcacctaatttatataggtatctgcaggcacaaataaattcttggctgggctcaagaggtttgtaaaaggtctaatttgagattccttatgaaaaatgtcagcaaagtcaatgtaaaagaaaaagggggggccatatggcaaatacttactcttgctgcactttatgcaaataattagcccaagcataataagactaaaacttattttggaaataaattggtcccactatgattggtctttggtagaaatagaaaaccagagagagaaaaattatgtttcagaaaaactatagtaccccttttattgactccagctttgtccacttttttggataaggtcatctgctgataactcaataattgattggttctcagggtcatttacctgggtccctcaaggcttcaggttggttctacagggactcctgaagctaggactttcacttcttgtggtagggcttactattaatcttacagtctgctgttcacttatgtgctgtactaaaactgtggataagaatgaccccaaccagacaccagtgaaggcatacggtcaacttgaagacggtttcactcctcttaccttgggggcaaccccttccccaacaatgttccataagcaagaagaaattagagctgtcattagcctttcccatctccatagctcacacctcaggattgaggtgtaccgaaacccaagggggtggggacattgaaactgcctttccaaaatcatgacagtaaaagaaacctgacatagctgactccgtcttacttctgacctccaagctgtccttgttcattcctaggcacaggccaagctaactgtgggtagaatttggtttataatttaaccttaaagcaaggatgataatagcccttcccaagactaaactgcctttgtaaaactaatgaaagcacacaaggttagaattatggacgggccctgaattctattttatttattttatttttttgagatggagtttcacttcaactgcaaataagtgttcattctctctctctctctctgtctctctgtctgtctgcctctcttgctctctctctctcatatctggacccatccagatcattgtatctacattttttaaagtctcaccctcgattcaggtgattctaaagggtagctagggttgaaacgactgaattttgtttgttggcctctttgttctttggctttcctggctgcacgttttcttcgttttgctcaaacacagcagtcatttgtcagtcttacattggtgcatgcggtgcctacaactacaagtgggtccttatcaagttcagagaattgtttataggccactcaagaccagccagagtttcaacaccatccaaagaacattttctggcaatataggtgaccaattccctctgacttgacaaaggagagccagtttggaatttaatgaggttcttttccttaccagttaagcctcagtagaatcctcatgacctttggttgaattacatggacacttattaaaggctctcaatggtcccgcactgttctaagcactggacaggacaccaaataagaatgtagcagggaggaactcaagatgctgaccatctcattgaggagacagggcatatttgaatctggaccgtaagtgctacaggacaatgatggggaaaaaagacatctctgtggaatggttggaatggtatcatagaaaaaagactagagaagatagaatttgggccaagccttgaaaagagtatgggtcgaattcagctggtgaaggatggcgaatttccagacctgtaggatgatctaattactccctactcacagagttggagtaattaagtcacaggaccactctgaacagaatggacagagtggaggagtagctgagaggtaaagttcccgcaggcaagatgaaaccttccaccttgacccttggatgcctgcaggaggaggtggaccttgattggagaagctttaaaaagccctagtttacaaaagtaagctgtggtgagaaaaattatagcacctggtattcctgggtgacactatctggaaggggtgggaggaaaggcttaccaggttgttagaaatgttctgtatctctgttacagaggtggttacacaggcgtatacatctaccaaattccatccgacttacacttaaaatcagtgcattttcgtggggcatgatcacaagcacctgggtcctgtgtcctagctactccaaaggccaaggtgggaggattgcttgagcccaggagttcaaggctacagttagctatgatcacattccattgcactctagcctgggtgacagtgtgagaccctgtctgtaattcattctgtgcattttattgtctataaattgtgtttgaattttttaaaaattttaagttgtatttaaacaaagagaacctatggattaaaagactttaaaataatagcaaccaatggaaatacatgactggaattctgatgcaaacaccctattaaagaaattttttagagactattggagattgggcacagtagctcatgcctgtaattccagtactttcagaggccaaggtgggtggatagcttgaacccagcagttcgagactagcctgggcaacatagtgaaacccatctctattaaaaatacgaaaaaaaaaaaaaaagaagccaggcgtggttttgtacgtctgtggtcccagctatttggggggctgaggtgggaggattgattaagcctgggagacaggttgcggtgagcagagatcacgccactgcactccagcctgggtgacagagtgagatgccatatcaaaaaaaaagactattggagaaatttgaatactgactggattatgtgataatcatacttatctttttttaagatttgatagttttagcctcaatggtttgcattttttagagttcttttagggacatatactgaaatatttatggatgaaaatgattgaatctctagctgttgcttcaaaataatccagtgtgagtgggcagagggagttatcagggaaaccagatgttttctaatcattgttgaagctagtaatgggaagacaggagtttattaaactattatctacttttgtatctgttttatggtttcaataatagtcaaaactatcatgtatttgcatttaaaaagtcattgttggttattgaagaggaaaatgcttcgtacaagcatttctctacaaagagtgttctggcggccaggcacggtggctcacacctgtaatcccagaactttgggaggccgaggtaggtaggtggatcacttgaggtcaggagttcgtgaccagcctagccaacatagtaaaatcccgtctctactaaaaatacaaaaaacagctgggcgtggtggcgggcacttgtaatcccagctactcaggaggctgaagcaggagaatcacttgaacccgggaggtggaggttgcagtgagcagagatcgcgccactgcattccaggctgggcgacagagcgagactcaatctcaaaaaaaacaagagtgttctggcattcagtgattaactagtgagactttttggaggccgctgcaatattttctaagtaatgatgaatggacttggagaaggaaaaatgaagataaatgccctgctttatctactttgcttaaaataagtcaaaggcacattaggcatttcatatttgcagttaggggacatcaagtcacatagtgtgaaacgttgtttggaccgctgaattcagtattgtgtgtatgtgtgttgaggaggaagttggagttgtaaaggaatcgtccaggtagcccccatgtcccacagctaaaggagaaagcattgtgctgttgatttggggacaggggactgttcaccgaattaggaaatgtgagttctcgttcagctctgtggcctggggcaagtcctgaacctagctggccttcagaatccttagctggaagtctggaattaaaaattaggtgatatcccttgaggtcaggagtttgaggccaggctaaccaacatggtaaaactcagtctctactaaaaatacaaaaattagccaggcatggttgtgcacacctgtagccccagctacttgggaggctgaggcaggagaatcgcttgaacccgggaggcggaggttgcagtgaactgagatcacgccacagccctcactccagcctgggtgacagagcaagactctgtctcaaaaaaaaaaaaaaaaaaatttagatgatctctaatgccttacattgaattttttgccagctctcactcttttactatagcgtcattgttttaaaccagtcaaagtagaccacctgcatcagtgattcttgtaggtggtggggaatgtcagaaatgccatcacttggcccccatcccagaactgcagaatgatctcctggcagcatgttcctgggaatctgcattttagccaatgtcacaggtgattcttatgaagaatagaactcagagcagttttagggcttgttattcgttctttttcttcatattgcctcaaaatacaatcaacacttaagctgcttttcttctaagaatctaagagatttcagagctttactttgaaagggataaagttgtgatcacctgacattgtgagtagatttaaatgtttaatttttgttagtaatttataaagtataatttaggaaatactagagacaaaaagaaaaaagttatagtagcctgtgactctttagccttagcaaagcagtgttaaatgggtttcctgtatatccttccatgatttttctaatacatacatatgtaaatataattatttactaatgccagtaggcagcaatgagaacaaaacctcttttgtatttttttttcccatgagtcaaacaaaagacttcagattcagatcaattctggtgtgctagggcaggcctttcctacaaggggtggagaggccagcctttcttctcttggtgggaatggcctgagctgtgttgtggggcaggccgctgatttgtgtgatgtatcattagagggaataagcccattgatcttttctagtttccgttaaacttgaactgagaggccaggcacggttgctcacgcctctaaccccagcactttgggaggctgaggcgggtggatcacctgaggtcaggagttcgagtccaacctggccaacatggtgaaaccgagtctctactaaaaatacaaaaattagctaggcatggtggcacttgcctgtagccccagctactcgggaggctgaggcaggagaatcgcttaaaccgggaaggcgcaggttgcagtgagccaagatcgcaccactgcactgtagcctagcaacagagtaagactctgtctcgaaagaagaaaacttgaacggagacaaaaattaaaaataaggccaggcgtggtggctcatgcctataatcccaacgctttgggaggtcaaggcgggcagatttcctgaggtcacaagttcaagaccagcctggccaacatggtaaaaccccgtctctactaacaatacaaaaattagccaggcatggtggcaggtgcccataatcccagctactcgggaggctgaggcacaagaatctcttgaaccaagaaggcagaggttgcagtgagccaggattgctccactgcactccagcctgggcaacagcacaagacaagacactctctcaattaaaataaaaaattatttaccaaagtaggtttattttctccgtattattgtatgacctatttttaatacacatcatgctcatctatgttaatattctcctatatcaagatttgtaatggccatatagaattcctctgtataaatataccagtgcttatatggttgtttcttacaagcagactgtctgcctctttttactgttttaaacatggaaacaatagccttctgtgtctttttgtacatccttaggataaaacttttagacaattaagtgaaataatttttcatttttaaaagtgattttgaacacagttaacccatattcactatagaaaaaatggcaaatccaaggaaatttttttttttttattagagtctcgctctgccgcccaggctggagtgcagtgggacgatcttggctcactgcaacctctgcctcccgggttcaagtgattctcctacctcagcctcccgagcagctctggattacaggcactcaccaccatgcccagctaatttttgtatttttgtagagatggagtttcaccatgttggccaggctggtctcaaactcctgacctcaagtaatctacctgcctcagcctcccaaagtgctggaattacaggcatgagccaccacgcccaggctaatccagggaaaaattaaaactaccatagctgtttcatttagcacagagtcagataacttttcatgtgtgtgtgtgtgtgtgtgtgtgtgtgtgtgtgtgtatgtgtgtgtgtggtaatgtattttaataggatcacacaatacatggaattttattatctgcttttttcaattaaccatatattacaaacatttttccacatcacccacattgaaaattctacaatatatctgtaaaccaaaaataaaattctaagccccctaaccaacggaatagatccctcctgtcagccaggggattccatagtaaacctgaaaaactagttcaggccatgatgggaaggaagtgtcaaacatgcctcattataccctcctccctttggaattcaggcacaactgaccagcattaacattaaaacagagatcttaggagtgacaaacagactctttataccaataagataacaaattccaacctgactctcctatagcatcacatgacagcagaccctaaaagaaaatgaagtattttaccctaaaatatatttcttcgatgtattttgtctttttttgttttgtttcttttgttttcttgagatggagtctccctctgtcactctgtcacccaggctggagtgcaatggcacgatctaggcactacaacctccacctccgggttcgagccattctcctgcctcagcctcccaagtagctgggactacaggcaccccccaccatgcgtggctaatttttgtatttttagtagagacggggtttcaccgtgttgaccaggctggtctcggactcttgacctcaggtgatccacctgccttggcctcccaaagtgctggggttaacaggcatgagccactgctcccggcctcttcgatgtatattgaaatggccctgcaaggctgtctcttgtggggaatatctacattatgtagtgaatccccttacctgtccaggccttttcctgatccaggagagattcagagtctggtacctatttaggtctgaaaagagacatttaccatctatatagaggtctgaaaagtgacgtttaccatctatgtagatgaagcctgctacctggaggcttcatctacataataagaaccttggtcttcacaaccccttatcttaacccagacactcctttctgttgattgcaggcctttagataataagttaactttttcaaccatttgccaatcagagtatctttgaatctaccgaagacctggaagcccacccttatttgagttcttccacctttctaaactagtgtataccttacatgcattgatttgtgtttgcctgtaacttctagtccactaaaatgtataaaattaagctgtaacccagccaccttgggcacatgttgtcaggacctcgtgagattgtgcttttggccttggtcattcatacttggctcagagtaaacctcttttttacagagtttgactcttttcattgacatatctgtatacattaattacaaaatattatttaatccaaattgcttcggtcagtatacagattttaagtggctaacatatacaaaagcactctagtagatttgttaagagaaagttgatcagaactgtttgatgccctcaaaatatttaccatctacaagggagtctaaaaccatcatacaagtcatcttgtacattgtatcacagatccccaggagaaggtacaaaagatgggctgtgagagttcagggcaagaacattgttagtgaaggagatcagggaagggtctgaagaggcagtgatgggagggtgcggctgtgtgaagatgggggaagaaaggtattccaggtagtagaagggcataagctgaggcatgctgccaggaaacaagagacccgcatctctatacagcgagtcctggcacttaatgggatgcagtccctgtcccagtaaggacgacaggaggagtgggaaatgaagttgcgggggtcagccagtaccaggttatggatagtttagaatctctggctctgcagtgtggactacatttcctgagcagtgggtgctttttaggcgttgtcacattttgttttagctggaataatgatggcattggagctggctgggagtaatgctctgaagcattgtgccagagtggaagtagtaatggaagaggggcagtaaaatgctacttccatgactagaaaccaaggctatgacggtagcagccaaaacagagaaaagaagaggtgctgtggagttagaatgacgaggcccggcagtctgcctacgctaatgaaatcaggaaagctggagcgtcaaaggggcttctgagttttggtggctgggataatagtcccattttaaattatgagtggcaagaattgtttttgttgaagcctgctttttcagtcctagcatcacacactctgtacctttctttttcctgataggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaattgacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacatttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgccacctaggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaaaaaacttaaaaatggcaaaaaaaaatctctaaatgttattccagaatgtcataaaggccaattggtgaagccgaatgtcaccctcccaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatcacctgaggtcaggagttcaaaaccagcctggccaacatagtgaaaccccgtctccactaaaaatacaaaaattagctgggcctggtggtgcacacctgtagtcccagctactagggaggctgaggcaggaggattgcttgaatccaggaggcggaggttgcagtgagccaagatcatgccactgcactccagcctgggcgacagagcatgaccctgtctcaaaaaaaaaattagatatttgggttgaaataaaaatgattttcttcttgtgaccaatcgtaacttgttttttctcctttcaggtatgaattaagtgaaaagatgttgtctgcatgcaacttactgaaaaatactataaatgaccccaaagctttgaccagcaaagatatggtgagtctgacctgcaaacaccatccccagtgtgtacaaagtgcatgagtgggttcattgtcaaggccagctgtaggctgcccgagctgttgcttgcatgcttttctcctgaactgtttccagcatgagtgggctgggtaaacatcatgtggtcttgctccctggatcacactgccagcgtttccttgaggcccaacttcggacatcctttacccaccctggacttttcctggggtggaggcatctgtgaggcgtacacttgcagacagaaagcagggctaattgcagtcagtcgtcatctttctacatatttcatttctatttatagaacagtaagatccagggagcagcatccaagaattttttttttaagttagcatatgtttttaaaagaaacctatctgagccaaggtcagcattcctttcagttatgaaactgtatgttatgctctgatgtggaatgcaggcggccactatttttaaacataaaaataaccgcacttgtcatctcgcagtctaagaaattcagagcaaacagcaaagagtttgtggttgccttagtgatcatgaatggtacaacataggacacaagtatttctatggcaatggttaatgtgacaccatggccaagaatgacatattctcatgtgtcgaagttatgtgcacattctttcataggccagactaaccccctggttgacagctgtcttttttattagtgcattgagaaaatgtaggatcccctaaggataccgaaatgcacagatactcaagtcccttatgtaaaatggtgtagtatttgcatataaactatgcatctactttaaattctgccatatattttaaatcatttctatatcataatacctaatacagggccaggtgcagtggctgacacctatgatcccaacacttcgggaggccgatgcaggtggatcacatgaggtctggagttcgagacgagcttagccaacatggtgaaaccctttctctactaaaaatacaaaaagttagccaggcatggtggtacacccgtgtaatcccagttactcgggagtctgaggctggagaattgcttgcacccgggaggtggtggttgcagtgagccaagattgcacctctgcactcaagcctgggtgacagagtgagactccatctgaaaaaaagcctggagtgcagtggcgtgatctcggctcactgcaagctccgcctcccgggttcgggccattctcctgcctcaccctccccagtagctgggactaccggcgtccaccacaacgcccggctaatttttttgtatttttagtagagaccgggtttcaccgtgttagtcaggatggtctcgatctcctgacctcgtggtccgcccatcttggcctcccaaagtgctgggatttacaggcatgacccaccgcgcctggcctcaaaaacttaacacaatgtaaatgctatataaatagttgttatactgtattgttttgtattacatattttttaaatattttcactctgccagtggttgaatctatggaaatggaacctgtagatacagagggccagctgtactaaataaaattgctggtcaagtccaggcacagtggctcacacctgtaatcccagcactttgagaggccaaggcagtggatcacttgagcccaggagttcagtttgagaccagcctgggcaacatggcaaaaccctgtctctacaaaaattagccaggtatgatggcatgtacccatggtcctagctacttgggaggctgaggcaagaagatagctggaggcccaggaagttcaggctgcagtgctccatcatcatgccactgcactccagcctgggagacagagtgacaccctctcaaaaaaaaaaaaaattcctagtcaaggggaaacatagaactacatattgaaattcttggatttgtattcatgaaaatacctggctataccctggtcactagtaaaaccataaaatctcactgcagggtcagtatttcccatcaggtttaacctaaacttaaaactggtgccttacaaccccagattttatagccatagtacacttttctttcactgttctcaaaatactaggttacgtggcctttgggaaggattctgttttcctgcatcctccaaattgccgagcatggtgtcatccacacacactgtgatgggtacatctttttaactgaattttcatttggtgtgaaagtgtttaaagtattgtgttgtgaaaagtagtggacgagtaaacacaatgccagggctagataatcatgtcaggacaccagttatttagcagtaatagaattagaatgaccagaagacataatttcccttctttcagtgtgacaactccagagaaacaggaatgtgaatatatacagaaaaaaaaggacactcttcaagtgacccaaaatgtgattgaaatggttaaaactaaataatcagtagcaggatgataaagagatggaagctctataatcccaactctaccttttctacagaaagaggacttcttgggttctggtgcttctgacataggctgtctttctttgatatatttttaaacttttaaagagtaagcacagcagaaatgaatattaaactcatatgaaggcccattgaaaagacactgtagtcatcctcatcaccagtactgactgctcagtctccactgagcttcatgtgacccagggttgagttgatcatccacaaagcaagtgccttcttcatgtgtccacagcctaaggaagtcagagtggagctgatgagagaatgaaattagttccagacggggttcccttttattttccctttccgtggttgaacagttgtatttgggattggggtgggaattgggttggctatacacgtacggtctcccaacctagtgctgtgctgaggagttgaaggaggtgagtttggtctggataggaaggaagcagcataattcagtgtaggctagttaatttcttcctaatttctatgaaaattgtttgcaaggccagtatgattacatcatattaatagcttaataaatggagccaagcctgagtgtttattctcatcacagaaactatgaaagcatggtattatccagtttttcagatgaggaaacggaagcagaataacttccctcgggtcataaagcttttaggtagcagagcctgcatttgaaactcagtggtctggctccagagcctctgcttctgcatggtgctgtctggtctcctttatagacattagaatctacacgtcatttaaaatcaggagaaatgtcccagtttggtgtttgaagcttctcttagggctgttggtttttgagagcagattctaactgcatatatatactttgactataaaaggacaggttacttgtgctttcaactaggtctcagaaagtctataaatagaagaactaacgaccacttggtgttttggcagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccggtatgttggctgcccttccaccctctcttctctaacagtacttgggttgtgactcatctcagagaacctggttgagccactcctgaattctctgaccatgctaaaatcctttttattgcttttccacatgacatggcaagaattttcttgagtcattcataagaggcttgaagtttaaacaaaactgggtgacacagattctagatctgtttttgaaaggaggttttgaggatcttcttgctgcagttcagctgcattcaaaagtgagaggtgtatgcctggtaagaagcatgtctcacgttccctcctgagctgaatcatgcgggcttggccggtttgcactcaggaggcagagtgctgcttacaggcccagggtcacagccttggtgcgtgtggaccacttgatttgaccttactccatgactgctgtccttgcagaagtgtgtggttagtcaagatggggactaagcaaagccaccttaacagatggtcaaatgatcaccattctcaccaaaatatactgttattggggaaacagcatagagcaaagggcatgttattcttgtctctcaaccataatagaatagtagaaacttgttatcccagaatagagccagtggacatcttagacatgaagtgagggaggggcacatacacagatggtaccctcaagaaactgtgagctttcaacttcttgttcaaatggagcagcctgatgccacatagaccccaagtcttttaatttttgtaatacatatttttatttctagtatgtgacagagaagtcagagtatctcagtctgattaatgaggatgtagtgtgaaccttagaatatgcaatcatactgtccaattttctgaaattctgtcttcatccactgtccaatctcttctgctctgttttgggaacttggaattgatgcagagaagaaagccaagcagatttatccttcctttctcttataagtgtgtttgttccctctttttggagccatgttagggtataactgcttccatcttacaggaaggaatttcaagcccctcctcttcaggctttctagactataaacagagctggtgatacagtcagccagagtgattgtttaaacagaagtagataatatccagggaagctgaaaacaagatttcactatcactcctgacaggaacagcttagtatacccttagaagttgataaaacatcttggcaaattaaataattttaattccattgctggatggtttgggttaatcacttatcttaatggttactgctcccccttctaggctgagattctggctccataaggtgtagatctaggatgcttcagcatctatgcagagcagagtccgcaaagtccgaggtgctaaggagccccgaagcgcacacgaattcacctgcttctcctccacagggccttttattttctgcattaaaaacacccacttttaaaaacatgtccttagtatggagttgtttgggatcttaaggtaaatgttcatggtaccttttattttcctttatgatagaaacattctgaacattttaacttcatatttggtcccacataaaagctgctttctaacactcaccattccggtcatttcagagaaagtgccgaaggaacttttaaatgcccgaaggataattttatccctgaagactccttaagaattacaagaatagaaaaggtctggttcatcgattctgttaaggggacttaactgcatttgttctcgaccataaattctggagctggatgttatatgattggaattctgcttttcaggacccccgacaggccagagtagtaaattcagagtctcagaatgagtaatgtttggataagtaggtaccaccctgtccaacgttccatacgtaagcgtttgcaaacacttcgttcatgaatagctcactacctgcttcactttcctaaacacagctgagtgcctagattccaaaaatcgtttattctcaagagcaaccagtagaacaaccaccctgacttccaagccattgcatttcagccaccagttgcaaacaagatacgctgtggaagcttaccgttgtttctcttgcttcaggtgtcgtgaaatagggggaaaaaaagtttttggtttagtatgaaaacatctctcacatttccttctaagtcactcttggtctccagccacctggtaccatttcactgggctcctgtaaacaccatcccttcagtggcttcgtaagcggctgctattagaaggggctgcttcctaagagacttttttttttttttttttacagatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggttagtgcgcctggttcctgtgctcaggaatgcacccgtaaccagcagacaggactgcggtggccattctggcagagcaggcatagatgccacgcttccaccacagtgcacttgtttgcaggcctgccctgagtccatacactgcctggcactccttgctgaccaaacataccagggaaatatgggcttaaatttcacactggaaacttctccctcctttgccttgccttttgtccatttgcatagtttgcatggaaatactgttagttcccctacatataaatgattgcgcatccccatcagatgctcagtgactgttgcttcctgtctctgtgttgtactgtcttcatagcaaacagtgtcccaggtccagatgtgttcacagcttgacttttttttttttaagagacggtcttgctctgtcccccaggctggagtgcagtggcgggatcttggctcactgcaaccacccccggctccctggttgcagtgattctcctgccttagcctcccgagtagcagggactaacaggcacacaccaccacacctggcttttttttttttttttttgagactaagtctcattctgtcacccaggctggagtgcagtggtgcgatcttggctcactggaagctctgcctcccgggttcacaccattctcctgcctcagcctcccaagtagctgggactacaggcgcccacccccacgtccggcttattttttgtatttttagtagagacaaggtttcaccgtgttagccaggatggtcttgatctcctgacctcatgatccacctgactcagcctcctgaagtgctgggattacaggcgtgagctactgcgccagcccctggcttttttttaagtagagatggggtttcagtgttgcccaagctgctcttgaactcctgagctcagacaatctgcctgcctcagcctcccaaagtgctagggttacaggcgtgacccaccactccaggcccacagcttgacttttaaccaccacctgaacttccagccccttactctactgagacatcctccacgctaaaatgaagttggctccttactttatgcccttcctttgctcatagctcatgggaagctggtttctccctgcttgccaccacctgccccaagtagttccatcgccagttctttcccttctgtcaccacactcttccccctttccctagcacagccccactagaggccaccactgccagctcagtacgtacttctgaagtccttgtcatctcttcccataggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgtaagctgtctccattgggcctcctggccaggggtctgggggactctggacgggagctctgggagtgccttttggccaggagcgaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaattcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacaacatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttttgcgtgtctctaggccaaaggacaggagtggtgataggtagaaggtaggaactggcatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacatggaagctgcagctgtagcagattcccttcttcccctctgtgggagggagagcttctgaccgacttctttcttccagaagagtttgttagctgtgctgtggtttttgtttgattttacttctattatctttcaaagcttttgaggggaaggatcataagattaaaccaaagagaactgtgtcctgctgctgctgctgaccagagggaaatccgtatttcaagactagataggctgggcacagtgggtcactcctgtaattccagcaccttgggaggctgagacaggaggatcgctcgagcccaggagttcaagaccagcctgggcaacatagtgagactcccatctctacaaaaaaaaaattatctaggtgtggtggtatgcacctgtagtctcagataccgtggtggttgaggcaggagaatcacttgagccctggaggtcaaggctaccgtgatctgtgatcgtgccactgcactgcagcctgggagacaaaccctgtctcaaaaaacacactagacagaagacaagttgtgttgttctttcccttgatactcctttatatccatttaaatccctgaaatttaatggaaatcaagcagttaagtgaagcttttttcacccatatgtagtgtttcccctcttatttccagaagttggatctgtgcaacccactgggattgcgtgcttacacacagatgttacttgtagccttaaaccgaggtggtttagggttttaggatcacagtgccctctctaagaggaaaggtaaaagatctttggcaaattgcagagtctctaaacacacactactgctgcttgcctggtcattcataattaattagaagaaaaaaaaactttctatccccatcttctgcttccccctcctggtgggcagaatggttgagtaagataatcctcttaactgggacctctggagggtggaggcttgcctcattcatcttcacatcctcaggccttcacccttagaggtcccaaaaaagtttcccagaagaccgaacgagtagggatatttggggaaccttgccaattattggagggtgttttgttctgttacctttcggttgtctggaggtttgagaaacccaacatggcttgttctttccatcttatcttaaggatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctttt

SEQ ID NO: 255 - DNA, 241412 bp, Homo sapiens
gagctccgggtccgcggcggagcgagcgagcggccggcaggttgggaggagcggccgaaggtgagtgacgcggcggggccgtgccgcgccccgtgccgcggcgaggttgtcccggagcgcgaggcccctacccctgcctcgggctggccccgcgcggagccgacttggcgcgcgccggggttgcgcggcggccgtggcggtggcggagggcagcccccgcgggctcccgctcgtgcgggtgaacccggcggcctcggggcggtcctgggggggggtccgagaggtggcgtcggccccgcggccgtcggagtttggcgcgctctgcagcggcggcgctcggccggtctggaggagggagaggcgcgccgggcacggagcagcgagaaagttcgggccgggccggccggcgggagggtgcgggcgcctggctaccccggcccggcgctctgtccctcggatgcctctgggcccttccctagcccggggcggaacgggggaccctctctgaagcggctctccgtggagttggatgttgcccttcgcgggagggagtggcggtcaagacccctttatcctcggccccagaggggcaggtggcctcgggtcgccctccgccaactccgaggtggcttcggccggggctggagggcggggaggcgggggaggggcgtgggcgctgcggcctctggggcggcccaacccggcgcgggcagcgtgggtttccgaggtcccgcggttccaggtcgagggaaggtgtaggggccctgaagcgggctggtccccgaatgttgcgttttctgtgccgctttgggcaacacgcagtggcgctcgcggcagccacggctccttgaccgttcatctccttcacccgggtcccgtggaactttcagaggcaactgttcttggtggctcttgcgggtcagcacgagccgtgctgcacgagcgtgacctagtgaaggccttgggcgagttggcgttaacaatttatggcgtccgccagcgctcgctttccgcacgtggcctctgcggagggtcagcccatcttattaaatagtggattctattagaccctgatacccgaggctaataaggaagcttaatcatccagatgtgtaatcgtgcagttcctttcctcaccgtcattgccccccacctctggagctgaatggaaatgagggtctgtttgcttatattgaattcctgagtttattcaagttcatttttaggtggcgttaacagctaagtagctgttcatctgccagtttctcctttcatccaactttctctactaaaatgttgagcacgttttatttaaaaaaaattgaagtgtaataaacatataaatttactcttctaaggtcaaaattcagtggtttttaatatatccgtaaagttatgaaatcatcactaccatctgattccatttcgttgcccccaaaaagaacccctataccgattagcagtcattcttccatctcccagcccttctccctcattttaaggcagctacttaggaagtttttctaagatagagactgagtgagaaaactgagaggtgattaactttgatcctttttctgttactaggtttggggaaaggtgctgctgaagcaatggaagaaaaattaagtattggctgtcctatggggaggttaaaatgaataaggatggaagagaagctgccagtagaggaataattgcctcctgtagagacccacaagttgggaatacattttatccccttagggcacagggatgctttctgggctctagacttgcctagtccataaatcactctagtcgaggttctgcctcagcgaaagtgagttctgggtgtgtgtgtgtgtgtgtgtgcgtgtgcgtgcgcgctcggcagggaatgttagaaggaaaaaagactaggcttaaaagtaattttttaaaatatccaaactggccccaaagaaagaaaccaaaaaaccacaggcaaatggccactggaattgatacattcaagactagtttcatttcatgagtatcagttcacaaatagttctgagttaatgtgtgcatacattaactttttatcccaagtgggaggaggaggatggaaaaggatctagttgggggcagtgcaaggaactgggaagaggaatgggataatggccgaaaggggcagtgcttgtgggagctgaggactgttgagatggaataactatagggtgagcagattctgaaagagcagagtgggtctgtgaaaagttggacacttcactcgggctttttgttggataatgtgtgcatgttttaaaaatcatttttagtaaggagagttgaagctatccaaattatgcaacatccactacacttctcactcacccttcaataagaaaagtcaacttgttttcaagtgtttcgggaagttttaggcctgttgcatgggtgacagcttatgccatcttttttttttttttttggtaatttagaacattgacatagcgagactccgtctctacaaaaaaaataaaaaataaccggatatggtggcacatgcacctgtagtcccagctacttgggaggctgaggcaggaggattgctttagcccaggagtttgaggctgcagtgaactatgatcatgccactgcactccagcctagatgaccgagcaatatcctctctcaaaacaagatgagctgtaccataggtatacatatcccacacccccagccctgccgacggagttttgctcttgtcagccaggctacagtgcaatgtcacagtatcagctcactgcaacctccgcctcccaggtttaagcgattctcctgcctcagcctcccaagtagctgggattacaggcacctgccaccatgcccggctaatttttttttttttttttttgagatggagtctcgatctgttgccaggctggagtgcagtggcgcgatctcagctcactgcaacctccgcctcctgggttcaagcgattctcgtgcctcagcctcccgagtagctgggactacaggcaccgtgtcaccacacccagctaatttttgtatttttagtagagacagggtttcactatgttggccaggatggtctcaatctcttgacatcgtgatgtgcccacctcggcctctcaaagtgtcaggattacaggtgtgagccaccatgccagtttttgtatttttagtagagacggggtttcaccgtgttggtcaggctggtctccaactcctgaccttgtgatccgcccacctcagcctcccaaagtgctgagggattacaggcatgcgcccccacacttggctaatttttgtatttttgttagagacgggggttttaccatgttggccaggctggtcttgaactcgtgacgtcaggttatccatccgcctctgcctcccaaagtgttgggattacaggtgtgagacaccctgctcagccttttttttttttttttttttttttttttttttttgagatggagtttctttcttgttgcccaggctggagtgcattggggtgatctcagctcactgcaacctctgcctcccgggttcaagcgattctctgcctcagcctcctgagtagctgggattgcaggcatctgccaccatgcccggctaattttgtatgtttagtagaaacggggtttctccatgttggtcaggctggtctcgaactcccgacctcaggtgatccgcctgccttggcctcccaaagtgctggcattacaggcgtgagccactgtgcccagcctgtagctatacatcttaagagtacatcttcacaaattgtcacaaagtgaacataaacatataacaagtactcacggaaagaaccaaaatattgccagcattgcagaagtgcccctatactcttgtccaatcactgcccctcccgaagagtaaccgttgtgccaactgtggattagttttatctgttttcatgctctacacagactcacacggtatatagcttttagtatcctggtttctttctcaacattatatttgtgagattcagctgtgttgttgcttgtggctgtagttcagttattttcactgctgtgtaatattcaattgtatgactacaatttatcaatttttaggtttgaggggcatttacatagtttccagtttcttacatggtaagtagtgtgactatgaacattctaattctagtacacgtcttgatacacaatatccaatacaaatgtgtacatttgtacaaattctattcagaagtagaatttcccagttccaaactaggattcagtttagaggtacagtcatgcggatttctgaagtggttgtagagtttatacttctacccgtagtgtgagagagttctgttgtgtcctttttaaattggaagagcagtagatctgcagagtttggcaaatggacaaaatatgacctatttattattttttttttggaggcggagtcttgctctgtcaccaggatgagtgcagtggcgcgatcttgactcactggaacctctgcctcctgagttcaagcaattctcctgcctcagcctcccgattagctggaactacaggcacacgccaccacgcccagctaatttttgtacttttagtagacacggggtttcaccatgttggccgggatggtctccatctcctgacctcgtgatccacccacctcggcctcccaaagtgctgtgattacaggcgtgagccactggcccaatatgacctatatttaccccatcctagcagactaattatttgttgtcttcacttccagtgcttttccatgtctgttcatgtttttatgaagtcacaattctaatattcaattttgtattttgtttcttaacacagtatcttaatattgcttcagtctctgactttttaatccctgcatatgcctaaggatatgctttcatttaataatcctcttattagaaatgtgtgttaatttctggtgttttactagtacataccgttgtggaaatcatctttgtgcatatagtttttacctccctcttgggtatttcataaatttgagatttttgtttatgtggcttgggatctttgttaaactgctgcctgcagagttatccttgaacctaatatggaattgattaaagaaatcttttttatttttttgagacaggatatcattgtgtcacccaggctggagtgcagtgacaggatcagagctcgctgtaaccgtgaactgctgggcccaagcaatcctcccgcctcagcctgcctcccgagtagctgggactacaggcatgtgccactgcactcagctaatttttccttttttttttttttagttgtagagatggggtcttgctaggttgtccaggcgggtctcaaactcctggcctcaaacaatcctccctccttgccctcctaaaagtgctgggattacaggtgtgagccactgcacccagtctaagaaatctttaaattgctaatatgttacctgcaaaagggtgtctcattgggttaaattgcaattctgaaaataatggtgaggttgaccatgataacttctttaaaaatagcataaattgaacctttgtggcaatttcatttaggtatcactgattaattttctttatatggtcctgtttacaaaggtattgagccaagagcttgaaaggatataagaaggatcataccattaagtagttgattgtccagaaattatatctaataattaaaaataccagttaggcaaaattcttacacatgaccaaggagtgttcattctacaaatgcagtgcttgtttaagttctgagggagaagtctttcttgtctagatgattaggagctgcttcccccaaaagtaagacttgagctcagctttaaggagtctctagaaattggctagggagcagacatcactaaagagacactgagccttctcaaggagagagatcagcggtgcatagggagagccccggttgaccactggacagtggggttggtgatgctggcttccttactattctttttctggaagataccgaaaataaatgaactaatatataggccgaaaaaagtacttggaggattttgggagaaagctgtttggtacattcaagtcagcatcatggggtttaatggtaaacacctgccagagattagaatgcagtaggctgcttttttgcctaattatagatcttaactcctttcccctcaggtaaaattcagtgataatttctctaagatgaaggctgctagaccagccttcattcagaataagccaatatcacttaactttagtaaacagtacttaaatttgtattatgtgcaaggccctggtgggggaaatcagagactagaaagctaagagttcatagggaatgaatgtataatgatgcaaaattgtattaataggcaaaatgttagaaatactcaatatcgatacaaaaggttcactctggaaaggaaagggatggagaaattaatgctgagtagagagatctgggtgatatttagggggatttggccttgaaaaatgtgtatgggtgggaattagagtaaagggcactgcatttaggcaataggttttgaaaaagtaaaaggtggcagtgcttgacacataataccatggtcagtcataggcttggagacccaggtgaatggcaatttgagattgtacctttcttcctgtgacttgtgactgctgagccagcctggtgatctctgtggaaatattgtaggtgtaggcccaggctggctacttttaatctaggatctgttgcttgctgtgtgacctttggcacagttactaaacctctctgtgtgtcaatttcccatctataaacagggataataaaagcatctcctttattgggtacttgtgaggattgaatgagttaaaaccaactctgttggttgaggcagtcacctgtccagactcaagaacacttagaagggtggttggtatacagtaagttttatacatgtttgctgttattcccttaatttttgaatttctgaattatagaatttctaatactcacacatagtgtaaataatataaacaacaaagggtttaaaataaaaacaaaactcatcattcttgtctggtcccaactcagctacagtcttggtttaggtgtgataactgctgtttctgtttttagttcttctagtggttattttagcaaattaccccccaaaatttagtggctcaaaaatttgttttatggtgttttggattctgtgggtcagggattcaggcagggctgggctgggtgattctgctgctttcggtgttgactgaggtcattccctggtacccagctggtggatgtgctggtccactggctccaaaaaggctttgctcccatgactattgccttagtgggagtagctggaatgctgggctcagcaatgactgttgagcagagcacctacacatgttgacttcatttgtcttcatggcaactacatgtcttcatggtgacttcagcatggtggctccaggtagttgaacttgtgtggcagcaggcttccctcatgtgttactaagggctctccagagaaacataaccaatagtgtgtgtgtgtgtgtgtgtatgtatatacacacacacaagatttttaaaacaaggaattgacttattcagtttggaggcgggctagtcctaaatactgcattgtgggccaacagatggagacaaggagagtctagaagaagactgaaggaggtctgctggagaattccctccagctcagggaggccggtctttttgtttagttcatacctttagttgtttgcatgaggcccacccacattatggagggcagtctcttttacccatagttacctgatttaaatgtgaatctcatccaaaaacatcctccaagtcaacacataaaattaaccatcataccctgctacgagcaccttgggtaaaccagttggaagcttcatggccttttatgacatattatcagaagttaataacttcccttttgccaaactattggttgtagcacaaaacttgctcaggctcaagcagaggggacatcgacctgccacttgatgggagtgtcaaagaatttgcagtataaaatatactgccagtctatgcttgagttcataaatttgacagtgtctgttaacttcctgctaaggaagaagtggaatttatattccctcacacctctctttcctcttctctctgcctcctggtttttattagatatcttattatttttgccttattatttttagttgtcttcttttggttacctttctgatttaaaataaagcagtccattctttaccaggccgtagagatatggaaaactcaggtttgttgaagggtatggtgttggggagggacatggcagaaaagcagcttcaaatggttgaggcttgacaatgaggctcttgttaaaacactccagccactaaaaatgggaattgcctatgagtgtgtcctctttgtgagcctagcaggtggcataatttgacactttttattttttctctttggcttttaaactcagatacctgtttgcctttttcttccctacacttagcatttaaattatgaatgctggaagcaaatgatattttcaccaatgaagaatcttattacagacacatggttgagttgagtgtttgtatgtggatgtgctgtcagaaataagtgctctcttgcttttttcattaccaaagcaatcagttaattggaaacagagtgtcaggagccctgtaactctgttggaggtgttttgggttttttctttttttggattcatttagttaatacaattgagcaatggggcttagtttaactctcagaacacataactaatccctttttataattatcatccaagaaacatataagaacctctagtcttgttggtttgcattcattgtatattgcagatataacctcttttgatatttgtcttactaataaaatttgacttggttagtggcaagaatgtaaatttgtgtttgatatctgcataatatttttggctaaattttttcagatttctgttgttaattctgactggttcaccctttgaccttgggaaaaaatagaacaaaagcaattagaacaaaagtagatactttgggaggccgaggcaggcagatcacttgaggtcaggagttcaagaccagccatagccaacatggcaaaaccccatctctactaaaaatacaaaaattagctgggcttgctggtgcacacctgtagtcccagctacttgggaggctgtggcaggagaattgcttgaacccaggaggtggaggttgcagtgagtcaaaatcacgccgctgcattccagcctgggtgacagagcgagactccgtctcgaacaaaagttgaaatgaaacataaatactgtattcaccttttctcttttctgtcctcctcctctccttccctccttctcttactccctccctctcttcctccctctctctctccctccctccctcccttcctctctccctcccttcctctctccctcccttcctctctccctcccttcctccctccctctctccctccctcccttcctccctccctccctcccttccttccttcctccctccgtccctcccttccttccttccttcctattcatctcaatagagctgctttttcctctaaaaataatagcttcagggtagccctttttaggggatgggattatccctgttatgagatggttcagctcacttttctgccaaatactccctcatctcctttacccaaatggagccacagaccaatctgaccatcttggtgtcatatccccttctagtcacaactcttgccccgagggtatccttacttctaatatcatagatcaatttagtcagtttttgaactttatgtacctgagatcacagagcatgtactctttcgtgtctagcttctctccatgttatatttgtgagattgatccatgttgtatgtggttatgggttcatgctcattgctgtatagtgttccatcatgtgaatatactgctgttcatcctgttgtccatgaacgttaggtttctagttttggaccagtatgaacagtactgtcatgaatgattttgtatgtattttctggtgaatataggtacacatttaagttagatatatatctaggagtgcaatttttgggccatgcagttcaactggagtaggtaccgtcagagtggttttatcaagcggtattcccagcagtggtgtatgagtttcagttgcaccacagtgcttgttattgtctgttgtcttattttagctaatctggtaaacgtgtgttattgattccctagatgactaatgaagatgaacacctcaaaaagggttcatactttttattttattgcatagcaaagtagaaaaacaaagccagtttgaccgggtgcagtggctcacgcctgtaatcccagcactttgggaggcagaggcgggtggatcatgaggtcaggagatcaagaccatcctggctaacacagtgaaaccctatctctactaaaaaaatacaaaagattagccaggcgtggtggcgggagcctgtagtcccagctactcgggaggctgaggcaggagaatggcgtgaacccaggaggcggagcttgcagtgagccgagatcgtgccactgccctccagcctgggtgaaagagcaagactccttctcaaaaaaaaaaaaaagaaaaaaaagccagttaaagaattcatctagagacattgtatcagttctttaaccactctagcttttctgtttctctacacatttattgtgtttttttgttttagttttatgagagatgtatttcaaggaatttacttctaataaaaatttaaagaacagaagtttatggataactctactagttctgagaattaaggtatttaaaggatgaaactgctcatactgtattactctttcaacttttctaatttgttaactcagtctatttatttttgcctttcactttgacatttttataggagaatttgaatcatgttctatagtttccaggaattaaatttccacataaatgtaaaagaaaacttgagatcctgatgcaccattttttaaagggttttaaaaaggggaattgttaacgtagggataagctatatattgtgaggcttcgatggcagtgctgttaagttcttgtcacttcttagcaaatgaaatgcatagtttcaaggaaacctcacgtgtggtttgatgtgtttgagttcgttttgatttatttcctgttgacattttgagatttcttcctttagcttttattctgggcacctattttatcctctcagttgtttctttttaagacctgtatgcctctttaggaatccaacatgcagctgtcatctagctttgtacttctgtgcatatattccatcttcccttaaatattattggtgtattgctgatcaggggacagacacaaggtggtcttaaatatctgtaaggtacttacaggtgttgtttggcctcttggtggcaagactatgtcctgggtcagattatctaaagggtttttggagaattcaggcttttgaccttggaggcagaataagatttctctgcctccagagacaccaaacttttaactccttttggagttatacttcaggagtaggaggaaagtttgctgaattcctatcaagaaaaggtggttgagagacatgattgaagattgcttaattcatcacagtttctcagctctggcatgaaacagttgggagaagcgattcaaataactgctgatgaaagttgtatattatttttccttttttgaagtttagggaattcagggctagctcccaaatgagatcatgtgaacttagtgatgttctttctggtgggtctttattagagtcagtggggagggaaggggagcggttttggctgtagagtgggatctgaaaattgttcataatgctgggaatgacagaaatgtgggtgcgaagtgcagtgcagagacactggcttgaggaatagcaaggccttttatgatgggcccaggtgggaggggagttactaggttatacttcataggcattcaaaaatacttgttgaatgaatatggatcattttatcagtagcatactaaggctgtcagatctgcatgaagctattgattcactagttatcattatagtggcttagcagcccgctggggggtacctgtccttcaggtgattaggaatttcatgcctccatcagtgtaagtttgaacacttgggttacgaagaaatttgtcctaatgaggtttggccccagatgccctgccaggtgtgcatctgagtgtggtttctattcttcatcaccctctacacacacacacacacacacacacacacatccgtcttgtgttttttggtgggctcagagccacgagggagctattagttatccttccaaaattcagcaagctgtttgtgtttgtttttgtttttgttttgagacggagtctcgctctgtcacccaggctggagtgcagtggcgtgatctcagctactgcaacttccgacggttcaagcagttctcctgcctcagcctcccaagtagttgggagtacaggcatgcaccaccatgcctagctaatttttgtagtttgagtagagacagggtttcaccatgttggccaggatggtctcgatttcctggcctcatgatctgcctgcctcggccttccaaagtgctaggatcacaggcgtgagccactgcggcccggctgcaagctgtgttttgtcgggacggtttcgattagtttttaggctaataaagaacactgtttctttttgtttcttttttaggtttattttagccaacctgaggaaacaaaagcctactgttaggatattcatgggaaaatagggaagccttttttttcctttagtgaaatcctatgtgcctatagagctttttcacactttctagagaaggtaagcatctcttcctgagaaagagtggggataatatgtctgggctcaattctgcctgttgtagggaagggtgtgccggtgggtcaccttttgaggttaagaacgagtaataagaccttgaggattcttttttttttttttttttgagacagagtctcgctctgtcacccaggttggagtaaagtggcgtgatctcggctcactggaccctccgcctcccaggttcaagtagttctcccgcctcagcctcccaagtagctggaattacggagtcccccaccatgcctcgctaatttttgtatttttagtagagatggagtttcacattattggccgggctggtcttgaactcctgacctcaagtgatccacctgcctcagccttccagagtgctgggattacaggcatgagccaccttgcccggccaaccttgagggttcttagccatccccaaatgatctgataaagtagccttagtactgtggaaaaaagtgtcactctttcctgctctgtcaactttgatagcaaaaggaggaaacactgctaaaggggcttgaagtttatatagtttgtgaatcattttcttgggaacttttcaaaagaagtgttgtaaacctctgacctcacatccagtttgaccagataactgtgcttacctgttgaggcccatctgatttgagtcctggcttaaagcggttgttcacatgttgaagtctgtatttaagctccgctcccaggctgggttgtgtcatcccgagcctccccttctccctccttgacccccagtggcccagggcagtttttactttaccgtttcttcctggctttttacctatacttttcggccagacacttcaaggggatctgattcgatgtaggggaggggttcggagcatgggttctagaatcgaaactctactatttcctgcgaggtgtatgttttctttgcttctttgtgtttggaaagaaatattgatattgtcattccgtggtgtttaagtgtgtaaagaggaggagctgggaggaagatgaaggaagacctaggatgtagtatttcctgactataaaactccctaggaaaagtcctcaaagagccaccttgtttactttaggctagaggagcggagaaagggcggtgaccctgtatgacatacagtgaacaagagaggtggaactctggcaggaagtaaagggtagaggcaggctcagggacccaagtcttgtaggaaaccacaactccatgaagcctatatggagtttcttagcattgtctttaaatttttttttttttgttttgagacagagtttcgctcttgttgcccaggctggagtgcaatggcatgatctcggctcaccgcaaactcccccttccaggttccagtgattcttctgcctcagcctcccgagtagctgggattacaggcatgcaccaccaggcctgactaattttgtatgtttaatagaaacggggtttctccatgttggtcaggctggtctcaaactcccaacctcaggtgatctgcctgcctcggcctcccaaagtgctgggattataggcatgagacactgcgcccagtgtctttcaacttttactaggcaccttataattgtgtcttttcccccaaagcccgctctcacgacagcctctggatatcaagatctgtcagccttaacttagtaagtgttctgagtttctctgaacttccaacttctcaggatctgccacaaatttgcaaaaggtggtgttgaatatttttccttcagaaattaagtttttaattcttgtatattttcataggagtagctatgagaggagtcttaactttgggtattgtttttctttggcttctagagaaaagtttgagaggtctagtgattttcattaagttcttttttaagcaatcatttgtgaaactattcacatcctcagatcttggtaagatttccatgcagagcctaatactgaaaagctaaagaagaacctggactttttggaatgatttcgacctctcataaaatcccagacaattacatttccttattttgccaggagactggtatgccagttaagtttataacctcgatccttgttttatcctccatcagttagagattaattacatgcctttggaatggtgagctgttgagccttgtcgtctttgaacctactattgttctcaataaggtcttctaaaggtcagacaaacaagtcatttagatttttctcctccccttaaagcatgcatttataaggcaaaaacttaatgatcattcattccattccattgatcattaaaacagctttaaaaatgaagtggtttcattactcatattagtctagttatgctcagtgacttaaaacaatacattttaatttctagacttaatgagccactccactctgggacatacttatggcagagggtaagaaaagaaatgaccatagccgggtgcggtggctcacacctgtaatcccagcactttgggaggctgaggtggatagatcgcttgagcccaggaattcaagactagtctgggcaacatggcaaaaccccatctctacaaaaaatacaaaaattagccgtgtgtggtagcacgcccctgtagtcccggctacctgggaggtggaggtgggaggatcacctcagcctggggaggttaaggctgtagtgagctgtgatcataccactgcactccagcctgcttggtagagtgagaccctgtctcaaaaaaataaataaaaattaaaaaggaagtgaccagttcattcatagttattaacacttctgcttgtgtgtcacttctactcgccttcacttggctgaagaaagtcatatggccaggcctgccagcaatgtggtagagaagtgtggttaattcttccatctggagatgctataagtcacgtgacaatgggggatataatcctctttcagggaggttagcgaataattgaaaacaatataatctaacataatggaagactatatttaactcaaaaaatttaatggcctgtgttctgattcagaaatagtttttagaattggttaaatctgcactttgggttttattttgaaaagattatgcctcagaaatctgcctagatatggaaaacagggtctagtttttggacaggactgattaatcttttatgaattggagagctgtaccaacaacttggtaactttccattagttgtttcccatggctccagatctgtattttaatcaagaagttacacttcttcctctcttgacttttatatcttgattttgcatgcattgttagtatcctattggtcagatgatttttgtttaattgcctgatttaatatggttttggcagccaattaacagtggatgctactgtcaagagaagggtagagatggggccttttgacagaaataaaatttattaaggcctcatcagtctgtcttggtatttttctttcaaaaatgaaactgatgaactgttgctgatgttcttactaggaaatttctgtcttatataaaagatatgaaatcggaattctttgaagcaagatgacaaaataaagtcatacattgctgtgaggaacagaacgtttgtgcctcaattggttattcaccatctacatgttgagattctttttgtgggggatcttggccatttctgcatgttcaccctcacactcctttttatgaggtgtgggggccatctacttaggcaagagtcttaggtagcttctgtaatttttatgagaaagctgaagtctcttctgcttggttgacttttaaaaagtaggtgcaccaagcctcagctggtgtcagactgctgcacttggggttcttcctgagctcttaacctgcttccagctcttagtgaaaacttgtttttgggagatggtgttcattcatgaaatttcatcaaacactgggcacttggaattctctactttcttttccctccagattctttttttttttttttttttggagacagagttttgctcgtcacccaggctggagtgcaatggtgtgatcttgggtcactttaacctctgccttctgggttcaagcgattctcctgcctcagcctcccgagtagctggggattacaggtgtgcgccaccacgcgtggctgatttttgtattattggtagagatggggtttcaccatggtggccaggctggtctcgaactcctgacctcaggagatccacccacctcagcctgccaaagtgctgggattacaggcatgagccactgtgcctggctcagattcttttattgaatgaacgtctactatgtcttcagcttccattatttagaaatagagaagagtttaagaaacagccacaggcagctcatacatggtgatcccttttgcctctctcagtggcccttttttggagaactgttagaaaagttgctgtaggccttggtattagaaaatgttggcacatttcttgggaaaatgtttgatttgttgaataatgtaaatattgtaagagattgtgatttcctcattgctttgaccaaatttatatcccactgttaaaaagaaatggagaatttcatgatggttatttactaatttaggtctcattttacgattctgttttcccttttgctgaatttatttatttttaaattaaaggtaaatatagttacatctagttttgaaagatgccgcaagtgtttttggaccaaggttgggtacagatacatatatcgtggttccttcatgcagttgaaagttttaagaggactctgtgtgggggagtgcacatacacacagctggatagcactcctaacgctcctttctgtgctcactccgtctctttcatggttttcacaagcagagcatatgctctgtggcatactgggggtactcagtactctgtctcagtgctgagacttggagaaaggcattctttttgagcccttttgctcatgaggaagggggtcctggtgtaccccagggtttgttctccaggcctgggacccacagtggggttgaactggcagaaggcaaagaccataatggttacttctgcagggacagatctggaagggacttcatgctgacttttgggtttttaagttggtattttctgatgagtgactttggtatctcatagaattctgtaaactctaatgcactccttaagcttagcaatgtgtgcctgcctgtgctctcctgaccaccagcctctgacctaccctggttttcacttcattactcctcccttggtgctgacagctcatgggaattaagccagaattggcccaaaagctaaatgcctgcactgctgagctgtggtttcccatgaaaatgccttccctgagttaatgttagccttttgcttgtattgatggataatgcaaaacatgatcatctgtaaggtctcagttcttgatctcttttctgtagacactcattctcgtggtgacctcatcttctctcatggctttaagtgtggttgatattccaatcattatcacatttaggtctccagctctgacttttttctccagttccactctgtaaggcccaactccttccccagtatctacacccgagtgtgtggtggccacctcaaattcaacgtcacccaaacagaatttcttatttcccccaaactccttctccccacagacttctagtggtaaaacccctaaactttgtaatcatcttcactcccctatctcatacaccctacctttaattcagtagcaaatcctgtttcaccttcaaatatatgtagaatctgcatcgtcctccctctttccactgccaccatcctctctcacctcaattactgcactagcctgatacctggactctctgcttcccttgcaatccattctcaacagccatcttttaaaaacaaaagtcacattgtggcactgcgtagactctctgttggctccttgtttctatgggaggaaaagtttttacagtgaactccatggctgtccttgcccggtcccttgttattctgtagcctctcctgtgctcgcccccacctctgctcttccacaggtgtcccttttgcctcccttagggcctttgcactggctccttcctggggctggagtgctctgtcctcacctcagtgaggtccttgctcagatgtcaccatgtcagtgctgtgattattcagagttataacctgtcttctcctggcactccaggtctctcttaatccgcttggcctcttcttttttttttccatatcaaaaattaaccagtattattatggaatttacctattatatttattgtttattttcagcatatcccagtagaatacgggcttttccagggcaggaacctttagctggtttgctggttggtggtacatcaagctcctagaacggaactggaaacgcagaagacacttaaataggtatttgctgttaaatgagctgctgataaggatttactatgctgttcagaacccattatgtgaggaaatatatatttcagttcactgttaggaaaacgtttatttccttgatgaacagggactcccaacttacctgattccctcttctgctttggctaccaggatgccaggaactaagtgtcatgctcagttgtgaaagtgattggcttcaacttgctggtgaagtaatacaacccttcccttcctttcccttttccccagcctttacttgattaagtcgttctgtagttttttgttgttttttttttcttgacaataactctgccttttattgtttgacttttcaagtaactttttggagtgtatgtgtataagaattcaagtcaatcttcaaaggaagagaattcatttattacagagatttgtttatcttagcttacggctggttttattttagctttggccaggttggcaccattgtttcaagtagtatgtcacttattgtggggttttttgtttgtttgtttttgaaactgtgtcttggcctgtcacccaggctgaagtgcagtgctgcgatctcagctcactgcaacctccgcctcccaggttcaagcgattcttttgcctcagccttccaggtagctgggattacaggtgtccactacgacacccggctaatttttgtacttttaatagagacggcatttcaccatgttggccagctggtctcaaactcctgacctcaggtgatctgctggtcttggtcttccaaagtgctgggattatgggtgtgagccaccgtgcccggctcgttactggttttgatcagtgttctgaaatagtaattttgggtatgctgtctctctacaggcttctgtttgattgaatttcatttatacaggtattaacatgcttgtaaactactattgtctattgctttattgctttggttagtcaatcccaaactcttgctgccttttttttttttttttttttttgaggcagagtctcactctgtcacccaggctggagagcactggctcactgcaccaatctcagctcactgcaacctccgcctcctgggttcaagccattctcctgcctcagcctcccaagtagctgggactacaggcatgcgccaccacacctggctaatttttatatttttagtagagacggggttttgccatgttggccaggctggtctcaaactcctgccctcaggtaatccacccaccttggcctcccaaagtgctgggattacaggcgtgagctactgctcccagccaactcttgcttcttaaacccaaggaccctgatttctgacagaatatgtatacatacgtgtgtgtgtgtgtgtgtgtgtgtgtgtgtgtgtatttatttgagacagagtcttgctctgtggcccaggccaaagtgaagtgcagtggcatgatcttggctcactgcaacttccacctccctggttcaagcgattctcatgcctcagcctcctgagtagctgggattgctgggatgcgccgccatgccctgctaatttttgtatttttttagtagagatgggtttcagcatgttggccaggctggtctcgaactcgtggcctcaagtgatctgcctgcctccgcttcccaaagtgaggcatacaaaaagccgtagaatttcatatttttgagctggccagatttgtcaatggctctaataagtgttgcatttttatttaaggaggcatgtggtgatgttagccctgtgatataggagaataagcagcaaaggttgggctggtttccctgctcccctggctgccgtttctccattagaactggaattggggatttcacaaggacctcttggaaaacttcacagttagttttaaaaaaaaatgcatttgtcacccagaggatcaatatttttctaaaatttctaaaataaaggatcagtttgtttctgaaatttggttacctgaagccattgacaaattagttgtttcttattcaggttacttttaattgagttgtgcatgcaaacccacatgtatccctctctgcctctgaggagaatggggcctttcttggagaacacaaaagtaggaattctgattttattttgtgatcttagtcactttacaattataaaaattttggagctaatgagaaacctgaaaaattctgaagtcttcaaggagtgtgatcctggtgctgtctctcaggcatttctcccagagaacgggacggcagagcaatgactgttccccagcccacaggtaggagctggtgggcagcaccagcagcagtagacctagaagtcttagacttagatgtgatttgaaatatggcttttattatgggagcagcacacataagaccatcattggttctcatatgggaaaaacccttgaatattggctctaggacagattttaaggctgggtgtggtggctcgtgcctgtaatcccaacactttgggaggccgaggctggaggattgcttgaggccatgaattcaagaccagtctgggcaacctagcaagaccctttctgtacaaaaaaataaaaattacaaaaaattatttaaatgaaatttagcaatgttttatgtacgtgtcttctcatacttcaaaaagtcaagttgttctacaaaaccgtccatgaaaacagtagctttctgccctgcttttcccacctgattccctctcctcagaggaatctctcatctatcttctgatgttgaaccataagaaaatgctgatatttgactgctttagatctgtgaaaatgactgtatcttgagaaagcatgcttatcatgtcatttcttgatttttttaaattcaattttggatatttactttcctcacactgtggaagatgaagatataactcttatgacttcccccaacacgtctcttctcctgctgtaatattaatatgatttttgtttgattaatatataatgtttatagtattatttagactggaaataattcacagccaagacatgtaatttaaatatttccttcctcatacagcttttgcccacccagagttaatcattgttttgagtgcttgttttaagtacctgtcactgactcattcccaaactgaagcctaaccttcctttctgtgtgtttgcacacctcagggtagctgtccattcatcctttcttcctgaaggcgtcccttctgaagtttccaggccgttctgtaccttctctctgtttctcttccctggatactatggtatcctcctcctttgtggtttcttttggtctctggtttttgtgtgttttttgtttgtttgtttgtttgtttttgaaatggagtttcactcttgtcgccctggctggagtgcagtggcgcgatcttggctcgcggcagcctacgccacccagtttgaagtgattctccttcctcagcccctcaagtagctgggattacaggcaggcgccaacacacccagctaattatgtatttttggtagagatggggtttcactatgttggccaggctagtcttgaactcctgacctcaggtgatctgcccacctctgcctcgcagagtgctggaattacaggtgtaagccactacactcggctgctctctggtcttggtagagagcattggccaacagcttctgcacaaggttacaagggagatagtctccttgagatttggcatatctaaattgtcttttttttttttttcttttaccttcacacttactagtttggccaggtgtacagttctagtttgaaagtccttttccctcagaactttaaagagattgttcccttaagttccagctttttattaaaaaaaaaaaaatagagtttcccctcacttctctttaaaagtttttaggggcggggcgcgatggctcatgcctgtaatcacagcactcctgatcacaaggtcaggagattgagaccatcctggccaacatggtgaaaccctgtctgtactaaaaatacaaaaaattagccaggcgtggtggcgggcgcctgtatagtcccagctactcgggaggctgaggcgggagaatggcatgaacccgggaggtggagcttgcagtgagccgagatcgtgccactgcactccatcgagcctgggcaacagagcgagactccgtctcgggaaaaaaaaaaaaaaaactttttaggatttttctttttgtccaagtattctgattggtctttttgcattcatttttctgggcacacaatggccttctcaaactgggaacttaatgtttttcaattattggaacatttaaaaaattatatttagataactttccctcttttcattgaatttgcattttctaatgttggtggtccttctgggcaatcctctgattatcttacctttttctctcctattttctatgtcttggtctttttattccattttctggtggatttcctcagctttaccttacaaccattttactgaattaaaaaataacttttttttttttttttttttttttttttttgagacggagtctcactctgtcacccaggctggagtgcagtggcttgatctcggctcactgcagtctctgccttctgggttgaaggttgaagcaattctccagtctcagcctctcaagtagctgcgttacaggtgcccgccaccatgcccagctaatttttgtatttttagtagagacctggtttcaccatgttggccaggctggtctcaaactcctgacctcaggtgatccagccgcctcggcctcccaaagtgctgggattacaggcatgagccaccatgccattttcaagctaatatgtctcaatttttttttctttgaggcaggatcttatttgtaagccaggctggaatgcagtcttatgatcactgctcactgcagccttgacctcctgggcttaagcaatcatcccacctcagcctcccgagtagctgggactacaggtgcataccaccacgtccagctaatttattatttgttgtagagatagggtctcactatgtttcccaggctggtcttgaactcctggactcaagtgatcctcctgccttggcctcccagagtgctggggttacaggtgtgagccactgtgcctggcccatggctcagatttaaaagatgtaaaaggtgtatagtgaaaagccacccacttcctgtactagctaccatattctctctttacaggcaactggtattcctccttccagagataactctgttaatatatatatatatacacacacacacacacacacatatacacacacacacagacacacacacacatatatacactttttttttttttgagacggagtcttgctctgtcgccaggctggagtgcaatggcgccaccatgcccagctaatttttgtattttcagtagagatgggctttcaccatgttggccaggatggtgttgatctctcgacctcgtgatccacttgccttcgccttccaaagtgctgggattacaggtgtgagccaccgcgcccggcctcatacatatttttaaaatgtgtgtatatgatcatattctctctccctgtgaaatcacagatgataatagacttcatatattgttatgcatctttttttcatagaaccatgtgtcttcagactgctccatgtggaggtatgggtttctttttaaaatcattttaaagagcagcatagtatgattttaaactccatattttgtttaatcagtttcctattgatttgctacatccaacaatgctgcaaggggtaactttgtacgtgtattatgctcacacgtgatagtgccatgtgtgatgaatatggaattaccaggtgaatgcatatgtgcatttgtacttctcacagatgttactccagctgcctttcatggaagctgtgctaacttatgctctcacaggcaaggcatgaaagcacttgtttctttatatcgttgccagtacagtatgttatgacatttcttaatctttaccaatctgttaagtaaaaaatggtatctcatctgtttttaatttgcatttctcttaggagaatgagcatattttcataaatttataagagctgtttgtatttgtgtttctgcgaactgttcatatcctttgccattgggctgttaccaagttgtatgacattatacctaagggaaataagcccctcatgtgataagaattggagttgtttgcagtttgttcatcttttgattcgggttatattacatttttccatgttggtgaatttattagcagcttattttaaagtctttggatttaatatcatgaagagaaaaaggcgttccccatcttaaaattattatttttaaaatgtccagggtttcttttggtacttttgtagtttcaatatttttatatttaaattatttatccatattgaatttattttagtacatatggatccaagtttactttttttcccagatggctactggttttcccagtcatttattaatagtccattttccctctgactaaatcccccatgcctatgtgtctgtttcttgacttctgtttcttgacttctgttgtgttgctctgcctagctctgtgatgttgagctattcatgttttagttgtgacactattctaattgttaagaatatgtttgtattagggaggattgggcttgtattaaatattttattgttgatgttaattgtcagttttgtagtggtatttaaaaatgaattatgtggctgggagcggtggctcatgcctataatcctagcactttggaaggcccaggaaggtggagtgcttgagcccaggagttcaagaccagcctggacaatatgatgaaactctgtctctatgaaaaatacaaaattagccagacgtggtggggcatgcctgtagttccagctacttggcaggctgaggctgcagtgagtcatgattgtggcactgcactccatcgtgggtgacagagtgagacaacatctcaataaaataaaataattttaaaaaatgaattatgcaaactttaaaggaaactgatcatattttatgtaactcaaagaatgtttagggacctaggctggtaaaggtcagagttttctaactcaaggtttgcttccttttttttttaaatccctccaatgagggggaaacagatgctaaaacaatagtgagaagtacttaattggctgggtgtagtggttcatgcctataatcccaggactttgggaagcccatgcaggaggatcacttgaggccaggagtttgagaccagcctgggcaacaaagcaagaaccttccctctataaaaaatacccagatgtggtggtgcgtgcctatagtcccagctactgaggagactgaggtgcgagggttgcttaaacccaggaggtggaggctgcagtgagctgtaattgtacccctacactccatcctgggtgacagagtgagaccctgtctcaaaaaagtaaaaataaagtagtacttaatttgggatcaagatcggcttacaaatcagaacattcaggcttgaggaagagaaaaagcaattaaataggtcaacaattgcaaagcaaaactcaatttgagagttggataaagagatttgattgtggggactctgtcatttgagatgcaactcttggtccagtctcaggtgatgaaaatacagcatcagtagttaactggagtacagcagcattggtgcctttctttctgtgaaaaaagtctttatttgcctaagatgtagaaaagagactgtagtgaaccagagaccattttattctgaactgtggcagaataaaacgccttctggcgtctgtcctcactgttactctgaaatagcccatatatcgggaaaaaatgtggctgcttctgtgtgtgtgtgttgtgtgtgtgtgggccagattgttgttgtgttacattgtgataccaagagagaagagaacttttgtctagatgctcacctgagacatccacctggcctccaagcagcatgcacatgagtgaggaatttcaacaacttgtttttttcctgtaagataataagtgtaaaacattcattggacatgagcacaaacacagaggcgttatagactagactgtaaaatcgtctgtgggccactctgagcccctgtggtcagtcctttccttggatgactctaaaggggacttgggccccacttaggcataacggtgaacagagatttaaaaggagtttgagagcattcgtgtacagagatttaaaaggagtttgagagcatttgtctttttttttttttttttttttgagacagagtttcactcttgttgcccaggctggagtgcagtggcaccatctcggctcaccgcaacctctgtctcactggttcaagcgattctcctgcctcaagcactttttttttttttttttttttttttaccatttcaatcattttgagtgtatagttcattgatgttaagtatgtttacattgttgtgccaccatcatcaccatccatctccagaactctttcatcttcctaaatagaaactctgcacccattcaacccttaactccccatttccctccactccctccagcccctggtaacaaccattctacgttctaactgttttatttttaaatttagacatatagttgatactcagaagcttaacattccttatatgaaagtcttcaccaagctacttggcgtgagcatcttatttgccctttaagccttaccctgggaataaaatatagcctttatcactgtttttggaatatcttggaagtgcgtaaaactgcttcagtttattatgtagaagtgcatttccagatttctggagtgtggatcgaagattttcataccagcagtagggtctcaaccttgtttttcttatctcttggcaagaaagcaaagctggccattggggtataataaaccttgtgtacacagctgcaggagggaacagggaggtggctgtgcttggaggccgggtgttttgccgacgataatggggcatctctggcaccatgttgctggtcggaacagttttggagttggattttgtcctgcagtgatgtctttgaagaggaaagcacttttgaatatttgcattgctttgaagccagtgccatggagatattgtgacttattgccagtcagaggcaaagctgagtgtgtgaggttttgaacaaaggttgttgaaaaaaggagataatcattaattttttcagtaaaattcattgaaccccaagggcaatttggaggggtcatagctgtttttagaatctgttgctaatcactgtatatcgtagatattaagcctaggttaagagcattagtgtgggtacagagtttagatttgccagtttgtgactttaggcatgtttaacctttctaagtctgtttttccatctgaagaatggacatagagaaaatttatcactgggctttttgtgggggacagatgaggtaaggcataatgcatttaaagtggcaggcacagtctaaatactacctagtgctcctgcacaggcatagaaaatggaaaattgtttatatattttaccctcctccaaaacactcttagaccatctgatttttatttgacttatctgaatcctgaatagtttttactggatcatactctggtatctggactgtccctggtttgaaggtggtgctgctgggtgagaagccaaggatgagagaggctgtgttttggaggcccagtctgtcaaaactgaggtggcatttctagttcctgatagagtgagacagatgcaaaggtcatgggagctttgaacagtttctatgcattatgtgttgtttttcatcttctggaagtgggctggaatttgttttcagcagctaagttcattatgtagttgcctctaagccatgcctccccttttccatgtttgtgaaaagcaaaacaaaaccaccaggcacattatcttttacgaggacctggagattgactagctgacacccccagatttcacatttatgttgagataaggagaataatgtaagtcacccagactttttgtcattctgcatttttattcacagggatgaacagaagcttgcagattgggagaaaggggggggcagaaccagttgttttcaggtggacccaaataatgcatctgctttgataactgcctatctcgatttgcttggaaagggcatagagtaataaatagtttgtgggagtgtgaagaatgagcctttagactgacccaacttgtggaaattcagaaaatgcagaaatgtacgttcttccagcttgtgaatgttgaacaatggaattgttagaagaacttttgaaacttgttctttttttgaaagtattattgtgctcggttggctacatgtgctttggtctcaaaaatttgtgccttaatcacattgctggggaggctgtggatttcactatcaacagaaagtaatgtaagatgtgatatcttttcagcaggacctaaggagattttctcgaaagaaaaggggaaaatgccgctcttaagcaaaaaatctggaccatgttggcagacatacgtctttgaaacataccagcagagaattatttaatcatttgccccttagttttatcttgatcactcctagcgtgattttttccccctcttagttatgcagcagcctactggctgacatttaactattgattgttcatcctggggaatgaattactgtgatttatagtcaagggtacagatgtaaagagacagaaaggatcagatgtttctagtgccttttttcttcctctgatggcttctcccagaaacttgataaaagcaccaacactaaaacatgtttacaataagaaagctgtttattcatcttaagtagaaaattctataagtttatgtaaaattttgcccatgtgggaacaattagtcttttaatttgagttgtgtattgtaattccatggatggagatgggtggaggttgggccgaggggaagctgaggtaagaagccagaccagagaatttaaaatgatgtctttctttgaggatgccccctttgcccctcctgctgggcctcgcagccgtgggattggccacatcacttcctgtccaagttggcactgagagtggcacagtaactctgcccagtgttctcagactgcagtgggcaagtttccagcaatagagtcacccaaagaaacaacgcagcctcctttttttctttctctgttgcctagggcagttttcctcagacctcagtacctatgtcccttgcttttggaataaccccattaggtccccaaaccttgcctttgatgtatgtggcttcttgaggatcccctacatttgcatctgtttccttcccttatgcaaaggccctacgtcttccctgggagaagagtcctcgggggctttcctgtgggagaaaggaaggatctattcctgcccacacttctttctctccagatagagaaatagctcacatttttggtgcctactctgtactgggcactgtactgtgagttttcatgtgtgacctcacaggtactatgatcatctccaagtgacgttcagagaggtggtctgccccaggtcacagggctaaaattagtaacatgtaaggaaaatggctttactctcagcgtgagatgaaacagacaatacagtacacctgctgagtgacagagttgtccctgagttgttagggcctttgcccgccttggagctccacttgcttggtgcacagtaggcagcaaatgggctgtagaatcatggtatttgtgatttcctgtgtccttgacagttgagatattctctaaggctatttatgttctctctaccatgctcgtcacaagcagtcttctgggtcctcacaagcagtctttattgtttatatttctattaacaggtctgttcaaggcaacgtaaacctttcctaccatgttcctcaaaattcttccaagctccttcactacccaattccaaaaccacttccacattttttggtatttgttataacagcaccccacttccaggtactaaagtcttttagttttctattcctgctgtaataaaacccacaaatttcatgcttaaaacagcacgtgtggggcgcggtggctcacatctgtaatcccagcacttcaggaggctgaggtgggcggatcacttgaggtcaggagttaaagaccatcctggttaacatggtgaaactctgtctctactaaaaaatataaaaaaaatagccagacatggtggcgggcacctgtaatcccagctactcgggaagctgaggcaagagaatcacttgaaacccaggaggcagagtttgcagtgagctgagattatgccactgcactccaacttgggcaacagagcgagactgtctgagaaaaaaaatacacaaaagcacacatttttttatattacagttgtgtagatcagaagttggacacaggtctcactggaataaaatcaagaagtcagcaggaccagttccttctgaaggttttggggagaatctgtttccttactgctgcagcttctagaggttgcctgtattccttggcttgtgacccgtttcttcatcttcaaagccaccactggcaaatttagtcccttttacgcctgacatttcttctggctcctcttatgtgatcccatctttctgtctctgaccacagaaataaaagactttttaaaaagactcattagattgggtccatctagataatccaggaaaatctctccatcccaaagtccttaatcttaatgccgtctgcacaatgacttttgccatgaatgtaacatagtcacaggtttgggaattagaagttgggcacctttggggggcgcatttttctgcctgccacacatgataaggtgtagacacaatacagttaactctcttagttcgcagtcggcacccctttaagtaaagtgtgtggtttctaatcaagcattttattcagggtgcatctgttccacctggctggcagcacgcaccttgcaggtcaggtgtgagatgagcaagacccattggaagactggaagctacctccttctctcttttaggacaaggaagcgagagagaagcgaggagaccacttgagttgtgactctcctgcttatggtgaaattaagaactaaaactaaaacaacaggaaccctttcataacggaaatactgaagtataaaatgaaaccacctcctaaacaactctttttcctttgaaaacaaagctaagctgcgttgatgcttgcacctctgctcttgcgtgggaaaattggacccctctgtgacatttggtatgttactgagcagggttcccttggggaggacgagaagcctcctctccacttgacacttggaatttgataccagttcctgtctgacagctggttagcctgtcaggccctcacaagttaaatcttgtctcagaaaataatttgctagaagatcaaagcatggatgggataaattaatttttcaacaagccacaggtttgggataattgtctctcaagtgttgctaatgtctttgataaacaagtaatttgggggggctctttttttctcttgagattataaatcttgattgattcatatgttgaaaaagaactctgaaagcttgcacctaagatgaagccctggaataacctgaaataataataataggtatatttcaacacctgtgccattcggagcagtgattctcaacaggtgggggtgggagatcgatttttgccccccaggggcatttggcagtgtttggagacatttttggttgccatgattttggggaggggtgctactggcatctagggagtagaggccagagatgcccagaatagcccacaacaaagagttatagaatgtcagtagtgctgaggtggagaactcttgattgagaaaggagtgttttctattttacttattttcgtgtgtcttaacactattcctggatttaatttctttgaggatagggtccatccttttattttctcactcaacacaacaagttgccctgagtaggctcaaacatttatttactgttgattcccctctctcttgttaagctattcatccttttttttttctgtcttggagcagagctattgagggcagcactgaaaagcagatggtagagctgtggcagaatcaacatggttgggagagcggaaagaacacaagctctggacttctctcagccccttctttctcgtctgtaaaaaaaaaaaagttaataatagtgcccaacttaggatgattgtacttgagaaagatcgtgttgcaaaaaatggggatgtagtaagtgctcagtaatgccttctcaggcagctgagcaggagactgtgtgcaaggccctctatctcagggccctgtttttttgtaaaaagttgagtaaaggaggggcagacatcttacacatttcagaattgttatcagttctccaggaagaagagggaaagaaaaacatttatagcatttcagtaaagattactccatgattgacaaaacaattttgaggatcctaagaggcacattctgcctcaggctggagcagtttttaaaactaaattgacagcaactagttcaagttggaacagtcctaacttaattatagatacctgcagaggttccttcaaacaggtgggtttcaacagcgtggtgctatctagcaaaagctattgtttgcttagttatttgtttgagagtcagcttagaacataaggaaggagtcagagttggggtggaattctgtctctgattggatcagagcctccattttcctaattgtaatatggaaataatgattgtccctcagaggatggttataagggacaacatatttgttacacatttggcatagtaagtacttcataaatgacacctataaaagtttttgtttgaaaattttccagcttttgttttttatttatttattttttgagacagtctcactgtgttgcccaggctggagtacagtgacacaatctcagctcactgcagcctccacctcctgggttcaagcaattctcctgcctcagcctcccgagtagctgggattacaggcatgagccaccacacctggctaatatttatatttttggtagcgacgggatttcaccatgttggcccagctggtcttgaactcctggcctcaagtgatccacctgcctcggcctccctaagtgctgggattataggcatgagccatcatgcctggctgaaaactttccagtttttaaatgtcatgcatgtttttgctcaagaacgctttggctgtttggggcattttgtagttccatacaatatttttttccgctgtaaaaaattacattggaattttaataggaatagtattaaatctgtaggtcacttcggggagtatgaacagttttaacagtgttaattcttccaacccatgaatacaggatatctttccatttatttatgtcttcagtttcttttagcaatgttttatagttttcagcatacagatctttcacctccttggttaaatttattactaagtatttcattctttcttttttttgagacagggtctcactctgtcacctgagctagagtgcagtggtgcgatcacagcttactgcagcattgaactcctgggctcaagtgatcctcttgcctcagcctcccaagtaactgtgactgcaggtgtgtaccaccatgcctggctgatttttaaatttttttgtagagacatctctgcgttacccaggctggtcttgaactcctggactcaagcagtccttctgccttggcttcccaaagtgctaggattacaggtgtgaaccattgcacacggccttattctctcttgatgctattgtaaatgaaatcattttctttattttttagatagttcattattagtatatataatagaagtgctactgatttttatatgttgattttagtatcctacaacttcactgagtttattctaacaatcttttggtgaagttctgaaggttttctatatataagattatatcatctgcaaacagagacagagtaacttcttgctttccatttttgatgtattttatttttcttgcctaatagctctggctaaaacttctagtactatattgaatagaagtggttaagagtgggcatcctgttttgctcctgatcttagaggaaaggctttcagctttttaccactgagtatgatattagctacgggcatgccgtatgtggcctttattatgtcgaggtccattctttatacctaatctgttgagagtttttatcatgaaaggatgttgaattctttcaaatgatttttatacatctattgagatgatcccttgatttttatcctcgattttgttaacgtggtattagttaattttaattaatttgcatatgttgaaccatctttgcatcccagggataaatcccatttgttcatggtgtatgatccttttaatgtgcttttgaatttggtttgctggtattatattgaggatttttgcttctctagtcatcaaggacattgacccataattttattttcttgtagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggtttgtgatttctgattcaatctccttacttactattggtctcttcagattttctatttctgtattattcagccttggtgtaagttgtatgtttctaggaatttatccatttgttctaggttatctaattggttggcatatatttgtctatagtagtatcttatataatcctttgtatttttgtggtatcaattgtaatgtctcatctttcatgtataattttgtcttttagttcagctaaaggtttgtcagttttatcttttcaaaaactcctggtttcattaatgttcatttttttccttctgctgactttgggctgttccttttctaattccttgaggtgtaaagttaagtgtatttgagctctttcttccttaatataggagttgattgctgtaaacttccttgtagtgctgcttttgctgcatctcttaagttttggtttgttgaaaaacgaaaaaaaaacacaaaaaaacagagagctggaggcatcatgctacttgacttcaaaatatactaaaaagctgtcatcaaaacagcatagtagtggtgtagaaacagacatatagaccaatggaacagaatagagaccccagaaataattcatatttacagtcggttggctctttgacaaagttgccaagaacacacaatggggaaaagagagtcttttcaataaatggtgttggaaaaactgggcatccacatacagaaaaattaaacccctttctcacaccatatacaaaaatcaactcaaaatggactaaagattgggggcatggctcaggggtagaggatttgactgcaaaatggactaaagacttagtaagatccaaaagtataaaactacttgaagaacacacagagaaaaagcttcttgacattagcctgggcaatgatgttttggatatgacctcaaaagtatcacagaagcaaacatagacaaatgggattgtgttaaactaaaaaaaaaattctgcatagaaaaggaaacaaacaatagaatgaagagatggcctgtagaatgggataaaatggttgcagaccatacatctgataaggggttaatatataaaatatacaaggaacccatacaactcaatagcaagaaaataaataaccggattaaaaaaatgaacaggccgggcgcggtggctcacgcctgtaatcccagcactttgggaggtcgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaatgaacagaggaccttaatagaaatttctcaatagaagacatacagatgaccaacagatacatgaaaagtgctcaatatcactaatcagggaaatgcaaattaaaaccacagtgagtggccagatgcagtggctcatgcctgtaaatcccagcactttgggaggccgaggcaggcagatcacttgaggtcaggagttcaagactggcctagccacatggcaaaacctcgtctctactaaaaaatacaaaaccacagtgaggtatcatctcacatctactagaatggatattatcaaaggcaaaaggtaacaagtgtgttgggaaaatgtgagataaagggaccctcttagactgttgatgagaatgttagtacaaccaatatggaaaatagtatgagtatggaagttctgcagaaaataaaaactgaacttccatatgatccagcaatcctacttctgggtatacatccaaaggaattgaaatcaaagagatacctgtacttctgtgtccctcgcagcatgattcacaatagtcaagttatggagacagtggaagtgttcatcagtagatgaatgggtaaagaaaatgtggtatatgtgtacactggaatactcttcacccttacaaaagaagaaatcctgtcatttgcagcaatatagatgaacctattcataaatgaaatagccaggcacagaaagacagatactgcattttctcacttatatgtggtatccaagaaagtcaaactctcacagaagctgagagcggagtggtggttgtcaggggctgggagatgagcggtgcttgggagggcgttggttaaaggtaaaaagtttcagttaagttaaatatgttctggagatctattgtacagtgtggtgactgtagttaatgtatacttggaaattactaagagattagctctcaaatgttctcaccacaaataagtgcgaggtgggtatgttaattagctagatttaatttcacgaggtctatgtacatcaaaccatgtatattgtaaatatatacaatttttattttttaattataaccttaataaaagtgggaggaaaagtgataaacggtaataagcccttaaaggtaataagttaacttgtcacccaacgtatttattaatttttctatacaatgtaatgtgcttggagaacattgaggccgggcacggtggctcatgcttgtaatctcagcactttgggaggccaaggtgggcggatcacttgaggacaggagtttgagaccagcctggccaacatggtgaaaccccatgtctattaaaactacaaaaaaaaatagctgtgcatggtaacgggcgcttgttatcccagctactcgggaggctgaggcaggagaattgcttgaacccaggaagtggaggttgcagtgaatcaagatcacaccattgcactccagcctgggcaacaagagtgaaactctgtctcaaaaaaaaaaaaaaaaaaaattgaaaatccgcaagcttcagaagacacactactgcgtgtttgtccttctacggaagtcagtacagatctcaatgacttgttctcatttcaccagaaaatgaccattgtgcattatgctgtcagtgcagatggaaaactagcagcagtttacaaagtttccacttgaaaaaacataactctaattgatttaaaaaagtagttgattgttgcaagacttgacatttctctagttaatttctatgcctgttgttttgccccttaccgtcttcaaaatctgaatccaaatccagggcttctctattaggaggctccatatcatatctctttaatcctgataatttctcagttttttgtttcctacctacctggctattttcttacgctatctttatttgcttagtaaatataacatttcatgttctattttattttattttattttattattttattttttatttttgagacaatgttctgttgcccaggctggagtgcagtggcatgaccatggctcactgcaacctccatctcctaggctcaagtgatcttcccacctcagcctcctgagtagctgggaccacaggtgtgcaccaccatacccggctaatttttttattttttgtagagacagggttttgccatgttgcccagactggtctcgaactcctggaatcaagcaagccaccccccacttggcctcccgaagtgctaggagtacaggcaagagccactgcacctggccctgttaacttcttatgtcatttccccactttaatatatttgagggctagttctgtgtcatgtatgtattttaacatcactaccgcatctggtgcagagaggggcattctgtagtcttcgtacttcttatcttcactattgctgatgagccataacaaatttgagatgagcaattaatagatggaccggccaacaaacactatgtggaggaataagtgaggccaaagctgatggatgatgcaaagtgaggacgtaacatatttcgctggggaaccagacagatatgcagagtaagcgctctgataggggaagtacgggctgttatgggcgcttcatactgggaacattaatgggaggtggaggtcgtagttgaagctgaaacctgttgggtgaggtggagttcgccaggtgaagtggtagacttggggaagaggagaggagggggagcatcctgtgtttagaaccaaagagagtttagtgtgtgattattgggtgggggtgggagggtaggtcataaagggcctggtaaactgttaagaaattttaaactttatctcaagagttgtgggaaatcactggcaagttttaagttggtaggtgaagtgctggctggaggaatccctccagcttgggtatgtgaggatggcctgagaacggaggcacctgcagtaatcccccagtgagagacactgtagcctgagctgaccttggggctagaaaaaggggacaaatggcggctgaggaggagaatctctgtgagttgattgaatggggagaggcaaacatcaagcccagtgcccagacttctgggaggatctggctgctactcagtatggcggttgaggaggagaatctctgtgagttgattgaatggggagaggcaaacatcaagcccagtgcccagacttctgggaggatctggctgctactcagtgaaaggaagcctgggaggtttgggagggcagatggatgagctcatttatggacagattgagttcaagcatctacagatcattgaaggggaaatgtgagcttgaaccctgcatttgaagttcagaaaagagaaagagcagaatgaattgagttctgggagtctttcccatgtggatagtaactgcagcggatgaggtgataagatcacctagttagaggtgggggagcagaagagggcttagggcagaactctgaagagcaacctgcaaaggagactgaggaggaatggacagaaagggtggaggaaatcttcatgggtgcttttcaaggaggcagtggttaccagcattagctcctgcagagccaagagaattgagtcattttgctgggcttagcaacaagaactttcagggacttcatggcagcgtgacagcatatggagatgcagtactgttggcctgtacagagcctttttttttttttttttttttttttttaaattccctgagatgtagtctcgctgctctgtcgcccaggatggagcgcagtgactcgatctcggctcactgcaacctctgcctcacgggttcaggtgattcttctgcctcagcctcccaagtagctgggattacaggcatgcaccaccatgcccggctaatttttttgtatttttagtagagacagggttttgctatgttggccaggctggtctcgaactcctgacctcaagtgatccacccgccttggcctccaaagtgctgggattacaggtgtgagccaccacaccctgccagtacagagcctttgaagacattagaaaatgtgtgcctttctggatggacacagtccctggcttggtgagtggaccgtgcatgggacttcagctcttatgtgccaccttagctgggtgcacttgtttagtgtgcagaatacaccttccatgcgtggtggcctaggatatatctgcacttctcaatcgaaggcaatgttgcctcccagggaatatttggcaatatccgaagaaatttatgattgttatagctgaatcagagagggtaggtgctactgtcatctagtgtgtaaaggccagagatgctgctaaacactctgcagtgtccaggacaacccctgacaacaaagaattatccagccccaaacaccagttgtgctgagaaacgctggtgtctgtgaccctttcaggctcatgggaaaaggcggtcagagagggtgatagctggaggtgggtggacctgagaacaggctccttacatactttgctgcagtctcatttgcttgtggcagttttcaccttgcctctcctacctctctaccatagaactcttactcatcatgttataggttttcatttgtttattcttatgtagccattttcactattccctctcccacccccactcccccaagcagtaaattctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagcagctctcccagcattttgggaacaaatcaggtcattatctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattcacagaactgtctcggaaagccctgggtaagtttgaagagcaaagttgccttttctgttttcagaaatattttaccccgcaacgatgtgtaaatctaaagcctgtgcaagaatgaaaacgagcttgagtattaagatttggcacagtgtgtgcaagcaatgagactgggttaaaaacaggaagtgtcttaatttaaagatggtgatggggagacggattaaaataaactgctggccatgttgaatctgagataggcaagccttggttgtgggcacattcccttctgaattactctatgcagatatattttaggcctctttctattaaattgtctttcacatggtttcaaagatagggctagtgataagaattctcttcctgcatggtgggtaccattatataaacggtatgagcatgcttttcttgtgtctctgtataactgcttggtctggcactccacaaaatagtaaaacacatttctgcagtggactagcccatgctgtgaaagaggaaggtggtggtggacaaaaagtggtaagttttaggctgaaggatgttgatgttaaactttatttctgattatggcagtctttcatcatgtaatttaagaagcctgagatcatctgacttttttttatgttttttttctttaggactgcaggaagtgttgataaacatctgtttaagttgtctataccatgaaatccataatcttccttcataactatgatagcatatggttttctatagttaggaaaactatttctcatgtatttcatggtttggccaaatccttttattacattagtactaaaaaattccttaggatttctagagaaaataatatgtattatggataaataagggaaagtaagataattcttaaaccttagtatcagcagtcattctaaaccacattacacatcttcagtaaaagtggttacaaaagatttttctcacttcaaaagatccgccagggaagagtcccagctttttcttggtgttattttaggtattaactcaggagggcttcctgaaggtttgtcagtgagatagttggggggttcctgagctttttattgttgtacgtgaacttggtacttacttctttggcttttaaactctcagcagcacgtacagatgccctcacatgctttctgggatgactttaacgctaaatagcaggggtgtttctcaagaatgtttaagaaaagaaagcagacatttgtttgcacaaacagatatttgtgacttctgtgaaaaaattccaatagttgtaatataggaaatttttataaacaaacacccctaccaactaacccatcgtgtatttttatgtgtgtatagaaaaaatgaaaggatatactaaaatgttaattgcatagtttctctgggaattgaatttaattaaaatttttttatcaagatttttaaagttttataatgaccacgttatgtttatgtaataaaaataaaatagaggctaggcacagtggctcacacctgtaatcccagcactttgggaggctgagatgggaggattgcttgagtccaggagttcgagaccagcctgggcagcatagtaacaccctatctttatttttaaaaaataaaataagagagggggacaataaatgcaaatatataaatgacagaaattttatggtctggtcaaagaactatcattgcatgaaattatagatatggtcatgtaaggttaccttttttcattataattccaccaataattctaaagtttcttttctttttttttttctacttcttccacagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggaggacagttttttccttccttttcctattctggctccaacagctgtctcaacacagcccgagatggggagcagcctggcttccaccggcaatagctgtattgtgggagtgtgaaagagaagccaccttttcctccctctgcccaagccacctggcccctttgtcctttctcctcctcgtcctctgaggtatgagtggctgtgactgtatgacataggaactatgaagcggggtgaggggacggtttggtgcgtaaatcctcacgcaggtggcggttattgtctgtgtggaggaaataagcccggttcttcctgggactgctttcatttccctctagcttccagagggtaaaatgaaccttaatggaggttggggggtggcacgcacaaagtcctgggttgagggggcagtggtcagaaagttccctagggtaatatacaaaggagaattaacactggggacactgaggtgggttttggtcctttccacataactgacacctttcaaagcaaggacttgctttctcgtgaggaatgtcagcagtcgcaacaccactgggttggatgcaggataattattcagaatcacgagttacctgtttgcaagcaatcacattgcaggtgggataaataagcagacagtctgtggtaggttcccccaccccaaccgcctcccctccccccagggatactgtaattttaagtattgttttggatattggtaattctaaagctccaatcttaactgggttttatgaaagccgttatagggtgtttattaccaaaaaaacctccttcttatttaataatacagtgcctagccactcctttttccctgcatccgtacatgaagcctgattgcagatctcgaacagtatatttctttgagctaaacagcaagaacagataaggtatcttatcaaaacaccacgccaggtggcgtggctcacagctataatcccagcaatttgggaagctgaggtgggaggattggttgaggtcaggagtttgaggccgcaatgagttatcgcgccactgcactccagcctcagcaacagagggagaccctgtctctaataaaacaaaaacattacaccattgtcagaaagtgatttgttcttctttgttggattaaattctctcacgtgcaaggtagtggccagcagcctaagaagatacacaagctcttcactgtagatgtttggcggtgtgggagttacaaggttaattatgagcgtaaggcccaggcatcttttcttcctaacaatttcatttcatcctatttctttttccattctttctccgaactgtctatactttattaaagtcttctttttcccagactccagaataatttcctgtgatatgttttagcagtttctccaggaaaaggctccaggagtctttaaatccagccctctttctgctgtatctttgtgcctcacatcttgagagaagttgagtggtagaaagtaaaggaaagcagaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtttcataccagagtcaatctactagtttgcttggttttataggcgtgattcccaaattttgaatctgaagttagctgtcagtttaaattcagagggtccgcagttgtttttcaggtttttcttgattctgcctttggaaaccaggaagatgttgaatttacttttcatctgacaatattgcacatctgtgaacccaactgatctgaaagtgtttacctcttaactctgtgaagttagctggttattctggatggctgggacaatggtgaggaccgtttataatggttactctcacctgtgctccagacgctccacttggtgctagaaatacagcagtgaacagacatggttcttgcctccacacagcttgcagtttagtagggcagactgacgacattaaaaagataccatcggtgttgttataatggtgataagagttacaaaataaggggccaggtgcagtgtctcacacctgtaatcccagcactttgagaggccaaggcaggaggattgcttgagcccaggagttggagaccaccctgggcaacatagtaagaccttgtttctacaaaaaaaaaaaaaaatcaaaaattagctgggtgtgttgatgtgcacctgtggtcccagctactcaggaggctgagttgggaggatcacttgagctcagaaggtcaaggctgcaacgagctatgatcgcaccactgtattccagcctgggtaagtgagaccctgtctcaaaaaaacaaaaataaagggagcatgtaacagtaggatctaatctagcctaggcaagtacggcattcttgagaagtgacttaagacctgaaggactgatcgaattgtctgtgtgaagattggcagcgggtgctctgagggggaaaagcggaaatagcatatgcagacaccctgaggtagaaagggagctctggcctgcttgtgtgattactgtgggagaatgaacaggaagaagacgaaagtagaagcaagaagaccaattaggaggttccaaggacctgcctaactaaggtcagttagccggtgattgcccaagccaagactcaaactcatttttatgaaggccgcacaccctcatctcctcagcagttgttaaacaatatttgataatggtgttcatgtcaacctggcacatgtctagaagattcttaagtgactttttcttttcacatggctttttgaccttttaaatataatatgttttaatatgacgttattagctgcacaaaggaagggaactgctcatttgaatgaaccagaagaaacttggaattttgcctgccttctgcttcagccctgccaaaatgtaatttctttaattcatcaaatcacattcttgactaatctgctcaagtctgtactatgccttggcctttttccctgtgacaatttagggatctttaaagaaaatattttgaaatgttttctcttgatcagggtgcttgtggttaggtattgcatacactgcttttatttgcagaatgagctatttttctaccatgtgatcctttgttagaaatgaacatgattgtggctggccgcagtggctcacgcctgtaatcctaggactttgggaagccaaggcaagaggatagcttgagcccaggagtttgagaccagcctgggcaacatagcgagaccccttctctacaaaaaaattagaaaattatccaggcctggtggcacacacctgtaatcccagctacttgggaggctgaggtggcaggatcgcttgagcctaggaggttgaggctgcagtgagccatgattgtgttactgcactccagcctgggtgacagacagcgagaccctgtctcaaaaagaatgcaattgtaattttgtcacctttatttaaaaaaatcatttatcaggtggttgcaatgaaaagcaatttagttgtttacaacctctaccttccagggacttaagtgtgttcagaagtatttaaaatgaaataattatcttagctaataatgataaaattactgtggagcattgagggctactttgtgccaggcaatcagctttaaacacctttgattttctccctatgatgaggggtatactgtgatttttattaaacatttggggaaactgaggcttaaagtggctgagttttctaagagcacgcaggtggaaagtgatcaagctgagtcctcagcttcatatcttctcagggtccttgatcttccgcaccctgtagttctggttcattttaggcaattatcagaagtcacctcaaatgccaagaacctgtgtaacacaggggatgaagtaaatgtgagcaatgtaatgaagcgtttccttataaactgttgtaaggattttgttccagagatgaagtatgagaaaaatataagccaattgttcagtttcatattagtcaccctcttctactgaactttggtaaattcaaagcttccctctatacgaatttacttttataggaatattacaaaatctatactaagaaatattagaaaataacctgtacttaataggtttaatggaaattaaacccaaatataatggaaatctgaatgaatgctcatttaaaaaaatataatttatagcagtggttctcaaactttagcgtgcatttgggtcctctggagcattatgttaaaacacagatagctgggctccaaccccagaccttctgattcaggagttctgggactggcgtacaaatgtacatttttgacaagttaccagctgtatgagggttctccaaagagacagcataggtatattaggaaggagattcattataggaattggctcatgtgattacgaaggccaggaagtcccaggatgttccccaagaagtctcaagatctgccatctgcaaactagagaacaagaaggccattggtgtaattcagtctgagtctgagggctgagaacctgggagcacctggcgtaagtttccatctccatctgagtctgaagatccaagaaccaggtgcgctgatgtctgagggcaggaaaagatagaagttccagctcaagcagagagcaagtatttgcctttcctctccctttttgttctattctggccctcactgattggatgacacccatccacactgatgagcatccatgttggcggtcttaacccttttcccacttagaaaaaaagtgcggtttgtggccagtgcttatttaattttacataaacaggctgttggaggctaaagcaaatcggactgattttcagtgtgaaaataaaatagaaaatattatttctaaacagaactaacatcacaaccatctgaattatcagaatcatctatttcagaaaaatcggattcatcaaatgaatcttccatcaactgttagagaacgatgttaacatcactcataggaatgctatgttttctaggatttgacattttcagcaattgagaattactatattttgtaaatggaaatgccactactaaaaacagaatcctataaataggatgatgtcttttgtttccaaagtcgatatactagaacgatgtgaaaatttaaaaaacgagatctttcgtggcaaggttatcttggggtaaacactgcagctgcaagcaccatgggcaagtattctcagggcaaacaggaagagagttagtgaagtctactaattcaaatgctgatctcttcttggcacacccagaagtaatgttttaccggctgcctgggcatccgtttgcccagtcaagttggcacgtgaaattaacctgcataccaggtaatgtttctgctgctggcctagcgaccacactttgagaacaactaataagtcataagacagtagaacccctggatagtaataagtgctcgtgaaatgagctggccagtagctaatccctgagaaagccatttcctagtcttataccacgtcagtaatccaaagcaggatggcgatctgaagtcctgaagagtcaagggtgatacgatgactctatggagccatcaccactattgggaagacagtggggacacctgcctcccctaccttccacaccatgtacatgatggcacgtgacttagatgtgcaaactgtgcagtgtcagctttgtgatgataaactcttccactcagtctgctatgtatatggcatagtcactatactgctaaattaaataaatcaaatgagtgaacataaatcaggattcagataccaattaggtaaaatactatagtttgtatatgatggggattatcctttttctggaatgtttcagcatccaacctttgctgcgtttgtcttcttgcagtgactgagaattagctgaaataactgtaaaagcgtaagattcccatttggctggagatgaaatcacagaggttggtttactaagccttaagaaattcctttagatttgatgtgtccagacttgtactggaatatgaaatattcaatttgacaagatctgtgagttcctagtacatacgtgtttttagaaatgtgtttctcaaaatacaattaggaaaaaatccctttgaaatgctaaaactacctttagtggtgataaagatgccgacaaccccttctgtttaaataaaaacaaacaacttttaaccttcatgatgttataataacatcattaacttgtgtagacaaacatcagtgctcacatttaaagtaatcattaaacattttcagagttatacttaaaatgactttttaatcatactataaaatactgctgcaaagttgttggtggggtactaagttgtagttcttatttcttctttctctacagtctgttttggctctaccttggggggaaaatacccaaagaattgtaactgaatacagaagcattttaaaaaatcttattttaaagaggaggagaaattttagagctatttctgataataaacctcaaaaagtgagaagtattagaatttatcttggttaattttctttttttaattaacgagcatgcattgcttatataaaacttttctctgtatgtgtctgtatctgatgcagttagaagttcaatgtgagtttagtgattcccagggaagacttagggaaccttggtttctgagttgtgctctcctctgactacgtggtgagtcttagtctctggagtcagccagatccagatcttagtctcatggagttagccatgatcattttaaacttataattattaaagtgctatgatgtacaaaggtgcttatgaaactaaaatttgaggaattagatacaatgactatgcggttttgctttttagtaactgtttctcattacttcattgatccaaagtgagatttttaaagctaaagtccttgttccattaagataattctgtcatttgtccagttactctccttactcaaattgctagcccctttggtacttttctctctagctcttgccctgcttcatgatgttcctgaatagttttagttttctttgtttatttttccactttcttgggccagacctccaatttaattcttttagttgaatgagctgctttctcgcttgttacagactcacttagggctcattcctccctgccttagtcccagtatggtctcagtaatgacatgcagtatggggactttggactcctgtttgaacaaaccagctttgagatgataaaaatttgaatatgaattgagttcttgaagataagaaattgttaattttgttaggtttgttaatggcatggtagttactctaaaaacaaatttctgggcgagtgtagtggctcatgcctgcaatcctagtactttgagaggccaaggcaggaggatcacatgagcctgagaggttgagcctgcagtgagatgaaattgcgccagtgcacttcagcctgtgtgacagagcaagaccatgtctcaaaaggaaaaaaaaaaaaaaaaaaaatttattcattagttataaatgcacactgatgttcttataagtgaaaagatatattgttttggttttgctttaagattccagcaaatataaaacagaaaaagagggaatatattaaaaaggctggcaaaatatgtatcattgttgaagcttagtgatgggtgcattgtattcaatatagtattctcttttgtgtatatttgaagtttttcatgatagaaggtttaaaaatttagaacaaaaatgaatgtggaggttcaggatcctaccagatgtttctaaatgaactttaagtgacaatggggaaaaatgtccatatcatcctggagtttaaggcagggaattcttggtagggggctattgaaaaatagccaaactgttagtcaaaaatgtacatatgatctcatggccacagatagtaatgtagaagacagatcacgaaagtactaatccttgggtgaggaagaacaggagaaggcagcccaagaacttaactgaggccccaagaactaaggaaatctgttttgtaaaaggacctgtacggccaggtgtggtggctgacacctgtaatcccagcactttgggaggctgaggtgggaggactgtgtgagcccagaagtttgaggccagcctgggctggtttaattaaattagctgggcatggtggcacacgcctgtggtctcagcgacttgggcggctgaggtagaaggattgtttgagcctgggtggttgaggctacagtgagctatgatcgcgccactgcattccatcctgggtgacagagcaagactctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcattaaggaggagcatagcaaagaagtctagacctatgacttggagctgttctgttatataaataggatatccagagatagcaaactgctcactgcaggaaataggggaaatagaggataatttggaagaacaccccactgttattatttgtggcagttatgttctataaagtcgctgtggacataattagtgaatactgagccattgctcctaggggaacaatacagagttagattcctgtgagcctctggttataacgattttgtcagctgtcaaccgatcaatacatagccttgttttgcatgtgtttctgtttaaagataccttgtttaatatacattgttgattcattaacattgacctcatggcgaagagcactgtatctcatgcctaaatgaagcttagccaatgcgtctcttcttcctaaggcacatcatggccttgttgtgattaagaacattagacgacactaaggcatgatgtttggggctcattttaaacagcaaaatcaccaagaaacccacaaaaatgaaaaaaaaaagccctaaaaactagccacaaaagggacatttgttaatagtataagggctagaacaaagagtgtaggctggttttttggcttcagctgggtacatgtatgtggagtgactcaaatattttggtgtgtacttgcttcagtggcacatatactaaaattggaatgatacggagaagattagtatggcccctgtgcaaggatgacacaaattcgtgaagcgttccttaataaaaaaagaaaaaaaaattttggttctctccacctgtgcgcaaatgaccatgagcattagtcttggggttataaataagttttagtagatgaatttgcaaatgtggaatccgtgaataataaggatgtactgtattttttcatctttatttcttaattaacaactgtgatctgtattttaaatgagcctttttgggggagcttgataggcattgagtgtttttcccaaagatttgtcaccttcttgtgagttgtctagtctgttcttttggttttatagatttattctaaactaaaagttaatggtagttgccatttataatttcttgcagaggtttttgcagagatcatccatttaatatttttgtgcattgaaggttttaattgtacagtcaacactgtcattcacttgtgattttcattttttccaagcttagaaaacttgaaggatgatgacttttttattggagaggttaaaaaaaaaaagtaggtaaaagtgatggatgcttaggctgagggtggtgactgaatatgtggtacttgaaattgagtttgagtgtccaggcctggtttcattatatcttgggacacttaaaaaagtcttgcagaggcaatctgcttgaaaatgctgtataaaccttaaacctctaaattgtaaaatgtaagtgcataataatttctgatttgtagacttctgttgacaatctttcaagacgggagaagggtgaaaaagacggaaaagacaaacagatatttttcagaaatgaaaaacatgtacattttctgacatagggaatgagagatttttctaaatgtgacccagaaggctttcaggtgatttcctaacaagatttgagttttctcggattaaatatggttgtggctctctaccatgtgccccagtcttatctttgttatgccccttcacacatactctgttcttcacatactcttccttctgctggctagtgcttccctgtttctggaactttcttaagcatttttaccatgtattatagttatttgtattgtagttacgtgtcatccttcttcgtcttagaagagaagtttccatctgactccatgttttctattgtagaccctagttcagtgccttttaaacagcagatatggaataatcctctaatggaataaatggggagaagaagggatagtttgtggttacctgggaaagcagtgtggttaagtcagcatgggtttctcaagaacaagcctttcttgaattaacctcatttcctgtataaatcagatacttattggagagagaatttgggtaatgttgttgttagaggatatcagaataaaaaaactacatgtttcattaagttcttaggattttttatggataagttggaaaagcatgggcttgattgtaataagatagatgaatgtgttgcaggttgattaactgttgactttgtgcaattcactgccttgccagtgctattctaacttttccatcagggaactattaaggaagaggaaagtttatactttattttggagggtttagagggttgagggtacaggaattgaaggttggattgtgggcaggatgtagggagactttagaggcacagccaggagcgaaatgtctttgaagactcatgttttcacataaagatgcattcactttgtatttttaacatgcccatgtttgttttaaaatactttaaattatcaccagataaaatgtttgagtagccctttcccaatgtcatgatattctagtttgagaagagtggtctttgatcaagaaaggtggatcaaatttgtgtctatcccattgttgggagggaagctaaccaactggatgtcagacatcaggatagaaaaaaaaaaaggctgcaaaaagttgaaggcaatcaacatgaacaaatacacaattaagctctactgaatgcagcttcctagagtcgggggaaagttgcatgtttatagaatgggagacctggatcagtagcagctcttgttaaaaagattgaaggtttcagccaaccatttgatatgggtggccttctctggcagctttaatggcacagtactcagaattaaggagataatcatcccgttgttttctgacttcgttaggctacctccgagggcttgttttcaaacaagttctacattttaagagggtaagccagggaaataaatggactagaaactatgccctaccaggaatagttgaaaggctatcggggtggaaaggagagcaaagttaattctcaacttcaggggggcaggattggaatttatgggtagacataagaaggatatgtttttctatttcaatcaattaagaatttttgctttgtaaacacacataaaatggatatcatatactatttagtaatcacttttttcacttgatagagcatgtatatcttatgtaactatttgatatgttcatatgatttttaatggctacatagcatctctctgtatgagtgcactcttatttattaaaaccatccctgacagttactttggtcatttccaatttcttagtataaacaacaactctacaatgaagatatctcaaatacactcatcactgtgcatttgttgagttgtttccttaggacaaattcttagcagcaggacagctgagtcagcattggtactatttacttatggcttttgaatacttattgccaaactgcttcttaccagtaataggaaccgcatgtgttaaagaagtcagattaccccaaattagagatgttgtcataggattttggcagtgggttgaatgttggacagtgatctaaggctccttaaaaaatgcatgaaagttttagtgtaggaccagatgactgtttcatctagaactttcacatttcagtcttactatgtaagtcacactgttaaagaaaactgtcaagagtctgtaacagagaaaatactgcagacgttttctgtattcagaaagcactgtagaaattgaccaaggaagagaggctcatggcaggcaacaacgcaatgctgttaggttgcatgtatgatagaaatagtaaaggaatctttcagcagattaaccattttataacttaggtaagttggggttttccaagtaagtaaattgcattttctttttttttttttttttttttgagacggagtctcgctctgtcgcccaggccggactgcggactgcagtggcgcaatctcggctcactgcaagctccgcttcccgggttcacgccattctcctgcctcagcctcccgaatagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccaagtaaattgcattttctacaccctgccagagctgggtaacaactgcttctggggaagatgggaacggacaaaaagctgctctagatcatgttcccagtaaagagctcaaagtgattttgcacgtgttttatcctcatgacctaaagctcagctgcagtgagatggtgtagtgcactgagattatcagcaaaggggattccagcttcactgcttgagtaagccactgggcctctctgagctgtagtttcttaacctgcataggagatgaattaccaatacaagtcagagagttacagtgaggatttcctgagatgatatattggatagtactttctaacctgtaaaatgctttacaaatattagttgtcaagttagacaaccgatgctagtggagatttccaatttaaagctttctaatggatgaaagagctagtgaacttcatcacggcagaagttgggtctgattttgcttgattttgccttgatgtttggctcatagttgcaattcactaaatatttgttgaatgaaaaaaatgaaattagcatttcattgttttattaacacattagagaggcacccatgaaaatgtgtgcttctcatctttgtggagtaagtactgctattcattcttacaagcagggaagcagatccatcaattctcaaatcactctcacagccagattctgcatttttcaggtgatttctaattacatgaaagagattagatcaagtactcttttttggttatttaagaggaaagatggaaccaagcctgtgttctgtagctctattgtgtaaaatcacttcgagcaaatgaatgaaatattttgtcagactttttttttttttttacttactgacccttaatagaaaataattttatgtgtagccctccccagagtctctgttgccaggaagctaatgttgctatccctaatacggcaactttgtctatttttctgttctttgtgcattgtgtttggtcttaaactgtgaatattccattaactgagaactctgaacagccattgtgtaactggagtgatagtctgtgtcagttcaatgcattgtacttgagaataaacatgctgttttatttgtggtgggacttctctcattgccactagtaatatgttgttaactgaaaatataaggctattaataagcctcataagtactttgcattgttgaaacaatccttcagtgtaggatcacatgattttgtagatatgtatgtgtgtgtctatattttcaaataggcagtagacccattcgtttcttatccttgggtgtgaggtcagaagtgtcagtgaaattgagtccagaattgtagttatgcgtgctttcctagggagaggtttctcttctttttaatcagaatctcaaaattgctctatggttcagaaatgtttagggaccactgacgcagcaaattcagttcagcccggatagtttatttgatctgtggtgactgtgtcactagaaagtgatataaaatacctagactagcacagggcacacataggttctacacaaatatttgttggaaacccaataaaaatcactggtgctttttttctttcttccctgtaacacattatggcctgtgaacctctagaagacaggatctttgtcttacttagtctttggcagctgtgttaacttctcgcgtctgtctcctagtgtcatagaatgtgcactttctttctttttttttttttttgagacagagtcttgctctgtcgcccaggctggagtgcggtggcgcaatctcggctcactgcaagctccgcctcccgggttcacgccattctcctgcctcagcctcctcagtagctgggattacagacgcccgccaccacgcccggctaatttttttgtgttttttagtagagacggggtttcactgtgttagccaggatggtcttgacctcctgacctcatgactccgcccgcctcagcctcccaaagtgctgggattacaggagggagccaccgtgcccggccagaatgcactttctgtagcaaagtagaagttgtaaaactttttctcaccagacacccttatacatacaaaacaatctgaacatgtgtcctcaacgtagacacctagttataaattatatacgtgtacatatctctattgaggatatatgttcagattgttttatgctaatatgaaacatacatagttgcaatgttgagagatgaaaagtaatgttttagcatgtattgataaccatgatggctttatattaatattaaaagctatacctatttctgcccatgcctacttttggtgttctcataatctgagcatgcgctcagctctggctctttgcagccgctcttccacctcctaacactctttcaggagatgcccttactgttaactgcttattctctgtgcttcttaattcatattcttgagagtcagcatctaattgactcagttcaccttatcattccaggtcaactcatgtgagtctcattgacatacagtgttgtttttggcttctcttgggaagcccactctggtccacacaggtgactgcatgaagtgggaaatgaagacacttggcacagacatggctgttcaggtaacaaagagtgtgtgcagggcggcttcactgagaaggagcctggtgaggctggaatggtgactgctttcaccattagacaaatgtcagtgggtagagaagagagaccaaagtgtgactttagaaacagaaaaatccccttttcttcctttgcaaatccatacctatatattttgaagaccactaggcatgtcaggtaaactttcagcaatttaaattaatcagagagctggagaacatctattcctgttaagatctttcccacccattcaactccctgactagttactgctaaagagaaaaatggtagcagcttcatctttaagacttaagccatagttcttgcaatgggaaagtcaaccctaaagaatggtttcatgtttgctcccattctaccttgtgcagacagtagtttaaggatgtcttctgcagagcataacttgtgtagtcacccaaaagggtcttccagttcactgagaccatggtattgcagtaaagaaagagtttaattgacgaagaggtggctagccgcatgggagatggagttatcactcaaattaatctccctgaagttttgggggttgaggtttttcaaggatagttcggtggacaggggactatagaatggatgttgctgattggctggggatgccatcataggagtgtggaaaacagccctcatttgctgagtctgcctctgggttaggggccataggaccagttgagtcatgagtcgcaggtccaggtggagtcagccagtcgtcaaaaatgcagcagtctgaaaagacatctcaaaaggccaatcttaggttccgcaagagtgatgctatttaccacagtaattggggaagttacaaatcttgtgacttccagaacaatggctggttatcatttatacctacgcttttaacaaaacttttattttaggttcaggggtgcatgtgcaggtttgttaatatgggtaaactcgtgtcatgggggtttgttgtacagattgtttcatcacccaggtgttaagttaataatacatagttatttttcttcaccctctgcttcctccccaacctccaccctccattaggctgcagtgtctgttgttgtcctctatgtgcccatgtgttctcatcatttagctcccatttataagtgacaacgtgtagtatttggttttctgttcctgcgttagtttgctgtgggtgatggcttccagctatccatgcaaaggacatgatcttattcttttttatggctgcatagtatttcatggtgtatatgttccacattttctttatccactgtaccactgatgggcgtttaggttgattccatgtctttgctattgtgaatagtgctgcagtgagcatatgtgtgcatgcatctttatgatagaatgatttatatttcttttggtgtacacccagtaatgggatttctgggtggaatgggagttatatttttagaactttgaagactcatcacattgtcttccacagtggttgaactaatttatacttccaccaatactgtgtaaatgttcctttttctctgcaacctcgccagcacctgttatgttttgatttcttgataatagccattctgacaggtgcgagatggtatctccttgtggttgttatttgcgtttctctaatgatcggtaatgttgagctttttttccacatacttgttggccgcatgtgtgtcttcttttgaaaggtgtctgttcatgcctttgcctactttttaatggagttgtttttttcttataaatttaagttccgtgtaggtgctggatattagacttttgtcagatggatagtttgccaaaattttctcccattctgtaggttgtctgtttactttgttgatagtttcttttgctgtgcagaagccttttagtttaattagatcccatttgtcaatttttgcttttgttggaattccttttgacattctcgtcacgaaatctttgcccattcctatgtccggaatggtattgcttaggttatcatccaggtttttgagtattacatttaagtttttaatccttcttgagttgatttttgtatatgatgtaaggaaggggtccagtttcaattttctgcacatggctagccagttatcacagcaccatttattcaacagggagtcctttccccattgcttgtttttgtcaggtttgtcaaagatcagatagttgtaggtatgcggccttatttctgggttctctcgtctgttcccttggtctgtgtgtctggttttgtaccagtgccatgctgttttggttattgtagcccagtagtgtagtttgaagttgggtagtgtaatgcctccagctttgttctttttgcttaggattgccttctatgcctacatcttagcagaattcaggcccttctcataaccctaaccttgtggtgtttcattagctttacaaagttgatttagttttggaaagtgctattctcattcttgctttaaagttaaactataaactaaattttccccgaagttagctttgcccatgcccaggaatgacgaaggacaacttggaggttagaagcaagggtcagatatctcttactgtcacagttttgcaaaagcagtttcacttccctcttctaagtaccttctgcattgattggagccagcaaagagaacttttgcagcatttcttagtttgaatgtgccatataaatgaaacatgtttggaaatgtgaaaccaagtcatccatgagaatgttttcctctgaaaggcagcacttcttgataagtcccttcctcatggaactttggtgcagtgttggcccattttaaaatttattggttacccagggagatgcccgagcttatcagaattagagtctctcatttgagtacgttcttgcagtatagaagtttgcagatgttttataactttaagaggcccagtggtattgaatttagagttaatttttaaaactggctccaaagtcaccagcatggacaaaacttacagtcttccaaagagagagtgccaaagttcaacgcttggcattgttggtttttttttttctttgtgcccatatcaggtagctatgattatcttcattttacagagaagaaaacaaagctcaagagttaatttgactaaattcacagatgagtgaagtatgaggtagagagtgatcctgtgtgagaatagtttacatttatcttgatgtggttataaccactaccttatctataatgcatgttaaaaatcaacttctcaagattttttacaccaaaggcaaaaatattcaaatgttgatatagtcccttccattcatttttatatttttgtttaaaatcttcaacatcatacccagttttcaacctaactttataaagtaagcatttccttaatcttcataaacatgtttaagatatgtatcataatttaacaaattattaagtttctgaaatttttacagtagtgaggcagtggatgtatttatgtgtaagtctgtggggtttttttcctgtctctcccatagaggcagagacttgctctgtgacccaggctggagtgcagtggcatgatcgtcactctgttgcccaggttggagtgcagtggtgcagtcatggcatgctttaacctcaaactcctgggctcaagctatcatcccgcctcagcctgctgaatagctaggactacaggtgtgcatcaccatgcctgcctaattttctaaaatttttttgtagagacaaaatctcaatatgttgcccaggctgatctcgaactcctggcctcccaccttaacctcccaaagcactgggattacaggtgtgagccaccatgcctggccaaggttgattttttaaaaacattatttccttagtatgtgtatgattagaagcaaaattacaggtcagaagtcacattttaaaagatcatgaccacttaaaaaacccttaatatgttttgccaaatttatatcttttaaaaatgggatcgatttccacactcatcggggtatatttgagtatgtagctcactgtagacagagctcctggggagggaggaatggctctggtgctcttctacccacctgtagaggttcagctggggaccagctccactgtggggcattgggaggctgttagtgcagaggtatcttctcagtatctgcctgacacactactgtatccagctgcctgacccagtcctgcccacctgccttcctttcttcctgcctcccctctgttttatcaactttgtctcaaaaaacatagcttcctatctctatatgttcgtctcctatttatggtccctcagtatgttatagtgcttgctaaggtttgaatgtcccatgtgaatctcatgttgaaacttaacccccaatgtggcaatattgagaggtggggcctttaagaggtggctctgccctcatgaatggattaatccattcatggattaatggattaatgggttatcaggggagtagggctggtggcttttaagaagaggaagggacctgagctagcacactcggccgcctcaccatgtgattccctgtgctgcctccagactctgtcaagtccccaccagcaagaaggccctcaccagatgcagccctagactttggacttctcagcctttgtacctgtaagaaataaataccttttctgtataaattacccagtttcaggtattctgttataagcaacagaaaattgactgagacaatacgtatattctaattgtgttcacttttctttcatctagacttaccagaagtttacttctctggttggcttttcaaggaagcttttgaatttcacttctattttttctattaatgcattcattattagtgaagtattttgtaatcatttttcaaacagattgggtgttttttttttctcatttcaatatgtagttcacttatgttaattatttagggcttacatttttctctgttctcaaccttcatcagattccgtaacacttgatacgttgtaaggtttctgttttcattcattatacaccttccccaccccaggccttttcattactttcaacacagtctcgtattaggatttatgttttttaaaacaattatttaggagaatagaatagtttttttctccttgtattgggttttttgtttgtttagatgtctgttgtttctgtgatggctttgttttaatctgtgcttggagagtgctctctcattgctactttggagaatgtattattctttggcctagtatgattgtgtgtgtacatttggggacaaaatgtttttgtggagataatgtagacttaaaattttaaatccgtagctgtattttcgtcacaatgaaaatttgatgtccttagtaagccccgaatagaaagccttgacttgctttttgagcatagttaacagtgttgagataagagaggtttgctggcagttgcactgatggctgcactgttgtccagtgggcccagctgggtgtacagctcgccgtataaacagaaatctagacacaggtccctagaagcctaatctgtgacctagaccctgtctctgaggtactcttaccagaaagttaatctgttagaggatctttcatcagcataaaaggcagaaataattttctaaatgctgttgataaaatgtgagtgcatgctgcttcattcgattatggaaactgagcattggagacttattctcctttttaacaccacttgcctccagtaacttacactaattgtcatctataccaagcctttgaaaatttgtagtttttgtaagtttttaggaaatatgcatgctaattagataatgcctaaattatgttgcttttcatgtgaatttagtaaagtcatttaagacccgttggcttagtttttcatgagactttctaaacatgcttaatctctgcatactattttaataataatgtaagtttttgactttttgctattataatgggcagtgaatatatttgtgctgaaatctgtgtggaatttttttgaacatcattttcttactgtatattattagaggtgaaatgtttgggtcaggagttacaaacatatatatttttaaaaaactactctaaagatccttgatacattttgtcaaattgatttcttgtaaaaatgggaccagtttgcacctctgttgtggtatgagagagtgcccatctccttggggacctagccccttgatggttccagcactccatcgaaaaccagctccactgtggggtgttttgtgtgacatggtggtgtcatatgtcttctctgcaagaaaaggcattgttagcaaggcaaacagaaatactcgatacagttatgtataaaccagaggaagcctttgccagagagattgttgacaattgctagagggtatgataatgcagaagttacagagtgttcctttggcaacacgtgttaatggatttgttccagtgttggagccctttttaatgaaaattctcaacacctacactggaaaaataataaaataaaaagccttagtcaggaatgtattgcttgttaagatttagccaaggaagtcacatgttatttaacaaggtagattacttttttctttgtagtaggcaaggaaacagctatgcttcacttctaaataaaaaaaaaaaaaattttaaaaacgttttttaaaaagaaaaacgtgactaagataactgtctcattcccaggcactttttaatctcatataaatttacatttagagacttaacagtttggcttttttgaatgaatgccagaaatacagttggactatagagtctcagctgagaagcagacacatggagcaaggtatgttctgtcatttatcagaaaagttaaagaattcattttgtttaaaaggcagcacatagattattcagagagagaaaaatatgggtttataggaaaattcttatgtatttggtaaggactctgagtttgtactttagcttcatgtctcataaatcaagtcccaagttcaccaggtgatagtattcccaggttacttgtgggtgtaggtgcagaacaactcggaactttgtggttgggcatctttttctgccgtccaactttggaggttgctgggaggagatgcttattttccttttttagggcatttcagtttaaaacaaattaaaaatggaaagtcaatgttttccctccactaatacaactcttaacttatggttgtaataaacagtgattttttttttttttttttttctaagagacagggtcttgctcttttcccaggcttgagtgcagtggagaaattgtagttcactacagccttaaactcctgggctcaaggcatcctcctgcctcagcctcttgaacagctaggactacttgcttgtgctgccatacccagctatttcggatcatgaggtcaagagatcgagaccatcctggctaacacagtgaaaccccgtctctactaaaaaatagaaaaaaattagctgggcgtggtagtgggttcctgtagtcccagctactcgggaagctgagacaggagactggcgtgaacctgggaggtggagcttgcagtgagccgagatcgctccactgcactccagcatgagtgacagagcgagactccatctcaaaaaaaaaaaattttttttgtagagacagggtctcgatatgttgcccaggctggtcttgaattcctggcctcaggcaatcctcctgccatggcctcccaaagcactgggattacaatatggacataagccaccatgtccagccctacttttgcttttttgaaggacatgtgtgttaagcagaaatttctaaagtcagtgcattttttgcatcagaacatgttttaactcatgagttaaaacatcgctgtttctggcataacggtcttcccacatttccatctttatattaaaaatttctgaaataaaatttctttttgggctagaaaaaggtaagattggatcaagtgatccatttaggacttgccttttcatactttgcagtctcattactattatcacaatgtatgtcctaatacaataaagttgaggtttaaccaaaagttctcttttcttctggcatgctttgtgagaaaatatttgagctggtgtaaattgtaattactggcagatatggaagagagtctgacttggagtattcatgatgctgatatgctgctgcagtcagtcaagtgctgcgtgagttgatgtcattaccaaaggacagtctctataatcagagaataaagtataatttgtaaatgtggaggagctagaggaacaacttgatttcacttgtcactaaacttatctaataaataaaaatgaggatttattattattattattatttttttgagacagagtctcgctctgtcacccaggctggagtgcagtggcgcaatcttggctcactgcaagctccacctcctgggttcacgccattctcttgcctcagcttcccgagtagctgggactacaggtgcccgccaccacgcgtggctaatttttttgtatttttagtagaaatagggtttcaccgtgttagccaggatggtctcgatctcttgacctcgtgatccgccctcctcggcctcccaaagtgctgggattacaggcatgagccaccgcgcccggtcaaggattttttttttaaagccagaagtaatataagtcggtatcagtgagaaaaggtggtgaggatagcagggattaagtaagtcgcgggcattttatttttatcttaaagaaaatgttaaaatggttgacgttttctagctcaacactcccacccccacctcacccattgattgatggtttgctttcgaaatcctgagtgaaaagacaggaattacttcattgtgctgagagtgactgatgtcagaaggtcagttttcctacatttacaagattcatacacacttctgaaaggttttctgttagactgggtggactgtagatgaacagggcactttttgttttgtaattgcatttagctttaattagaggtttagagtagaaagctgagagttgcttggaggagccaaccaggagattaatgggctgtgcccatccgccgcagctctgtgcttccaagaagtttgccagggtaacctggatttgtctttattgtactggaaggagtcttgtcctgtagaagtagaaatcactgatgcatcactaacatcatgtggcctttgttctctgccgcacatgtttgaaaagcgcagctcgcacccactcttcccttaggaaagggggccgaagctctgtacctgtaacattccataaaggctaaggatcatgaggatgttgagtgggcagggccccagcggtctttactgaaataccagagcctgcactctgataatgaatgaggctcgagggaacattcctttggcatattttaatgcttgacctagttgactggggtgctctgggaaaatgagcctcacttcctgcttttccaccttaaattgaagtatggggtgctctgggaaaatgagcctcacttcctgcttttccaccttaaattgaagtatgtcatttatatgattgttaatattgaaatgagcagctgtaccactctgttctcaacagggaggaagcctttttatttgtaatgtttgaaaatattctttctcagccgcgcgtggtggcttatgcctgtaatcccagcactttgggaggctgaggcgggtggatcctgaggtgaggagttcaagaccagcccggccaacacaatgaaaccccatctctactaaaaatacaaaaattagccaggcatggtggcacgtgcctgtggtcccagctacttgggaggttgaggcaggagaatcgctgaccctgcgaggtgggaggttgcagtgagccgagattgcaccactgcactccaacttaggtgacagagtgagactccgtctcaaaaaaaaaaaaaaaagaaaaaaaatattttttctttttttaagtgtatatattttttaagttgaaacctgtgtttgccttgtctttatgcccacaggggaacttgaagtcattttacatatcaaaagcatcttctcaggttattctgaattttgagaaggctaacatttgctaggctttatgtttaaaaaaacaaaaacagaaaaagatcctgggcttctcccatcttgcttggcaaatgaggagtctagggtacttgtcttaaatgttctgacatatttcaattaaagcagtgaacaatattctcaaagacaaggcagcagctgatacttggtaatgtccttaaaactgcatagtaataaccttcagtgagatttgtataatttggagataagctccacttatatctgtaaagttaaagcacagagaaagttagtacagtatttgcctgaggtcagtcacgcagttggtgacaaaagccactattcttagtacttcatgagacttctgttttatataatagattacagaggccaggcacagtggctcttgcctgtaattccagcactttgggagactgagctgggaggatcatttgagcccaggagtttgagaccagcttgggcaacatagcaagaccctgtctctacagggaaaaaaaaaaaaaaaaagccaggaatggtgatgcacacctgtgttccagctgctcaggagactgaggtgggaggattgcttgagcctgggaggttgaggctgcagttagccatgatcatgtcactgcactccagcctgggcaacagagcaagaccctgtctcaaaaaaaattaattacagagatagtgttctagttaatagcaaggaaagaatggcttaagcaataagcttggccgggcacagtggctcatgcctgtaatcccagcactttgggaggccaaggcgggcccgatcacttgaggtcaggagttcaagaccagcctggtcaacatggtgaaatcctgtctctattaaaaatacaaaaattagtcagatgtagtggtgtatgcctataatcccagccacttgagaggctgaggcaggaagatcgcttgaacccagtatgtggaggttacagtgagctgagattgtgccactggactccagcgtaggcaacagagtgcaactgcatctcaaaacaaaaaacaataagtttaatgaatgattcccaaagtatggtctatggaccagcatcattcacatcatctgggaacttattagaaattttaaatttttaggccctatcagacctactgcttactctgaaggtgggagtctaggaatctgtgtttttacaaagccctccacatacttctgattcatgataaagtttcagtaccactagcttcataccatccttttataattttatgagtttaaatgctcagggctgctgagataacatacccttgggtcctgagtgtatacaaggtaagaagcagctggcagcctccttgaaggcccagcatagacaaccttactggcctcccttttaatatacagataggtaagaaagcagaagaggaaccaatatttgctctgctaggcactgtgcctatctttcccacagttcccttgcatttagccctcatgccaatcatatgcttgtcatagtgtgctccttatatgttttgggtacttcatcattttctagttgtaatctcagtcttgagagcaggctcagacgtttgcttcgattctttcactggcaatcacggagacttgacattgtttcatttaggggactgtacatttcctcatggggcatgcagtttgtgttggagatacagaaagcttcatcttgaacttggtgcttcttcctggaacagtaattttatttcaggtttgtgggagaggaagaggagggaccttgttttttttttgcaaaccatgacattccctgtacgtaccatgtacctggtgcatgataaataactgttaaatagatttctatactattaacagaaagcttgtattgtgtccggaattggttccttcaggtggtttcttggtctcactgacttcaagaatgaagccatagaccctcacggtgagtgttacagttcttaaagatggtgtgtccggagtttgttccttcagatgttcagatgagtccttagtttcttccttccagtgggttcatggcctcgctgacttgaggagtgaatctgcagacctttgcagtgttacaggtcatgaaggtagtgcagacccaaagactgagcagcagcaagatttattgtgaagagcgaaagaacaaagcttccacagcatggaagggaacccaagcgggttgcctctgctggctctggtggccagattttattcccttatttggccccgcccacgtcctgctgattggtccattttacagagtgctgattggcccattttacagagagctgattgatccattttacagagtgctgattggtgtgttattacagagtgctgattggtgcatttacaaacctttagctagacacagagtgctgactggtgtgtttacaaacctttagacacagagcgctgattggtgcgtttttacagagtgctgattggcgcgcttacaaacctttagctagacacagagtgctaattggtgtgtttacaatcctttaactagacagaaaagttctccaagtccgcacccgacccagaagctcagccggcttcacctctcagtatcatctcccagatagcttgtgcccacccttcagacttctttgtttaaggcagttattctcaaaatgtcccttgaccagaaacagcatcacttggaaacttggtagaagtacacattctcaagttccaccccaaacctcttgaatcagaaattctgagggtagggcccaggaatttatgtttcaacaagtcttgcaggtgattttgatttatgctagcatttgagaaccactggctttacgcatgagaagtaggattttaaaattgtactttttattataattttctgggaaagtaaagctgtttcacctgtaaactttgggaataggagcaccctgaagctcacaatggcatcctgcaaagccccaaagagtgctagttgttgatcattacctgtgcacacatcattccctcactcagagcccagctaggaggcctcctttcaccttgtaaccaggtcacccctagatgtgatcacttcctccacaagaactgagagagaagagaagaacaccagaggatactgaactggccatactggggcttatggtttaaagggcagaactgagccaaatgaggactcctcagaaaattgctttctcgttggatcaccccagaaataaatcagtaaaagcattcaccttttgttttatttgcttcaaacaaagtaggaaacattcttcttgctttatatatctagataccaagtaaggaagtatgatttggattcttgagtctctttattttatttttcaactgtgtgtgtgtgtgtgtgtgtgtttgcctttgctaagccatggagggtaaaaaatgaaatatattagcaacattgttgacatggaccacagacaattaaatgtttcatttcttattaatcctgaaagaaaaagccttttttttttgttgggcggcagggagggggtgcagtcctctatacaaaaatcttaaaaactaaatatatctattctaattgttttcccctggaacatcatcatagtttaggagtatatctcaatgttgattttaaaaaataaatatgtaaacagctagatttatgcactgttaaagcatcagtgcaagttttaggaaaaaatcaagcatgacaattgaaaataaaataaccattactaagttggactcttctttaccctcaagaaattgtacttggatgtttatgggagaaattattccaaatcctaccagttctgtcagaaaactaatattactctacataatcattttctcccacctctgtataatatttaacttttatttgaaatgtaggctcaagctatgctaaaaatcccatctcgaagatgacgagcttatccatggggaggggatggagggcagagcactctcataactctaggaatttgactgttatatcttgacttaataaatgtctgcagctgaaaataggaaaaattgactatatgcatgtttgaacacatagacataaaaaatgccagctgaagcagagtattccgcatgcaagccaagaaaaatcgggttcagtgaggcacagtttggcagggaaggcacactgaagctgcagggatgggaggtctagtaactggggaggtattcagttgagggctggtgccctccacgtagccttccccgacccacccaccctgggtctgcttccctctgcccccagtgtgggctcccgtagcacagctgggtattagcttggtaatggggaaaggatggtattcaactgggaatctttggcttctaggaacaaaacaaacttggggaggatgttatcaggatactgaagtcctccccaaaatccaggatcttcagagaaaacctaagaatcaaaaatagaaaagcacaggaagttgaaggactctgtctctgtgtgttgtccctgcttctctcagctccatcctcacctttctgcactccagctctgttgtgtcgtccacagcatgcaacacacagatccagctccatctggagcccgcctgtcagctcctcagccccaattttaaaaccctaggggagaagcatcttctcagcataggtctcacatctttatgtggtccagtgagccatggtgggggaggtaggtgggtgcagggaggcagtatgggaggtccacctctgaccctgtggcccagtcagaagaccccaaagagaggagtagcttgcatagatggaacaaaagcattctccctatgttattccgttcacatgttgctgtgggttcattaaccccacacttagaaagtaatcatctttggctctaagaaaatctggaggttggacctgaaaaacctcaggccagacagtgaatcagtcctggattgtgctgaattttctaatatgactccaccccatgaggcttcatgactgtcagcatctgctgtctccagtgatgctgtgtccgaaattggtgggttcttggtctcacagacttcaagaatgaagccacagacccttgcggtgagtgttacagttcttaaagatggtgtgtccgaagtttgttccttctgatgttcgtacgtgttcagagtttcttcattctggtaggttcgtggtctcactggcttcaggagtgaagctgcagaccttcgcggtgagtgtaacagctcttaaggcggcgcgtctggagttgttcgttcctccggtctggagttgttcattcctcccggtgggttcgtggtctcgctggcctcaggagtgaagctgcagaccttcctggtgttacagctcataaaggcagcgcggacccgaagagtgagcagcagcaagatttattgcaaagagtgaaagaacaaagcttccacactgtgggaggggacctgagcaggttgccactgctggctcaggcatctgcttttattctcttatctggccccacccacatcctgttgattggtcaattttacagagagctgattggtccattttgacagggtgctgattggtgcatttacaatccctgagctagacgcaaaagttctccaagtccccactagatcagctagacacagagcactgactggtgcatttgcaaaccttgagctagacacagagtgctgattggtgtatttacaatcccttagctagacataaaggttctccaagtgcccactagactcaggagtccagctggcttcacctagtggatcccgcactggggccgcaggcggagctgcctgccagtcccgcgctgtgcgcccgcactcctgagcccttgggtagtcaatgggattgggcgccgcggagcagggggcggtgctcgttggggaggcttgggctgcgctggagcccacggcatctgggggaggctccggcatggtgggctgcaggtcccgagccttgccccacggggaggcagctgaggcctggtgagaattggagcgcagcgctggcaggctgacactgctagggaacccagcgcaccctccgcagctgctggctggagtgctaagcccctcactgcccaggggccggccgctccaagtgtggggcccgccgagcccacacctacccagaactcctggcctacccagaactcctggcccgcgagcgttgtgtgcagccccagttcccacccacggctttccctccacatctccccgcaagcagagggagccggctccggcctcggccagcccagagaggggctcccacagtgcagcggcgggctgaagggctcctcaagcacggccagagggggcgccgagagcaggcaagggctgacagcacgttgtcacctctcaatgcctatcttaaacagaccctttacatggcattggtggcaagtgagactggaaattctttgtgaaatgcttgcatgatacaagagccttctcgtaaatctgttttaaaagtgtcctttattctgaataccattttgatccgtgatccactgatggaagtcaatgatgttgaactaagaaaatacataggttactagctatgaaccattcttcattagtgcacttgcttggtaatgggttaatttgaattgggaatgaatcttagtccacaaactagaggtgcagagaatattgcagtttgctaaatagacttaatcttgactttaagcttctactgctttcaggtagcagaaagattcacctcgattattcttggatttctttcccatatcaccctcccagagttgtgccaaggttccaggctttactaatgtcatgatgtcaggaaggcctgagaagttatccgtttacaccagtccctactgcttctgggctgcatttgaggctagggagggtgctttgtcagcatccagccatcctcctggggttgctgcacacctcagggtgcagccagagtgcaggtatggccatctgccactcagagtttcacagtcattcacttccaagatctcccttaagtgtgagagatcttgctatcttctcacctgcttttctcctcaagaaggtaagccagagccctcgacccttgtgaatgaggaaatttcagagagaaaaacattggaactccccctgccccagagttggtaactgctcaaatgctggctgccgccaggtggtgcaagaggcgctgcttctctgtggtcacctagcagcagtctcctgtggccagttccccacgtagaggtggcaactgcccttcttcatggctacttgctggaggtttgtgggaggaggggagtatggggggtgtgtgtggctttacctgccccaaattgtcaggaggatttgaggcatttctttgttgttgttgttgtttggctgtttccaaaacccatttggaaacctgttattccgtaagagtagccttcaaattcttaagcattttctataaatcttcagtgaactaataaaagtatttccttttcccttttctggcaatgggtagtctagttctgttaatattcctgcaaagaaactcatctaccagcctcactcacactgtgcacttttgccctcagaatcctcagtggctagcctaattgactacaaccagtttagatgatcagctaccttccttttgccattatttcagatgctgccttgcccatagcacaaccaatgcatttaaaaaataaaaacatttggggtgggagaactatgattaaataaaggagatctctgtagagtatggcaaagcttgcacacaactttaataaaaatatgctgtcttgagtaaccagcatattacagaggctctgtgaatgcctcttcatctagaatttcagtacaagctgtacataaaatatttatacagcacagtgtgctttgcccctcacaaaagcgtgggttcagatgtacactgttactatagacgtcactaacatataagccggtgaagaacctttaatgtatttgtaatgttagcaaagtatctgtcatcagattaaacttgtagtgactgataatgtagccttggctcctagccaaaaatattttttttgatatcagaatgacacttaatagtaaagatatgtcatagaggaaggggaagaagagaatttactagagaaacttaaaagactggttggtgcagaacctagtaacttggtttgtggctggcagaaatgggagtagtccctgggattacttctaaggaggaaattttactacaaacacagctgggaataattctgttaccaagtcttttttaggatcaatacagagcttatttgtaaaaattaaaatctaactatcactttattgtctatgggtatctgttacattttatctgtaaaagaggaatggaaatgcctgcctagtaggttcatcataaggactgagaggatacgggaccttattaagtcctcagtaagtagcagcaattttgcttttgtttttatgatgattacttccactcatgactttacctgcatgttctttaatcttcaaaatagattagtgaagtagtgatgtttccattttagaaataaaatacgctggggaaacgaattgtaatacacatgacaaagcttaatattagtatccttctatgaaggatccctcagtatccttatataaagatcctttatggctctaatatgcttcagttgattttgttccttgtaggcaaaagtttcaataaatatactgttttctctccattatcaaggatatatggattaatattaatatataaatatataaatccattatatagtaatatatattaacatatacttcctttattaatatcctggatatatgaaattaatatcttggatatatgaaaaggtattccagatcaataagatgaacacagtagtagaaaaatagagaacatgaacaagagtgtaaaaaggtgcgaagtgttcaaccccaaagatatgctaatcaaaatttaaaaattaaatctatacaatacaatttaaaaaataacattacccattgttagagggggtgtggaggagtgggtattgtcatgtgccactgggtcaaacattgtgtagggcaaattaacaatatcagatcctcacattttctgtacatttgaccttgaccttatcccaggcaaatacttgatggtatagtgaaggatatctttctcagcattacatatataatcaaaaataagaggtgacttaagtgcttcaagggaatttattaaaatggattattgatcagtcattaaaaatgaaagcatacaagactattaaatggtacagaatttctatcagaataagtgggaaaaacaagttacaagtaatatcatatgatttacttttagtgaaacttacatgcacttacacatttgtgtattatgtttatgtgtcatgcatacatataaaagtggaaggcggttcaacaaagtgctaattatcctcatgatttttattttttctttgatttttatgaacttacagtaaagaacaaagtactactttgaaggaagaaaaattattttttaataattcagcataaattacataggttatccaaagatagtaatatggtatttgatctgaacctagacttctgttctgttgatttgacacattttggtgtctttccttttatgttaaataagtaactatcatttacctacagcagaagaagaatataacttagcatttgagacttgataacatagagctgttgaatagttctgtaagatttgttagggaaccaaaaccaggcatgtgaggatggtgctggaagagaaaaggcgggaagggtttgcagtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgtcccttgacccttcactgtgtcttctactgattccccttagaactttcatttacccctggagcttcaaccatcatcttcaggtaaaactctagcaacaagtcatctttgcccgctgtgcatcatccttgctgccattgagagtttggtcttaaaatggtacttgcaattagaacacgttcactttgtcacaaaatctgacagacattggacatacttagaattcatatctggcttcctgagacagctgtcagattgtctaccaatggtctacccattgatgatggaacaagctccttgtatcagcctcaaataaaaatgatggaattaataaaagacgcttaccttaaggcacaaaggcctatgaatttcaaaaagcattgacagaaccgatccaaaaaatatgtagtttgtaaaaactctaatacaatccacactgaagtaaaaagcttaacttagaataatccaaatagtctttgtcagctggacagctaatcttggtgaacatggaagagtagacaataatgttaaggcattgtgtgagggttaaattgtttgcgaggtcggcattgctggggcttcggattcaaactgggccttgaaagagggggtaagaaaagtctatggggaactgatgggcacaaaggcagggtgtaagtgtttgttcttgggaaaatgatcagactaatctgattgaatagaagacgtttattggaaattaaaggaagataaagtagtgatagataatggaagaactgaaggtcaacaggggagtttatatgtgatggaagagaaaatcattatcactagggatgtagatgtaagaaaacgttaggtttggaagttataagacaagagaacttcaaagtttgtgggattctgtaaggtgggatgggaataagcaatattgttgagtacctgctgtgtgatctgtaaggcataagatgtcattattattttacagcaagctttggagtagatgtactagttcccattttatgcatagtgagatggaattttgagcagacatacttgtctaagtttggcagagtggctggaccaggattcatgcccagtgacatctgacttcaaagcacagtgaggatggagaatgttgagaccagttcttcattttacagtcaaggggatgggcccaggcctattcaaggttacaggaataggatgaaagcaatttctctgtaagagagagtggataggctgtgatctgcagagggtccaagttagaggctcttgttataaacagatgaggtatgccaaggaagttgggttcagcagtgtgataggagtgaaaaagaaggggtagagagcagctggacattcggggaaagtggtggtgactgttagtggaaggtaatgacgagagagatgacttgaaaacagttccgaggttttagtcccagggaactgccattaacagttttaggagaaaagccatgtgtgtgttatggagtggtctgagtaagtatgatagacattaaaaaatacataaaaatagagtggtatgcatgtgctgaattatgtttgtactaccaaacacacggaggaggagaacagaacagaaggtggaaagctatgagggatccagcgcttttctttgcagtggtggagagtcacgagagcaaatagctagcctttacctaaagcaaaagggactctttgcatgatatcttaggctcccttttattctggcctgcccctgcacccccagcaggaaagtggcttaactgtactttgatttccaaaatgcgtagcagtctctagtattgattcccctctcctgcagatctcaagcctaaaaatgagtattgttccattacatttccctcaaaaacatttctttttcctttcagaatgatggtcactatactggatggacttctgaactagtgaattactttcatcttttgatcacactaggaaattgtccacggagttgaaatatttattgcagtaatttctggccttacataattaagataacatatcgtttttttctttataactatcatgaagttgtcatgtttgtttcctttaactttgctttttagaggtacgaatctgttccctagtcttttatgctccaatgatctgttcagactgctcttgatctacaaatgtatgattgagaaaagacttttataggatgaaatatgagcaagctgttttactctgaagaataaaagtgaattgtattactctgcagattaagtcaataaataccccattttcataaacacaatatgcacagactagataatactagggaaacttgatacatcaaaaggagtattaagactgaaaaaaatggagatactcaatttattgcaggctttattcaataaacctagaaaatagagagtttaaatcaaaatctgttactctgtttctagagataatcaatgttaaaattgtactatattattttccaagtttttagaatatgtgcatgtgttgttgtgttagctttctctatttttgcaacttgagtaacatttattacatgcttgtgctgtgccaagctaaataccaagcattttatatatattaatttattctcataacccttggtacttttattatcctcatttacacacaggacaattgaagctcagagaaattagccaggcacagtggctcactcctgtaatgccagcactttaggaggccaaggcaggcagatcacttgaggtcagaagtttgagaccagcctggccaacatggcgaaaccccgtctctaataaaaatacaaaaattagctgggcgtggtggcacatgcctgtaatcccagctactagagaggctgaggcaggagaattgcttgaacctgggaggcagaggttgcattgtgctgagattgcaccattgcactctagcctgggtgacagagctagacttggtctcaagaaaaaaaaaaagaaagaaagaaagaaatgacttgcccatgttcacatagctggtaaacccacactggttcagaacttaaaccagtgagataccaaagcccatatcagtgggcttttttacatacttcttttccttaataaaatgcttatttcttttttctacagcatcattttaaatgacagcatagtattcagttatatggaaatgtaatggtttctctatcccatctccttttattagacatttatattgtttcttgttatttacttttagaaataacattgcagtgaacatctgtcatgcacatctatgattatttccttaggataaattgccagaagtggcattgctgaacaatgatagaatgtagcactcaggtgttgatgtattctgttaatttactctgttgatgtactgttttctcgaaaggccacaccagtttataatctcagtagcagtatattgaagtacctggtaactttcagctctcagcaacattggtagttagcaatttgaaaaaaaaaagtgtttgtttttaaaaaacattctaggtattcctttttaagtccatattatctcttgcctctaatgctgtagtagtcatgatctccttactggtttatttctatctagcacccactttgccactaacagaatcggatagggcacggactgtagagttagatgcctgggttcaaatcatgactgtgctgtgcctcaatttccccgtaagtaaaatgaaaatagtaataaaagccctctggtaaagtactttagaacagtgcctgacttttggtatgtgttcagtaattgttggcctactagtattgtcttccagaagtccctgcttatatgattaaaaaaacccaaggttatacttgtttttgaattgtaattattaccaaatcagtaaatcacagtagaaactaaagtgctgaccttgaagcattgttagtgttaacactgtgaccaacctgaagatcacaaattaccttccgtgactcagttgatgctgagaggtcagggatagagtaataacaggaataactagaatgttaaagtgctttatattaagctgccagtgcacttccacacacattatctcattcgatcctcacaacacagctgtgaaggagatggagcgggtattattaatctcatcttacagaggaggaaattgacttggaggattaagtggcttgctcactgatggttgtggaaatggtcagtggcagagctgaatgtgtactctgggccttctgactgtaaatacttactcttgatgcttcataacatcatgataagctaaggaggtgcaggtgtagatgcccaggtctggagatttgctggaaaagaaggagcaaaagaggatgccactgggaggagggagcagagttggggtaaggaaacttagatatactaaaagagagggaggtacccagcggggagagaggtggggaaggagtcataaagaaagggaaaaacagggggccaggacttccgtgactacagggctggctgaatagatcagggtggagggcttcatctttgagactgaaggaatgcgtcccctgagccaggaaggagggaggagatggagcaagtagacacaggtgatttgaaatagaaaggaacattaagagggctgaaggattgtggcctgaatgaagaaagaaggaagtatttatttctggagagtaaaagtggtaggtttggggttttagatttgagaaagggaaaccatttagagtatctgtgtgggaaatgggccaaggaattagaaatgcctgccagagacctctgcaggatgcaggaaggacccagataaaaacgtctgggctccaagtcgacagattctgtgaaccccttaggcatgctgaggatttccttgccagatgatgtaactatctgaggatgtttctttgtgagctcagtgctagacaggcacaggagcagtattaggatggaaacatttcttaattgcttgaggagtgaggaaaaaaacggcactctgcaataaccctcttgtttccaaataccaaagcagctgttgggctgtgctcctgtctaggtaccttttcctcaggagttaagtgccacatgatgatatttatggttgctttttagggggtacatggttttttaattagtgaagaccgagtagcaatagttttgttttgtgttctaatagcctttgttattatagtcagggaggtgaagtgaggagatgatagatgctttcctaatctgtgaaatgaggagttggactaggcaggtgctccccaaagtccctttctaacattaccattttctcatccaactccagtctacgctgcctcctctccatttcctcctttaccagacagtttagtgtgtctcaagttatattttatggtgctttagatatatatatgtatatttttgcttagagacttcatgcattattattagagacttcatgcagtatgtagtgactgtagaaaaatgaaagatgtatcgataaataaaagacctgttaaaaatatgtaactttaccaccattaaataaccactgtttatattcttccggagatttttttttttaggtgtgtatgcctaaataagattcttaaatacagaaatgcaccctgcttttctcagttgaaaattataaacctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagacagatgaacatcttttcatatgccatttatattcctttgtgagttttctgttcatatcctttgcccatttctccagaggggtatttgctatttttgttactgacttgcagcaacgagattttaaagatttaaaatttttaaatgtcttttattataaaagtatgttagttgttttgataatttctttgaatttttatactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataaggggatgtaaaggaattgatctagataagttagtttacttaggcctcagaacctggcctttaatcatctgtgcgcaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacgttttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgacttgagataggaattaaaattaatttctttcccaaatgaatagccacctgcaatttttgtagttcttgtttattagagagtccttactcaaagtatagtccttaagcactattatattgttttttctttcttctgtttgcttttctctccttgggtagtcctttgtgcaaaacgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatatggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttatattttgtaaaatgtcttaagatacaatgaaatggagaatccctgagtgtttttttgatttcctaaactctgatccacaattatagatgtgtctgaaggttcaaaaatattgaacgtgatttcagttgtttctagaatttaaaaaaattaataatttttaataatgacactttaaatgaggagaaggcttttaaaaccaaatataaaaatctggagagttcagattccctgtctctcctctttcaacctttaatgtataaaacaaatccttttgattcagccactgtgtattgataatggcttatttattacaatcagaggaattaaacaaagatatgtagatactttgtcatcttttcttattatagaaacagtttgattttaagaatttttattcagaacgcagattcgaaaagaaaaaaaagaatttttagaaaagttgccttttaatttaaatttcttgttttgtcctaataatcacattgaaatagccaaaacaaataatataaattaaaatgcaacgatggcccggcatggtggcacatgactgtagtcccagctactcaggaagctaaggccagcagattgcttgagcccaggagttcaagaccagttggggcaacatggtgagaccctgtctctacttttaaaatgtggtgattggtacctgttgagagaagggttaactgaaagttattcacatggcccagaaagtggctgaaaagtgctctttctggtgtgaatttctcttgctgtgaaagcactctgaaggggagacctaatgccattgcaggagcacttcagctccaaacttgagcgttgcaatcagaacaagaacccgaggaaaagcctgcaaaatgagcctgctgcgatatagggtgtgcttttggacagttatacataagaatttttttcttttttcttttttcttttgtttgagacagtgtctcactctgttgcccaggctagagagcagtggcgtgatcattgcttactgaagcctcaaattcctgggctcaagcagtcctcccacctcagtctcctgagtagctgggactgcaggaatgcaccaccacatctggctaatttattttttgtagaggtgaagtcttgctttgttgcccaggttggtctcaaactcctggactcaggtgatcctcctgcatggacctcccaaagtgctgggattataggcatgagccactgtgcccagcctcatgagaagatttatgatgatagatagaagaattattaatttccacagtttgacaaatgataacaaatagcttttacagtttgagcatcccctatcccaaacgcttgggactagaagtatttcggactttggacttttttgaatttgggaatatttgcatatacataatgaaattccttggggatgagacacaagtctaaataacaagttcgtttatgtttcatatacaccttatatacaaagactgaaggtaactttatacaatatttttaataattttgtgcatgaaataaagttttgaccgcattttggctgtaacctgtcacatgaggtcaggtgtgaaatttccacttttggtgtcatgtcagcattcaaaaagtgttggattttggagcatttctatttcagatttttggattaaggacgttcaacttgtatgccaaattagtaaatattttttgagttcctacccacatccctgtgtatgggctctagaagcagccatggtttagtttcctcacctgtaagggagggtgtagaacttcttttaatgtacatcactgtaggttaagttcgggtagagaaaagactaaaggcaaccaaggctggctgtcctctgagcccctatgctaagctgaactaggcttttgtttctggcaatggatcattttgctgtcacggagccagtgattatttaccacccctggttttgagtaggtttccttttcccctggcaatagctcttagagtgtttcacagagaggcaacgggattcagaagatgcccgtttacactggtaccactgtctcgttatgtcatggtaaagtaatgaagtccaccatcattactttaccagttccccattggtgttttggtcttccctatacattttttttaacttttatttatttttaatgagatgaaattcacataatataacaataggcagtttaataattgacaattcagatgtatttagtacattcataatattgtgtagctgccacctctctctagttccaaaacatttttgtcactacaaaagaaaaccccgtacccagtaatcagtaacacactattctctcctctctctcatccctgacaatcattaatctgctttcagtctctatgaatttacaattctagataccacatgtaaaataaatgttctcatacaatatgtgaccttttgtgtctggcttctttcacttagtatattcatccatgttgtaatgtcttagccattttatggctgaatagtccatggtacggatatatcataatttgtttatccattcatctgttgatagatttttgattttttccccaccttttaattcttatgaataaggctgctatgaacatgggtgtgtaagtacttgagtccctgttttcagttcttttaggttcatacttagaggtgtaattgctgggttatatggcaagtctgtgtaacctttttgcaaaactgttttccacagggccaaaccatttctagtcccaccaacaatgtacaaggttccaatttttccatatccttgcaaacatttattttccctttttaaaaaaattatagtcgtccttgtgggtataaagtagtattttattatggttttgatttatattttcctaatgattaatggtatttatctttccatgtacacattggccatttgtatatcttctttggagacatgtctgttgaagtcctttgcccatttaaaaattgttatttgttgttgacttgtaagagtgctttatatattctggatactagacccttaatagatatgtgatttgcacatagtttttctcatttttaaggttttctttttttttaatttttatttatttttttttagacagagtcttgctctgttgcccaggctggagtacagtggcaagatcttggctcactgcaacctctgtctcctgggttcaagtgattctcctgcctcagcctcctgggtagctgggattacaggcatgcatcaccacgcctggctaatttttttgtatttttagtagagatggggtttcaccgtgttggccaggctatcttgaactcttgacctcaggtgatccacccgcctcagcctcccaaaatgctgggattacaggtgtgagccaccacccctggcctccctatgttttcttctaagaagttatgcttttattttttatacttaggttgttaattcattttgagttaatttttcatatggtatggggtaggggcccaactttattcttttgtatgtagatatctagttttcccagcaccacttgctgaagagacagtatttccccatttgaatggtctttgtacccttgttaaaaatctattggccatatatgtgagattttatttctggactcttttttctattggtccatatatttatccctatactagtactacaccgtttttgattactgtagctttgtagtaagttttgaaattgagaagtgagagttcttcaacttttttcttttttttagtgttgttttggctatttggatccctttcagcttcatacgaatttaaggatctgttttttcatttctgcaaaaagggctgttggagttttgataaggagtacattgaatctgcagattatttggagtaatattgtcatcttaacaatattaagacttccaatccatgaatataggatgtatttccatttatttaggtcttattcttcagcagtgtcttgtaatttccagtgtgtaagtcttttgcctcctgtgttaaatttgttcctaggtttttttgttttgttttgttggttttcttttttttttttttttttttttttttttttgagacagtctcattctgttgcccaggctggagtgcggtggcacgacctcggctcactgcaacctcctcctcctgggttcaagcgattctcatgcctcagcctcctgagtagctgagattacaggcgcacaccactacgcccagctaattttttgtatttttaatagagatagagtcttgacgtgttggccagactggtctcggactcctgacctcaggtgatccgccctcctccatctcccaaagtgctagaattacgggcatgagccaccatgcccggccatccctaggtattttattctttatatgcaattataaatataattgttttcttaatttactttatgaatgatttgtatttattattattatttttttttttttttgagacggagtttcgcttttgtcacccaggctggagtgcaatggtgcgatcttggctcaccacagcctccacctcccagggtcaagcaattctcctgcctcagcctcctgagtagctgggattacaggcacacaccaccatgcttgactaattttttattgttagtagagacggggtttttccatgttggtcaggctggtcttgaactcctgacctcaggtgatctgcccatcccagcctcccaaagtgctgggattatagttgtgagccaccacacccggcaagaaatattatttttattttttaaaaaataatctctagtggttattttaaaattcaaggtaagaaccccactattcctccaaatattctgtagagtggtctctgttaagtttgatatacatccttctacatgttttccatgcatttatatacaaacatactttcttactgtgaataaagtcatatactttgtctaaattttaacttactattttacataattatagattgtgtctttctctgctagtttacttatttctcttaaatgctgcagagtaacccatcatactgatatgctacgtagctgacccttgaacatcatgggtccacttatatgcaggtccacgtgcaggtctgcttttatgcagatattttcaacccaacatggattgaaaatagagtacttgagggatgcaaaacttgcataaagagagaattgacttttcatatacgcaggttcttcagggctggctacagaacttcagtatgtgaggatttgggtatttgcaggcagtcatggaaccagtcctccttgtatatcgagggatgactgtactttgtttaaggctttattttaatgatcatttagtgtggtgttggtgttttatagtataaataatgcaacagttaacaattttatacccacatcaacgtatgtccatgtaagtctttaaggtaataagaattgctgaggcaaaaaaaattaccttaaatttttttaaagttttgtgttaggcataacacataatttactatcttaactgtttttttaattgcacaattcagtaatgttgtttacattcacattattgcgcaaccagtctctaaaactctttttcatctttcaaaacaaaagcgctatatctgttatacaacaactccccacccccctcttcccctggcagccattctactttctgtctctgtaattttgactattctaggtacctcataagtggaatcacacgctgtctgtctttttgtggctggcttattttacccagtgtaatgtcctcaagggtcatctatgttgtaacatgtgtccaaatttcattcctttctaaggctgaataatattccattgtagcatcacattgagtaattaaatgcttggaaagaaagaagaaaaagaagggtatgtctgactcttttcattcccatacaatgtggtaacatacgtaataatctaaatagaatataaataaataaaatgaagtccttttaggtatgtgtatgagctatataaacaggtatttttaaatgcattgtggatccaacttcatattagtaggtgaggaaacaactagtagcacataaatgcttcttgggcttcttgcacacttgccctccatacacctcacctcatgcccaacataactttcattatccctccacccattgctggcagtcatttttaaatagctttggattttatgccaaaagatcttctacttgttgacagattctgtgaatacccagtgttcgcttcttttgcactttccaagaaagatgagtttgggaatttgctaacatgttctaaagttaaagctttttgttctgggataactgaaaagtttagttatccaaaaggcagcccaccttcatttttcaggagggtcactgtgatgttctgtctttctgagtctcatgtctcatacctttctgtgctctgtcataattaactaaagcagaaggagggagatccttttgtaaaatgcccaaagaaaagaaagccagatggaagtgaggagtaagagtaaccacagttgctttcctcttccatcagtctttaaaaactttttattttgaaataatgttagatttagagaaatgttgcaaaggtagtacggggctcccatacccttcactcagtttctcctaatgttgttatcttacataaccatattgaactatcgttaatataattatcaaaattgggaatctaaattggtctaatacttccagctaaacaacagaccttactagcattctatccagttttccgctatcctttctttatgttccatgatccaatccaagatccacattgtattgagtagttctgactctttaaactcccacagtttgtgacagttccttgtcattccctgtcagttatttctggttagttattttgtggaatgactagatttggggctgtctgatgtttcctagtgtttacctttaagttatgcttttttttgttttgaaagaagaccacaaaagcaatgatgtatcttttttattgcctcataactggttacttgatgtcagtttcccttattgctagtgctattcgtgtggactcatcatggacagttacttcattctgtgggttataacccaatattatcatcattattttcttcttcaaattattctagctttggccactgggagctccttcaggctgactctgatgtccttttgacatgcttccatcttttttcaagtacttcctcacattatggcatcccctgatgctctaggctaatcttgtattttccttgccctacttttggaatcagtcacttccctaaggagcctgggtccttttactggacaatggtgtttagaaaccaatatctgagtaccagacgtgcacattgcaactggggtggctttttgtcttccatgagttttatggtgagctctttcctgtgaacatggttgtaccaggtctgaaactcgtttttaacacttctaggtagtcagtcactttgatgtaaagtcattttgatcacttaatgttgagttgttaaaatcaatgcacataccctgtagaaaaataggttctttatcaatggaatagattaactttttgtggaaaaatacttttacattgataggatagcattagcatccagacatttttgacattccttcaataactattcctgagtttctgactctcatttttagcccattccatttttatttattttattttattttattttttgagacggagtctcgctctgttgccaggctggtgtgcagtggtgtggtcttggctcactgcaacctcccgctcctgggttcaagcgactctcctgcctcagcctcccaagtagctgggactacaggcatgcaccaccatgcccagctaatttttgtatttttagtagagatgtggtttcaccatgttggccaggatggtctcaatctcttgacctcatgatccgcctgcctcagcctcccaaagtgctgggattataggtgtgagctgttgcacccggcccccattccatattttaatgagaatatcttttggttagttatagaggtaaatacctggatttacaatgtgtaactacagattcatcatcctataataaagtaactctttttgcataaacttttgataagttatttttgtccttataattttatgtgtgaagtctttacggtcagaggacattgacaaaatattttagattgaaagcctgttctccttgatgattcagtataacttcttttgactgcgcttttagttcttgcaaaatagatcttgtttagatgagattccagcatgactcctttgtaatttttcatatttttgctattacatctcaactcttgaagagctatttctgtgaaaaccaaacatgcagtcaaggcacattccacgtgtggctgatggggttatcatagttacaaatcatatttatccacagtgataattatcttccttagcgttttgttctacttcagagctcatttgtgggccttaccacctgtttcttacatatggggaaagagtctcttattctcttttggaatatagatctaagagtagatttatatcaggatttgaaagatgaatctttttcaaggatgtttttcctctggaccgtggcattgtgtaagaaatttccctactcatcccatccctggggcacattaatttggagatgatgttaaatgtgtcagagtgtggcacaaatctcaactggcagataaagcctagtattgaattgttttcagttcagaaacgtggctggctgactttgaccctgaatgtgtaaattatctttgcagcaataagaacttgaagtagctttgatagctaatcatagtatgataactcagccagaagaattcactaagagcagtttgtgtgtcttccatctaatgtaaaggttagtaatgtaagtcatattcttggtgcctttagacctagttatgcagagagacatcacattgacattcagtaattcttactcttaacagttccttaactctaaaatcatctttttccttacctttccctagttctagaacagcaaaatattttacttagattctatcattaattaatatactcgtttgaatttttctcttctaaaaaatgtaggccaggcatggtggctttacacctgtaatcccaggactttgggaggtcgaggcgggcggatcacctgaggtctggagtccgagaccagtctggccaatgtggcgaaacccaccccgtctctactaaaaatacaaaaattagctgggtgtggtggtgtgcgccatagtcccagctactctggaggctgaggcaggagaatcacttgaacccgggaggcagaggttgcagtgagccaagatcacgtcactgtattccagcttgggtgacagagcaagactctgtctcaaaaaaaaaaaaaaaaaagtaaaattattttggccttaccatgcttggtttctttgtctttgttttttcattcactttatgtttggggaggagaatggagtgtcagtgatttcagcaaaaagttggggtaccagttcataataaattagtgtctaagattaatgttacagctgatattcaaagtaccaaatacgttattgttctgattattctggtccttaaatttgtctctttcctggagacgtggtaaacaataatgatgattctaataatgaccatttattgaatgagcactatgtgtcagacattgtactggtgatgtggtttggctgtgtgtccctacccaaatctcatctcaaattgtaatccccacgtgttgagggagggacctgatgggaggtgattggatcatgaggatggtttaccccatgctgtcctcctgatagcgagggagttctcatgagatctaatggtttaaaagtgtttggcagtttcacccttgcacccatgtctctctctgtctctcctgctgtcatgtgaagaagaggtccttgcctccccttggccttccaccgtgattataagtttcctggccgggtgcagtggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggcaggagaatcgattgaacctgacagatggaggttacagtgagccaagattgtgccactgcacttcagcctgtgtaacagagtgagactctctcaaaaaataatgataatagtaagtttcctaaggcttccccagccatgcagaactgtgagtcaattaaaccttttttcttcataaattgctcagtctcaggtagttctttatagcagtgtgaaaatggactaatgcaattgggcaatgtctgacagtttgcaaataccatctcatttgtttttaatagaaacctcctgctgagagtggtggctcacgcctgtaatcccagctctttgggaggccgaggcaggcagatcacatggtcaggagtttgagaccagcctgaccaacatgatgaaacctgtctctactaaaaatagaaaaattagctgggtgtggtggtacgcgcctgtaatcccagctacttaggagactgaggcaggagaatcacttgaacgtgggaggcagaggttgcagtgagcccagattgaaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaaacaggcagagagcatcaggaagggcttcctggaggagaaagtgcgtacactcagtctttaagagcacgtgggaggaaaaaccagtgaagtcctcctgctgtagacagaatgatcagcctgggcaaaggtgtagaggggtaagagagcgttaaacatgaggcagctgtgtaatattgtttcctgtaatctcttctgtacaggtggagaggtagcaagagacccaaatgatgaatggctgtgagtgccatgccatagcaaaattctgggttttaaaagagaataagcatgatcaggctggggatgttgaggaggggaaagaagggggatagagatggagaccacccagtggcccgctctccctcagtgctttggattatggggaaatgaacagagagccactgtgcccagattttattatgggttgagcagtgatcaagatgggagagagaaatggtaatgggactaactggcccatacaccagatggcatttgaggggaaggccgggtctgtgttgtcagggggccctgtgttctgactcccttcccattagaataggtggtgattaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggggcggtggctcacacctgaaatcccagcactttgggaggccgaggtgggcaaatcacctgaggtcaggaattcgagactagcctgactaacatggtgaaaccccgtctctactaaaaatacaaaattagccgggtgtggtggtgcatgcctgtaatctcagctactcaggaggttgagacaggagaatcacttgaacccaggaggtggaggttgcagtgagctgagatcccgccattgtactccagtctgggcaacaacagcaaaactctgtctcagaaaaaaaatatatgtgtgtgttttataaacctataaaatatgtgtgtgtgtgtgtgtatatatttatatatttatatatattacatatatatatatgtttagaaaataaaagatgcagtatgtcagtgctttcttatgacagttgcagctacaaaggaagattaaagctttttaaaaagtagaatttttatctgtttgtggagaggactgaaaccagtaagctcttgaaatgttttcatcctctcatcaaatatatatggacctgccatatgccaggtactgttcttactactgtggaaatagcagaaaggaaaaacaaagtccctgctctcagaaggtttagaatgagataaggcaggctactgagttggcttaaaaactaagaggaaactagtgaagtgtagttgcccgttcacatttttatttttttaagtattttatgcccacggaaaactgtgggactgggacttgaattctaattttatgttttcttgggttattctttaaaacagggtcttagactagtaattaatacagtgtcactctctttcaccttcctcaattcctttgcatgcttgttaggtcattcagagtggcactaaggtaaactttggcatatcaaaatccacttgaaagcagatggttagcaaggggcagtgacttatgcctgtaatcccagcattttgggaggccaaggcgggtggatcacttgaggtcagaagttcaagaccagcctggccaatatggtgagaacccgtctctactataaatacaaaaattagctggtgtggcgacgcacacctgtagtcccagctatttgggacggtgaggcaggagaatcgcttgaatccgggaagcagaggttgcagtgagccaagatcgtgccattgcactccagcctgggcgttacagcaagactccatctcaaaaaaaaaaaaaaaaaaaaaaaggagatggctatgcttgttaaacactgtttcagttgagtacctctcctgtgggcttgttggttcttgtgcagattcctgctcctgcccaagtccaggactagctgcacatacctgcacatgtgcctcacccagtccaggacggctagccttgttctcttcacccagcccagcagcagagtgctaggaaactttgctggcagggctgtaagaacctctgtagtttcttcccatttccttgttctcctaacttactatgctgggaggaaataatatggtgtggtaacgattttaggcaaagaaaaaaagcgccgaaatggatgtggtggtaaaattaggccaatcttttggaagcaccttagcaacctcctttcatgttcttggtacctttacctggttgtattgtaatgttcatttttccttgtgaacatctctctgtgtgtgtgtatgtgtataatttatctagtaccatggaatctttgaaggaaagactaaaaaactttcagaattattattattattattattattttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgaaaactttcagaattataacaataagtttcatttgttgtatagcacattctacgtgaccatagaccaactctcctttatcaatatttgtgtattctcttaaagagctaaaagaaatcattttttaaaaattctttatatctaatgttggccaatgttacctataagaaaagatcattgtttcagagcatgtgagatgaagatgattgactttagggcatttacatgtgggaactgtcaaggtagttgaagtttacaagagtgggctctctctctagtcacttcgggaggaatgccatcatcaggacatcatcacgactgactgatttggtcagtctgtctttcatcaagtcagggagataaacagaattgaaaaattgttcacaaaggttgtcagttattagggtgtggctgacgaaccacacctgaagagctacctagatgaaggcaactcacagagttacttaacaacctccaccccagttgatggtccagagtgtttccaagggaggtgaactaagccaatgttgagactgagtgggataaggccatggtgacatgcataatagatgcattcatacacattgcttcaatagagcattttcttggatggaagcatgggaaataacacatgggcgtatactcacgcttgttgttagctttcggggtcactgctgatatccttccttgttcagttaccctttgggacttgaactcctgcaagatcgttgaaaatcttcatgttctcagaactcaaagggaagaagacttgacccctaacccttcagaaagctggctgaaaaaaaaaaagattgtccataaatagcaattggctttacctagtattatttaccacattattaaactgctaattgcagtggtgtttttataatgccactatattattttaatttagaaaacattttataagtttattgtttgtaaattaaatagatttgcttaacagttctttgggaattccttaaactttattgctagctacaagtcctttttaaatagaatcaataggctgggcatcgtggctcacgcctgtaatcccagcactttgggaggccgaggagggcggatcacctgaggtcaggagttcaaaaccagcctggccaacatggtgaaaccccatctctactaaaaatacaaaaaattagctgggtgtggtggcgtgcacccttagtcccggctactcaaagggctgagacaggagaatcatttgaaccccaggaggtggaggttgcaatgagctgagatcgctccactgtactccagcctgggtgacaagagtgagacgctgtcccaaaaaataaataaataaaataaaataatgaatagactcaatagacattgatcctgctaacatattttgccttttaatctattggtacttcttttattccctttaaagttaattctaaataaaggagaagtatcttaatttggttaatatcatagtttggaactatggcaaaattattttttctcaggctactttctagtaagtattttatatttattcactaaagaaaatttttaaaatttcaaattacgtagaattgtaccactctcacatagaaatgtttttatctttcttatacatatatttatgtggtttgatttttatttggaatgcttgttttacttgaggtgtcaggactttccactcatttatgaagcctttacaattataatgataaatactgttacattaatgtacaataatttataaaactgactttctcatgtttaaaatttagatcgtgtctaattctttgctactttaagtatcattgcagtgaaatcttcaggccataataagttacttccttgcgataagttcacaggaataactagattaaaggtatgaatacattttaatttggttgaacacttacgtttatcaaaaactctttacaaaagtaacacaattatcctaataaattagaatattagaagtatataagatgaaaaaacattctcactgaacttcagtcctgctctccaaagtgaaccatgatgagaccttaagcaaatgttatatataatgagaaaagatagtcctgaagaattgagtgatatggaagtgataatggtgtactatatgggtgaaaaaataaagtactggtttagatacatgatttaagaaatagaatcctgacagttccctctgtggataagccatagaggtgtccagtgttggtttaatatagcagctggtttgaccgagtaccctctgctgcgtcaggtaatgttaaatgatgtccatgcccccttgactctgatcaagacatggctacaacctgcagtttccagctttcctgggtttaagggccattgaagaatccttgtagataagagaagaattgtacattccaggaactggaggcatagctagccttggaaagctcggagggttagttgagacagctttagacttgcacatctgtgacctgagtatctttgagacttgatttcatcttctagacccagaggcagagatcatgtttgtggttatttttctgggaactgagactgggcaaagggaaagaggccagtacgcaagagtgctgtttataaatggttaacatcgtccccagtcccgtagaagaagaatgaaatggtattctcctgtttggtggttttatttgattgtttttgaattctttgtctctgacagaaggcatcttctgtatcctttatgttgtcactcactttattactctggcattattataattaggttaccttatcactccacctgccagccctatctccatccccaagacctgaagggacggttggcttgacatgtgaggaggttttttggccttcagagatgtcgctgtcagccccctgagttccatttgttagtattgggtccagcccacagctttctactaaaaacaacaggcaaactaaagaatcttttagtaagtcacagacaattgtcactgaaccaagagcccagcccacggggccagttcctcaccgactctatgccttaatttccaatgtgtaagcttggatgactacacttatctccaggattcagtgtaggacatagaaaaaagtacaggactcaagtaatgattgaacttggaataaaaaccttaaggcccatgtcctctgtctctcatgcttttcagatgtgtcttagtgcctgctccttgcacagaagctgaatccaaacaagccactgaggaagttacatttcacttcacttcttaataacataggtatgtcgatcccattagataggagtgtgtctaaaattcagaacctttgacactaattatctgactgtcaaatgacagtgtcattctattttgcaggcatttttgatagtttatcttcccagtaatatttttgtaatcttcatcaccttgaccatctaactcttttttttggagacaaagtctttctctgttgcccaggctggagtgcagcggtgcagtctcagctcactgcaacctccgcctcccgggttcaaccgattttcctgcctcagcctcctgagtagctgggattacaggcgcatgccaccacacccggctaattttttgtatgtttagtagagatggggtttcaccgtgttagccaggatggtctcgatctcctgaccttgtgatccgccagtctcggcctcccagggtgctgggattacaggcgtgagccaccgcgcccggccgaccatctaactcttatgtgcccttgcctgtacatataaaagtacatttaaaaataggattggctttcatttgcataatgaacacacatattacccatagtacctcccacacaaagccacctatgcctcttaaattgcactttgttaataggaaactatctgttgttttgtgcttttggcagctgtagagaaaatacacaaagccaggtgttgtggctcttgggtaagactgagaatgtgatttttgcaatctgtgtttttttaatagccagttattggagataagaaagagaaattcagtacaaagtctaagatgtcccagtgatgcactctgactgggtgtcattatctcaacaggaatgaatgtagttcaacagtatgtaggcccggtttcttagacatgatgtctgctgaaatggtgataaggtatcccacattatcggtgtttttttgaagacagcctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtcccttcagctgaagaagctgcttagaaatttaagccggacatctcaggcggccatactggaatggaatgtggaaaaggtagcagttatatgtgagcaatacctttgactgtgacactctttcgaaccccagtttagaccagcagcagctctcctaatggggagtcaagaagtagtaagagaccctaagagtcatataagacacaaatcacctttgcctgtgatatttgccatacatatgcctatggttacatgcagaggatcccaacaggagcatcatacacacagcaaataacactaatgtgttttatttatatgtaccaaattaaaggggcatacaaaataaaatttttaaatgagtgggtgaagatattgggacagaaggaagatatcaagaggaggaaatatggagtaaagatagaggtagcatgtactgtaaaagatcttgtaagtagaccagaataggccagtaatttggctccatgcttcctagcagccaaggcaaagaagtaattgtgaccagatacatagttcacagcatctttaagattcagtaagctagcaactcaagaaaagcacaagtagtcaccatatagggacaagtggaccatgctgtgaacagcacactagatagcaagtacagctgtaacaatcgttgctggagatagagcagagcttcagtcctttatgacaagcttgtccaacccatggcccacaggctgcatgtggcccaggacagctttgaatgcagcccaacacaaatttgtaaacttcttaaaacatgagatttttttaaagctcataagctatcattagtgttagtgtattttatttgtggcccaagacaattcttctagtgtggcccagggaagccaaaacgttggactcccctgctgtatggaaaatcgaatttgtttacattctcctgttgtattcatttttgaaattttgctaattcctaaaaggaatccacagagagcaaactctctattactaacttttttcctcttctcaatgtaaattaagtagtatttcaaatgagattaaaaacaggatacttcttgaactttactttaaaaatacaggttcatgagccccttaagttttgtgactttctgttgtaaaaaagactgtattcactagatggcagtgtcaccagccttttgggaagttaaatatgagtgtgactgtcctaagtactaaacatgggtaaaagtaggaagaccatttaactgagcataaaggatctcatttctgcgccctacaggaaagagtagttctcctttttctcctcccctcttatttgaggccgggaagaaggcgctgtgcatagcgctccaagcatctctgggtggcactggagggccatttttcacaaggagcaagtcggccagcagagtgctcagttcttggtcatgccagtggctgcagggtttccagccacttgtccttgcttctttgtttctgaactttcagtccggggcaggagttactgacaagagttcacaaaccagctgtgagataatggtgtattgataaggtacaaaagtgtgtttagcagatggggataatttttcgaccctcagtgtttgtttaaattgtttctagcatgaaagcaatatgatctctctcaggaaatgagattgttttctctattcaggtaataggatcttttacccatttccatctttgaggagtgattatatacttctgcagtttttttaaatgaaaaagatttatttttaaatcatactggcataaagttaatggtattttgttaaattttaggatttttacagcatatcttggctgacactgatcttggtcctatcctagtggcaatctcttaacagttgtgctgctggtgttatgagtaggacagttcctcattgtgtgggactgtctcgtgtgcggcagggtattctgcattcctggcccttgcccactaaatgccggaagtgcccctcagacatgactgcccagtaacactcccatgcatttccgtgtgcctcctggggtggggccagtactctctagtgttgaaaactgctgggctagagattttggtgtaggttgtgggccttgtggatttagtgaacatgatcttttaaagaaatgtatataaatgtactttatatttttaaaaaatcactacagcccatcaccttaaacttctgctcattcatatttatatatgtattctgattgtgattactcctacatacaattcttaatatagtacaaaattgtacatatataattttatggtacccatcccccccctgccctttttttgagacagggtctcaggctggagtgcagtgatgcaatcatggctcactgcagcctccgtttcctgggcccaagcaattctcttactcagccttccgagtagctggtaccaaaggtgtgcgccaccatacccagctaatttttaattttttgtagagggtctccctgtgttgcccagactggtcctgaactcctggcctcaagcaagtcctcctgcattggccttccaaagtgctgggattatagtcttgagctaccgcgcctggcatagtatcatctttttgataccaacatactataaatatattttattgcattttatttgaaactgttaatagacacataatttgctgatgaattgtattctttgctcttttagtccatctggcatcatatgctcttcctttttgctagaattccctctttttttctttctacagaagtatcactgggtgggagaaagccttacctgtgatggtttgagtacccacattttaaaattatgctagttaagaagagggggaataatgttgtttcttttctctttttcttatcaaatagactaaaaaggctactcaagggctggaatttgattcccacttgttcttgtggtacctagcacagagtcagtcccatagtatatcctttaggtaaagacttaattaattggtgtgctttcagtttattttccctggttggtctttgcatttgtccagttaacaccagcttctggatattagatcaccataaagtccaagacatgaagaacaaatgttatatattctctttgacatttaaagacagaagatagtggtagaggagatcccaagtgatacctaacctagctaaagacccatgaggaatgaaagaacgaacagggaaaacaactgctgaatccaggtggaaaaatgctggcctacttctggtccttggtatgccaggatccaaaggtggtgccagctgatagcatatgttcaacagctgtgttgatgccatttgcctgcccagacaagcctcttgaggcatgaaagcctaaggaaggtttctcatattaaggatcaacagggactcttctgtatccgtcctaccagtgtcacctccccacccagcatcagccgagcaccacatccactgaagctcaataaagaaatgtttaatgctgaagagtttcaatcaacaagatgaaattttcaggtttaggtaaacttaggaactggcttgggttactagacttccaaattttatccggtcctaccttattgcatgacataaccgtgaggactaaagtgaaggcttttcagcagtcacttcagtgagtcctcagcatttaggtgatactgtatcaactcgtgtctgaagcaacttggatttaagatagtagatcttgtgctgattattagaatggacatcctgaacaccacttaaattaccatcaaactgcatagccagatctttaatttacgaaacctctattttgtcacttctccaagctgtcatttaagctaaaagctgctgtctttacacatataaatcaaagaaatatttcatttatattcacttgatacctaccaaatttcaccactggaatttctgaatactttatatcctctatccttccatccaggcttggctttactaagtgtcctttctaagccactcattatcaatcaagatagtaattattctgcaagaccccaaatctcagtggctttcaacaacacacactgatttttttactcatatgctacacgtccattatttgtcagctgcagctgtgttcagtgttgacctcaacctgtgatggagcagcctctgcttatgtcgctgctgttctttatagcagaggaaggaaagaaagcaaggcaaagttccacactagcccttaaaacttcttcctggaagtgagacatggtatttctgctaccacttcattggttaaagcaagtcacaatgccacacccgagttgagtgagggtggggatatgtgattcttccttaggaaggagcaggaaattttggtgaatagtaatgtaatctaccacatgtttaaaatgcagtcccttctctagaagatctcagtagtctaagagagaataatttttttttaatatactaccgtaagtgaatgttaggtcagttaggtcgatttttttttcattcttgcaaggaatcattatgtctaataaaatataataaagagtttatggtatatttgaactgtccttaatgttattttactgagtccagttcttttggcagtggtttagtttctttaacaatctgtattctacaacttcactcgttgccttccttgtttaacatttatttttcaaaaccagacatgtcttttgtcttcaaaggataaatggaattggttaggagaaggattggggaggaggggggttgtggcaaatgtctaaaacctatgttttattcccttattttctcaaaaatgttagctcatgttcacacgggtttatctgtttagtctaagaagtagttacttttgctgtctggccaaagaggttcaggaccctggagctttgttctttgggaccctgaaggcagcctggcaggcagagcccagtatcacctttacagctacttgatggtgatcaagagccagctgctcttctttcacctggctgttgggggaggcacaccaatatgggtgggcaggaaaagttacttcccaggctgaaattttcccaccgtaaacttaggctgataggctgacagtctgcacctctcttcctcagcagacattccgatcagcaggccagtttgtgacgcgtgcatgtgcacacttcagattgcttcttccactttcctctttcctgctcaggtttctcataggagtaggctccatgtaagacttctgtcttttgtgaaaaagaaagcacgtatttatagaatggaatttcttactgaaagagggtgcgggcagaatggaggatgacatgaatcctgactcagtaacatttatggaaccactctctggatgccacacttactgtgggcagttaccaaaaaaatcagtttggcctacctgcctcctaatataatttaccctgcacacaaggcagtatcttgaaggttatttcagtagtacccacggaattctgcttcctttaggtaaggaaaagtattcccaagaacaaaatatacaggttaaagcccatgtaatataaaattatggcattcattgaagaaaatacaggctattctaattccagatcacatttatttatttatttacgagacagagtctcgccctgtcacacaggctaaagtgcagtggcgtgatctcagctcactgcaacctccacctgctggttcaagcaattctcctgcctcagcctcccgagtagctgggactacaggcacacgccaccacacccagttaatttttgtatttttactagagacagggtttcaccatatcggccaggctggtctgaaactcctgacctgaagtgatctgcccacctcagcctcccaaagtgcttagattacagtcgtgagctaccatgcctggccccagattacatttttaaaatgaagaaacagatattttctcttagtcaaaatacttatcggaacaattttttttaaagcaaagattgcatcatttaaaaaaacatattcactcctaggcatctgaatcactgcttcacatgcacagtagacattcgtgaaattatttttttaaatgatgatgaatgccagggcttgctttttttaaaaaaaagtctccaaccacaacatccaaactggtcatttgggaagtgatgcttccattcagtaagaaagctcctgcacactgggtgaacaggcggtgttttctcctctcatcgctgacatttaatacctgtcttgaggcaaaattgtctccaccttattaatccatggctcctcacgagccttaaaacagagaataaaacttgtcaaagaagaaaaatagaaaattagagaaaataacctcactacttattttcaggcaccttgtgacttaagaaaatgtttttaaatgtggactctacattttatgaacttaaatttagtgtctgttggtcaaaatccacaggacctttaggagagaaaatggccataactaagtacaagcctctctttttaaatgcttacccaggtcagttaaaagcttccttgtagttctgaatcctcagttcttgctttacagccaatacttaaaaggaacaggggagagctacagtgcttttgaatttcagagaggcctcttatttgtgcctcaagaatagtttgtataaatgttatatttcaagccacacagtacttaaaaccatcacactgtttagtttatctagttgggtagaagagggggcaagagaacaaagcagtattaaattagggcagcagcatcagggacaggctgatgtgagagcaccttctttcttgggatgggtagagtataattgtccctttgcctatcgtcagatttgggtggcccagttgctttaaattttgaaaacatgggagtattaacgcaaagaagagccaacattagttcagaatagctgaattcatcattcttttggaaccagttttgctactgtataatgataatagctcttcagcattcatctagtgagtgataaagataagtgatgatccacaagaaagtttacctttgacttgtgggtgctcacggactgcagaatgcagatgttcgtagatcagccgtactgtaattttcaaggatttaatatgcaatacattcctatattaagatgttgaaacattaaaatattaataatttgcaatgatttttaaatactttaaacaggctcttccactggtgagattgtttttccaagcagagttagctagtttaaattctttcgttgtggctgggtgcagtgactcacgcttgtaatcccagcattttgggagtctgaggcgagcagatcacctgaagtcaggagttcgagaccagcctggccaacatggcaaaaccctgtgtctactaaaaataagaaaattagcctagtgtggtggtgtgcgcctgtaatcccagctgctagggaggctgaggcaggagaatcgcttgaacctcggaggcagaggttgagccaagatcacaccactgcactccagcctgggcaacagagcaagactcccatctaaaaaaaaaaaaaattgttttgttgtattctcagttgtctatttcaggtctaggcaggcaagaaaactttgtcaggtacactggtgtcttccaaaatgtgcatcgtaccctctattactcagtgtcattaatcacatccattcctttcccaccctgtcttggaataggacattaactcttcaacgatctgccccctaaataaaacctgctttcttgggccatagtaaacaacacgtaattctttgcgagaaaagcaaaatagtgataattataatttttttttttggaacggagtctcgcactgtcacccgggctggagaacaatgaatggcgtgatttcggctcacggcaacctacacctcccaggttcaagcgattctcctgcctctgcctcctgagtagctgggattacgggcgcctgccaccacacccggctaattttttggtatttttttagtagagatggggtttcactatgttggccaggctggtctcaaatgcctgacctcatgatccagctgccttggcttcccagagtgctgggattacaggcgtgagccaacttttaaaaattaaaaaaatttttaaaaaccaactttttaaattttcaaaaaccaattttaaaaaccaatttttaaaaagccaacttttaaaaatttaatattggagcataatagaattcagcaatataagatttgattgggaataagaaataacatctcttttaaaaatgactacagccctcttaacaattttactcttaaccaattttggggtaccagtttactaattgatcaaattccagattggaaattagtcatcatttgattaaccagagttaagcctcttgaatcaaattctctaatttattatctcccatctgatctaaattcttttttaggggataaattgccaaaacgctttcagaatgcccagtactagaaatctaagctattcaattcagtctcttctctgttttcaggctcctttcctgaccctttggagaacctaatatatttagctaaaaatttttctttggggcctcacctaataaaggtaaatagaaaactgatagctatcacataacatacatattggttaataattgcaaccaaaagtaaattaataattttgagctatttatattagctctgccaaaattacatcattaaatttggccttatgaagcattgctgactgtagtaaaaacaagtgtgagcaaagtcttcatatgcactgagtctggtttcagttccacgtaatactgacttggcaagtgtggaaattctcatgtcatcattaccaaaaaaaagtgagttcacacagggatttctgatcaagtgacccattactgcgggaaaaaaccacacatacaaaagcctttgaccccagtaattttgtattggtatatttaccctgatcttaaactgcaaggaatgtccgcaattagagtttttctttgttttctaagtctgaaacttgataatccatttctgccttcccatgacgagtggacattcctccagccagtggtgagttcctctttccttcgctctcagcaagagcatgggttgccctcccatctcgtaagcagagcctaccacaaacgcagctcaaatctcagtttccagccctgcttactcactcgcttgttcctgaatccccacattacccatcatggcatcttactctgtagacttcacatgtgaactttgccctcgccggtggaaggggtacagtccagatgggagatgaaatccaaatgctccaccaaagggctttggtttgttctggggagccctggtgctgccgaagcctcttgggaaggaaggagggaagaggagaagaaaagatactaagtttggttttcattaaaaatttttccaggttttctttaaactgataggttcagggtctttttcatacaacagtctacttttagagcttttgttcgtttgttgtgtcatgggaatttataagggatggaaggaaaagggggacaaggaatggtctaatttcggtcagtagaagaatacctgaaacctgtttaaatttatttggaactaatgacttctacttttagtatccataaaagacttcccttggagcacaaagaagttaataatctgtgtatattgtcacttcatgctcttcttaagcgctgtgtgttggggcactgctctaggtgtggtgaaagactgctacaggataaataagtcatggtcactgccctggaaagaagcttaaaatccagtgggagtaaatgataaatgcataatgacctaaatgtcagatggatctagtacgtacctggaggattgcatagaagcatcctgacaagggtgccaagaatacgcaatgggggaaaggacagtctcttcgaagaatactgttgggaaaactggatatccacctgccaaaaaataaaattggacccttaacaccatatacaaaaatcaacttgaaatggattaagacttaactgtaagaggccgggtgcagtggctcatgcctgtaatcccagcactttgggaggctgaggctggcggatcacaaggtcaggagtttgagaccagcctggccaacatagtgaaaccccatctttactaaaaatacaaaaaatgagccaggcgtggtggcagcacctgtaatcccagctaatcgggaggctgaggcaggagaatggcttgaacctgggaggcggaggttgcagtgagctgagatcatgccattgcactccagcctgggtgacagaccgagactccatctcaaaaaaaaagaaaagaaagacttaatggtaaggcctgaaaccatataatttctagaagaaaacacaggggaaaaaagcttcttgacattggccttggcaatgattttgttgctgttacctcaaagcacaggcaacaaaagcaaaaacatacaagtgggactacatcaagccaaaaagcttctgcacggcaaaggaaacaaccaacaaaatgaaaaggtaacatacaggctgggagagaatgtctacaaaccatatatctggtaaaaggtcaatgtccataatatacgagaaactcgtacaactcaatactaaaataaaaaaaaaagtggaggtggggcaaaggaccttaatagacacttttccaaagaagacacacaaatagccaacaggtaaatgaaaagatgcttgccaggtacggtggctcatgcctgtaatctcaccattttgggaagccgaggcaggtggattgcttgagtccaggagttccagaccaacctggacaacatggtgaacccctgtctctacaagaaatacaaaaattagctaggcgtggtggcatgcacctatagtctcagttacccattagactgaggtgaggaggctgaggcaggaggatcacctgaacccgaagaggtcgagactgcattgagccaagatcatgccactgccctccagcctgggcaacagagtgagattgtgtctcaaaaaaaaaaaagaaaaagaaaaaaaaaagaaaaatggtgcttgacatcactaatcattagagaaatgcaaatcaaaaccacaatgagatattatctcacatttgttaggatgcctgttatcaaaaagacaaaatataacaagttttgacaaggatatggaggaaagggaacccttgtacgctattagggtgaaaattggtacagccattatggacattggtatggaagttttgtaaaaatcaactatatgatccagcagtcccacttgtggatatatgtttaaaagacatcaaattagtatgtcaaagagatatcttcacttccatatttatttcagcattactcacaatagcaaagatatggaaacaacccaagtgccatttatcttaggaatggttaaagaaaatgtggtatatatatacaggatagaataatatttagccataaaaataaggaaagcctgccatttgcaacaacatggatgaacctggaggacattatgctaagtggaataatccagacacagaaaaacaaatactgtatgatctcagttatatgtagaatataaaaacgttgaatccacaagccaagagtagaatggtgattgtcagggtctggggcatgggagaaacggtgagatgctggtcaaagggtacaagctttcatttataagatgaatatgttctggagattagggagcgtccttagtcttttccctctccatgcagagggtaactatgtgtgatgacagatgtgttgattaatttgattatgggaatcaatatgcaatctatatttatatcaaataatcacattgtatactttgaatacgtataatttctattaattattcctcaataaaattaggaaaatcagaagcatcctaaaagttgcattaaaaacaatgatgaaaacaggccgggtgtggtggctcatgcctgtaatcccagcactttgagaggctgaggtgggtgatcacttgagatcaggagtttgagaccagcctggccaacatagtgaaaccccatctctactaaaaatacaaaaattagtcgggcgtagtcattcctgtagtcccagctactcgggaggctgaggcaggagaatcacttgaacctgggaggtggagggtgcagtgagctaagatcacgccactgtaccccagcctgggtgacagagcgagactctgtctcaaaaaacaaacaaaaacaatatcccctttaaaaacgcaatgaaaaaaatagctgccttaccaagccaccagtgagagcccatctctgaggaaaaggggtgtgcagccggacaggcttcagtttaaaagcttaaaccttgacttggacttactttatgccctgagcaagctatttaacttttttgttccttaatttctaaattatgaaatggcagtggaatgaaatggaagatgaaattgtgccttgttcgatgccctggggtctgaaaggtgctcctaagggtgtacagcagttagcaccgttagcgtcctgggcaaacccacagcccgcagatctcttatttggcagcgaattcctgcagatcagctctaagagccagatttcctcatggaggaaaagactgctactgtcacgggaaagatttgtttaaacatattttttagtacagttttataagtccttatcaagtagggccagcccccagataaaaaccgttaagtatttatctgtaagccagaggttgagaataggaaacatttgaatctttaagaacttgagtccaacaaaaatactggctaacagcctgactgaggtgaaataaaccttgtttccagttttccagaaaaattgtttattactgggcaaatcttgggcctccaagattgcctatatttttgtttttcttttctcttaatctacaggaaacttctgggttgggccttctcatagttatccgttgttaaaagttctatatttctacaaaccttcttgtgcgaggagtatctggaaaaaaaaaacaacattgagatcactctttaaaaattagtgttttagacaggtttctggttttctctgctttgttaactgaaacagcccccatagaaacattctgaaagacttaatcaaacaagtattcagaataaaatgaatgggaagaagttttgagtctccttgatcaaacatggacctgtgctttaaaaagctgagcccctgagtttgttgcactgtgtacttaaagtctgtgacagtttagcctctttctaggctgcccatatctctcaccactcggttcatttcccggttttaaccactccccacggtccccagatgatcattttcatcctgagcctcttattcccaccttcagtcacttcagaaactcccctgcactccattcaactttctggacctcccctttaatgtttgccatttgtgcattctacagctcggtgcacttgttttctgacctcaagagtcaggagaggagctatcccagcttcaattcctcatcaataaggtacagaaaatactctctaggattactgaagaaatgaaataagcaactgtattttaagtattttatgtactgtaaaagcattgtgcgtccgggtgcagtggttcatgcctgtaatcccagcactttaggaggccgaggcaggcagatcatctgaggtcgggagtgactggccaacatggtgaaaccccatttctactaaaaataaaaaagttagccaggcgtggtggtacatgcctgtagtcccagctactcggaaggctgaggcgggagaattgcttgaattcaggaggcagaggttgcagtgagccgggtgacagagcgagactccatctcaaaaaggaaacaaaaaaaagctgtgccaataaaattatacttattattctagatacaaatattctgaatgctcctttagtcagattctgtgttttctgttttgtttttgtaattttcacttaggaggaggctgtacataaatcaagcccttagtaaatccttatttagtgaataaataaatactgccaacatctggccccagccctatttggcctcaaatttctgagggctggttaccactattgctgaaaatagaaaaggagaaacaaaaaacaaaacccaccaattcaggacagaatatatttgtgcttaaacaagcacacagtactctcacatccaccctcggtctccctgaaactcagacctgcaaaactaggatacaagctgtaatgacatgatgctttcacaatagcagattgaagttagactccagaagacagctttacagtgtgttaaaccagatagaagacaggcggctgctattggtgttttacactggtgtacatcggtgcttctcagtctcttcacattctaactcattccttttggtgttctgtgtagctattttggtctttatttcatatttatttgatttgctcttttcttgtaccctttattccaagggggaaaaaaaggtgggggttggacaacagagaatgaacagcacagaattcctttccttaaatactgccatcctgggaaatctagaatcatgaaatgtaagatacagattgtgccctagatcctcctgtcctactcttcattttatggacaagtccatccagaaacctgtgatggatgagggcagagcctggaagaaccccagtctccattccctcctccttctccctaaaccacaaagcctgatttgagtacccagggctacccaggttggaaatagaagtcctcatcttctgcccaggatttctcactcctagccacagagcttctgccccctcctagccacagagcttctgccccctcccactggaagcattgtgcccaggagaggacctttttctcttatctctgctggtaagcttgattatcaggatattcctggggacctagaatttaatctcttctccaaagctgctctttgatggtgttgagggtgtttttgccagtaatgaacaatcttcttgttttgaagctgccttttatcttgtttaatacattgtaaagttgtcttctggagtcttcttcagtctgctattttgaaagcatcatgtcattccagctcgtatcttggttttgcaggtatgagtttcagggggaccagagggtggatgggagagtgctgtgtgcttgtttaattaagcacaagtatatcctgtcttggattggtgggttttgttcttgtttttccctttctattttcagcaatagtgataaccagccctcaggaattttaggccaaatagggctagggccagatgctggcagtatttatatattcactaaataaaaatttactaagggcttgatttatatacagcccccgctaagtgaaaattacaacaaaaaaaaaagaaaaacacagaatctgactaaaggagcattcagaatatttgtatctagaataacaagtataattttattggcacaatgcttttacagtatataaaacacttaaaatacagttgcttatttcatttcctcagtaatcctagagagtatttcctgcatcttattgatgaggaattgaagctgggatagcttctctcctgactcttgaagtccgaaaacaagtggacggagctgtagcactaagcctcagcctgctcgtcttcaacctgctcctggctgcagagtcttgattgactctgcctgtctccagtgtgctttcattcccttcagtgggtaacttgtcagacctcatcttgtttttgagactttggtttctgtcttgccttcttcctaactttggtattcttagttccaaatcctgaataactcctgtaatgggcctcccagtagggggggttcctgtatttatattcacagatgtacgtattttaatagttaacatctgaaatcagtatacatcttaaagttgccatggaagttcatttcttcagtgtctgcctctgctcgtcacttgaggtgctggtaaactaagaccaaagtttagattccctgcttgagggcacttgaaccacagtggtggtgagttcagaatgcaaatgagagtaactactgacttaggattcaaatcttcaggggagattcctcccctctctgcccagttcccaggttgaaacatccaaggctctttgccatccctttctgcatggcgggtttctttgtggccatttggttccctggattcaagtggtccctgatacctgttcagtttaccatcttgggccgggcatggtggctcactcctgtaatcctagcattttgggaggtcaaagtgcgcagatcacttgaggccaggagttcaaaaccagcctggccaacatggcgaaaccccatctctactaaaaatacaaaaaattagctgggcatggtgatgggcgcctgtaatcccagctactcaggaggctgaggcaggagaatcacttgaacccaggaggtgaggttgcagtgagccaagatcatgccaccgcactccagcctgggcaacagggcacaactgtttccaaaaaaaaaaaaaaaaatcccatcttgcatgcttttcctttctctgtagtatgtaaaataatgtatgtttgtgatcagtgagatctcagatctgataaaatgcagtgttttgtcatgagagttgctcccagccgctgatggggttgccttgttcagcactttttagcaccaggggagtaagccatgttcttgctccccctccctcaggctgaggctttgcttgatcacctgctaagacaaaaaccagagtgggtcacgagtcactctctctcttcccccagccacagtggcagctgcctaacttggtttcttgctggtgcacacatgtgacagaaatacaatgttaataaatatttctacgtgtaatggagaaacaagccataaaagtagctgtttgccatctgctcagatacattattaggaaaggcaatgacattttatgattcagtaacttaactattctcctgccttctgtaaaggcccatcacatataaataaattataaacatccaaacacatcctgagagaagtgcattggtctctgaagcagaaacaaatgatacctgattctcccttctcccagaggagatctcaaacaactcagttacagtgcctcacagttgtaacctatagtacaaacgtgttggagatataacaccttgtatacgtatgtagagagaattggcataacaaagtagagaggagaattagacgaatgggcaccccaatcagtgattcagggagaggaccatattttaaacagcaggcaatgactcatttactgagtgttttctgtgtgtcaggcactgtactacgcactttgttcatctataagtggaagaatgcttgtttttcaagaacaaagggaataataagaataaaagtgaaggccaggcgcactggctcacgcctgtaatcccagcactttgggaggctgagaaaggccgatcacttaaggccaggagttcaagaccaccctggccaacatggcaaaacgctgtctccactagaaaatacaaaaattagcagacgtggtggcatgtgcctatagtcccagctactcaggaggcataggtgggaggactgcttgaggctgggagttcgaggctgcagtgagctgaggttgcaccactgcattccagcctgggcaacagagcgagactctgtcttaaaaaaaagaaaaaaaacgagttggggggcaggcacggtggctcacgcctgtaatcccagcactttggaggctgaggcggatcatgaggttaagagatggagaccatcctggctaacatggtgaaaccccatctctactaaaagttcaaaaaaattagccaggcatggtggcgggcgcctgtagtcccagctactcgggaggctgaggcgggagaatggcgtaaacccgggaggcggagcttgcagtgagctgagatcccgccactgcactgcagcctgggcgacagagcgagactcagaaggataaaaagtaataacctgaagagtagcttcgtttcaggtggaaggtgagagaggctgcagaaagcttagggctgggcgcggtggctcatgcctgtaatcccagcactttgggaggccaaggcggtcagatcacctgaggtcaggagtttgagaccagcctggccaacatggtaaaaccctgtgtctactaaaaatacaaaaatttagccaggtgtggtggcaggcgcctgtaatcccagctccttgggaggctgaggcacgagaatcacttgaacccgggatgtagaggagctccttgggaggctgaggcacgagaatcacttgaacccgggatgtagaggttgtaatgagccgagatcatgccgccacaccctagcctgggtgacagagcaagactctgtctcaaaaaacaaaacaaaacaaaaagtgcttagtcaatatctggttgttgattgtttaaggaaaaggccaagtgagggtatgactggttggtagaaatatgtatcttggtataagcagttctaggagtgatatgtgtcttttgctgctgttattgttgtttctgttcagcgttaatacgttttgcattgtaccacaaatatttccttactcctttgcctttgagacaaagggcatgagtttataagttgagttgaaaatagattaaatatatagtacagcctatgcccagcaagcagaattatctatgcaagttatgcagcccacacggaaaaagaaatgctgtgcggcctcattagcaccccaggatttgtggggctccccctgggcagccttaaccaggaaaatttcatagtctccttggcattccatccaagatttaagacttctcctttcatctccttgaggaccatcaactatacccttgagctcagccatcccacgcactgaggcttatctgtacttccagcccagacctccctcctaattccccactatacctgtgcactgaaacaccctcttaggatctccttcttccacattcctcctcctctaggcaaggcaagtcgttttcctcatctcagccagagcagtagttactgaaaactaacccaatatggtggcttctgagctcaggtgtctttcagtgactcctgctgcttccaaaataaagtccaactgtttagcttggcatgcaaaacctgtagtcatccatcccttgcatatttaactcctcacacaccccattctgtggtctcttcttccctttgcatctgctctgggtgctctttgaagactgtacttcctcccctttggggccaatttagtcatctttaagcctcatttcaggggtggtgtcctcagataacccttcttcacataccagtttgggttatctaccgctgtggctctatagctctcagctcacaccaataggataagtatttaacatactgttaaattacagtatgccatgataacttctcttccatcattctgtattgcatgagtacaaagactgtgtcattaatccctgtctccgtagcattgtgtctagcctttaacagtcacttaataaaggcaatgaaaaggaaataacatttgaccttcaatttaagtttgactaggtatggtcaaacgttagaaagtggcagtgaacttcttttgaagtcagaattcatattttcctttaacatcagatattggcagccagcttttccagattttcttggccaaaaatattactaaaattgcatgcccctagattttgatatctaggatgatacatctacagcatgtaattatttgtctcaataattgagctttaccttagggctctaagagaagaggttaaaggaatcagtggtttagtaattgtattgttaatcttaaaatgaaagttgaatggaaaatattttaaaaactggttaagaagataattattgagagcatggaaaagataattactacatatactgtaactggtgaagatggaggttttatgaaaaataaagcagcttgtaattttttacaacttctttcaaatgcaccttggactgccaaggtgagaggcaggggaggacattttcattccgtggagtcacactgaggatttatcttgtaattgattatcacattatctgctttgatcctcatgagataatgagagtggtgttttgttttgttttgtttttctttgagatggagtctctctctgttgcccaggctgtagtgcagtggtgagatctcggctcactgcagcctacacctcctgggttcaggtgattctcctgcctctgccattcgagtagctgggtttacaggcatgcgccaccgcacccggctaatttttttttgtagtcttagtagacacggggtttcgccatgtttgccaggctggtctggaactcctgacctcaggtgatccacctgcctcagcctcccaaagtgctgggattacaggcgtgagccactgctcccagcctgagagtgagtgttttagcaaagcaaaacggcagaggtaacatggccccctccctccacatcttatgaggtttcctaccattttctgtccaatcgtgactttttctacactcacttttagtgccccataagaaggatatttaatgaaaccttttatggactattgataagaacccaacccttgaccgggcgcagtggctcacgcctgcaatcccagcactttgagagccgaggcgggcagatcagaaggtcaggagatcgagaccatcccggctaacacggtgaaatcgcatctctactaaaaatacaaaaaaaattagccgggcgtggtggcgggcgcctgtagtcccagctacttgggaggctgaggcaggagaatggcgtgaacccgggaggcggaggttgcagtgagccgtgatcgcgcccctgcactccagcctgggtgacagagcgagactccgtctcaaaaacaaaacaaaacaaaaaaaacacctttttttgtcttgccattcaagttacttccaacagtgctaccccttctcccaagactcttaatgtagtctgtctgtccatagcattgtatccagattcctgaacctggcatatgagctctcaataattcattctgactcatctttccaggcttactgtttaaatatgttttatttattaatgtttgagacagggtctcgctttgtcacccaggctagtgtgcagtggcatgttcatagctcattgcagccctgaactcctagactcaaagggtgttcctgccttagcctcccaagtagctgagattacaagcacatgccaccacacctggctaagtttttatttttagtagggacagggtctccttatgttgcccaggctgggcccaactcctagcttcaagtgatcctctggcctcagcctcccacagtgctgggattataggcatgagccactgcactgagccataaatagatgcaagtcaaaatccaagaaaaccttgaaacaaattgccttacatggtaagaaaggtttatctttttcataagttcagaaatgaacttctggggttaattaatttgtaattgcccaattgcacacacaaagccaattcactgagactgtgatattgcagtaaagaaagagtttaatgaatgctaggccagcaatgtggaaaatggagttattattcaaatcaatctccccaaaggctcagagagttagggctcttcaaggatagtttggtgagcggaggacttagggaatgggtgctgctgattggttgaggatgaaatcatagggatgtgcaaaatggtctaatcctgtgccacctcacctgcactgagtccatctctggacttccttggttgagttatgagtcctggctcccggtggggtcactcggttgcctgaatgcaaaagtctgacaagcatctcaaaagactaatcttaggttctatagtagtgatgttatctataggagcaattggggaagtcacaaaccttgcaacctctggccacctgacttctgagcagtaagagattatagaaagtatgcttacatgttagcagaattcaggcccctcccattattctagtcttgtggcctttattagtcttacaaaggcagtttcagcacctgaacaaggaagggaatgagtttcagggagggactgttatcatccttgtttcaaagttaaattacaaactaaatttctcccgtggttatcttagcccatgcccaggaatgaaccagcctgtgaggccagaagcaagatggagttgaaccatgctagatttctctcaatgtcatcatttttgcaaaaggactttcagatttagtggcccactgatatcattaggggcccaggttcttattgtcacttcactctgccatccactatgcactggtacatcctgagacttgctctgcctcttggcaaaatggctacagaagtgccaggcatcacatctagacagggcatcttgtggctcttgtaggagtaaggaaacatttccagacgcaccctagagaacatcttacatttcactgaccaaaaatgagtcacatggtcctttacaaaccaatcacaggtaaagggaatgccgttattatggtaaccagcatgggggaacaggtggagagtcaaccaccaggactacagggcttccttttctccctttgtatgtccctcttccatcctgacctcatggtgaccctaaaaagtctgtgcctgcctaccaccaaacctgctctctgcccctctagattttaggtacccagccccccaggcctatacccgagttcgctttgctccatggaactttccttgcgcactccctgttctacccctttgccacctgtgtgaaggtcatatctctctagctggaccctgaggtcctttggggcatgcctgcgctgctctctattccttcatgtgcttcgtagagaaccacagaccctgactttatttgtgcaaaccttttccccaaaatgctaagactaataccacgcacagatggaagtactcttacatcctagtcatatcagccccttgagactggagctagtcttcaaaatggaataatagtgttccctttttattattagaatagtaagaattctatatgagtagaataagaaaaagttaatgtggcattcacaatttattaatgtcccttcatccatttacccacattcctttttattcttttttttttttttttttttttgagacggagtcttactctgttgcccaggctggagtgcagtggcacgatctcagctcactgcaacctctgcttcccgggttcaggtgattctcctgtctcagcctcccgagtagctggcggtacaggtgcacaccactttagtagagacaggtttcactttattggtcagactggtcttgaactcctggcctcaggtgatccacctgcatcagcctcccaaagtgctgggattacaggtgtgagccaccgtgcctggctttattccttcttaatgaggcacaaactcagtttctgcgtggtacatatagcctttagattttcatagttttactgtttttctgatattctcagacaaataaatggttgtacatcagaattattggaggagctttcaaacaatatgcctatccaagtatcaattaaagattcagtttcagttggcctgggttagggcctagggtgtttttgtaaaagttctcagggattctagtggcggccaggttgagagctctgctcttagatctttatatgcagaactctcctggctgagaattatcagaataatttcaaacttttcagagctcttatccagactgctgccatatattactgcttctcatattagcactgctgatcatgcagggtatgtcctggtttcttttgtgtttgatggctaaatatccaccttcccttttatctttttcctgcctggattgtaaacatctcatttctcttctgttccacagcattcaggacaatattaaagagatcatggaggctcagtcagttcccatcaacagagtccgaaacgttgtccacttcataacttgctgggcattctgtcctgtacacctttaaacaaccttcctggctgggtgcggtggctcacacctgtaatcccaacactttgggaggccaaggcaggcggatcacgaggtcaggagttcgagaccagtctggccaacataatgaaaccccatatctactaaaaatacaaaaaattagccagatatggtggtgtgtgcttgtaatcccagctactcaggaggctgaggcaggagaatcgcatgaacccgggaggtggaggttgcagtgagccgagattgccattggactccagccaggcgacagcgcgagactccgtctcaaaataaaaacataaacaaaacagaaacccttcctttaggcccagagagccaacctttccctcagagactgtttttaaaccaagccactttagactttgccagtccttctgtagtcccctattcaaaactttgtttatacctttcaggaatattttatctagtactttattgatttcatccagttatgtgccccttctctccattttttgacagtttctactttattccactcctccaacaactccttaatttctgctgtatcagcagagcctctcctaggtaattggaagagttgtccttctctcaaccctattctttctcaagtttgctattcccaggtcttctgttgccttcaaacactaccaagtagtctcattatctattcacaataatgatgtgaaagcttttgttccagcatttgttgaatgttcattttttctctggcctttcatcatctgtgacagtactttgtttagaaaatggagggtagggtggcacttgtatagcccattttgtatggttcaacattcatttcattgtgactaatgatgactgatagctgatgtcataagtagtgtttcttgcagcaaagtttcataaattttagcatgcatcacaatcacttggggtacttaactcaagtacgtattgctgggacttaccttcagggatatctaagtcaccaagtctggggtgaagcctgagaatttgtatttctgttaagttcccagatgatgctaatgctttatctggggaccacacttgagaaccactgtcctatgggatcaagaaataagccaggaacgagtgtatattttttctagttaaatatttaatgttaagatgtttagaatttttttagggaggtgcttgtcagatacttttcctaatagtgggtactcagagtatttcatgtgagactaccaatgtcatatattttaaaaactattagactgggacagatgggaaattgccttcagcataagaaaagccaatatttttcataagtcccaaaagcagcttttggggttggttgattcagtggttcaatgaaaccatcagagactctggttcctactctttattccactgtgccatggaccatgtgctggtacatcttcagactcactctgcatggtgacagaatggctgtagaagtgccaggcatcacatccaggttacatacagatgcacactgtttaatagccaagcttatgcagtatcagtaactattagagaaactgaaatggaggatccagaacttcttatcaaatataatccttaagatacaaacaaagcagtcattgaatagtttcttagcccattttctgtggcttatgatagaattcctaaaactgaatggcatataaagaaatttatttcttatagctatggaggctgagaagtccaagatcagggggacatgtggtaaacgccttcttgctgataccagtaaagcctgctgagctggagtgtcacttgaatcatattcgccacttttgctttctcttcctacatgggtcctgaggttttgctctcatcatcatcttgcctttcagtaaggtaactaacttgttaccctctgctatgtcagagagattgtttgtttcaggataaacatataaacagagtttcagataaatctcttatttcctggccactggggctcgagttatattgttagcaccagctctgtaaagtgcctcaatgtgttttttcaaccaaaggcaaaatatttggcaaagaatatgttggttctttacctccaggttctgggcaaactttgagtttccattcttttgagatagatggactttgttgtctttcataaacttgttaaatttgcgatctgcccttgaagaggcacttggttccttctaattcttttctgtagattcctctgattctccatcagcgtatggaaattttctcttctatcccttccagagaattattcttctctctgccattcaatttgactgtgttactgccaggaagagacagataaaagggcatcagcaatgtcgacaacttaggagtagttcattcctttttcctatggctgagcaagtggatttgactgtacttatttttgtgtattttaatatgttcacctgagcaaagtcagtgatctagaagcttcataaaatgaatagtgcataacagaaatcacacctcagtgtaagtcttaccttcctacaggagtcccataaaaacactcttaggacatgctttccccccacacatctgattgctgaacactttgtttcactaggcttcaacaggtctcttcaaagctgtcattttacttcagctgggattacattccaccctatttcacttaaatatacaccttccctttaattttctctcattcttatcattggcagtaatcagtgtggcaagagttcactttcttttcacatggagatttgatctttgattattttatttttatttatttattattattatttttgagacagagactcactctatcacccgggctagagtgcagtggcacgatctgcaacctcctcctccctggctcaagggattcttttgcctcagcctcccaagtagctgggattacaggcacacaccatcacacctggctagtttttgtattcttagtagagacagggtttcaccatgttggccaggctggtcttgaactcctggcctcaagtcttctgcccacctcggcctcccaaagttctgggattacaggcacgagccactgcgcctggcctgatcttagatgatttaccaaacagtgccacaccctctgccttctgtgtgtgtctcaggctgtaagtaaagtctccgtcttagtccattcaggctgctgtaacaaaatgctacagactgtgtaatttataagcagcataaatttattgctcacagttctgaagtctgggaattccaagatcaagatgacagcagattcagtatctggtgagggcctgttcctcaaggatagtgccttctatgtccttacatggcagatgggcaaaagagctaacaagcttcctcaaaccctttgtaagggcactaatcccatttgtgagggttctaccctgatgatttaatcacctcccagaggacccatccttaatgccatcccgttgaaggttgggtttcaaaatgtaaatcttgggagacacaaaacattgagaaccatagcagtctctcagacctcgttgtactcagcttcattttaggataactccacatttgagttaagaaaccaagagtttgtattcccaactctatgcttcatgaggttaaagactcttggcttctcattctcactgctcaggcaggggtagtccatctgaatggaaactcctttttggggggcacacatcatttttattttattttatatttctgagacagagtctcgctctgtcgcctgggctggagtgtgtgatctcggctctctgcagcctccacctcctgggttcaggcgattctcctgcatcagcctcccgattagctgggattacaggtgcatgccatcacgcccagctaattttttttttttttatacagagtcagtctctgtctcccagactggagtgcaatggtgtaatctcggattactgcaacctccgcctcccaggttcaagtgattcttccacctcagcctcctgagtagctgggattacaggcgcctaccatcatgcccagctaatttttgtatttttgtacagatggggtttcattatgttggccaggctggtcttgaactcctgatctcaggtgatccacctgcctcggcctccccaagtgctgggtttacaggtgtgagccaccacgcccggcctaatttttttttttttttgagatggagtcttgctctgttgcccaggctgcagtacagtggtgcaatcttggctcactgcaagctctgcctgccgggtccacaccattctcctgccttggcctcccgagtagctggacctacatgtgcccgccaccaggcccagctaattttttgtatttttagtagagacagggtttcaccatgttagccaggatggtctcgatctcctgaccttgttatctgcccgcctcggcctcccaaagtccagggattacaggcgtgagccaccgcgcctggccaccacttttaaatgtctgtgttgcagtgaaattttaaaagagagagctaaattttgatgtcagtttttaaatagatgctgccaagagccatgttgatagcccaaaccaattttccatttataccagtgatatacttcaagcctgaaaaatgtagtccagtgtgggaagaagccctgtgatggtgagaaatgcagtaagaaactgggttctcccatggaactgataattaatgcaatcagatatgaacagtatgtttaaggatagtctggacatgaatgtgtataatctgtctttatcagataaacaaataaaagtcttttacctaatcgtcgtttcctgagttagaagaatcctccttatcagatacctgctttggtcattggaaggaaagtagaacatccatcttggtggtgatccttgtttcttagtactctgtatatcctttccaagagacaggtttcttttatgaaatggctaagatcatctccaccaccatgaacaacatgcaaatggagctgctgcacaaagtttagggagttctaagcgttgggattccaaggcatattaccctgtactgaagaaactcggaacagaggcatcctcaaatcctaactgcaaggaagcgtagcctgtgtcctttgttgatggaggaatgattcagtgagaaagaacacagtgatttttttctctacctatcttacatcttactctcttgccatttcttgtaacaccttttcatcctgtcttaaccttcagctaccagcttaccctgatcgtaatgacaaggaaattcatacattttggttttttaaggactactttattaaggtataattcacaaaccatgcagtccaccctttaaagtatacgatgcaatggtttttagtaaattaacataatcgtgtaaccattggcataaacaacattagaacattttcatcaccccaaaaaagaaaacccatacccattggcaatcaaaagccgatttcctccccaaccaccacacaccccccagcactaggcaatcattattctactttctgtgtccatgggtatattaaatactgtgttgtaactggagataggatgcccatagtcagaaagcttgagctcacatgaactgttggcttggatttctgtgcggattaaaccagcttacttctgacacggcagatgctgggctttttaacctctttcctcattgtgcttcctgacttgttacctctgtatcataaaagcatgaaaggtcgtagaataaatgagtctgcagaaaactgcgtggttaagttaccccatttgtgttttacaaagatagcggaagggaataacctttgagggtcacatacaaaaagccatttcctcatcctccctaaccttaaaaagtcgacattatttttacagcagcttctctaaattgacttacacttgaacaaactaaaaactacaagaagagtagagcttagctggcaggcctggttttgaacaagtgtttgattttgctaatcttggtagtgcataaggtcacttttgtaaatttcctgtagaaaaattcttggttcttggacacactcagctactagaacagagagatggtttatattttttctatgaattaccagctgataaaattcccctcctttgagtgggagaaaaattcaagccagacaagaacttttgtggcaggtaactcttacttgaaatttatttggatttctagaggcaaattaatttctctctctgtctttcacaataaataggtgcctgtcaccttttttttttctctatctagtgagctgcttctatagatggaagaaagttagtccttccttttggtattttgagagttttatttttaggcctctccttggctgtcttttctccttgtaaagccagtgtcgaagtaatggcaatggtaagtatgcttagcgttctaaatttttttaatgcatgtttattactaagtaatttatctccttttcttctactttatagctccatattaaatatggtggcaccttttaataaaaaagaggaaagcctatttggaaacatataaaaatagcacaggataggtcatttttcagattctggtcagatcaccatttggaaagatcttattctttaaagcaaaagttttgaaccaaggatctgttgaagatggggagtgactctcattcatctccatcttcctttgaaatttcatacagattttttggtgtgtgtttgtgtgtgtctgtattttctaatgagaagatccataactttcataagcatcaaagccactgcctttaaatatctttttgattacttttactgtagttattgttttaagatctgctttttgccatttaaaaacatctttcaaatactagttaactcttaaatgtttttttgcagaataagatcctttttgcagtactttttgttgttgtttaatacctacccaaaattttggtccaagctctaggggcctcctcccgaagaatttggtttaaaagcaaaagatttttaacataaataaaccagaatttgctttttttctttttgatttttttttttttttttttttggtagtgatagggtctctctgtgttgcccaagctggtctcgaactcctgggccaatcctcctgcataggccttccaaagtgtgaggattaccggtgtgagccaatgtgcctagcattgatttgtgggggttttttgttttttttgggttttttttagagacagagtctcgctctgttgcccaggctggagtgcagtgggatgatcttggctcactgcaggctccgcctcctgggttcaaacaattctcctgcctcagcctcctgagtagctgggattacaggtgcctgctactgtgcccggctaatttttgtatttttggtagagacggggtttcaccatgttgcccaggctggtctcgaactcctgacttcagttgaggcacccgccttggcctcccaaagtgctgggattacaggcgtgagctgccacgcctggccttgatttgtttttgcatgtgagaaaatgtatgtcctagtgtagtgtggtgtgtcattagaagcatgatttgttcttaccaatgcagtgattacattggttcttctacattcagtagaatgctaataatgtggtaatgctagtcgccagtcttcttaatctctataacagaggaagcagaagtagagcagatcctatcctagccttgtaggtctagagaccgaactatagtgtcttctgggaaagcacttaaacaaaacacaggtttataaattgttatggtcactaatgtttcagtcaagatggtgactacctatgatttgtgtgtatgtgctacccttttgagaagcattaattagtccgttctctcactgctataaagaaatactggagactgggcaatttataaagaaaaggggtttaattggctcagggttccgcaggccaggaagcatggtggcttctggggaggcctcaggaaacttagaatcatggcagaaggcaaaggggaagcaggcacgttttacgtggccagagcaggaggaagagagaggagagaggtgctacacgcttttaaataaccagatctcacagtaattcactgactcactgtcaccagaacagcacccaggggatggtgctggcccattcatgagaactctgcccccatgatccaatcacctcccactaggccccaccttcaacactcgggattactgttcaacatgagacttgatggggacacagatctaaaccatatcaagcattaatattactattaacctgtgtgaaaaggaactgaattctgctgtgacattttttgtttaagaattaggcctagcaggtgtggtggctcacgcctgtaatcccagcacttcgggaggccgaggtgggcggattgcctgagctcaggagttcaagaccagcctgggcaacatggtgaaaccctctctctactaaaatacaaaagaatattagccaggaatggcggtgtgcacctgtagtcccagctactctggaggctcaggcaggagaattgtttgaacctgggaggcagaggttgcagtgagcggagatcacaccactgcactccagcctcagcaacggggcaagactccatctctacaaaaaaaaaaaaaaaaaaaagaattaggcttagggagtgcatggtggctcacgtctgtaatctcagcactttgggaagctgaggtgggcagatcgcttagggtcaggagttcaagatcagcctggccaacatggcaaaaccccgtctatacaaaactacaaaaattagcaagccatggtggtggacatctgtaatcccagctactgagaagtctgaggcaggagaattgcttgaacctgggaggtggaggttgtagtgatccaagatcataccactacactccaggctgtgtgacacaatgagactgtgtcttaaaaaaaaaaaaaaaaaaaaaaggccttaagataaaaaacagtgaaataaaagaagtcatatttttaagaaatgaaatccctaatgtttaaaaattatttaatgtataaaattatcaatttttatacattagggatttcatttttttaaatatgacttcaggctgggcgtggtggctcatgcctgtaatcccagcactttgtgaggccaaggtgggcggatcacctgagatcaggagttcgaaaccagcctggccaacgtggtgaaaccccatttctactaaaaatacggaaattagccgggtgtggtggtggcatgcacctgtaatcctgaccagccagctgagatcgtgccactgcacttcagcttgggcgacagagcaagactccatctcaaaaaatgtgtatattatatatatatgacttcatagacacacattggtctatacaacaaaaacaaagcattaggaaattatctcatgatttagccacaaaattaaaagatttatttcaacaaacacttattgaatgcttacccatttgactggatgatgcgtaggaataacaagaggtctgaggcatagtagtagacccatggagctgatagtttcagggcagggtagacatctaataaagtctttgtttccttttgtaagtttctctaagtttgtttaggatacctattttgacagccatacagatcttcagaaaatagggattatcaccagacaccacaaggaaataggtggaaaaatatttaaaaataaattgtaagccaagcatggtggcccatgcctgtaatctcagcatgtgatttgggaggccaaggctagaggatcacttgaggccaggagttcaagaccagtctgggcaacatagcaagacctatatctacctaaaaaaaaaatttaagaaaatttaaaataagtaaataaattgtagtaaaaatgtaggttatgtttcttcgtctgaaaataagctattctgaaaagctaagctttcccaatggtacatgagttctctctctaattatatcttctgtattcctctctcacttgaataattttcttttgaaaactttctgaagttatatgctttcagactttgtaaaataatatgttgaacatgattaatcatctctcagttaggttcattattttcaatcatattattgtattgtgctgtgataacaatgtccctagaaactggacagtttatagagcagttcgcctgatcatttttgttttttaagtatctttttttttttttttaaagacagtctctctctgtcacccaggctggagtgcagtggcacgatctcagctcactgcaatctccgcctcccgggttaaagcaattcttggtctcagtctcccaagcagctgggatgggactacaggtgcatgccaccacgcctggctaatttttttttgtatttttagtagagacagggtttcaccatgttggccaggctgctctcaaactcctgacctgaagtaatccacccgcctcagcctcccaaagtattgggattaccggcgtgagctactatgcacaccccttaaacatcattgtaaaaatcacttcccttgctataggaatttggctttgagttactaggccttccagaagccatccccatgactttgttatctggcctaagccataggtggggagtggggagggagacatccaaagttaattagaaccaagtataaatttgccatggatttaagccttctgtataagataaattcatccatagtatttttggattactttatttacttgattatttatttacttatttgattatttctgttctcattaattttctaattatgactagacaactaagttctgggtaagatatgtcattattacgtaatgatgtcttattcttggcattataaatgactatactgtgttgtagttttattatatttatgacatatgagaaataaataataggaactttaagaagactctatcacttcatatctctttggtctctttctctgtctttaacattggtcaggttccaaactagtgaaaactacagaaacaagtgcagttttctagtatagtctttcatcttacgaaaatatatttaatccccactcttttttaagtttcactttgccttaaggggagtggtcttaagaaaactcttagtatagttgtgagtatccatagtgtcaaatgaggggaaacattgtaacaatgttaggagccaaagttctcaccacaatctcatcagatgtcctgagctattttttacttgttaactcagaacaacaaatactaaagaaagtgccaaacaacctcaattcttctggctcacacttatatatagcagagatacgaaatagcccgcaatcccagatcttccatgggtaattttgggaaagtgtttttcatagagatgttgaagtccatggaaatcaggtagaacactaaaggacccggttgacccagtacattgcaaccctctgctctcatgtgcacctcacacacagccagtctacggattagagaccaccatttctgggggttgttatcttttttttttttttttttttgatacagagtcttgctctgtcgccaggctggagtggtgcagtggtgcaatcttggctcactgcaacctccgcatcccgggttcaagcaattctcctgcctcagcctcccgagtagctgggaccacaggcacacaccaccacgcctgggtaatttttatatttttagtagagacggggtgtcatcatgttggtaaggatggtctcaatctcttgaccctgtgatccgcctgccccagcctcccaaagtgctgagattacaggcgtgagccaccacgcctggccagttcttttcctttaacttgtattaactgcatagtagttagtttctctttcttctttctttaataggatcatctcaacatatttaaaaactatgccgtatatgtataagatttgccacctctgggtcattaaatggcatcacagacatagaaatgtaccaattccttttttatgaaatttatccattcatgcaaaagaagtatgataattaaaaataattttgaacattgggtatcctaggctctgagcgcgaggctctcagaaaattaaaatgacatcatcatcgtacttgcaaagcttaaagcccagtggggaagagcaacatgatagtaacaaaggtagagtgtaataagtgcggttgcagaatcgcaggccaaggggagctcacgtctttgagcttcaatttctttatctgttgcgggggagagtatctcatgaagctgttttgaagcttatctaagacaatgcatgtgaaaacactgtaaaattataaagctgcggacatgtcagttgtcatgtttggtttaaaatagaagctgggagactctttattctgaaaccatgtagataatccagggatgagactctagttaaagtgaggaaaacaatgtacttgcatgtcaattgcagttcctgggagaatgtttgtattattaggagactctcattccagaaatcattttgttggcatttatactaagtggcgatgacactgagaacagcacagcttcatctgacatctgacgttattgtcagcctttcttagtacccatggtatgtttttactgtatctcgtgaataagataatatattaagtctcctggcatataaggatatatgtaagatacgtgttgtatagttggtttctagagtgtcttcatagcagtcttccagtatttctatttattgctattccctctccacctctgtttctttcccattagttctttacaggtagggagattatatgtcccagtttgcctgtcctggtttatgtctcttgtccctacatcccatctacttaacattttaacaccctcgaaagcgtcccaatttggacctcaccttatctggtcaccctggctcaaagcatagaagaaaattaaatgaagagccagcaaattagtgaaattgtacagatgtgtgataactgacttcagtcactgagctgagctgatttacagagtgtggatttggtccagtaatatcttggaatgcagcttacagatgtaagtaagtagtgcctgattatagctacacactatagcaggtttcctaatgagctgttaaaacgaaagcatgtgtttgttcactgtggcacagaacagtagctttgacacttcagtagttttcaccatagcatggcttgttggggcttgaagactggcattccttcttaaaggcccatcaaggttttcattcactgtgagctatgtgttaagctggtactgatctcgtttttgaccatcattcacccatggcagccaaccagggaggtgtaaaatgcttttgtccccctgcccacatatgcacctcctttggtgtgacccatgggatgacagttgcgatgcagcttgaaaggatggctctacattgcagcttctctgcgtcatccccgttgcccttttagaatgagaaaagaggattgaaaggttcaaaagcctagagagaaaattctgcagtcctgtgtttttctgagcagagggaaaggtgctacttcgtaagactgcttgcaatccccaatataatagaataaaactgtccctactgccagcattaatatgaaatttgtataaaggtggagggattactttactgttttattaatatgcaatcccaatattttcattgcagggcagcttgcaaattcattgcaaattatgctgagttaaaatcaaatacataaatctacctttctctgttggcagctgtattggagtttgggattggcctctgtgcttattagagccaaagaatgtatattatttaattcttgcaaagtgaaagtaaaagatcaggaaataaagacaaatcaggggaatggaacatttttagtgcgattcctcttttactctccagcaagggaaagtggcttaaagatctctgttaaaacagtgcttctcacactttaatgtgagactcttgttatgtagattcttactcctgggtctaggatgggggcctaagattctgcatttctaactagctgtagagcatgctggtgctgctggaccacaggccatgacttgagtagcaggttgtcaggaagtgtgtgcttcagtgggctgtgactctgcatatccctgttgtgaaatatgcagatgagagtggcacacaccagaccctcaactggcaggaggagctgtgttttagctagaggttagggtgagagggaccacccagacttgtaaagcttaagtattgtccccggtctctttaccagtcttaaggtatccctaacagaggcccaatgttcctgctaatgaaatgaataaagaaatgttgcagtccatggatttgtaattccagtaacggcttattttacatctattaaaggctacaaggaaagaagtggagggaagggctggaagactaagaaaataggaaatgagaagaaatgcacaaaggagagttgcatttcctcctgcttctgtcaaaggaaaaaaagatgttatgtgccttctctttccacctctaaataaagcaacagggccaccactaactagtttgtgtgactatattctggctatttaacctctgctatttcacaaaaagtcctcatctgtgaaaggaggaatttggaatcgggacagttttcggaaccccttcaattgttaaagcatagcgactaagaattttatggtcatacaacactaaaaatcatacatatgtccttaggaatggggttttatttctgtaagagcacctccaaaacaagtggtgtgttaatacatgtgcattttatatttttctttatattctttgttctcttccttttaagaaaatctagtttgtttcattgcttcaaaattcctgaaaaattttctgtctttttatataatacagagttggctgtgttaatttctgcttccatcatactaatttaggaaacgtggcctaacagtggcaggaatagctagaactttcttctgtgacttactggcattttccctaagcatctgcatgtgttgggtgtatgtgtaagtaccatgcattggatacatcctctgttgaaaggataaaggaatgcttgttcgttccacaagttaccttggctccaactctgttccatactcagcctgttctctcaacacaatgatgtcttcagtcttaggacagaagtctggagttcattcacatctctattttgattaattgttttacacatcaggctccatataatgtagtggataatgaaatgctctaagtgagttagggattttcagttcttagacttgtggatgagagaatttcaaaaattatctacaaatttaccaacatagataatgtttgtatgatatacagaggttgagttttataaaatataaattgctctgagccagaaatgaaaaataaatgtagaatcccatgataaaaaactaaagttgctatattaaaattaatagtatactgggatttttgaaacattgttttgaggatgtgtttactatgttcaaagcaataaatttaggaatggaatctagtttcattagccctgctataacattttggagagaatataaattaatacctgctttttgaaggacaacctgacattatccattagaatgtgtaggccctattttcttcatctcacagattcatttcttgtaatttacccatttataattaattattgcaaatatgtgtttggaattattggacaggtacagaaagctatatgtagaagtacattcatcagagtgtttgcagtgtgggccaggtgcgacggtttactcctgtaatcccagcactttgggaggctaaggcgggtggatcatctgaggtcaggagttcgagaccagcctggccaacatggtgaaaccccgtatctactaaaaatacaaaaaaattagccagacatagtggtctgcacctgtaatcccagctactcaggaggctgaggcaagagaatcacttgaatctggtaggcagagtttgcagtgagccgagatcgtgccattgcactccagcctgggcgacaagagcgaaactgtgtctcaaaagtaaaataaagtgtttgcagtgtgaagaaacaatctaaatattcaacaataaaggaaggtcaaatgagacaaagatgaaaggggaatactatgcagccataaaagagagatgtggttgttatcttaggaagatgactataatatgaagttaaaagttacaaaggaacatttgggaagaatgtataggtacatacatgcttataaaaccacaagaaagaactgggaagcaatacaccaaagcgttgatagtagtagaattacggctgattttttactttctctgtcatgcatttctttattgttgaatatttagtactagtacatggagagggaatagaaaacttaatttggaagggatggggaaaaagtagccaccctgggagctgagttagaggagaacacagagcccaggtgtttcagcatctgttccggcgttggcggtgggaattctctgaatagtcctcactgtgccagagaagctttctgcgcacagctgggtcctgtgaggcaagacctgtgtcctgctgactcatacacagcatcccatatggccttaactttatttagcaacgtcagctcaaggaagccttgtgttccctttgggcccaggatttagaagagcataatcatagaatgtctgtcaggcctggaagtgtcattagggctgtcctagtctggacatgaagagtctgaggcccagagcatttaagtaacgttcccagagtcccagaggtagttcgaggccaactggaaatgaaaatgcggttcccaggctcgtggtctctctagtgctactactttgcttgtctccaagctctgctctggtggatgagtctccagttctcacaagcagtttttaaggccagagcaaaaggtttccaggtaagagaattttttttgtcatataagagaagattaaattaataggacttttgttcagatctgcattcagtgagatacatggaaattcagaggttattgactttccttgggtctggcctcttttggatatttaataaaggctgcaaaacctttcccttgaacgatgcaagtttgctgaaaaccacaaaactttgcatttgatttcggaggtttcaagagccctgtaaagcctgtccctgggttctgaatgtcctttgtcttgtgctcccctgttttcaagcagttcttttgcatttggaggtaacagaactgtgatctggtttggttttcatacctttgttgcagatatgttttcttcaaataaaaaagaaggagaggatagcaactaggaagatgaacaagcctcatcacattggatacttagtgttgtctttgtgtttacagttgctgttagattgtcattccaataaaagtaaaattatgtaatactttttaaagctcccatcacactagcacaactgctttcattttttgcagagtgtgccaccctgttcctttccacatggatacttcctggttacagccaaagactgttcattatgccctttcatgcttccacatgaaagacacaaactgaggctgaaattgagtggcttcttaccagaaattaggtatttgaataagagcagatcgtttttacttaaaagatgtaagttttgaaaatgaccacatgcagcagttaacacactgatgactggacttacctgaagagtctctgattcagtagcccgttgtggggcccaagcatttctaataagtcctcaggtgatgctgacatcactggtccacggccagactttgagaaacagtggcccagagaataacagtcttagaaggcagggtgttttccaaattttgctgaagacaagaatcagttgagaatgtttgttagaaatgtaaattttaacaccatgtcagactcactgaatcaaaatctctgggagaatcttggaatagtatattaccagatctggaggaactactattctcttgctatcaggtaagccccatagagtgtcacttgtttgcaaaccactcacaggacaatagaattttttttttcaaacactaactcaaccagaagggacaatgtaatatatttaccactcaatcgtttctcatccattgtctgctttgaccctatgagcccatgagcacctagcagcatccacatttttaaatgaattttaagtcacccttctaagacataaatatttttgtttcaggtaccaatatattgtttgaaagagataccagaatacctgctttctgagaatttcctcaagttttactgagttcctttttaataagcatagtcacaatatgcatttgtgtgtgtgtgtgtgagagagagagagagagagagagagagagagagataaagggaggaaggaaaaagaaatgtggttttctgccaagttcaagttccctagtgatggtgatgctgctgatctcggaacacgttttgagaaccactggaatagaccaataactctcaaatgtagcagttggaatctcctggaggagctttgaaatatacttctgctcaggtctcacccccagagattagttcaattggtctttgatgagacctagacagtaattctaataatcatccagccgggcgtggtagctcacgcctgtaaccccagcactctaggaggccaaggcgagtggatcacctgcggtcaggagctcgggaccagcctggctaacgtggtgaaacctcgtctctactaaaaatacaagaaattagtcgggcatgatggcacacgcttgtaatcccagctactcgggaggctgaggcaggagaatcgcttgaacccgggaggcagaggttgcggtgagtggagatcactccattgcactccagcctgggaaacaagagcaaaattctgtctaaaaaaaaaaaaaaaaaaaaatccaagattgtgaaccattactgtaggttgctccagataaaaggtaatgggttaggaagcttaagacttgatgaggaaaaataaaggttaaaccagtgctccttccacttcagtgtgcatacaaatcacctgggggtcttgctggaatgcagattgattctgtaggtctagggtagggcccaaaatgctgcttttttaaatcaagtcaggcagatgctgctaagattgcccaggggtctacactttgagtagtgaggtggttagaaagtgttgacctatgtaagtgcttatcaacacacagtttttatatatttttacgtagtatagaacaaataaaagcaatgtcattgagatttcagataccttagaaacaataaatattttgccattaatgactatttcccttcccttgatggctaaaacgttttgtttttgcttctccctacctgcttactcagagtttcaatcaaatgtttgtaaattaattttgctttagtatgacacatgtagtaacaggcctttcccctttgtaactgagtcccaggattcacggagtttgaggatcttgccttctggcttcctccttgcctcagaccctgccctttaggggttactgccctaagaggctgaaagtttagtaatgccccagagcctcgttgcaggagctagtcacttttggcactttcttgctgtcagaccgcaggctctgggagccagtcttcttgggacatggcttcatcctgtgtctctggcttgagcccaacctttcaggcctgggttaggggtgaagccttttatctggcaggtcccacagtctggcgcctttcccagcgtggtggagttgagaccttgctgtcagagcctgttcagaaggagagagggagagacaagaccttcgcgtgaggaggaaagagtttaagtcccgtctgtggaatctgtttcccctggcttgttgaattttctcagctgaacatggcagaagtggttgatatttgaattagaggctatgaaagtgtccttgggaaatgggtggggctgagccagtggtcttcccttttgcctctacctcatgctgaccaggggacaaggctctgtctcctgggtgtggcctgtcattggtcagtctgtgaccatactgctattctccaaggcattcctcaacagaatgggatcaggctttttcagtcatttcccatttttaaaggacatctccatggcagatgcccctactccctcccggtgcctgaatatttgcctgtctagcgtgggtaggtgaacgtcagcagaactcttgaagaatcactaaagggatgtgcttgtcctagcaggagagcctgtgacaataaaaaagcagagaatgttctgagtctcctgtattaaaaagggaaaagcttaagtgaggtttatttccactaaaggatagcaacataaggcagcttgacctttagtgtgactggagcaccgtaaatgctacttctacttttttcctttttttttattgtggtgaaaaacacatagcatagatttgccctctgaatgtttaagtgtacacttcattattgttaactgtatgcacaatgccatgacagatctctagaacttttccatttcacatgactaaaatgctgtgctcatcaaacaactctgtttccccctgtgccagccgctggcaccaacctttctactttctgtttctatgactttaattacatgtatgtgtcatagaaatttggctttttgtgattggcttatttcacttagcatagtgtcttcaagtttccattctattcatgttgtagcatgtgatagaatttccttttttgtaggctagataatagtccattgtatgcatataccacattttccttaggcattcatctgttaatggacttttaggttgcttctgcatgttggtcattgtgaataattctgtagtgaacatggggatgcaaatgtctcttcgagttcctgtttttagttcttttgggcatatacccagaagtagggttcttgaatctcatggtagttctatttcttatttttttgaggaacctctatactgttttctgtagcagctgcaccattttacagtttcaccaacaactctcaccaatgtagggttccagtttctctacatgctaccgatgctttgtttttttgttgttgtttgttcttgtttttttttaatagtggccatcctaatgagtatgaggtgatactgtggttttgatttggttctgcctttttaaactccaaattcagtctctggttacagcttttcccataaccattttcaggtgaggtgcgtatgctgcgttggtaacataaatttaacattgtgagagcttttatcaggcagcaaattgtaaagccccttctaggtcagacagttgacctctgtaaagcttaagttaggaacttttatgttcttaataaaacacaagaaaatatgggaaatttccatttggcatgagcctttctgttttcttggtggtggtggtgtgggggtggtataggctctccctaaattgcccaggctggaatgcagtggctcttcacaggtgcaatcatagctcactacagcctcgaactcctgtctcagcctcacaagtactgggactacaggcatgaaccaccatacccagttccattctgctttaaacagtggaaaaaatacatgtattttttaaatggaagggttggttatatcttcaatgtgaaatcctctatgtgaaatctaaataaactattcctggaatgtccagtgtcctttccccgtgatgataaacaaagcccagagctgcctctctttaaagatagtaagaagcctatgcataaacaaaacacttaaaaataagatcatttattttattttactcatccgcttaaacccatcaatgacttttaacttagaagaaaacctagtcttcctactatgaccaacaggactaagcaaatctcataacctagcctctgcttacctctcacttcagcccaacctactctttccctctcttaaaaactcagtagctgaaatatatggagctctttctggccccgagcctccagaccttttaaagaaaaaaaaagattgtaattttgatgaagaccgcattgtcaatttttatttctatggctcttacttttggtattatgtctagacctctctaagccctaggtcttaaagatcttctaggttttcttaagttttatagttttttttttaattttagatttaagattcatttggaattaacttttgtataagacagacggttaagaagattcattattttgactatagataccagattgctgtagcactgtttgttgaaaagactttccttccttttctgaaagagtttttcttttctgaaatgcctttgtcaaaaatcgcataggcacatctgtgtgggtctatttctgggctgtatgctgttcctgggaccatttttaccttccacctttcccctagttaactcctacttatccttcaggtcttagtttcaatgttgtttccgtggaaagacccttaaggaccacccattcctatacatctgcataccctcaacttcagtcctaaggaagggtacctctgttattctcactcaacacctgtttttttctccttcgtagcatttagcataatacgtttataactttttttgtttgtgcacatatagttcgtgcctataagcctcaaaaaggcaagaactgagtttattttgttcaccactgtagtgcccagcactgtgcctattacatgctgagttctcagtcaatatttttgaataaatgagtgaaacaaagttaggcttcctgggggatgttttctaaatccctaggtatcattttcttaaaattagaggatattcttggctcttggagccttagggcataatttttttcccagttaacccatctttgaagatagggattttgagaacttttggcctacctcagggtcacctagcgggttatcaaaatgcagattgcagggccccaaacccagagttcctgcttcagtaggtctgggatgggccccaaaatttggatttctaataagttcccagaaaataatgctgatgctgctgttctgggaacccactttgagaactgtattagtctgttcttgtactgctatgaagaactacctgagactgggtaatttataaagaaaaaaggcttaatcgactcacagttccacaggctgtaaagaagcatggctgggaagcgtcaggaaacttacagtcatggtggatggcgaaggggaaggtggcacgtcctatgtggtgggagcaggagaaaaagagggaagaaggtaatgctatgcactttcaaacaaccagttctcgggggaagtccgcccccatgatctaatcacttcccaccaggcccctcttccagcacggaggattataactcataagatttgggtggggacacaaatccaaaccgtatcaagcactagtgttttaacgttaagaatctgaagaggcccgagtcactgagccgccactgccaaggactcatctcccccttctcccgccaccgcccgcttttgcagccatttccactgaggaaaaacaatcgtatgtccacagtccagaacctccactctttccacccctttgctgatacaagtaagggtgatacctgtcctgctggcactgaggattatatccatataagaattcatccaacagagaaatggcaggaagacccttactactgtccaagggactgctgatgattatgataaaaagaaaccaatgaaggcatttaaaaagaaatttgcctgcaatgatactgtaattgagcatccagaatatggaggtcattcagctacagggtgaccagcacaagaacatgtgccagttcctcttagagattggaatggctaaggacaaccagctaaatgttcatgggttttaactgctgtggctcgctgaagcttgaatgaggttttccttgcaatgagtagaatttcctttctgtcccttgtcacaagtttaaaaacctcacagctttgtataatgtaaccatttgtggtctgcttttaacttgacctagtgtaattccttcatgcagtaaacttgaaagagccatgctgtctagtcttgaagtccctcatttaaacagaggtcaagcagtaggcgcctggcagtgtcaagtctgaaacaaagcaatactgtcatgtttcagccacacctagacccctaagatcatagacaactacgtctggccagaagctcctccgctctccctctgcagagttccctgccctaagagactgtcaccacccgaacaatcctcggtgaatctaagaggagaggatggggtaaggcagcaacagcaactctaccactggaagggagcctttggtggtcaaagaaagatcccctggtgtctataacctgaccaggtgcagagttttagagaggcccccttcccaatagcgaggtgataggacatctggcttgccacaaaggtctttttgaccagacatgccctagctaagggatgtccaaacaccagaatgtgagaccaaccttccatcaaagttaaacctttgacaagggaacaaatctcaaaactgatgtaccagtcatgtagctagctgtagagcttgcaacttaatggcaacagctgtccaatttcatggaaagtaaccaactggttttgaggtttgtttgtttttttcccctccagttttaatgttatgtgtaatgtatttaaaccccttttttaaatttaagttctagggtacatgtgcacaacatgcaggcttgttacgtatgcatacatgtgccatgttggtgtgctgtacccattagctcgtcatttacattaggtatttctcttaatgctatccctcctctcttccccctccccacaacaggccccagtgtgtgatgttcaccgccctgtgtccaagtgtgctcattgttcagttcccacctatgagtgagaacatgcagtgtctggttttctgtccttgcaatagtttgctcagaatgatggtttccagcttcatccatgtccctacaaaggacatgaactcatcctttttaatggcggtatagtattccatggtgtatatgtgccacgttttattaatccagtctatcattgatgggcatttgggttggttccaagtctctgctattgtgaatagtgccgcaataaacatacatatgcatgtgtctttatagcagcatgatttataatcctttgggtatatatccagtaatgggatcactgggtcaagtggtatttctaattctagatcgttgaggaatcaccacactgtcttttacaatggttgaactagtttacactcccaccaactgtgtaaaagtgttcctgtttctccacatcctctttagcacctgttgttccctgacattttaatgattgccattctaactggtgtgagatggtatctcattgtggttttgatttgcatttctctgatggccagtgatgatgagcattttttcatgtgtctgttggctgcataaatgtcttcttttgagaagtgtctgttcatgtccttcgcccactttttgatggggttgtttgattttttcttgtaaatttgtttaagttctttgtagaatctggatattagccctttgtcagatgggtagaagccaaatgatgagtgaactcccattcacaattgcttgaaagagaataaaatacctaggaatccaacttacaagggatgtgaaggacctcttcaaggagaagtacaaaccactgctcaacaaaataaaagaggacacagacaaatggaagaacattccatgcttatgaataggaagaatcaatattgtgaaaatgaccatactgcccaaggtaatttataggttcagtgccatccccatcaagctaccaatgactttcttcacaaaattgggaaaaactactttaaagttcatatggaaccaaaaaagagcccgcattgccaagacagtcctaagcaaaaagaacaaagctggaggcatcacgctacctgactttaaactatactacaaggcttcggtaaccaaaacagcatggtactggtaccaaaacagagatagacactaatggaatggaacagaggcctcagaaataacaccacacatctacaaccatctgatctttgacaaacacaagaaatgaagaaagcattccctgtttaataagtggggctgggaaaactggctaactatatttagaaagctgaaactgcatcccttccttacaccttatacaaaagttaattttttttttttttgagacagggtcttgctctgtcacccaggctggagtgcagtggcgcgatctcagctcactgcaatctccacctcctgggttgaagtgattctcctgcctcagtctcccgagtagctgggattacaggcacccgccaccacgcctggctaatttttgtatttttagtagagatggggtttcaccttgttggccaggttggtctcaaactcctgacctcaggtgatccacccaccttggcctcccaaagtcctaggattacaggcgtgagccaccacgccaggcctaaacccttatttaactaaaacttgttttcagaaaaaaataaatctgaggatgtgttacatgtcccccttttacttagtgacagtcccaggcacacacgagcttgtcattaacaatattcatcaatttaagagttgatcagagaaggtcatacaagaatccaatctcagtggaattaaaggaaaaatttttgctaagcagaaaataaatgagaactgtacatttaaaataaataaatgaacagaaagcctttcaaatcgtactaaactaacttatatctgtggctactacattgttgttctttaatgcttaaataggtaaaagcactgatgttttagttgaaactaccagcagtaggaatgcttgctcagtaagagcaagaccccactaacacagtcatatttataaagtcaaggtttaggtgtctgccagggtctgttttccctaaatctattacaaacaaatgaaagcaaatcagtaaatactgttttaatgtacctataccgagtcataaaattattttcctcccaagtcaggaagaaacataaagttggttaactgaaaaagagaaagtttaatcattctgattttcattctgatgctcttctttagactatctattgctgctttcttttgtagcagaacagctgattttccgcctaggttttcatgatctgataaaccttcaccatagacagtttcttggaaagaaactctggaagtgtcagttatctttaaatgttcaggaagctgcgtgggtctcagacccagctggagcagagccagcacgggattctgaaagcatttgcaggctctgagatggttttaacctgttccttggcagtgcagcccttgtgtacactcttggaaagatactgatgtttactttcatgatgtagaatggatgagcagtgaaggtttctaggaaggttgaacacactcatgcccactttgggacacaaggaggcagatgctctcatgggaactcttcaaataaggtcgtatggtttggctgtatcctcacccagatctcatcttgaattgtagttcccataatctcgtgtgttgtgggagggactcgatgggaggtaattgaatcatgggggcagttaccctgattctgttcttgtaatagtgagttttcatgagatctttacacttgattaatgttaactgtagttgtcctactgatctatcgaacaccaagtcttatttcttctaagtgtatttgtacccattaatctactgctcttcattccccatccccactacccttcccagcctccggtaaccactagtctactctctatcctcatgagattcagttttgtagctcccacatatgagtgagaacatgcgacattgtctttctgtgctttgcttgtttcactgaacataatgacccccagtttcatccatcttgctccaaatgacaggatttaattctttttatggctggataatattctattgtgtatttttaccacactttctttttaaatatttattattattttgtagagacagagtcctgctatgttgtccaggctggtctcaaactcctggactcaagcgatccacctgccttggcctccacattttctttattcatccattgatggacacttaggttgattccatattttgtctattatggatagtgctgcaataaacatgcaagtacagatctctcttcaatatattggttttctttcttttagagaaatactcagtagtggaattgctggatcatatagtattctacttttacatttttgaggaacctctgaagtgttttctatagtggctgtactaatttacattcccaccaacaatgtgtgaggatttttctttctctgcatcctcaccagcatgttattccctgtcttttttgataaaagctattctaattggggtgagattatacctcatcgtggttttgatttgcattttctggataattactgatgttgagcacttcttataccctttgttcatttgtcctctgttgagaaatacctgttcaggccttttgccctttttaaaatcagattaatgactttttgctattgagttgtttgagctccttatatattctggttatttatcttgtcagatgggtagtttgcaaatactttctctcattctatgggttgtttcttcaccttgtttgagtgtttcctttgctgtgcagaagcttttcagcttgatgtaatcccatttgtccattttcgtttttgttgcctatgcttttgagaacttaaacaaaaaatttttgcccagaccaatgtcctggagcatttccccaatgttttcttttattagttttataatttcaggtgttagatttaagtctaaatccatttgtatttgatatttgtacatggtgagagatagaggtctagtttcattcttctacatacagttgtccagttttcccagtgccatttattgaagagactgtcctttccctgttgcatattgttggcacctctgtcaaaaattagttggctgcaaatggcatggatttatatctgggttcactattctgttcagtcggtgtttgtgtctgttttttatgccagtaccgtgctgatctggctactatagccttgtagtatatttttaagtcaagtagtgtgaggcctccagctttgctctttttgctcaagattgctttggttatttgtggttccatataaaatttaggattgtctgctctgtttctatggggaatattgttggtattttgatagggattacattgaatcagtaaactgctttgggtaggattgtcattttaacaatattctttcaatccatgagcatggaataatatcttctccattttttgattcatcttctatttatttaatcagttttttatagtgatccttgtaaagatctttcacagctttggttaaattgattctcaggggccaggcacagtggctgacacctgcaatcccaacacttcgagaggccaaagcgggagaattgcttgagcccaggagtttgaggccagcctgggcagcatagtgtgacctcatctctaaaaaaaaatcaaaatattagccagacgtggtggcatgtgcctgtggttgcagctacttgggaggctgaagtcagaggatcgcttgagaccaagaaatcaagactgcagtgctcactgcattggtgacagagtgcaaacctgggtgacagagcaaaaccctgtctcaaaaaaaaaaacaaaatattcctgggtattttacattctgtgtagatacaataaattagattactttctttctttttcagattgttcactattggtatatataaatgctactgaattttgtatgttggctttgtatcctgcagctttactgaattcacttattacttctaatagttttttggtttttaaaaatagaagatcctgtcgtttacattcaaagcgaatttgacttctttctttccaatatgaacacctttatttttttttcttgactaactggccaggacttccgctttatgttgaatgaaagtagtgaaagtgcacccccttgtcttgttccagatcttagtggaaagccttttaggttttccctgtttggtatgatgttggctgtggatttatcatatatggcctttattattttgaggtatgtttcctctgtacccggtttgttgagggtttttatcaaaagggatattgaattttattgaatacttttcagcacttattgaaatgatcatatggtttttgttcttggttctgttaatgtgtatcacatttactgatttgcatatgctgaaccatctttgcatccctggggtgaatcccacttgataatgttgaatgatctttttaatatcttgctgaattcagtttgttaatattttttgttgaggatttttctatctgtgttcatcagtgaaattagcctattgttgtcttttttttttttttttttttttttggtggccttatctggttttggtatcagggtaatgcccgccttgccggatgagtttgagcattccttcctcttcaatttttttttttttgaagactttgagtagaattattatagttcttcttgaaatgtttaatagaattaatcagatcctcgacttttctttgataggagagttttaattatagctttgatcttattacttgctattggtttgtcgaggttttctctttcttcgtggttcaattttggttgtatatgtccaggaatgtatctttgtcttctagatttttcaatttgttggcaattgtctctaatgattctttgtactcctatggtctctgttgttttgtatcttttttgtttctgattttatttatttgggtcctctctttttagttagtcttgctaaagttttgtcagtttttttttaactaaacttttgttttgttgatcttcagtaatgttttaatctcaatttcatttatttttgctctgatctttattatttcctttctcctagtaaatttgggtttggcttggtcttgcttttctagttccttgagatgctccattattagtccattattaggttgtcttttggtagtctttcaacttttttgatgtagatgtttattgctataaacctccctcttagtactgtgtttactgtatcccatagatttggatatgttgtgtttctatttttatttgttttgagaaatttttaaatgttcttatttcttcatcaactcattgtttattcaggagcatgttgtttaatttccatgtttttgtttaatttccaaaggtttttttgttttgtttttttttttgagatggagtctccctctgtcatccaggctggagtgcagtggtgcaatctgcaacctccacctcctgggttcaagtgattctcctgcctcagcctcccaagtagctgggattacaggtgtacaccaccacacccagctaatttttgtatttttaatgagacagggttttgccatgttagtcaggctggtcccgaactcctgacatcagatgatccacccacctcagcctcccaaagtactgggattacaggcatgagccaccacacctagcccaaaattcctcttgttattgatatctagttttattccattgtggtcagaaaggatacttgatatgatttctacttttaaaaatttgttgagacttgttttgtggcctaaaatatggtttattctggggaatgttccatgtactgatgaaacgtgtattctgaatagttgagtgaagtgtgttttataaatatcagttggacctatttggtctgatgtgtagtttgatacaatggtttctttgttaattttctgtctagatgatctgttcattggtgaaaatggggtatttgacgtcctccactattattgtattataatctctctctctctttgtatctattaatgtttgctttatatacttgggagctgaatttcagtccatcaaatgtattaatcagttctaagatttctgtttgattttttgaataatgtctctttgttaaatttctctgataaatttctgaatggagaattaccgttttgtttcttgttttctggttgttttgtaactcttctcctcctttcttcctgtcatcctttatggttaagtgactttctctggtactatgttttaatttgttggggttttttttagtgtgtttatcataggtttttacattgtggttaccatgaggcttatagaaaacatcttatagataaaacaagttattttaaagagatgacagcttatcttagataagcagtccccagtctgttttggcgccagggaccagtttcatggaagacattttttccatagatcaggcagtggggatggttttgggatgaaactgttctacctcagatcatcaggcattagatcctcataaggaacgctcaacctagatccttcgcacttgcagttcacaatagggtttgcactcttatgagaatctatgctgctaatgatctgacaggaggtggagcaggcagtgctgtgtgacctggttcctaacatgcgacggaccagtactggtccatggctcaggagttggagatccctgtcttagatcacaaaaaaaagaataaataaaaaactttaaaacaaccctccatctttaattccatcccctgacattttgacttttgtgggcctgaatttacgtattttgatattgcctatctcttaacagattgctgtagctgttagggtttttgatagatttgtcttctaggtgtcatactagaattatgggtaacttatgggtggactgcacatgacaattagagtatttgaatattctgggggtttctatacttgatgttacctgtaggttttataccttcaaatgttttctttttgcacattaatgttttttcatttcagattgaagaaccatctttaacatttcttgtaagacagatctagtagtggtaaattctcttagcttttgtttgtcagaaaaagactatctctccttcatacttgaaggatatttctgctgtttgctggataaagtatttgaggatagcagggttttttggggttttttctttcagcactttgaaaatatcattccacttcctcctgacttacggtttccattgagaagtgtgttgccaactgaagtggagtttctttgtatgttatatcctccttttttcttgctgcttttagtatcctctttttgtccttgacctttgagagttttattattatatgccttgggtgtagttttatttgggtcaaatctgtttagtgttttctgaccttcctctacctggatatttttctcatattttggaaagttttctgttattatttattgagtaagcttttttctacccctcactcttgctcaactttctcttgaacaccaataattcttagatttggtcttttaaggtaattttctatatcttgtaggcaatctttgtataatatatttccattcattttactttttctcctctatgtaatttcaaagagcctgtctttgggctgactgattctttcctctgcttgatgcattctgctgttgagagcctccaataaatttttcagttagcaaatatatttttcaatttcaagattcgtttgattttttatcacttcaatctctgttaaattcctctgataagtttctgaattgcttttctttgttgtcttggagatccctgagtttctgtgaaactgctattttgaattcttggtcagagagctcatgaatcaccatctcattagggtcagtcactggttccttgctttatacatttggggaggtcatggttccatgttcttatggatatatgtctgtgtctttgcattaaaggatttattatttattccaatcttctctgtctagtctgttttggtttttactggtatgtttgcttagagattatttgtaatttagctgttgaatttcttacacatttttcccgctaggtcactgcctctttttcagcactaaatggtacttaaaacccaggtttgcctctgttcttctagcaaaggatcagaggattgcctggctggaatgggggaggttgcaaaggagctatccctgtggtatggaaaggctggctaggagttcatgcccaagagacctgtggaatctacctcctacagcatagtgctgccgaacacccactctgatttggcgtctcctttggttgagttacagagcggagcttccagggctggagatggtaatcctgcctccttcctttgtgtccggctgtccacagggtggtatctcccttcaggcactcctgatgcttctcatgggttgaggcatggataggtctcctgccaaagaagccaagatggtaggcaagttgtgtgtccaacttaatctcactttttccagtgtagaatctgagttgggggaagttttacatgtgcttgataccaagcagattgggggaagggtgtcacagatatgaaaatctgattctcttactgtctgctggagtttttttttttttttttttttttttttttacttctcagtggccccaggaactgaccgattctctttcatgagttctgagagattgctggtgataatctcgatggtgtatatttattttggttattctgtggggagaagtgaagccagctttcatctacatttttaaagtataattcttattttgagtggcaagaatctgattccagtatcctgccttagtttttatgcatttttgaaattcctaccattgcatttagaaccttctacctggtggagttttttttttgtttgttttttgtttttcagttttggaagtatttgattttttgaaacagttgacattcatataaagaacaaggttgataatcaagcctgctctagtaattctgtgcagtctagaaaagagtgtactggggccgggcgcggtggctcacacctgtaatcccagccctttgggaggccgaggcatgcagatcacaaggtcaggagatcaagaccatcctggctaacacggtgaaaccgcatctctactgaaaatacaaaaattagctggacgtggtggaggctgaggcaggagaatggcgtgaacccgggaggcggagcttgcagcgtgccgagatggcgccactgtgctccagcctgggtgacagagcgaaactccgtctcaaaaaaaaaaaagagtgtactggttaagtactgagaagcatttcctgtgtgtctcatgtaagtacttcaggctcttaaatgtgttactccaaggaataaggttgcaaatacagttgctctaaaaacatattataccagcctggccaacatggtgaaaccccatctctactaaaaatgcaaaaattagctgggcatggtggtacacacctgtaatcccagctgcttgggaggctgaggcaggagaatcacctgaacctgggaggcggaggttgcagtgagctgagatcgcgccactgcactccagcctgggctacagagcaagactccgtctcaaaaaagaaaaaaaattacataaaattccgagatgcagctttcttatctaaaaaggatttgcgcaaagcctccttgcagtaagcatataggtaactaaggtgtctaccttacgtatatgcatcactcatttatgccctaagttctcatttgttaaaacaatagtgcccttactctaaatcacataatcacaagagccctagggctgaattgctcagctttaaatgtcagcactgtcatactagctgtgtgatgtgagcaagttctaaaactccctgtgcttgtttcttatgtatacaatggagagaaggggtagtactttgtagggttgttgtgaagtttaaacaaggtaataactgttaagtgtttttaaaagtcccttgaatgtaacaattgcatcagtggtaaggtatgcatttttctcatatggcctctgaaatgaggatgtgtcttataatgaatgtaatttcttaataagcattttatcatttagtgacatcttttttattagtagtacttaatgttacactttgggtgacattttatatttcaataactaatagtaagaggtctattaacattagctgccatcaacattaccatcaatattatcatcagcattatcttgtttctaactgagatagtggcatttgatagtttagcagtgctagagtatatatcaaatctcaattttatctaactacttgtttgcattggtgtatttttatcaaagttctagtgtgctgtttttcatatttgtatcattttagctaatgtaaagtatttatggggtcagctcatgcaatgtttccgtcattcattgtaccttacttggcgatctactaaaacatgcatcagcatccttcagtctcccgaaataaatagacacaaagacaaattctttattttctctgttgatgtattttcctaaatcgtttcgcaggagtggtttctttcttagctaggagaactaagccaccattgtaccacttaagatttactggtttgcactgtcctctgagggagaaaagaagcaatttattgatctgtaacacaggaatggactgtggccaaaccttttctggtttatacaatgcaccgacataagaatctgcatagcattaagaagaatgagcactcacaatttgaggccgcctgtcagcatgaataataactgagaaaaatcaatacacaatatacaactgttctctttgcacagacactgccaggattcacacccagtgacagtgtcttcttttttttttttttttttttttttttgagacagggtctctcactctgctgtgcaggctggaatgcagtggcgtgatctcggctcaccgcaacctctgcctccctgttcaagtgattcttgtgcctcagcctcccaagtagctgggatcacaggcgtgtaccaccctacccagctaatttttgtagttgtagtagagatgggattttgccatgttggccagcctggtcttgaactcctggcctcaagtgatccacccacctcggcctcccaaagtgctgggattataggcgtgagccaccgtgcccggccaacagtgtcttgttattttaccagtgatatgcttacagttcctaattttaggcttcctccttattttggttttattgttcagtttggggaagggtgggaggcaccaatttggatctgagaaaaagatcttctgccagatgaaagagtttcaataacaggagaggaccttgggccaaagtttattaagcttgactaggaagattctgggcacatctccatccaaataccttgacacatacttcattcacccctagcacatgcagcttgtcccttcttgtcttctgtttgccttcaaggttttacatggtggtatttacaagccgttatggagcaagagtgcaaacacacaaggctagcaaggggccagtaaacagggtttggcttagggttttgtggttgttagcttttaaaagcatacttagttgaataattccagaaactgggcttctttcctttgccccttcatttgcccctccctctctggtcttcccagtctccacttttttttttgtttaaataaaactgcgtttgtcagaaatgtatagacattcactcctattcttaaaagacagtgtttatccctaatgcctgccttttgattcagccagcagtgactgtgcacacagaggttattgctctccaagttcaatgttgtggacctgaaccagtgcctctgtttccaagagaaagtcaggtgattaccccttcatcagggagattggagccatcctatccttctggtgtgtcaccagccagaaactaaggatcagcagggagtggatggtttagaatctcctctctccaggtgaacacaatgctagtcagtgtagctggaaaagccacgcagcgggcaggcttgtcagaagcaatctgtttaaaaaaaaaaaaaaagagagagagaaaaaagggtccttttgaatttacactgagttgctttcacagtagttagctttgaactgtggtgcaaacccatttaaacaatgagggaaatttcactaagtggcaagaaattctcaccctgtgtgatcaaagcaatcagccatttccttttctttcctttttatttacttatatttctgaccccttataatcttcatgattgtagcctgatagtttccttttttgaatagcatttaaaaaaataccttttcttttccctgagggttttaaagcaaataagacagaaggggtctaaatttttagttttgttttttgagacagtctcgttctgtcgcccaggctggggtgcagtggtgcaatctcagctcactgcaatctccgtctcccaggttcaagtggttctggtgcctcagcctcccgagtagctgggattacaggcgtgcaccaccagccttggctaatttttgtattttttagtagagaagaggttttgccatgttggccaggctggtctcaaactcctgacctcaggtgatctgcctgcgtcagcctcccacagtgctgggattacaggtgtgagccaccgcacctggcctaaatatttatttttaataatgattattattacaaaagtaagaaaagagctaaaatccatgatttcatcacccagaggcaaccaccacagtgaacattttggtacaattacttctcatcgtttaaatgtgtacatatacacatacatatttttaataaaattaggtttaggatagtatacagttttgtttttcttttaaccaacatactttgaatattttgccttattaaaaacttatatgatttcaatggctgcattagaattagtgtatacagatattattttggcattctgttgttaagaggtcatgtgggtttctgaattgacactttaattctcaacttagaatttatttctcccaacttcttctgatttcatgggtctagagtcagagtttgggcacaatggaaatgggatttctatatgtactgttgtttactgtttgctagtatttttcgaaaggtatttgcaaaaaccaaaggggaaacagtatacttttttgtatttttttttctttttttgttttaaattttgtgattgaaatataagtcttattatggtaatctcaggtaacttttaaatagaaatatcaatgcaaaatgaatatattgcccaatgtggaccccggtgtttcagaactatgtgccatgctctatcattttgttactggaaaggggtcttaatccagaccccaagatcttggatctctcacaagaaggaattagaggtgaatccatagagtaaagtaaaagcaagtttattaagaaaataaaggaataaagaatggctactccataggcagagcaggagcgtaggctgctcaactgattatacacacagttacttcttgatgctaaacaagaggtggattattcttgtgttttgcaggaaaggggtgggtagttcctggaagtgaggggtcctcccctttttagaccatataggataacttcctgacattgccatggcatttgtaaactgtcctgctgctggtgggaatgttttttagcatgctaatgcattataattagcatataatgagcagtgagaatgaccagagatcactttcatctccatcttggttttggtgggttttggacggcttctttaccacaacctgttttatcagcaaggtctttgtgacctgtatcttgtgctgacctgtctcatcctgtgactaagaatgcctaacctcctgggaatttagacttaaaataaaggtctcagccttattttatctagcccctactcaagatggagttgctctggtccgaatgcctctaataatttgaagtttatccaacggcacagtgggagataatgaatttttgtttaagaggaggaggactgactggatcagatttgtgctttagaaaggtggttgcatgtaagaaagaggcgttggtagaaagacttcggatatctcaaaagaatttccatgaagttaatctttttaaaaatgtaaacatttggtgcaataattgctttgaaattgcagttgaataaatgaactttttgaaccagaatttggaaaggaagatatgcttaaaaaccaaaaatatttcgtagagtgctacacattaggaagtcatttgtatttggtgaccactttcctaaaatagtctcatttctagagaaccaattttgtttcccatagattattatgtgtagagaccccctttcagtatgtagccactggtacatccgtgggtgttatctccatactgccaggtccaatgcagtcacctcctggatctatagtctttctccccccattccgatttcctttctctgttagcagtcatctttgtaaacagaagtctaagatttagtttgtacattttttaaatgatccattttgatggggctctctttattgtttcaggttgaatgcctttgagaacttgatgcataaaatttgcatgactcctcactcctttctggatctctcattggactcaagccagcatggctcacaccacaaaggttaacggcagtgcctcaggtaaccctgtgctctggagtttgtgtgttaaatgtatgtcttttctcaaactaattttttattctctttaataatgaacggataatagcaagttgcctagataactaggatttcaaagcaattttctgtccattgaagtttgggtttgttttgttttactctcagaaaatttgcttttatcttagagtcttgcactgaaatcaattgagtaaattattacctaagtcaattctgttgaagtgttgaaagacaaatgtaaatactgaatgctgatgcaaatgtaatgtatactcctcttgcacttctttctgagggattgaatgaggagagaggaaattagtttggatgcttaaaaccaattcctagtagccactcccaagcagcttttgtttgatgttgctaaacaaagagaaaggagggaagagaagtatatattctgtaaaatgattctcttaggaatatgcaacaagccatattatgaatcataaagacctgtatttgaattcttattttggttatattagagacttacatagtttcactttctgttccaatattgcttctgtgagattcgggagaaatctgtacacgaaatgcagagaagatcctcctaagagacacatcaccatagggacaacctgcccaaaatggcgtgccaagtgttcatttcttttttgagttatgtgccaaatagctgaatgagtaagaatagtaattgtctatgcagaaattttttctgagcgtctgagtccagactcctacgtctgctggctctgaacaccttcaaatgacaacattatatactggagcaagtgtagaattggagccaggaaacctgaatttgagtcctagttccagcactaaccgtgaaatattgggcagggctatttctccacatgtaaaccatcggtaagtatatccacctgccggtttaggaccagtgagcgcaccagaaacatacttagaggagctatgtaagccgtaaagcacttttgaagacaacagcaggaagtgacctctaaagtgggcattcccagcccatgaatgtgactttttattctagcggtctcagctgcaattatctcctctgggtagaacactataacccaaacccagataaactcagttatttgttctgggatgactgatctttccctgtccattccatttttgaccttttttactgcccagcttcttgagacttttatagattctgctgtgggactgctatcaataataaagacatgaatgataatatctaacattcattgaacacttaaatgcaccatggtgcctaaaatgctttgcctgcattttcatacttaatcctcacaataatctaatgagattaagctattattttactgtcatcatcatccctatgtaatgtcacagagaagttcagggacttactgtaaatgaagtaagaaaaatcagaattatgggcagtggctcacacctgtaatcccagcattttgggaggccgagggggatggatcacccaaggtcggtagttcaagaccagcctggccaacatgacgaaaccccatctctacaaaaatacaaaaattagccaggcatggtggcgcatgcctgtaatcccagctacttaggaggctaagacaggaatggctggaacctgggaggcagaggttgcagtgggcccagattgcactactgccctccagcctgagtgacagagtgagactccatatcaaaaaataaaataaatcagaattatgatgactttctccagtaaaatatttggtgagagaggagattgaaacattatgaaatttcaagtgtagtgggtgggttttaattccctctgatgatgtggtttcctcccttgccctccatttgcttccattcacatgctcaggggaaggggtgtttaagattgttggtgcctcaagacctcaaccttcttctggtgccttgggcaaaatcctttcttcatgggtttagatacctaccccactaattcctttccaacttggtttgttctgtacttaccttttttctttgttcctgagatctaataagcaagctgtaacttttccttcccacctggtatcctgcctaacaggtctgggcattgaggttgaaggcaaaagaaagctctccgatttgtgactttcagggtgtcagagtatgaattgttactgcagacagttatctggactgtgcaggggaagattttttacttattctagtcaccatgacccatgtacatctataagcaaatctaattagagactcaaccataaacagtaatatatatgcaaacatacatatatgtgtgtatgtgtctgtatatgtatatacacacatagtaatatatacatacatatatgtatatacaaacacaaatgtgtgtacaccatatatatgacactcatagaaaaaaaaaatttttttttgagatggagtcttgctctgtcacccaggctggagtgcagtggcacgatatcggctcactgcaacctctgcctcctgggttcaagtgattcttgtgcctcagcctcccacgcagctgggattacaggcccatgccatcacgcctggccaatttttgtatttttagtagagatgaggtttcaccatgttaaccaggctggggttgaactcatgacttcaggtgatctgcctacctcggcactttgggattacaggcatgagccaccgcacccagctgaaaatttaaaagtatagatgtgtgttgtattgtctgaaaaccaaaacaaaagcaagaattactggtgataataccacctagaaataaatgtcttcctattttttatatagttgtcaaatgttatatatttcacatggttgagaatatgttaataaaaatcattcctttaccttttcccactttgtattacaaaggaaacacctctccaatgtttaaaaaaatactcaatgtaagagatgcgggttataaatacacttctgtgcatgtaaataacatttagagaacctagatgaagatgagataaagagggcttcatggcagctagtgagggccaattactggtctcctatgagaaaaggataagctatttgggtttagtaggagtttcagatgtggagtaaattatatgtttcttcaatttccaaaaattgctgcttgggcttcatagagcatgaggggaaatttcatgtgacgatggagtcagggcagtggcaaaagaagcactttccatagtgttagtaataaaacaagcaaaagaggagcctctgggaaagggcaaaccatgcccttggcacaaaatacatccgacgactgatcatctcaagttgacatccccatgtaacatttaaatgggataaggggtgattcacaaccttttatactctgacttccccttggagtccctcacggaggctgggtaaaagaaactgcttttaaaacgagctattcattaatgctgtaatttgtaaaatgtattatgccacacttcagacatacaaaatgtgtgaaagttatataacaagcacctttgtacacactacttagcttaagaaataaaccttattaatataggccagatatacatgagcacctactacgtgctgttttaggtactggggatacagcagtgaaccaaagaggcaaaaatttctgccctcaaggattgtacattctagggacagttaaagtctcctgtgtacacggttgccagaagaaaaaatactaagcacgtgttcatcgtttatctaaaattcggtttaatggtgctccactttcgtgcgcggccctacctgtgtaccccttgcagattgcacccctgcccttcctcaccgccagcccatcaaaatcaatcttccctcgtagtgttacctctttttcaccagatcctccatcctacttctcttgattggtacagtactgttttcattaattcaaaacattttaggccagatggggtggcgcagacgtgtaatcccaacactttggaaggccgaggagggaggattgcttgaggccaggagttcaagaccggtgtggggaacatagccagactccatctctacaaaaaaaaatttttttaaattagccaggcatagtggtatgcacctgtagtcccagctactcaggaggctgaggtgggaggattgcttgagcccagtagtctgaggctgcagtgagttatgatggtaccactgcactccagcctgggtgacagagccagaccctatctctaaagcaaaaaacaaaaaacattttattatggtactgctaacagtactgcagcgtcttttgttaaggaggtaagagcatcataaattgctcttgactgttctctcatagccagctaggaagtaaatggtgattgttggttaggaaaatagctgtgtttctttggggtgtagggatgaggcagtctgctttttccccaagtttctgaatcatgttgtaaactgaatgcactgattgatacctctctaaacactaatgttgtgaaactttaattagagcttagatatgctttagaagccaaataacaagtggcttatttgtgaaagaaagataataatagctatcctaccttcttcacaaggtggttgtgcagggaaaaaaagaatagctgtaaaaacactttttaaaacacaaagtgctggtcatatgtcaggggatagcaccattccccttgttctcttgtccttgtcatgagccgctgatcaggaaacatcccaggtaccctcatgtcaggccctgctggacgccatgatattggggccagagttgtattaacatcctcattaaacccagttaaatgacataaatggatgagcactgggaggtgactttttatgcctgctcttatcatctttatttttgctactagttgccttccccaattgattatagcttttccctcatgctctttctttttttgcagcctggatatatattttttcagacagatacatatttatttattaaagatgcttattgaattgcattaaaatgttatttaggctgggcacggtggcttacgcctgtaattccagcactttgggaggccgatgcaggtggatcacctgaggtcaggagctcgagaccagcctggccaacatggtgaaaacccgtctctactaaaaatataaaaactagctgggtgtggtggtgggcgcctgtaattccagctactcgggaggctgaggcaggagaattgcttgaacccgggagacgaaggttgcagtgtcccgacacagtgctactgcactccagcctccatgacaaagtgagactccgtctcaaaaaaaaaaaaagaaaagttatttaaattaatgataacataaaatttgacaggaaaccagaagagaagaattactcaaaattccacactaggtcttatttttagtatttatttttcatgcttttcaggctaacaaacttaaacacagtttcaataagcttttataatttggatatcagctcttgactttaacattctttgcatttttccaagtcttcatggaaaatagttttcaaattattattttcaatgactgtataatattccttatggtgtttctaccagttgaagtattctttttttgtttggatgtttggactgcttccacattttccctatggtagatgatgttgcagagaacatcttccctggtcatttttctcctccttttttattatttcccaacaatttcaaagaagcaggatgactgggttaaagggcacaatgttttcatggctttagtaactgttgtggggcttgaatctcgttatcttggtcagttatttggctccagcttttgtctctatgctgatcttaaatgagtacaaaggccactgataagaccgggtcagccagacagagccaggctcatggcagggtaggcagaatgctgcagtgcggtgcaccccactctcgcttgtgtaaatatttttctgggcaggagcgtttctcaaacagaactctgagcccactgcggtgaacctgatagcaggaattacgtgctatttgtcaagtataagactagtttgcagtgactggtctggctagaacccacctggtgttttctgagatcatctgtaaggaaacacacagcacagcagaggcagtgtgcgcccgtggtggtgagtcttagacctgtcatctgtgttagcattaccccgaaggcagagagtttgctgattagaaactatggctgctttaattcatgggtaccctccgtgacttttcagggtctcctggttgaatgaatttgcagaaggattaaaatgtgtgttcttatttgtgctttgtattctcccataagtagtgtgttggaggctattagaatagctgagagggtaaaacataaacacataggtaggagcctgacataaacacataggtaggagcctgccataagcacgtaggtaagaactaaaagggtgtgtttccatttcagttgtccagccttccttccatactctcagatgacaaaacacaagttgctgagctcacacagctaatgactaagccagaagttggacatggagaacatttttcctttgttcaaggttatttattatgttgacatttaaaatcagaagtgtgatatctgtgaagttctgattaaacagatcaagtgaaaaggatgtagttcagaaaactgcataaaaccctaaagtacagtgtttaaaaataaaacgtcctccctgatagggattatgttggtaagttactttttttcttagtatggattatttcaaattaataaacatattgttattcctttatttattgcatcatacagcttcatcctagtattagtgtgtttaataattgcatttaattagattatgcatttcaactttcaatgaaactgtagctgttagtcttttgaaggctaatttcacgctgaaatttatagatgaaataattttcttatagtggtggtgtttgagaagataatgtaactacttcttagatttcaatttcataacccttaaaatgttgggaccacctacaaatgggggacaccctgggttttgaagtcttgcctgtgtggttaatcagaacctcagaattcacccagcccccggagaggttttgaaaagcccctggctcatcagagcttgcttgtttcataaactcttaaggctttgttttaacctgtagccagcttcgccttataagctttcttgccccaagccttgagccagtcataatggcttaagcatcagatttcagacaggcgattagctctccagctaagccaagaaaggatgatttatcttccagtgagtaccagcctatttgagtgtaggaaggagaaaaatctgtgctcctgctcctgggtactgggcaaagaaaccctttggttggggatttttgcctggtaccaactttataggtgccaacaagaaagaaagaaaaaaacacatacaaaataaacacccaacagggagattcgctgtgttaagaactcgagctgttgctattattctaagagactgggtagccagtcaaagggttaaaacagcccttcctacaaggatttgaaaactctgtgctctgctcttcctcagcagacttctcgttgtgagtattggcatttatttctgattatgcacttcccctctttcttgaatgagttgggtgggctagctgagcccatcaaaggtatagctcatttgcttccttttccagggtttgccttcttcctgtgtctgggataatttcagttcatctcctttgtgcagtttctgagaaaggtttgtatgggcttagaggaaaatgatcgtgactaaagctcacagtcaccgctttggctccttttctataaaaggtggtttgatttgatctggcatgaaaaatattatcataattctcaaattcacagaaacgataagttcttgctctttcctgaccaaaaaaaaaaattaattgcattgggtagacttctctaataaaacctttaaggagacccatccaggaaatcagattttataagattcattcaaacagttgtagaaattctaagttcaaaaaccaaaagcagactcttttctttttccttccttggcttctctgttggatatttttggagtgagccttaactgagttactcatttccacatgctttaggaaaagtatgctcatgttttacaggctaagcctggttctgcttttgagctgcagttcattatgaatccggaaaacacaggtttttgaaatgcggcccatttgtacatatagcattagtcatctcagctggtagttctatacgatgagttatctcaccacttaaaaataagtacgctgctattttgagatttaaaaatatatatagtgaccagatttcttaccctagttaaagcaagccatggctgaaactcagattaaacaatattctataaaaatgagagaaggccactctaatcaacagatagaaaaacagaactatagacataagggagagctgtgctaagggacaaattgttggatttgtaggatttgttcgtatcctgaaagttaaatctttgtactcttaccttgtttatggccagatttgcctgatccctgatttccctcccaactggatcagaggttgtggaattggaatttcaccatacaaacctttacttaaaggaggtagtactagagtaaccatttatgggaacagtttgctactaatagttactagtactgagtttattttagttcctttttcatgattttattccattggaaaagttttctctcagggatcttttctactttggacatgatctctgttaggcagaatcaaaagatagctgtgtggctttctgaatttagtctcacaatatttggtttagttgataaatcccatccatcagctttgcaaataattttgtgaaaacattgattcagcttgtcctgcccaattttcccatccctgcccagtttactgagtgccttttccatttgcatccactgtccattaggccaaggcgtttgaagtgtttctgtacagcaggtacatttaagactctccaggaagaaagggggaagaatattccaaactgaaaacatcaaagagagagatggggtatttccagtaacttatatgcccagtgcttaatatcttaaaaaccctactcatgtgcatcagctcttacttttttctaactaaaaccagaaaaaagttctctcttcctctgttctcagtatccccctcatgtaagtctgtctacccaacacggtgcagccgatttatttatttttccctcagcatttttaggtggattgactgggatgctttattcaactcagggacgcaccacgaatatgttttttggggcaacccgtttggcatgttccccctcagctgtgaggacaaagactggtttgtcttcttgtgacctggcagaggaggcagaagtacctgctgagcttatgcagcatgtaccccaaccggtgccccacctcttcaagtggtgaatcagcctgatgatacactgatttttagaacacgctagggtggagacctggaagtctgtacactggtcggggagggagggatggtttgcatgtcaaaccatttcaacaatgcagcttacaggaaaaaaaaattaattgcaaaacactgtgatgccctttgccaccagatttttccattagcaccacactttatacagcttccaagtctgccccagggacaactgtttggcagtgtgaggggaaatggcagcatcacgtcataagtgcaatgattgttacctatgagcctatccggtaagggatctgagtgggcccaagcatcacacacgtgctggagctgagtgttctctgaggaacatgctaggatgttacttgggtgctagaaaacagcagctggaattcacaacacctcaggacactgattgtaaatgaagaatcctgagactaaacatcttctagaaaggtaaagggggcttagggctgggggcttttcctctgggctcttatcctttggtatgttgtccctggatgctttgagatgagactttgcagatactgctgaatttcttttcttttctttttttttaatactgctgcatttcaattggggtgttgtttggggactactggaaggaatgttatgaaactccatagaaatacttcaattcagtgagttcattcattcagtggctcacttttaaatgaccatacagatgtatttggcagaatacatctttgccattttccttctttgtgtaatggaccagccccgaggctgcgagcattggtccttctttgcctttttctccctgctttgtggttttgtgtatgtaaggatggctggcaagattaaggatcattgagctttgtattttctgttatttttctgtctccccaaacattttcactttcacaaactttaatctctaactattattcccttatcttaactctgaacttttgttttggacttattttgtctgaaatcatggtctatttccgtttcttcagttcttgtgtctgtaaaaatcacagtaggccttaccggaggtccatgactacaggtactcagagaccagctgtatccaaagagttgtgtaagataggggcatctgctccctcccagtgctgttgcccagccccaccctgccctgttccccagttagtgtctttgctttcttgacctggatatctttcccatatctattaatataagcccttcttatccttcaagtcttgctgcctctcttacctctcccaacaggcattctcagatactcccaatgggagttcctctcttcctcttctttattccttttattctgttattattctattattatttctattaaataattgccatcagttgcttttaattaagagttacggttgtgtgcgtcactaatcttataaacttgagtgttttaagaggcaagaatcatgtcatcttcttcgtatgcccaacaatgccttgcttagtagtccttgtagagtcaacagattcaatgttcaaccagcaaatatttgcagagcacctactttgtgctggcatgatgctgggcatataatacaggtcaaaaatcaggcccagcacctgcctaagaatttgtgggcctgagccctgccagttgccaatctgatgtgctatattctttgcagttttcttccagccttttcccgtaagttcccagttggtcgctctgtgaattcatgtgtgacacttcacctgggtgtgtttcctgggtgaacagatggcttttactgtgtcacacacacactcttgcgttctgcctcctctcgtgaaagttgtagttatctgctttctctccctcacttgctctaaggcaggcttaagatggtgttgttgctgggtgtggtggctcatgcttgtaatcccaacactttgggaggccaaggcaggcagatcagttgaagtcaggagtttgagatctgcctggccaacggggtgaaaccccgtctctactaaaaatacaaaaattagctgggcgtcgcagcgggcacctgtaatcccaactacttgggaggctgaggcaggagaatagcttgaacccgagaggtggaggtcgcagtgagccgagatctgcacttcagcctgagcgacagagcgagactctgtctcaaaaaaaaaaaaaaagagtgagaaagaaagatggtattgtctgttaagtgccttgggttccagagagaggtgaccaggtatgttgtggctgtcttaaggggaagattattgtcaggggccatttggaaagttcttcctggctgccatggcctttcattgctttttgtggcatgttagcagcacaaccagatagggaggaggtggtactccagttggttccttttgtctcaggcttattctctggtgcagcttggtgggctggttgcaaccgtaggtaagaacctgagctggtagcccctgggggtatggctggctggcctgctttccttctttcccactgttttcttgggaaggtctctacagacctcacctcttttaggtgtgaggagataaatagtccttattatcccttatttacagccttcatagagtctttgtagtaatctaagttaaggtcttaatgttcttatttagttctgtgtccccccaattcatttggtattggcttttcttaatgctgatttcaaatcttggatgaaaatatattatgagaccatctcttctttagatgtgacaaaggtaataaccatggggcaatccagactgtgaagaaagcctaaggtgtagaaagcccatgcgacactagttttaagccttcacatgtgtttggggaaatgcgtttgttgaataaaggataagaagacagaagactttttatttttcttgtcttttaaggtaggaccatcagatagcatcgtcttcctaaagtcactctcctgacaagaatcagacccctctgccggggcacaccctcctcatgtggaaggcagggtggcctctccttggaaaatctcccctcatgttaagtcttctgagcggatcctgctaatccaggcatgtaaaggaggagtcctcatccaagacccaacatggtgcacacctcacaggaggaggaatggaaaagcaggcacctttgctggactttccttttaatcccctaaatcctgtcacaccctaagactatgaaagagatgggtggagaagagccttggtgctgtggaaagggccatacccactttctccctcattgcagctcacagtgtaggtctcacacccatcccaagcacctaaggggaggggtcggttaaagcagcacaatacagtatttgaactcttcaggggtttggggaagtccaatataacagaaataacccaggccctcagcgtggggtagcagagcatcctcctttcactctgtctctttctaaggcaaatactcataggtagagtttttgcaaggtaagcttacctgagccagaaagggtgggaggaatgtgagattgttttgattgttgtccttgggttttgttgttgctgttgttattgttgtttataagaactacaagaggctgggcacggtggctcatgcctgtaatcccagcactttgggaggctgaggtgggtggatcacctgaggtcaggagtttgagaccaggctggccaacatggtgaaaccccatctcttctaaaaatacaaaaaaaaaaaaaaaaaaaaaaactagctgggtgtgttggcaggcccctgtaatcccagctatttaggagactgaggcaggagaattggttgaacccgggaggcagaggttgcagtgagccgagatcccgccattgtactccagcctgggtgacggagcgagactctgtctcaaaaaaaagaaaaaaaaaaaaaaggctacaagagagaatgtccctagtttatggcttttcagtaccaaaatagtatgcattcagcagtagagtaagcagtagcagtagaatagcaccatgcttatgcatgacataagcttcatctgtaaaaggctgaagtaatcataccttgctgtagggttgttgtgaggattaaatgagttcgtgtatgtataaggcacctgcagcagtggagtccagaagaattgtgcacagtgggtggtggggaaagatgagggcagggaacattgggggaggaaagtaaattcaatggatgtcaggaaataggcatcttgacctgtccacagtgtaattcaggccaccactcactacttaatttaactttgttcttatctctagactaatggagcaggctctctgggggaaaagtgttgctgcagtaatcctgttaagtgtaagaactgaaggttcaggttgaagtctcaaagttccaaagccaccatcccagggataaagactgtgctggtatacgctcagccagcctggtaccacagaaggcttttgtctccagcaggttccttttctcactgggcgtcaccttttctggctactctccgcctgtcagaggccaagccttgagtatatcttcatcttcccacatcttacttggcttctttctttgtatgtatattgaaagagtaaaggcagataggtgtgtgtttctctcttcagtgggaacctttgtgactgatggtttccaggcagaagaggttcaaatttttaattgtttcccttcccaacccttgtcatcgtctgataaaggactaggcatttatttgcatacaatgactttttctggtggacctcaccttcacagaagcacagaggcaaacacccatagggtcagatacaagctactttagcaaaatgattgactttgactgctttatgtaatctaaactcttaccagaacacaatatttatgaatgtagcagatttttttttttgcaggatcaagaaacactacattcagtactttattcgtttaacttttaagaacaagtcttttgatagttttaaaattgtatgtgtgtgtgtgtatatatatatatatttatttattattattttttttaatagagacaaggtctcactattttgcttaggctggtctcaaactcctgagctcaagtgatcctcctgccttggcctcccaaagtgctaggattgcgggcatgagccactgcacccagccgatattaaatcttagtttggaatataataatgtaactaaataataccagaatttttttttttttttttttgagaccagagtctcactctgtcacccaggctggagtacagtagcatgatcatagctcactgcagcctcaacctcccaggctcaagtaatcctcccagtctcagctcccgagaaactgagactacaggggcaagccagcacacctagctaattttttttttttttttggtagagacagagtgtcactgtgtcatccaggctggtctcaaactcctgggctcaagtaatcctccttcctcagcttgccaaagaattgggattacacgcatgagccaccatgccccccaaaaagggttcttttaaatgccttcttcacctttgtctaagtacattgggtaaatgtggcactagttgaacaagatttactgaattttatcacagggcaggcaggcaaagccagttctaaacaataaaacagagatcaacaaagatgacggatgactctaaatagcctgttttgtaaaattcaaaacgggacagctgtgtagagagaggcacagttttataagaattcactggacctgcctagtttggctcatcttggtgcctgcacatgccctgccttattccatttactttccttctgtctcatctcctactggtgaccacagttactgatgggagaccttaaaggtgattatctttgagacacatactttcctgtgtgaagacacaaagattaaactctataagaccatggcacttatttgggcttggggcttggtttataccaaataaaccaacagattaaaaaataacaaactaaaaacaaagtttcaagtgccaggtattttgaaatagcagatccaaataatttcatattactttacacaacaagacctccattagtaagagatttgggttagattttttcttccttttttttttttttactttaaactttattgagctgttttacataccatagaattcacccattttaagtgtatggtttgataagttttagtatatgtggacagttgtatatccacaatccagttttagaacatacccataacactaaaaattctcttgaggtttatgttatcatttacttttgacagaaatgttttcttctgcttttgaaaaaaaaaaaaattctgggccatgtgtggtggttcatgcctgtaatcccagcactttgggaagccaaagctggaggacttcttgagctcaggcattcgagcccaacctgggcaacatagtaagaccccatcactacaagaaaaatacagaaattagctgagcatggtgtcgtgctactctggaggctgaggtgggaggatcacatgagcccaggaggttgaggctacagtgagctgtgattgcaccgctgtactccagcctaagtgacagagtgatacactatctcaaaaaagaactttttttttttttaggtaatgaatttaaatcattaggggaacataccattcttactaactttttgaaacaaaaacaaaggttgctcgaagatgttatgaataaaatgtttaagagtatgagggtacagagcaagggaaggaggcttgggcctatggtttacgaatggtgattgtttttagccttctaattatatgttgcattaaataagaagaaaccaaaaaggaaccacttgcctccattccagcctcggttcagcataaaactcaatcatttccttcacaagccagctgctgtgctatagctcaaattgtaacagagagcctttctctgcagtggagggttagggaaagagggagtaagtcagcacaaacaatgaggaaacatttgctgcctttctgatttcttcctagaattaacaggcttacagctgcatttctaggtcagcatttcatatgcctgaagagtatgaggatagtttgaaaaatcagaaggaagatgagagagggctttgcctcttttttaagatcttgctagcagttttgtttgttggtaatttttgctgtctcactgacgccaagagtcctggaattaaaccccgtggccagcaggctgttagttcgtcaggaaattccaaatgggtataaataaattctctgcaacagctcctgggctctttgcctgctaatgtgtggagtccctttaatgctgagggaagtttgcctgagacctggcttcctgctcgctgaaaatcacagttattttgtttctgggtgggtaagtaagaatgcccacaaaagaaagagaggaggagagcatgatgtttgggtgggggttggtgaaatataaactcgagctctgtgtgttgtgaaaaagatttgcttttacttcaagctagaaagaataacccagtacttgatttttggtccagtgaaaatttcagctttacctatggctttaacataaagatgtcattgttgcaggagtgaatggttgtacatatatatatgctaagatttgagtttttgagtttaaggtttagttcaattcaataatttccttttttgttgctaaatccatctttgggtatttgttttcagctctgtttttccaatagggagttgctcaatattcattaaagctggcttcttgtataaacactataaaacaaaataaggacagggattcatacaaatactagctttccactaccaccccacctccccctggccaaaaaactgtaatgttttgttagaaaagcctgttttatccctaagttagccagtgctccttttctgcttttcacagaattactctctgaactggcacatttcttttttacgcttagaacagcatgttacttttgaagaaagtttggaaaataacagtccaagctcattctcttctgtgcatgcatgattgatttgggctgtatttcagcaacaacttttaaaatgagacagtggacattagagagcagcatagttggggttgcacttaggagcccatggcattttggctgttttgagacagatttggggtaaagagttgctgcatcttgtagttggcactgaacactggagaagagggccactgtataaaccgcaaggcccctgttaccatcacatgcctccctagcacaatgtgccctttattaagacaggccgttccactactgagaatagtaaccctttccgctgtcttcccctcactcttacgtgcagcctggcttctggcctcttaacccatgcccagagtagaattggcaatacccaggagggacactgcactggggattgttaggtcatgccagttaggatgcagctggaaaggtgctgctgagtgggacgtgcagaggggaagactgcaggctctgtctgcctgagctcatctggtctgacacctgccgtgattcatttttcttcatgccatgttaagaaattttgtatcaagtctagtcgacagttactcatagcctggaagcaactttggaaatcagagttccactgacccccctcattttaagggtatgaatcacatcactgcattgtatgattccagggctctcttgcccatggctcgtgcatgaactaggaagtgatcatagttcctgttcttgttttatgaaaacaatagtataccttcccccaacctaggcaggccattcaggacgactaccctggaggtgctctgggtggcttaaagcaccgtctttgcacagtgtgttagagagcactgtgccctgaggacttcgggagagctgcagaatgagtgttcagaataatcggcactcacctttgccctcatgttgtgagatggagatattttaacctggccataatatgctttaaaagttggggggtgtttgtctgcttttgcttttatttccttcctgtgctggactgggactcccccttatctaactggtacataccactctgcccaagcagtgcgtgtgcacacacacatcccctacagctccctgctggcatctccttcatacactcttaagaagaagaaaccaatgtagaactcaagattttagcagacttacttggtcttgaacaagtatcacaaataccttaaaccctgacttcgtgggggggggggcaaggtatagaggaggaagggttctggatcctctctggggggccagggttgtgttcttctccagacaacagagggtgatccagtaccactagtagtgacaatagaacccacccattgttctaagtgacaacacactgatgcaggtactattattttctcaaacaattggaatatagtctaatttgccgacagctgcaaagcagcagagccaggattcaaacccaggcagtctggccccagagtgcctgcttcaaatcactacatctcttcctctgttatacttattcatcagtagatgcctagatgtggggctttacacttcagcagatactaagagggccatgtaccaagcgccaagtactgaggaatacaaacataaatactgcttgagggccaggcgcggtggctcatgcctgtaatcccagcactttgggaagcccggctcacgaggccaggagatcgagaccatcctggctaacatggtgaaacgccgtctctactaaaaatacaaaaaattagccgggcgtggtggcgggcgcctgtagtcccagctactcgggaggctgaggcaggagaatggcgtgaacccgggaggcggagtttgcagggagccgagatcacgccactgcactccagcctgggtgacagagcgagactccgtctcaaaaaaaaaaaaaaaactgcttgacttctgcctcccctagacacttagagtctggtagagaaacacaggcatgtgcttgctaactgtaacacagttccgcgtatataggcaaagtgacttaggaaacaagagggaagaaggggaccagttattcccaggacagagcagttgagggtaagtagggctttacaaaaatgaggtatctgggttgggccctttaggacaatgcagctgattttgacagatgggagagtgtggggaagggtgtgctgggtagaggggatagaatgagcaaagatagataagcttgaaaatttctcagtacgttgaggtttggggtggggaggaacctgggaggtgctggattggggctaaattgttgacatttcgtgccacagaaaagagcttttaggctttcttctttaaagtggagctcctggcacatcactttgcaaggatagtgattgagaagttgtagacgtttccaggaatacctgaaacaaatgtaaaatttctcaaataatatgtaatacaggaaagcaaagccatctgcccctgaaaacaggctgcatatttgcagtatgagtaacagcagagtctgggctgtgctccctagtggcaggctgactgcactcgtgcaccctaaggacattgatgcacagatgaagaaaggaaagacagaaataaaatttatttttaaataattttaatcgtacataaaaagagctctcatgtcttcctcacccagactcagatttcccagtggttaacattttaccgtatttgttccatctgtgtgtgtgtgtgtgtgtgtgtgtgtgtctgtgtgtagaaatgcagttgtcatgtctttttggcctccttccatctgaaaagttctcgtttttacctttttttcatggccatgatggttttaaaaagagaggcctgacattctgtagaatgtgtttcaggcagggtccaggccatgccttcttggcaggacagtgcaaaagtgatgctctgctcttccccatgcagatacatgatgtcaactttgatcacctggtcgaggtggttatttgtcagctttctcatcatagagtcaccatttttttttatgattgacatttcatgccacagaaaagagcttttaggctttattctttaaaatggagctcctggcacatgactttgcaaggatagtaattgagaagttgtagacgtttccaggaatattttctggtgagatattctgagacgacatcagtatcttagtctttagtaggaaatctctacccactagccttagctagtgattcctacctgaatccgccactgttctaataattggtccatggtgattttctgttgacataattccttgtatatattagttggtattcctacatatttattatagcatgatggactcacaagtagatacctattctctggattgtaacttgttactatcattaatcatattattttcatgctcaaattatcctagatttggctagtgggggttcaaaagagtttgaatcaaatatacccttgacactggcattaaatagccaatctgatgtgtgctgacgattgagactaataactggtaggcggagggtgttatctgagttctagatatgtatttatctcagacagtatgggttacctgcaacaagatctgtggtaggcaggccaacagtaacactcgggaccctagaggcaagccaacctgaaattcagcttgtcagagaccatctggtgggtggaagttttgcgttttcagagtatattgtttaagttccccaggcctatcgtctacctttagctttccctgttggccaattcaggccctggtcagatgcgggtggataggtacacaaagctggaaacagcgtgctgcccgcctttctctcctgcctccagagacacttgttggctgtcagggtcggtgttgtcttagcctcacaggcattttcagtccttgctcttcccatcctagagtttcaaacacagagcgagtctgtgttctgcatctcaacatgctaaatcagaacctggattccctaaaatgttgtctcctgtttcttcctgccctcactcatgccatatccgtccttcccaggttagatttctcatacttcagtgaccttcagaaaaggaatcccatcacttttctctgcggtgagtcatccattggtttaaagaaaaaattttcttttttaatagcagaatgaggtaacagagccctagaagacaagcccagagaccggatcctggtctccagctcagcccagagtagctggaatttgtcagaccttctcagtttcctccgaagtattaggggcagacagagtcaaggctacaggctggctagcccagatgcagacagtgtcaaagttctcattgtggaataccaccagaacttatcttactattaccacttaccatctaattgggtaggtaaaattcatatggtgcaaaggagtttgttatacctagacaaaaattcatggggacttgaataatccatggaaaccctaatggagaatgctgaggagaattttaatctccagcatctagccagagcaatcttattaaaatgcaaatctgatcatttcactcccttgtttaaaacccttcaatagcttaccaatgcatctatgatgcaaaaacttgatccccagggtcctgtggaattagggctctgtctgtcccctttctgcctcactgcagtctttgcaaagtcctcttcccagttcttaaaagtggcaggttttgcatatgctctttcctctgcctagaatttctgccatccctccacacatccccaccacactgcccggtggactccttagctaccgctcccttgaagaaccctccctacccgtagcctaggcagggtccctgctgtgttccaacataacgcctgcattgtgctttcacaacacttaatacagttgttatttatgtgatcacttgtctgtctcctcctatacttcgtaagttctacccagacaggctctgtgtctgttttgcttagcacctagccgtgtttggcctattgcaggcacttaataaatatttgctgaatgaaagaatacatccatctttcagtgtaacaactgcatcttccttacatcagcaggaacaggtagatgtggaagatggagctggtatggagaagggtagtgatgggagacagtggaagatgtaggagtagtgtgcaggttaatgtctgttaaaaaagtccagataagattatctgtgagaggaaatccaaagatttgtggggagaagccaaaaggagttaggaagggttaggagtacacgaagcaagaccacattctaacttaatcatataaacaaaccaagcctgtaaaattgcagttatgctacatatgtgtcaactgacctgatatttcttaggaacttctggcatatacttttgctttctttaatgttacaattttatttgcatgaagtgtttaggtagctttttaaaacagctatactagcctgggcaacatagtgggacccccatctctataaaaaatttaaaaattagccgggtttggtcacacacatctgtagtcctagctactagagaggctgaggcaggaggatcgcttgagctggggagttcaaggctgcagtgagctgtgatcgtgccgctacactccagcctgagtgacagagcaagaccctgtctctaaaagaatgaatgaatacatacttacctacctacctacgtataacctgaagaggtattggtgaattgcagtaggcagtataaactctgtgaggagaagcatttcaggcttcttagaaaaagcctagcacgtggcaggtgcccatcatttgaatgcctgaatgaacgggttttatctgggagggaaaagagcaggcttaaaaacaactctttggtaaatgcaagagcaaaagaaaatctcatctgttatacatttcctttaaaccagaaggaggaacactcatattgctaccctttttattgtgtgttctctaacaaatggtgttcctcacacaaatttgatacaggtagcgaagctgctgggtctcaaagagcttagtgctaacagtgtcatcaggagataccacctgctaaacccgttcagaaggacgctgttgtacttcgctgtcttcttagaacactttccactcctggaaaagttgatgtgctaacttaattactctcatactctgagtaattagcttcatgagaacttgcctctcttcctgagttcatcctactggtttgctttcctgctgacgtgggatctttttgactgctttgaacagcaggatgcttacactctggggcttttaaatgtggaaatctgtgataattatgtacttctctaggactgactcagctcttcaagcaaaatcttcatgcttcatgtgagaggggacaataacattaatgggaattagcaaagttcttcagtttcaacagtcaggtgtggtatctggcgaagaaaaacacataaatagtgtgtgaaagttgtggcacaggggtgtaattatttttcacagcaccgtcagtcagtaactgggcctagagtgtgcagcagtgaaatcagaacaaagaagtcagtgtgtcctaattaatagataaagtaataatatcaaagtctcctccgttttaaagtccacaggacacattatttcaccccagtgctttttgctcatattaaagaatggctcattgtggtagagtatgtagaaagtattgaatgcttttctttactcaaaagtggcattttttatcacttgagcacttgagcgtagtgttattggccccaataggaaatgaaagacttgaagactacagatttttttttgaaatggagtttcactcttgcccaggctggagtgcaatgtcatgatcttggctcaccacaacctctgcctcacaggttcaagcaattttcctgcctcagcctcgcaagtacctgggattacaggcatgcaccaccatgctgggctaattttgtatttttagtagaggtggggtttctccatgttggtctcgaactccccacctcaggtgatccagccgccttggcctcccaaagtgctgggattacaggcatgagcctccgcgcccaatggaagaatacagattatatggccaaaatttcagttgctatctgtgaatttttattcttctcgctgtccccagcacaggctttctcagcctcagcgctactgacattatgagctagataattctttgttgggggaaggagggcctgtcttgtgcatggcaaaatgtgtgcagcagctctggcctctacacactagattcgggtagcaccccaagcagcgacaacaataaatatcttcaggcattgccaaatgtcccttcgcgggggcaaaatcacctccatgcctcgtttggttggtttaaaagaaaaattacctccagttgagaatcactgcaagcaggttagtactcgactagtttcctgcgatctaatcttcttcctggtgagtacgttaatttttatgtctttcaaaaccatgtattatttggacagcaagtttagtttcattaaaagttaaaatcatatagtactttatgaatctagatgaaatgatttttgaaatatccataactccatttcactttgttaatgcagaagaattgcaagcaaatttctcactgttcttgaggcagtaaattgggcccctctcacagagcactaagttttataggagatgaatatataaataaggagcagacttgccatcagtttgttgatttcaccttttctctgaacacagaggaatttggtctgaacttggagagttttctttaatcgatgccgttgcattggtgtttggttaccccaaattgcagagtgtgcaaacttagttgggagcgagagggaggaaatggactctgtgacccttggtgtctaggagtgagttggctcagagatgatgccaacctaagacaacatggagcccagtgttagttagcaggccatccacttaccttgagacgctggtataaattctggcaatgccagctgtcatgtagctgtttgcttcacttctgcctttaattacttttctatgcaccccatccccactagactgtgagccttgtgagaacagagactttgtccattttgttcggtgcccccagctccgagaacagtgcatggtaaatagtaagtgaagatccatagaaaactagagagatagagaaagagagacagagacagaaagcagaaattaattcatgtgcctttattatcaatatcaattataaatgtaagtcgaatgtgtgaataaatgttttattcggtctgcacttcccactgggtattataacattttaactggtcctattgaatgtagcctctttccctacgtcagtctcacgcacgcacaattgtcaagacgatctttgttgatgccttttagcccctagtttcagtggaaaaacttgccctgctccaggatgtgagattggtggcctctcctgtactcatcttcttccccttgtctaaccttggcattccttcagcagcaccaacaggttctgtcctggctcttcacctttttactctggtcatttaccttgtcttcagaactcatctctcgttaactcggttctgttttgatcactagtttacatactttcatactgcattgtgttttggttttttggagtgggggcggggttgttgttttttggggttttttcagacggagtctctctctgttgcccaggctggaatgcggtggtgcaatctcggttcactgtagcctccgcctcccaggttcaagcgattctcctgcctcagcctcccaagtagctgggtttacaggcatgtgccaccacacccagctaatttttgtattttcagtagagacagggtttcaccatgttggccaggctggtctcgaactcctgatctcaagtgaactgcccaccctggcctcccaaagtgctgggattacaggcatgagtctccactcatggcctgcattgttgatatatgcctttgtcactgatctcaattagtgttaagggtgtttggtagtcatctctcagctagactatatctgattttatttcttaaaaatttttcctcttactccttccactgaataggaccattttctgtagccaattaagctttcaataaatgtttatataatgaaagtagaggtggtgccaggagcagtctccaccactggatttccagacattcaaaaaatttttgtaaacaccagggacagccctccaattccagaatatttagttggaagctattactctcaggatttcagttgcagatatagccagtggaattttgactgtgcaaaagcaggcatagttctgttagtccaaaaaggcttagttaagagtctctttataacccaggtagatttttttttttaaactgctcttttttttttgagacggagtcttgctctgtcacccaggctggaatgcagtggcgtgatcttgacacactgcaacctccacctctctggttcaagcaattcccctgcctcagcctcctgaatagctgggattacaggtgcacaccaccatgcccagctaaattttttgcatttttagtagagacctggtttcaccatgttggacagactggtcttgaactcctgacctcaggcaatctgcccacctcggcctcccaaagtgctgggattacaggcgtgagccactgtgcccggccaaaactgttgtttttatacttcctcttgatcctgaattaataatttaagttttattgtaacacttttccagttaataatttagcgtctttctcctttttaagatctagtcttaatttttgagagggaaagggggaagaactgtagtacctgttagaattcagtgtaactccaagtaaacaagacccaaaacaaacgatagctaaaacaaaatagacctttatatctttttcacttaaaagtatagaggtaggctttttagaaatgttatagtagctctgatccacaaagtcctttgaggcccaagttccttctagtacatcgttcctccacccctagatatgaactcatgtttcaaagttacactagtgttctagtcatcacatctgcattccaggcagcaggatggaggaaggcacaaagaagaacataggtgaaaggattatttctgtgtttcttaatggaggttcctggggtatactacatgacacttctgcttacagacttttatttgcccctattagtgtggaaggaggggataatgcatactaaagaacatcaagctgtctttgccatggccacccctattcattcacctcccaagtgaactttctcattttattgcagtcaattccatttgccttccaaacagagacttcttgtaatatattttaagacaaatgcccaggccaggtatagtggcttacacctgtaattccagcatgttgagaggctgaggtgggaggattgcttgaggccaggagttcaagaccagcctgagcaaaatagcaagaactcatctctattaaaaataattttaaaaaattaaaattagccaggcgtggtgctacatacctatagttcccagctactcaggaagctgaggcgggaggatcacttgagcccaggagatagagactatagtgagccatgatcgcaccacgtcactccagcctgggcaacagagtcggaccctgtctcaaaaaaaaaaaaaaaaaaaaaaaaagagcaatacccacgtgttgtaaaaattataaaatataaagaataaaaatcatctataattccacaacctaaagataacaactgaaacaatatcatggaagaaatgtccttaacactaatatttaacgaacaacttctgtcttcagagcatcaagatgtttttcaaagtttattatcttattctgttggccaggcacagtggctcacagctgtaatcccagcactttgggaggccgaggcaggcagattacctgaggtcaggagtttgagaccagcctggccaacatagtgaaaccccatctctactaaaaatacaaaaagtagctgggcgtggtggcacacgcctgtaatcccagctcctcgggaggacgaggcaggagaatcccttgaaccagggaggtggaggttgcagtgagccaagatggcgccactgcactctagcaagtttattatgttatactatatattcagttatttattccttcagtaaacgttgtcagacatctcctttcttcccagcatgttgataattggtgtgtggttgggagaggaagcaatgaaaaaaaaaatgtatattttttttgggggggtgggggcggagatgaagttttgctcttgttgcccaggctggagtgcaatgtgtgtgatcttggctcactgcaaccttcacctcccaggttcaagcgattctcctgcctcagcctcccaagtagctgggattacaggtgcccgccactatgcttgggtaattttttatatttttagtggagatggggtttcaccatgttggccaggttggtctcgagctcctgaccttcaagtgatccaccctcctcggtctcccaaagtgctgggattacaggcatgagccagcgtgctctccaaaaaaaattttttttaattaagttttttgctctctgggtgcttatagtctggtacaaaagacaaaaaagtgttttcgtcttgttaaagttgggaaataaatcagggactcataagtgcctaatttatgttgatgtatgtaaacatacactagaaaacaggatattaaaaaaataatgacaccgggtagttttattgtagaataatttttaccatggacaattgtttgtgaaaatgacaccttgaaaacacatcttacttttttacttgctggagaatgaaacttgaattacaagtcctttgggtagcctggtttgagcagtattaggaaataagcaagcctaacttagttaaattctaacctcttctgattcccagaagtccaaagttcatttgggggtaatacaacgtgatacatgctttttgtgatttctacaaggtgaactaaagaaataactaaagatggaccagttaggttttggtaaaaactgtgataagttttgttgtgttttaaatactgatgttgagtcagttcatctttcctactgaaaatccttaagtgggaaaagtatagaaaaagtaggagttacaccaaaatattaacgcttgccacttgatggtaggatctgagtgccctttttttacgttctttaaattatctgtatgtggcttttttttttttttaatgttttacaagcatgtactactttcgtatctggaaaaaggtttgtttttctttcattttttaagaagaacttttcatcagtggcaaaggctcagttgaaattaatgataaaggataactacttgccacgtgtcataagcccagggctgagaagagtcaggcagtgctctggaaccagtgagtgctgcccggatcctgagaacccgcagagaacagtggggctgattgtgcctctgcacctcctcaggtgaccgagggctgggcaggaggacacagactctttcatgaagcagtgactagtataggaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggtaggtgagctgcgagcggcgtggggcggccaccgctggccgaattccggggggcctgggcgaggggggccggccgggaaggtgcgcactgctgggccgcttcactccaccgcaggcctacgggagtccagcttagacccgccggctcccacacacacatcccgggaggcccggatcagcctgcctgacagccaagctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggaatttcagacagtcctggagacaggtctggctgctgcagcttctctcctgttaatggaatttcagacagtcctggagacaggtctggctgctgcagcttctctcctgttaatggaatttcagacagtactggagacaggtctggctgcatattttgagtgatcaccttctccatgtggagatgaaagttaaaagggaaagagagaaggacagctacgttcttttaacacgagcacaagtttccaggcacagccctcccgaccagccctcccattcttaggctagagcatgactgctgctgggcacttctttcacatagaattcacttcccacacgtgttagaatcgaacagctagagcaatttaatattgttttaaattgggacgtaaggaatatacgtcctttttattcctctgcttggcaatcttatttttgtactttctttccaacatttgggaagaaagcgggcagatggaagcagaagtgttcttcacagcattcacactgtcgggtgtaaatgttcggcagtgctgggggttgggagggcagacagcaaccaggtttgctggaagttacttcaaactggacagcagtcaagtgggtttgtatactcaggagagggcagggagactgatggcttacattttcactcattgcttttgagttctttccatagctctaaaaatgcgcagcttattagcgtggctctgggaaaacaacacatgacctgatcctacaatttaaaaaaataaaaatgaccttgcttttaagtttgaaatgcatagcccaggtcagcgacaaggtctgcgctttgaaaggttcttgtgtttcctcttttaaatgtctggtttagccttaagtagtatttactgagtgccacatgatccagtggttggagtatgtaggttttgcccttatcttcattctttgcatctgtttgaactcatgacaatacaaaacaaggtgttcctgggatagggaatgttttgtccaaaaggagtcaacacggagaaaactcttcctacagttaagacagggtttggttttgtttttaaatgaggagagaaactgagaagtggaaaacacaaaatagagttgaagtctttcctctgtgtgcttctactcatgctgccagagttaatcactaaatatcccatgccccagctttctcagccggggaggtgccaaggcaaattgtaagcccatggaggtagtcaggagctgagtgcccttgacctccatttagaaaggcagcccagtctgcaaaagacagcagcagggacatctcatcccaggcctcctggttatgctgctgactttgtctgtctgctactgacttttagtttttttgtgtgcctcagataacactttgaaaaacaggaatcttaatgtctgctgtctatattccaagagactgtagatgaccaatgaaattatctactggacaatgctttcatgtcttttttttttttttttttaattgagacggagtttttgctctgttgcccaggctagaatgcaatggtgtgacctcgcctcactgcaacctccacctcctggattcaagcaattctcctgcctcagcctcccaagtaactgggattacaggcgcctgccaccatgcccagccaattttttatttttagtagggacgaggttttaccacgtgttggccaggctggtctcaaactcttgacctcaggtgatccacccgccttggcctcccaaagtgctgggattacaggagtgagcaccgtgcccagcctttcgtgtcttttataatgaattcttttaaaaatatttagtaaggacttactatgtgcttgtctcttaatcattatctctgagtactgatggacataaagatggaaaaagatggaaatagtagacattttagactacaaaagtggggaaagaggggagtgagggttgaaaaattacctattgagtacggtgtgcactatttgggtgatgtgtacactagaagctcaaagctcatcattacacaatatatccttgtaacaagcctgcacatgtactccctgaatctaacatacagttttaaaaaataatacaatcattatctcattacattgtttttaagcctgtgagttaaatatttgcatctccatttttactcagggagaaactgaagttaagagaggtttattaacttgcttacccaagccgggcgcagtggctcacgcctgtaatcccagcactttgggaggccaggttgggtggatcacctaaggtcaggagttcgagaccagcctggccaacatggtgaaaccctgtctctactaaaagtgtaaaaattagccaggcgtggtggtgcacccctgtaatcccagcaactcaggaggctgaggtaggagaattgcttgatcccaggagacggaggctgcagtgaaccgagatcatgccattgcagctccagcctgggtgacagaatgacctgtctcaaaaaaaaaaaaaacaaaaaaaaacaaaaaaaacttgcttacccagctgttgtagatccaggttcaaaacataggtgtgtcaactcttaaaatcataccagcttgctgtactgcaacaaacacaaatattagtttttaccattaggtgtattgcatgtcattataatattcttttctccctcttctaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagaggagagactccattaattcattctttaattcagcaaataattattgaatttgagccaggtgcaatggtacacatccgtagtcccagctactctagaggctgaggcgggaggattgctagagcccagaaatttgagaccagcctgggcaacatagtaagacctccatttctaaaaaaatatgaagtaaaaatcattattacttggattcctactctgtctcaagctataggctgtgaagatagtgtgaacaaaacagaacagagcccctgtccctgcggtgcttacattctaggtggggtgcaggatatagacagtagacctataacatgtcaggaggcgataaatactgtgaagaaattaactccggttatgggaacagcgagtggtagtggtcagggtgagggctgtttgagatgaggtggtcaaacttggagagaagggagtcttttcccactcattttttttttttttttttgagacagagtcgctctgtcacccaggctggagggtggtggtgccatctcggctcactgcaacctctgcctctcaggtacaagcgattcttgtgtctcaacctcctgagtagctgggactacaggtgcccaccactatgcccagccacttttgtattttagtagagatagggtttcaccacattggtcaggctgatcttgaactcctgacctcaggtgatctacccacctcggcctcccaaagtgctgggattacagacatgagccaccacacctggcccgataggcgcttacatttttgtctgtcttattctttctcgtattcattgggattcctgctcactcttccttcttgaaattgaagctaataatcagaaagccaccctggatgattttatggcttacagtaattccctgtgagccttaccaacctgattttgcttgtgaccatgtgcactgcctctcacagtgtataacatcatcctcagcttaggaccacactgcctggcttccgtttctggctctccaattctcatgaatcagtgtgacctgggaaagagtgtgcattagattaattttacatgaaaatgtgtgatacagacttaagccatccacagaaattccagtctttctattagtgtctgatggggcaatgattaaaatagactgaaatatattatttttatatcttcctaggtttccactttcaaacctgaattattgttagttttcagtatctgtgctataggacagttagtttgttgtggaagaaaaaaatgaatatgacagctcatgtgtggggtttttgccttttagaatccaaagagtctaataaacatacagggaagtcattttagaataaacaggattaaaaatgatctgtagactcaaacagagtctgcaagaactcatgccatgtctgctttgacatccttttaaaaatcatgatgtcagatgaagtcaaaataaaattcttaaatacctccagacagatggcacagtggatcatccattataaaagcattttgttcccagccttcctccctcctccccaaactggggtttctatttcacattcttgccagaaatattcagctgtaaccctgaagtaatttgctgaccctctgagcacggagaccagggagcaagttcggtctggctgtgtgacagtgttttttggtctatttccagtcacactgacatgccacacatcactggttagatccaaccctgctaacaaacacctaattaatcagctaaaatacagaagacctacagcacttgtgaacaaaacaataaatatttttaacagcacttatttagtcacaatggcagcccctctcagagcacacaagaacaaattttaagtatttctgtaatgcacatcatatttgtgttttcaccattttgtttaacgttctaatgaggaattaattaggttaggaaatgaacgcagagtattccatttttgttatctggcatttgtcatgtggactgaaaattaaagcaacttgatatagtaaagtggagatgctcaacacttagaagctttgagaatccaggtggcccagggtgcactgtgcattcctgtgcacaccataccatagagaatagcactcaccacagtctagaatgtatttctgaaccaaaagatatactggagtatagaagggtattcatctcaatgtttgttttccccaaataaaacagtagggaatttgggtctgacacctaccaaaaagagcatataaatgatcacttatatgaacctaacacagtattctaatttaaggaagttgttcagtttgggctctgaagctagacagtgtgggttcacattctttctctgtcactagaacagattgtctttgttccttcacagggttgtaatgaagattcagtgagtcaataggagtaaagcacagagtataaatgctcaatgaaagttggctgacgttgttgttatggttagagtatttccagaaatagaaatgtagatctagaacaaatgatgccacacagaaattgtacaagtggtcttttgttttcagcctaaatttttatcttcattattctgggtgatgcccctacccaattattatacctctccaactaaccattgtatcaatataaagaagtacatagataacaatgggaaacacaaaattgataaatgttcagtccagagtcattcagaatccgtgtcaaagctcaaaacgaagtatattagcggccaatccatagaattctgttcatttctcctagagttgaagatttgatgatggtgtcacttttcagtatgcaaaaaagtgttatttttagcagcatcataatgcttaacactatatttaatttcttaaaattacaactagagcatgcatcataagaaattaatagttcaagcataggcaacgtagtgagaccttgtctctacaaaaaaattttttttaattatctggtcatgttatcctgtgcctgtagcctcagctactcaggaaactgaggtaggatgatctcttgagcccaggaggttgatttgaggctgcagtgagctgtgatcacaccactacactccagcctgggtgacagaatgagaccttgtctgtgggtgggggtggtggggggagattgtgcacggtggctcacacctgtaattctagcattctgagagctgaggctggcagagtgcttgagcccaggagttcgagaccatcctgggcaatatggtaaaaccccgtctttactaaaaatacaaaaatttgccaggcgtgatggcagatgcccgtagtcccagctactcaggaggctgaggtgggaagatcaccggcgccctagaggtggaggctgcagtgagccatgattgtcacccactctagcctgggtgacagagtgagaccctgtctcaaaaaaagaaaagaaaaaggaaaaagaaattaaaagttcagaagagcatataataaaagagttaaagcctccctggcacactcctgtggtagcccgcgtgtgtttggtatttacagatgtccatgcttgcacgtctgtattttagaaacatatatttttgtaataaaatttgaatcatacatagtccgcctctttgttttttcacctaaaaggtcacgaacatttttctaggatttgagagacaatgtcttggttttgatggaattggaacctgatagtgaccagaggtgttctgtattttttaattcctgatagtatgagtttaatgcatttaatattttcttttataaaataaaaaagttaagaggaaatgagtttctgttataacaaaaatgttggtaaaaaaaagtttattcttcctgtaaatcagttggattgttttcgtttgaggcatagattagtgttttctttttttaattactattttcttctagagagggaagaggagagagaaaattccagataaatgacttacagatactctaaaaatatataactgtctctgagcaaatacaaacaaaactataacagtggaatttaactgcctgccccatgatttatagaacattcatctctcatactgaaaagacctgctttttaaaatcagcttccgtatttatactcttagttatcttagttcatcaaaagttaatgaactcgaagtcattcccataactatgaaagtaagttgtagacaagagatctgagccaaagcaaaagtagtcattacaaaatacgtttctaggtagttttctcctcgttcaaataatatatcatttacctgtcttagcacttggcttcttaatcactttcttttaatgctcaaaagcaccaaaacaatgcaatccaagtgtttctgggaccctgcagatataaaaatatgatgtaggtagtggaaggcctagaagtcagaagagctgacctctcatactggctgtgtaggtaacttgctgtgtcttttttttttttttttttttttttttactcttaagacagggtctcactctgtcacccaggctagagtgcagtggcatgatcacagcttgctgtagcctgaacttcccgagctctaaccatcctccctcttcagcttcccaagttgctgggactacaggtgcatgccaccatacctggctaatttttgtatttttagagacaaggtctccccatgttgcccaggctggtcttgaacttttgggctcaagcaattcgcctgcctcagcctcccaaattattgggattacaggtgtgagccaccatgccaggccactgtatcattttagaaagggagattgtggacttccatggcctcctgtgtcaaataaatagggtgagattagtttttctcctacagtcccttcagcaggattattctgtacaagtgtgagttaactgtttatgttggtgaccacacatgtattagcattcaggctgaggtctgagaggagagcgtagaaacaacatatttgtcctttctcctctatcaaagctacatgcttttcctcacaaagtagtatgtaccaaaaaagaagatggtccttcatgaataatctctactgcctgttccccaaaccatcatttgggcttaaagagtgaattcatgctcgagcccttttttttttttttttttttttttgagacacagtcacactctgtcacccaggctggagtgcagtggtgcaatctcagctcatcgcaaccttcacctcctgggttcaagtgattgtcctgcctcagcctcctgaatagctgggactacaggcacacgccaccaggcccggctaaatttttttttattattatttttagtagagacggggtttaaccttgttggccaggctggtctcgatcttctaacctcatgatccacccacctcggcctcccaaagtgctgggattacaggcgtgagccagcgcgcccggcctcaagccctttttcttaaaaacaaacattatttcagatccctttgaatttttagtcatactttgggaaagtaacctaaatatttgaaaggactccataatgaattggaaatttcagtcctacctgttctcaatgagtaagtttagatgttctttaaaaattaaatcagaatgtcaagctgaaaatgtggcacagctacatggttagttagctggctacactcttcttttttgtgttttcagaaagttcttggcactatcaatacaaatgtagatcagcataccagaacagttggaataggtgaacagagcaacttttaaaatccattttaatatatttttttaaattgattttctaacaaatttggaaacccatggctatataccaataactaatacccattctggacagataaatgttacacagaagactggagaattgatctctttaaaacccattcagctctagttttgggtgattttttttttctttttttaagagatggggtcttgctttgtcacccagactagagtgcagtggcatgatccgggctcacgccactgcagcccccaacttctgggctcagggctcaagtgatcctcccaccttccagctctagtttcactgaattatttttcttgtaaaacagtttgcttttaacattcctttatgtcaaggacataaagttttcattttaagtggcttgtttttcattatagtcatctcatttgccttagaatttaatatatggataattataaaagctaagtgcacttcggaatgataattaatgcatcaaaggtgttcctcttattttccaggacactgagatttctgtcacttgttgtcctttagtgatcactaatctgaccaagtcgtaaaatgaggctcatgctttattggtgtttatggctgttataagtttgagttaatgatagaagacttcacagttgcccactctgctgtccattaacttcccagttgtgcctgtgaaaaccgttgccacctggtgagaattttgagcatctagaccagagtgccagaattctgaaggtgttttgtaattactccacatgttgctgtcgttttgttttgttgagacaaggtctcactctgtcttccaggctggagtgcagtggtgcaatcatagctcaccatagcccctaactgccaagctcaagctgtcctcacacgtgaacctcccaatagctaggactacagacacttaccaccatgcccagctgttttttgttttgttgtgttctgtttgttagagaggggggtctcactatgttgctcaggctgatctgcaactcccaggctcaagcaattaacctacctcagcctcactaagtgctgggattacaggcgtaagccaatgcacccagcctgttttttgtttttcctcagagacggggtttcattctgtcacccaggttggaatgcagtctcaatctcccagcctcaaaccatcctccagcctcagcccctcaaagtactgggattacaggtgtgagccactcccagcctgtaattactcctgtttttatccctattgttcagggagcatttactttctgtttagtatgaacatctaccattagtggcccagggctgttaattaaaccaccagcagttcctaaaaattcacatggatccaagttgatgggttgaaactagaggggagtctaaattcttaatttcagtagtcagcttttatattggttaatttaattcagtggatctcaatcctggcagcacaatagaatcacctagggagaagtttgaaaatactgatgcctgcaattggagacactagttgtattaccaaggctttgactggaatggcatgtttacagagtgctttggggaactgaagttgatctttagagccaatggaagccccttggaaaaactgacctccctcataccttgtcctttacagggttcctaacctgtggtaagtaaagaatgtcactttctgacaagctcaggagccccacgttattttgggacctcgggaaaagaggaagtcacctaatttatataggtatctgcaggcacaaataaattcttggctgggctcaagaggtttgtaaaaggtctaatttgagattccttatgaaaaatgtcagcaaagtcaatgtaaaagaaaaagggggggccatatggcaaatacttactcttgctgcactttatgcaaataattagcccaagcataataagactaaaacttattttggaaataaattggtcccactatgattggtctttggtagaaatagaaaaccagagagagaaaaattatgtttcagaaaaactatagtaccccttttattgactccagctttgtccacttttttggataaggtcatctgctgataactcaataattgattggttctcagggtcatttacctgggtccctcaaggcttcaggttggttctacagggactcctgaagctaggactttcacttcttgtggtagggcttactattaatcttacagtctgctgttcacttatgtgctgtactaaaactgtggataagaatgaccccaaccagacaccagtgaaggcatacggtcaacttgaagacggtttcactcctcttaccttgggggcaaccccttccccaacaatgttccataagcaagaagaaattagagctgtcattagcctttcccatctccatagctcacacctcaggattgaggtgtaccgaaacccaagggggtggggacattgaaactgcctttccaaaatcatgacagtaaaagaaacctgacatagctgactccgtcttacttctgacctccaagctgtccttgttcattcctaggcacaggccaagctaactgtgggtagaatttggtttataatttaaccttaaagcaaggatgataatagcccttcccaagactaaactgcctttgtaaaactaatgaaagcacacaaggttagaattatggacgggccctgaattctattttatttattttatttttttgagatggagtttcacttcaactgcaaataagtgttcattctctctctctctctctgtctctctgtctgtctgcctctcttgctctctctctctcatatctggacccatccagatcattgtatctacattttttaaagtctcaccctcgattcaggtgattctaaagggtagctagggttgaaacgactgaattttgtttgttggcctctttgttctttggctttcctggctgcacgttttcttcgttttgctcaaacacagcagtcatttgtcagtcttacattggtgcatgcggtgcctacaactacaagtgggtccttatcaagttcagagaattgtttataggccactcaagaccagccagagtttcaacaccatccaaagaacattttctggcaatataggtgaccaattccctctgacttgacaaaggagagccagtttggaatttaatgaggttcttttccttaccagttaagcctcagtagaatcctcatgacctttggttgaattacatggacacttattaaaggctctcaatggtcccgcactgttctaagcactggacaggacaccaaataagaatgtagcagggaggaactcaagatgctgaccatctcattgaggagacagggcatatttgaatctggaccgtaagtgctacaggacaatgatggggaaaaaagacatctctgtggaatggttggaatggtatcatagaaaaaagactagagaagatagaatttgggccaagccttgaaaagagtatgggtcgaattcagctggtgaaggatggcgaatttccagacctgtaggatgatctaattactccctactcacagagttggagtaattaagtcacaggaccactctgaacagaatggacagagtggaggagtagctgagaggtaaagttcccgcaggcaagatgaaaccttccaccttgacccttggatgcctgcaggaggaggtggaccttgattggagaagctttaaaaagccctagtttacaaaagtaagctgtggtgagaaaaattatagcacctggtattcctgggtgacactatctggaaggggtgggaggaaaggcttaccaggttgttagaaatgttctgtatctctgttacagaggtggttacacaggcgtatacatctaccaaattccatccgacttacacttaaaatcagtgcattttcgtggggcatgatcacaagcacctgggtcctgtgtcctagctactccaaaggccaaggtgggaggattgcttgagcccaggagttcaaggctacagttagctatgatcacattccattgcactctagcctgggtgacagtgtgagaccctgtctgtaattcattctgtgcattttattgtctataaattgtgtttgaattttttaaaaattttaagttgtatttaaacaaagagaacctatggattaaaagactttaaaataatagcaaccaatggaaatacatgactggaattctgatgcaaacaccctattaaagaaattttttagagactattggagattgggcacagtagctcatgcctgtaattccagtactttcagaggccaaggtgggtggatagcttgaacccagcagttcgagactagcctgggcaacatagtgaaacccatctctattaaaaatacgaaaaaaaaaaaaaaagaagccaggcgtggttttgtacgtctgtggtcccagctatttggggggctgaggtgggaggattgattaagcctgggagacaggttgcggtgagcagagatcacgccactgcactccagcctgggtgacagagtgagatgccatatcaaaaaaaaagactattggagaaatttgaatactgactggattatgtgataatcatacttatctttttttaagatttgatagttttagcctcaatggtttgcattttttagagttcttttagggacatatactgaaatatttatggatgaaaatgattgaatctctagctgttgcttcaaaataatccagtgtgagtgggcagagggagttatcagggaaaccagatgttttctaatcattgttgaagctagtaatgggaagacaggagtttattaaactattatctacttttgtatctgttttatggtttcaataatagtcaaaactatcatgtatttgcatttaaaaagtcattgttggttattgaagaggaaaatgcttcgtacaagcatttctctacaaagagtgttctggcggccaggcacggtggctcacacctgtaatcccagaactttgggaggccgaggtaggtaggtggatcacttgaggtcaggagttcgtgaccagcctagccaacatagtaaaatcccgtctctactaaaaatacaaaaaacagctgggcgtggtggcgggcacttgtaatcccagctactcaggaggctgaagcaggagaatcacttgaacccgggaggtggaggttgcagtgagcagagatcgcgccactgcattccaggctgggcgacagagcgagactcaatctcaaaaaaaacaagagtgttctggcattcagtgattaactagtgagactttttggaggccgctgcaatattttctaagtaatgatgaatggacttggagaaggaaaaatgaagataaatgccctgctttatctactttgcttaaaataagtcaaaggcacattaggcatttcatatttgcagttaggggacatcaagtcacatagtgtgaaacgttgtttggaccgctgaattcagtattgtgtgtatgtgtgttgaggaggaagttggagttgtaaaggaatcgtccaggtagcccccatgtcccacagctaaaggagaaagcattgtgctgttgatttggggacaggggactgttcaccgaattaggaaatgtgagttctcgttcagctctgtggcctggggcaagtcctgaacctagctggccttcagaatccttagctggaagtctggaattaaaaattaggtgatatcccttgaggtcaggagtttgaggccaggctaaccaacatggtaaaactcagtctctactaaaaatacaaaaattagccaggcatggttgtgcacacctgtagccccagctacttgggaggctgaggcaggagaatcgcttgaacccgggaggcggaggttgcagtgaactgagatcacgccacagccctcactccagcctgggtgacagagcaagactctgtctcaaaaaaaaaaaaaaaaaaatttagatgatctctaatgccttacattgaattttttgccagctctcactcttttactatagcgtcattgttttaaaccagtcaaagtagaccacctgcatcagtgattcttgtaggtggtggggaatgtcagaaatgccatcacttggcccccatcccagaactgcagaatgatctcctggcagcatgttcctgggaatctgcattttagccaatgtcacaggtgattcttatgaagaatagaactcagagcagttttagggcttgttattcgttctttttcttcatattgcctcaaaatacaatcaacacttaagctgcttttcttctaagaatctaagagatttcagagctttactttgaaagggataaagttgtgatcacctgacattgtgagtagatttaaatgtttaatttttgttagtaatttataaagtataatttaggaaatactagagacaaaaagaaaaaagttatagtagcctgtgactctttagccttagcaaagcagtgttaaatgggtttcctgtatatccttccatgatttttctaatacatacatatgtaaatataattatttactaatgccagtaggcagcaatgagaacaaaacctcttttgtatttttttttcccatgagtcaaacaaaagacttcagattcagatcaattctggtgtgctagggcaggcctttcctacaaggggtggagaggccagcctttcttctcttggtgggaatggcctgagctgtgttgtggggcaggccgctgatttgtgtgatgtatcattagagggaataagcccattgatcttttctagtttccgttaaacttgaactgagaggccaggcacggttgctcacgcctctaaccccagcactttgggaggctgaggcgggtggatcacctgaggtcaggagttcgagtccaacctggccaacatggtgaaaccgagtctctactaaaaatacaaaaattagctaggcatggtggcacttgcctgtagccccagctactcgggaggctgaggcaggagaatcgcttaaaccgggaaggcgcaggttgcagtgagccaagatcgcaccactgcactgtagcctagcaacagagtaagactctgtctcgaaagaagaaaacttgaacggagacaaaaattaaaaataaggccaggcgtggtggctcatgcctataatcccaacgctttgggaggtcaaggcgggcagatttcctgaggtcacaagttcaagaccagcctggccaacatggtaaaaccccgtctctactaacaatacaaaaattagccaggcatggtggcaggtgcccataatcccagctactcgggaggctgaggcacaagaatctcttgaaccaagaaggcagaggttgcagtgagccaggattgctccactgcactccagcctgggcaacagcacaagacaagacactctctcaattaaaataaaaaattatttaccaaagtaggtttattttctccgtattattgtatgacctatttttaatacacatcatgctcatctatgttaatattctcctatatcaagatttgtaatggccatatagaattcctctgtataaatataccagtgcttatatggttgtttcttacaagcagactgtctgcctctttttactgttttaaacatggaaacaatagccttctgtgtctttttgtacatccttaggataaaacttttagacaattaagtgaaataatttttcatttttaaaagtgattttgaacacagttaacccatattcactatagaaaaaatggcaaatccaaggaaatttttttttttttattagagtctcgctctgccgcccaggctggagtgcagtgggacgatcttggctcactgcaacctctgcctcccgggttcaagtgattctcctacctcagcctcccgagcagctctggattacaggcactcaccaccatgcccagctaatttttgtatttttgtagagatggagtttcaccatgttggccaggctggtctcaaactcctgacctcaagtaatctacctgcctcagcctcccaaagtgctggaattacaggcatgagccaccacgcccaggctaatccagggaaaaattaaaactaccatagctgtttcatttagcacagagtcagataacttttcatgtgtgtgtgtgtgtgtgtgtgtgtgtgtgtgtgtgtatgtgtgtgtgtggtaatgtattttaataggatcacacaatacatggaattttattatctgcttttttcaattaaccatatattacaaacatttttccacatcacccacattgaaaattctacaatatatctgtaaaccaaaaataaaattctaagccccctaaccaacggaatagatccctcctgtcagccaggggattccatagtaaacctgaaaaactagttcaggccatgatgggaaggaagtgtcaaacatgcctcattataccctcctccctttggaattcaggcacaactgaccagcattaacattaaaacagagatcttaggagtgacaaacagactctttataccaataagataacaaattccaacctgactctcctatagcatcacatgacagcagaccctaaaagaaaatgaagtattttaccctaaaatatatttcttcgatgtattttgtctttttttgttttgtttcttttgttttcttgagatggagtctccctctgtcactctgtcacccaggctggagtgcaatggcacgatctaggcactacaacctccacctccgggttcgagccattctcctgcctcagcctcccaagtagctgggactacaggcaccccccaccatgcgtggctaatttttgtatttttagtagagacggggtttcaccgtgttgaccaggctggtctcggactcttgacctcaggtgatccacctgccttggcctcccaaagtgctggggttaacaggcatgagccactgctcccggcctcttcgatgtatattgaaatggccctgcaaggctgtctcttgtggggaatatctacattatgtagtgaatccccttacctgtccaggccttttcctgatccaggagagattcagagtctggtacctatttaggtctgaaaagagacatttaccatctatatagaggtctgaaaagtgacgtttaccatctatgtagatgaagcctgctacctggaggcttcatctacataataagaaccttggtcttcacaaccccttatcttaacccagacactcctttctgttgattgcaggcctttagataataagttaactttttcaaccatttgccaatcagagtatctttgaatctaccgaagacctggaagcccacccttatttgagttcttccacctttctaaactagtgtataccttacatgcattgatttgtgtttgcctgtaacttctagtccactaaaatgtataaaattaagctgtaacccagccaccttgggcacatgttgtcaggacctcgtgagattgtgcttttggccttggtcattcatacttggctcagagtaaacctcttttttacagagtttgactcttttcattgacatatctgtatacattaattacaaaatattatttaatccaaattgcttcggtcagtatacagattttaagtggctaacatatacaaaagcactctagtagatttgttaagagaaagttgatcagaactgtttgatgccctcaaaatatttaccatctacaagggagtctaaaaccatcatacaagtcatcttgtacattgtatcacagatccccaggagaaggtacaaaagatgggctgtgagagttcagggcaagaacattgttagtgaaggagatcagggaagggtctgaagaggcagtgatgggagggtgcggctgtgtgaagatgggggaagaaaggtattccaggtagtagaagggcataagctgaggcatgctgccaggaaacaagagacccgcatctctatacagcgagtcctggcacttaatgggatgcagtccctgtcccagtaaggacgacaggaggagtgggaaatgaagttgcgggggtcagccagtaccaggttatggatagtttagaatctctggctctgcagtgtggactacatttcctgagcagtgggtgctttttaggcgttgtcacattttgttttagctggaataatgatggcattggagctggctgggagtaatgctctgaagcattgtgccagagtggaagtagtaatggaagaggggcagtaaaatgctacttccatgactagaaaccaaggctatgacggtagcagccaaaacagagaaaagaagaggtgctgtggagttagaatgacgaggcccggcagtctgcctacgctaatgaaatcaggaaagctggagcgtcaaaggggcttctgagttttggtggctgggataatagtcccattttaaattatgagtggcaagaattgtttttgttgaagcctgctttttcagtcctagcatcacacactctgtacctttctttttcctgataggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaattgacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacatttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgccacctaggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaaaaaacttaaaaatggcaaaaaaaaatctctaaatgttattccagaatgtcataaaggccaattggtgaagccgaatgtcaccctcccaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatcacctgaggtcaggagttcaaaaccagcctggccaacatagtgaaaccccgtctccactaaaaatacaaaaattagctgggcctggtggtgcacacctgtagtcccagctactagggaggctgaggcaggaggattgcttgaatccaggaggcggaggttgcagtgagccaagatcatgccactgcactccagcctgggcgacagagcatgaccctgtctcaaaaaaaaaattagatatttgggttgaaataaaaatgattttcttcttgtgaccaatcgtaacttgttttttctcctttcaggtatgaattaagtgaaaagatgttgtctgcatgcaacttactgaaaaatactataaatgaccccaaagctttgaccagcaaagatatggtgagtctgacctgcaaacaccatccccagtgtgtacaaagtgcatgagtgggttcattgtcaaggccagctgtaggctgcccgagctgttgcttgcatgcttttctcctgaactgtttccagcatgagtgggctgggtaaacatcatgtggtcttgctccctggatcacactgccagcgtttccttgaggcccaacttcggacatcctttacccaccctggacttttcctggggtggaggcatctgtgaggcgtacacttgcagacagaaagcagggctaattgcagtcagtcgtcatctttctacatatttcatttctatttatagaacagtaagatccagggagcagcatccaagaattttttttttaagttagcatatgtttttaaaagaaacctatctgagccaaggtcagcattcctttcagttatgaaactgtatgttatgctctgatgtggaatgcaggcggccactatttttaaacataaaaataaccgcacttgtcatctcgcagtctaagaaattcagagcaaacagcaaagagtttgtggttgccttagtgatcatgaatggtacaacataggacacaagtatttctatggcaatggttaatgtgacaccatggccaagaatgacatattctcatgtgtcgaagttatgtgcacattctttcataggccagactaaccccctggttgacagctgtcttttttattagtgcattgagaaaatgtaggatcccctaaggataccgaaatgcacagatactcaagtcccttatgtaaaatggtgtagtatttgcatataaactatgcatctactttaaattctgccatatattttaaatcatttctatatcataatacctaatacagggccaggtgcagtggctgacacctatgatcccaacacttcgggaggccgatgcaggtggatcacatgaggtctggagttcgagacgagcttagccaacatggtgaaaccctttctctactaaaaatacaaaaagttagccaggcatggtggtacacccgtgtaatcccagttactcgggagtctgaggctggagaattgcttgcacccgggaggtggtggttgcagtgagccaagattgcacctctgcactcaagcctgggtgacagagtgagactccatctgaaaaaaagcctggagtgcagtggcgtgatctcggctcactgcaagctccgcctcccgggttcgggccattctcctgcctcaccctccccagtagctgggactaccggcgtccaccacaacgcccggctaatttttttgtatttttagtagagaccgggtttcaccgtgttagtcaggatggtctcgatctcctgacctcgtggtccgcccatcttggcctcccaaagtgctgggatttacaggcatgacccaccgcgcctggcctcaaaaacttaacacaatgtaaatgctatataaatagttgttatactgtattgttttgtattacatattttttaaatattttcactctgccagtggttgaatctatggaaatggaacctgtagatacagagggccagctgtactaaataaaattgctggtcaagtccaggcacagtggctcacacctgtaatcccagcactttgagaggccaaggcagtggatcacttgagcccaggagttcagtttgagaccagcctgggcaacatggcaaaaccctgtctctacaaaaattagccaggtatgatggcatgtacccatggtcctagctacttgggaggctgaggcaagaagatagctggaggcccaggaagttcaggctgcagtgctccatcatcatgccactgcactccagcctgggagacagagtgacaccctctcaaaaaaaaaaaaaattcctagtcaaggggaaacatagaactacatattgaaattcttggatttgtattcatgaaaatacctggctataccctggtcactagtaaaaccataaaatctcactgcagggtcagtatttcccatcaggtttaacctaaacttaaaactggtgccttacaaccccagattttatagccatagtacacttttctttcactgttctcaaaatactaggttacgtggcctttgggaaggattctgttttcctgcatcctccaaattgccgagcatggtgtcatccacacacactgtgatgggtacatctttttaactgaattttcatttggtgtgaaagtgtttaaagtattgtgttgtgaaaagtagtggacgagtaaacacaatgccagggctagataatcatgtcaggacaccagttatttagcagtaatagaattagaatgaccagaagacataatttcccttctttcagtgtgacaactccagagaaacaggaatgtgaatatatacagaaaaaaaaggacactcttcaagtgacccaaaatgtgattgaaatggttaaaactaaataatcagtagcaggatgataaagagatggaagctctataatcccaactctaccttttctacagaaagaggacttcttgggttctggtgcttctgacataggctgtctttctttgatatatttttaaacttttaaagagtaagcacagcagaaatgaatattaaactcatatgaaggcccattgaaaagacactgtagtcatcctcatcaccagtactgactgctcagtctccactgagcttcatgtgacccagggttgagttgatcatccacaaagcaagtgccttcttcatgtgtccacagcctaaggaagtcagagtggagctgatgagagaatgaaattagttccagacggggttcccttttattttccctttccgtggttgaacagttgtatttgggattggggtgggaattgggttggctatacacgtacggtctcccaacctagtgctgtgctgaggagttgaaggaggtgagtttggtctggataggaaggaagcagcataattcagtgtaggctagttaatttcttcctaatttctatgaaaattgtttgcaaggccagtatgattacatcatattaatagcttaataaatggagccaagcctgagtgtttattctcatcacagaaactatgaaagcatggtattatccagtttttcagatgaggaaacggaagcagaataacttccctcgggtcataaagcttttaggtagcagagcctgcatttgaaactcagtggtctggctccagagcctctgcttctgcatggtgctgtctggtctcctttatagacattagaatctacacgtcatttaaaatcaggagaaatgtcccagtttggtgtttgaagcttctcttagggctgttggtttttgagagcagattctaactgcatatatatactttgactataaaaggacaggttacttgtgctttcaactaggtctcagaaagtctataaatagaagaactaacgaccacttggtgttttggcagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccggtatgttggctgcccttccaccctctcttctctaacagtacttgggttgtgactcatctcagagaacctggttgagccactcctgaattctctgaccatgctaaaatcctttttattgcttttccacatgacatggcaagaattttcttgagtcattcataagaggcttgaagtttaaacaaaactgggtgacacagattctagatctgtttttgaaaggaggttttgaggatcttcttgctgcagttcagctgcattcaaaagtgagaggtgtatgcctggtaagaagcatgtctcacgttccctcctgagctgaatcatgcgggcttggccggtttgcactcaggaggcagagtgctgcttacaggcccagggtcacagccttggtgcgtgtggaccacttgatttgaccttactccatgactgctgtccttgcagaagtgtgtggttagtcaagatggggactaagcaaagccaccttaacagatggtcaaatgatcaccattctcaccaaaatatactgttattggggaaacagcatagagcaaagggcatgttattcttgtctctcaaccataatagaatagtagaaacttgttatcccagaatagagccagtggacatcttagacatgaagtgagggaggggcacatacacagatggtaccctcaagaaactgtgagctttcaacttcttgttcaaatggagcagcctgatgccacatagaccccaagtcttttaatttttgtaatacatatttttatttctagtatgtgacagagaagtcagagtatctcagtctgattaatgaggatgtagtgtgaaccttagaatatgcaatcatactgtccaattttctgaaattctgtcttcatccactgtccaatctcttctgctctgttttgggaacttggaattgatgcagagaagaaagccaagcagatttatccttcctttctcttataagtgtgtttgttccctctttttggagccatgttagggtataactgcttccatcttacaggaaggaatttcaagcccctcctcttcaggctttctagactataaacagagctggtgatacagtcagccagagtgattgtttaaacagaagtagataatatccagggaagctgaaaacaagatttcactatcactcctgacaggaacagcttagtatacccttagaagttgataaaacatcttggcaaattaaataattttaattccattgctggatggtttgggttaatcacttatcttaatggttactgctcccccttctaggctgagattctggctccataaggtgtagatctaggatgcttcagcatctatgcagagcagagtccgcaaagtccgaggtgctaaggagccccgaagcgcacacgaattcacctgcttctcctccacagggccttttattttctgcattaaaaacacccacttttaaaaacatgtccttagtatggagttgtttgggatcttaaggtaaatgttcatggtaccttttattttcctttatgatagaaacattctgaacattttaacttcatatttggtcccacataaaagctgctttctaacactcaccattccggtcatttcagagaaagtgccgaaggaacttttaaatgcccgaaggataattttatccctgaagactccttaagaattacaagaatagaaaaggtctggttcatcgattctgttaaggggacttaactgcatttgttctcgaccataaattctggagctggatgttatatgattggaattctgcttttcaggacccccgacaggccagagtagtaaattcagagtctcagaatgagtaatgtttggataagtaggtaccaccctgtccaacgttccatacgtaagcgtttgcaaacacttcgttcatgaatagctcactacctgcttcactttcctaaacacagctgagtgcctagattccaaaaatcgtttattctcaagagcaaccagtagaacaaccaccctgacttccaagccattgcatttcagccaccagttgcaaacaagatacgctgtggaagcttaccgttgtttctcttgcttcaggtgtcgtgaaatagggggaaaaaaagtttttggtttagtatgaaaacatctctcacatttccttctaagtcactcttggtctccagccacctggtaccatttcactgggctcctgtaaacaccatcccttcagtggcttcgtaagcggctgctattagaaggggctgcttcctaagagacttttttttttttttttttacagatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggttagtgcgcctggttcctgtgctcaggaatgcacccgtaaccagcagacaggactgcggtggccattctggcagagcaggcatagatgccacgcttccaccacagtgcacttgtttgcaggcctgccctgagtccatacactgcctggcactccttgctgaccaaacataccagggaaatatgggcttaaatttcacactggaaacttctccctcctttgccttgccttttgtccatttgcatagtttgcatggaaatactgttagttcccctacatataaatgattgcgcatccccatcagatgctcagtgactgttgcttcctgtctctgtgttgtactgtcttcatagcaaacagtgtcccaggtccagatgtgttcacagcttgacttttttttttttaagagacggtcttgctctgtcccccaggctggagtgcagtggcgggatcttggctcactgcaaccacccccggctccctggttgcagtgattctcctgccttagcctcccgagtagcagggactaacaggcacacaccaccacacctggcttttttttttttttttttgagactaagtctcattctgtcacccaggctggagtgcagtggtgcgatcttggctcactggaagctctgcctcccgggttcacaccattctcctgcctcagcctcccaagtagctgggactacaggcgcccacccccacgtccggcttattttttgtatttttagtagagacaaggtttcaccgtgttagccaggatggtcttgatctcctgacctcatgatccacctgactcagcctcctgaagtgctgggattacaggcgtgagctactgcgccagcccctggcttttttttaagtagagatggggtttcagtgttgcccaagctgctcttgaactcctgagctcagacaatctgcctgcctcagcctcccaaagtgctagggttacaggcgtgacccaccactccaggcccacagcttgacttttaaccaccacctgaacttccagccccttactctactgagacatcctccacgctaaaatgaagttggctccttactttatgcccttcctttgctcatagctcatgggaagctggtttctccctgcttgccaccacctgccccaagtagttccatcgccagttctttcccttctgtcaccacactcttccccctttccctagcacagccccactagaggccaccactgccagctcagtacgtacttctgaagtccttgtcatctcttcccataggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgtaagctgtctccattgggcctcctggccaggggtctgggggactctggacgggagctctgggagtgccttttggccaggagcgaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaattcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacaacatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttttgcgtgtctctaggccaaaggacaggagtggtgataggtagaaggtaggaactggcatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacatggaagctgcagctgtagcagattcccttcttcccctctgtgggagggagagcttctgaccgacttctttcttccagaagagtttgttagctgtgctgtggtttttgtttgattttacttctattatctttcaaagcttttgaggggaaggatcataagattaaaccaaagagaactgtgtcctgctgctgctgctgaccagagggaaatccgtatttcaagactagataggctgggcacagtgggtcactcctgtaattccagcaccttgggaggctgagacaggaggatcgctcgagcccaggagttcaagaccagcctgggcaacatagtgagactcccatctctacaaaaaaaaaattatctaggtgtggtggtatgcacctgtagtctcagataccgtggtggttgaggcaggagaatcacttgagccctggaggtcaaggctaccgtgatctgtgatcgtgccactgcactgcagcctgggagacaaaccctgtctcaaaaaacacactagacagaagacaagttgtgttgttctttcccttgatactcctttatatccatttaaatccctgaaatttaatggaaatcaagcagttaagtgaagcttttttcacccatatgtagtgtttcccctcttatttccagaagttggatctgtgcaacccactgggattgcgtgcttacacacagatgttacttgtagccttaaaccgaggtggtttagggttttaggatcacagtgccctctctaagaggaaaggtaaaagatctttggcaaattgcagagtctctaaacacacactactgctgcttgcctggtcattcataattaattagaagaaaaaaaaactttctatccccatcttctgcttccccctcctggtgggcagaatggttgagtaagataatcctcttaactgggacctctggagggtggaggcttgcctcattcatcttcacatcctcaggccttcacccttagaggtcccaaaaaagtttcccagaagaccgaacgagtagggatatttggggaaccttgccaattattggagggtgttttgttctgttacctttcggttgtctggaggtttgagaaacccaacatggcttgttctttccatcttatcttaaggatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctttt

SEQ ID NO: 256 - DNA, 241412 bp, Homo sapiens; identical to SEQ ID NO: 255

SEQ ID NO: 257 - DNA, 39301 bp, Homo sapiens
tgattgtgcctctgcacctcctcaggtgaccgagggctgggcaggaggacacagactctttcatgaagcagtgactagtataggaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggtaggtgagctgcgagcggcgtggggcggccaccgctggccgaattccggggggcctgggcgaggggggccggccgggaaggtgcgcactgctgggccgcttcactccaccgcaggcctacgggagtccagcttagacccgccggctcccacacacacatcccgggaggcccggatcagcctgcctgacagccaagctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggaatttcagacagtcctggagacaggtctggctgctgcagcttctctcctgttaatggaatttcagacagtcctggagacaggtctggctgctgcagcttctctcctgttaatggaatttcagacagtactggagacaggtctggctgcatattttgagtgatcaccttctccatgtggagatgaaagttaaaagggaaagagagaaggacagctacgttcttttaacacgagcacaagtttccaggcacagccctcccgaccagccctcccattcttaggctagagcatgactgctgctgggcacttctttcacatagaattcacttcccacacgtgttagaatcgaacagctagagcaatttaatattgttttaaattgggacgtaaggaatatacgtcctttttattcctctgcttggcaatcttatttttgtactttctttccaacatttgggaagaaagcgggcagatggaagcagaagtgttcttcacagcattcacactgtcgggtgtaaatgttcggcagtgctgggggttgggagggcagacagcaaccaggtttgctggaagttacttcaaactggacagcagtcaagtgggtttgtatactcaggagagggcagggagactgatggcttacattttcactcattgcttttgagttctttccatagctctaaaaatgcgcagcttattagcgtggctctgggaaaacaacacatgacctgatcctacaatttaaaaaaataaaaatgaccttgcttttaagtttgaaatgcatagcccaggtcagcgacaaggtctgcgctttgaaaggttcttgtgtttcctcttttaaatgtctggtttagccttaagtagtatttactgagtgccacatgatccagtggttggagtatgtaggttttgcccttatcttcattctttgcatctgtttgaactcatgacaatacaaaacaaggtgttcctgggatagggaatgttttgtccaaaaggagtcaacacggagaaaactcttcctacagttaagacagggtttggttttgtttttaaatgaggagagaaactgagaagtggaaaacacaaaatagagttgaagtctttcctctgtgtgcttctactcatgctgccagagttaatcactaaatatcccatgccccagctttctcagccggggaggtgccaaggcaaattgtaagcccatggaggtagtcaggagctgagtgcccttgacctccatttagaaaggcagcccagtctgcaaaagacagcagcagggacatctcatcccaggcctcctggttatgctgctgactttgtctgtctgctactgacttttagtttttttgtgtgcctcagataacactttgaaaaacaggaatcttaatgtctgctgtctatattccaagagactgtagatgaccaatgaaattatctactggacaatgctttcatgtcttttttttttttttttttaattgagacggagtttttgctctgttgcccaggctagaatgcaatggtgtgacctcgcctcactgcaacctccacctcctggattcaagcaattctcctgcctcagcctcccaagtaactgggattacaggcgcctgccaccatgcccagccaattttttatttttagtagggacgaggttttaccacgtgttggccaggctggtctcaaactcttgacctcaggtgatccacccgccttggcctcccaaagtgctgggattacaggagtgagcaccgtgcccagcctttcgtgtcttttataatgaattcttttaaaaatatttagtaaggacttactatgtgcttgtctcttaatcattatctctgagtactgatggacataaagatggaaaaagatggaaatagtagacattttagactacaaaagtggggaaagaggggagtgagggttgaaaaattacctattgagtacggtgtgcactatttgggtgatgtgtacactagaagctcaaagctcatcattacacaatatatccttgtaacaagcctgcacatgtactccctgaatctaacatacagttttaaaaaataatacaatcattatctcattacattgtttttaagcctgtgagttaaatatttgcatctccatttttactcagggagaaactgaagttaagagaggtttattaacttgcttacccaagccgggcgcagtggctcacgcctgtaatcccagcactttgggaggccaggttgggtggatcacctaaggtcaggagttcgagaccagcctggccaacatggtgaaaccctgtctctactaaaagtgtaaaaattagccaggcgtggtggtgcacccctgtaatcccagcaactcaggaggctgaggtaggagaattgcttgatcccaggagacggaggctgcagtgaaccgagatcatgccattgcagctccagcctgggtgacagaatgacctgtctcaaaaaaaaaaaaaacaaaaaaaaacaaaaaaaacttgcttacccagctgttgtagatccaggttcaaaacataggtgtgtcaactcttaaaatcataccagcttgctgtactgcaacaaacacaaatattagtttttaccattaggtgtattgcatgtcattataatattcttttctccctcttctaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagaggagagactccattaattcattctttaattcagcaaataattattgaatttgagccaggtgcaatggtacacatccgtagtcccagctactctagaggctgaggcgggaggattgctagagcccagaaatttgagaccagcctgggcaacatagtaagacctccatttctaaaaaaatatgaagtaaaaatcattattacttggattcctactctgtctcaagctataggctgtgaagatagtgtgaacaaaacagaacagagcccctgtccctgcggtgcttacattctaggtggggtgcaggatatagacagtagacctataacatgtcaggaggcgataaatactgtgaagaaattaactccggttatgggaacagcgagtggtagtggtcagggtgagggctgtttgagatgaggtggtcaaacttggagagaagggagtcttttcccactcattttttttttttttttttgagacagagtcgctctgtcacccaggctggagggtggtggtgccatctcggctcactgcaacctctgcctctcaggtacaagcgattcttgtgtctcaacctcctgagtagctgggactacaggtgcccaccactatgcccagccacttttgtattttagtagagatagggtttcaccacattggtcaggctgatcttgaactcctgacctcaggtgatctacccacctcggcctcccaaagtgctgggattacagacatgagccaccacacctggcccgataggcgcttacatttttgtctgtcttattctttctcgtattcattgggattcctgctcactcttccttcttgaaattgaagctaataatcagaaagccaccctggatgattttatggcttacagtaattccctgtgagccttaccaacctgattttgcttgtgaccatgtgcactgcctctcacagtgtataacatcatcctcagcttaggaccacactgcctggcttccgtttctggctctccaattctcatgaatcagtgtgacctgggaaagagtgtgcattagattaattttacatgaaaatgtgtgatacagacttaagccatccacagaaattccagtctttctattagtgtctgatggggcaatgattaaaatagactgaaatatattatttttatatcttcctaggtttccactttcaaacctgaattattgttagttttcagtatctgtgctataggacagttagtttgttgtggaagaaaaaaatgaatatgacagctcatgtgtggggtttttgccttttagaatccaaagagtctaataaacatacagggaagtcattttagaataaacaggattaaaaatgatctgtagactcaaacagagtctgcaagaactcatgccatgtctgctttgacatccttttaaaaatcatgatgtcagatgaagtcaaaataaaattcttaaatacctccagacagatggcacagtggatcatccattataaaagcattttgttcccagccttcctccctcctccccaaactggggtttctatttcacattcttgccagaaatattcagctgtaaccctgaagtaatttgctgaccctctgagcacggagaccagggagcaagttcggtctggctgtgtgacagtgttttttggtctatttccagtcacactgacatgccacacatcactggttagatccaaccctgctaacaaacacctaattaatcagctaaaatacagaagacctacagcacttgtgaacaaaacaataaatatttttaacagcacttatttagtcacaatggcagcccctctcagagcacacaagaacaaattttaagtatttctgtaatgcacatcatatttgtgttttcaccattttgtttaacgttctaatgaggaattaattaggttaggaaatgaacgcagagtattccatttttgttatctggcatttgtcatgtggactgaaaattaaagcaacttgatatagtaaagtggagatgctcaacacttagaagctttgagaatccaggtggcccagggtgcactgtgcattcctgtgcacaccataccatagagaatagcactcaccacagtctagaatgtatttctgaaccaaaagatatactggagtatagaagggtattcatctcaatgtttgttttccccaaataaaacagtagggaatttgggtctgacacctaccaaaaagagcatataaatgatcacttatatgaacctaacacagtattctaatttaaggaagttgttcagtttgggctctgaagctagacagtgtgggttcacattctttctctgtcactagaacagattgtctttgttccttcacagggttgtaatgaagattcagtgagtcaataggagtaaagcacagagtataaatgctcaatgaaagttggctgacgttgttgttatggttagagtatttccagaaatagaaatgtagatctagaacaaatgatgccacacagaaattgtacaagtggtcttttgttttcagcctaaatttttatcttcattattctgggtgatgcccctacccaattattatacctctccaactaaccattgtatcaatataaagaagtacatagataacaatgggaaacacaaaattgataaatgttcagtccagagtcattcagaatccgtgtcaaagctcaaaacgaagtatattagcggccaatccatagaattctgttcatttctcctagagttgaagatttgatgatggtgtcacttttcagtatgcaaaaaagtgttatttttagcagcatcataatgcttaacactatatttaatttcttaaaattacaactagagcatgcatcataagaaattaatagttcaagcataggcaacgtagtgagaccttgtctctacaaaaaaattttttttaattatctggtcatgttatcctgtgcctgtagcctcagctactcaggaaactgaggtaggatgatctcttgagcccaggaggttgatttgaggctgcagtgagctgtgatcacaccactacactccagcctgggtgacagaatgagaccttgtctgtgggtgggggtggtggggggagattgtgcacggtggctcacacctgtaattctagcattctgagagctgaggctggcagagtgcttgagcccaggagttcgagaccatcctgggcaatatggtaaaaccccgtctttactaaaaatacaaaaatttgccaggcgtgatggcagatgcccgtagtcccagctactcaggaggctgaggtgggaagatcaccggcgccctagaggtggaggctgcagtgagccatgattgtcacccactctagcctgggtgacagagtgagaccctgtctcaaaaaaagaaaagaaaaaggaaaaagaaattaaaagttcagaagagcatataataaaagagttaaagcctccctggcacactcctgtggtagcccgcgtgtgtttggtatttacagatgtccatgcttgcacgtctgtattttagaaacatatatttttgtaataaaatttgaatcatacatagtccgcctctttgttttttcacctaaaaggtcacgaacatttttctaggatttgagagacaatgtcttggttttgatggaattggaacctgatagtgaccagaggtgttctgtattttttaattcctgatagtatgagtttaatgcatttaatattttcttttataaaataaaaaagttaagaggaaatgagtttctgttataacaaaaatgttggtaaaaaaaagtttattcttcctgtaaatcagttggattgttttcgtttgaggcatagattagtgttttctttttttaattactattttcttctagagagggaagaggagagagaaaattccagataaatgacttacagatactctaaaaatatataactgtctctgagcaaatacaaacaaaactataacagtggaatttaactgcctgccccatgatttatagaacattcatctctcatactgaaaagacctgctttttaaaatcagcttccgtatttatactcttagttatcttagttcatcaaaagttaatgaactcgaagtcattcccataactatgaaagtaagttgtagacaagagatctgagccaaagcaaaagtagtcattacaaaatacgtttctaggtagttttctcctcgttcaaataatatatcatttacctgtcttagcacttggcttcttaatcactttcttttaatgctcaaaagcaccaaaacaatgcaatccaagtgtttctgggaccctgcagatataaaaatatgatgtaggtagtggaaggcctagaagtcagaagagctgacctctcatactggctgtgtaggtaacttgctgtgtcttttttttttttttttttttttttttactcttaagacagggtctcactctgtcacccaggctagagtgcagtggcatgatcacagcttgctgtagcctgaacttcccgagctctaaccatcctccctcttcagcttcccaagttgctgggactacaggtgcatgccaccatacctggctaatttttgtatttttagagacaaggtctccccatgttgcccaggctggtcttgaacttttgggctcaagcaattcgcctgcctcagcctcccaaattattgggattacaggtgtgagccaccatgccaggccactgtatcattttagaaagggagattgtggacttccatggcctcctgtgtcaaataaatagggtgagattagtttttctcctacagtcccttcagcaggattattctgtacaagtgtgagttaactgtttatgttggtgaccacacatgtattagcattcaggctgaggtctgagaggagagcgtagaaacaacatatttgtcctttctcctctatcaaagctacatgcttttcctcacaaagtagtatgtaccaaaaaagaagatggtccttcatgaataatctctactgcctgttccccaaaccatcatttgggcttaaagagtgaattcatgctcgagcccttttttttttttttttttttttttgagacacagtcacactctgtcacccaggctggagtgcagtggtgcaatctcagctcatcgcaaccttcacctcctgggttcaagtgattgtcctgcctcagcctcctgaatagctgggactacaggcacacgccaccaggcccggctaaatttttttttattattatttttagtagagacggggtttaaccttgttggccaggctggtctcgatcttctaacctcatgatccacccacctcggcctcccaaagtgctgggattacaggcgtgagccagcgcgcccggcctcaagccctttttcttaaaaacaaacattatttcagatccctttgaatttttagtcatactttgggaaagtaacctaaatatttgaaaggactccataatgaattggaaatttcagtcctacctgttctcaatgagtaagtttagatgttctttaaaaattaaatcagaatgtcaagctgaaaatgtggcacagctacatggttagttagctggctacactcttcttttttgtgttttcagaaagttcttggcactatcaatacaaatgtagatcagcataccagaacagttggaataggtgaacagagcaacttttaaaatccattttaatatatttttttaaattgattttctaacaaatttggaaacccatggctatataccaataactaatacccattctggacagataaatgttacacagaagactggagaattgatctctttaaaacccattcagctctagttttgggtgattttttttttctttttttaagagatggggtcttgctttgtcacccagactagagtgcagtggcatgatccgggctcacgccactgcagcccccaacttctgggctcagggctcaagtgatcctcccaccttccagctctagtttcactgaattatttttcttgtaaaacagtttgcttttaacattcctttatgtcaaggacataaagttttcattttaagtggcttgtttttcattatagtcatctcatttgccttagaatttaatatatggataattataaaagctaagtgcacttcggaatgataattaatgcatcaaaggtgttcctcttattttccaggacactgagatttctgtcacttgttgtcctttagtgatcactaatctgaccaagtcgtaaaatgaggctcatgctttattggtgtttatggctgttataagtttgagttaatgatagaagacttcacagttgcccactctgctgtccattaacttcccagttgtgcctgtgaaaaccgttgccacctggtgagaattttgagcatctagaccagagtgccagaattctgaaggtgttttgtaattactccacatgttgctgtcgttttgttttgttgagacaaggtctcactctgtcttccaggctggagtgcagtggtgcaatcatagctcaccatagcccctaactgccaagctcaagctgtcctcacacgtgaacctcccaatagctaggactacagacacttaccaccatgcccagctgttttttgttttgttgtgttctgtttgttagagaggggggtctcactatgttgctcaggctgatctgcaactcccaggctcaagcaattaacctacctcagcctcactaagtgctgggattacaggcgtaagccaatgcacccagcctgttttttgtttttcctcagagacggggtttcattctgtcacccaggttggaatgcagtctcaatctcccagcctcaaaccatcctccagcctcagcccctcaaagtactgggattacaggtgtgagccactcccagcctgtaattactcctgtttttatccctattgttcagggagcatttactttctgtttagtatgaacatctaccattagtggcccagggctgttaattaaaccaccagcagttcctaaaaattcacatggatccaagttgatgggttgaaactagaggggagtctaaattcttaatttcagtagtcagcttttatattggttaatttaattcagtggatctcaatcctggcagcacaatagaatcacctagggagaagtttgaaaatactgatgcctgcaattggagacactagttgtattaccaaggctttgactggaatggcatgtttacagagtgctttggggaactgaagttgatctttagagccaatggaagccccttggaaaaactgacctccctcataccttgtcctttacagggttcctaacctgtggtaagtaaagaatgtcactttctgacaagctcaggagccccacgttattttgggacctcgggaaaagaggaagtcacctaatttatataggtatctgcaggcacaaataaattcttggctgggctcaagaggtttgtaaaaggtctaatttgagattccttatgaaaaatgtcagcaaagtcaatgtaaaagaaaaagggggggccatatggcaaatacttactcttgctgcactttatgcaaataattagcccaagcataataagactaaaacttattttggaaataaattggtcccactatgattggtctttggtagaaatagaaaaccagagagagaaaaattatgtttcagaaaaactatagtaccccttttattgactccagctttgtccacttttttggataaggtcatctgctgataactcaataattgattggttctcagggtcatttacctgggtccctcaaggcttcaggttggttctacagggactcctgaagctaggactttcacttcttgtggtagggcttactattaatcttacagtctgctgttcacttatgtgctgtactaaaactgtggataagaatgaccccaaccagacaccagtgaaggcatacggtcaacttgaagacggtttcactcctcttaccttgggggcaaccccttccccaacaatgttccataagcaagaagaaattagagctgtcattagcctttcccatctccatagctcacacctcaggattgaggtgtaccgaaacccaagggggtggggacattgaaactgcctttccaaaatcatgacagtaaaagaaacctgacatagctgactccgtcttacttctgacctccaagctgtccttgttcattcctaggcacaggccaagctaactgtgggtagaatttggtttataatttaaccttaaagcaaggatgataatagcccttcccaagactaaactgcctttgtaaaactaatgaaagcacacaaggttagaattatggacgggccctgaattctattttatttattttatttttttgagatggagtttcacttcaactgcaaataagtgttcattctctctctctctctctgtctctctgtctgtctgcctctcttgctctctctctctcatatctggacccatccagatcattgtatctacattttttaaagtctcaccctcgattcaggtgattctaaagggtagctagggttgaaacgactgaattttgtttgttggcctctttgttctttggctttcctggctgcacgttttcttcgttttgctcaaacacagcagtcatttgtcagtcttacattggtgcatgcggtgcctacaactacaagtgggtccttatcaagttcagagaattgtttataggccactcaagaccagccagagtttcaacaccatccaaagaacattttctggcaatataggtgaccaattccctctgacttgacaaaggagagccagtttggaatttaatgaggttcttttccttaccagttaagcctcagtagaatcctcatgacctttggttgaattacatggacacttattaaaggctctcaatggtcccgcactgttctaagcactggacaggacaccaaataagaatgtagcagggaggaactcaagatgctgaccatctcattgaggagacagggcatatttgaatctggaccgtaagtgctacaggacaatgatggggaaaaaagacatctctgtggaatggttggaatggtatcatagaaaaaagactagagaagatagaatttgggccaagccttgaaaagagtatgggtcgaattcagctggtgaaggatggcgaatttccagacctgtaggatgatctaattactccctactcacagagttggagtaattaagtcacaggaccactctgaacagaatggacagagtggaggagtagctgagaggtaaagttcccgcaggcaagatgaaaccttccaccttgacccttggatgcctgcaggaggaggtggaccttgattggagaagctttaaaaagccctagtttacaaaagtaagctgtggtgagaaaaattatagcacctggtattcctgggtgacactatctggaaggggtgggaggaaaggcttaccaggttgttagaaatgttctgtatctctgttacagaggtggttacacaggcgtatacatctaccaaattccatccgacttacacttaaaatcagtgcattttcgtggggcatgatcacaagcacctgggtcctgtgtcctagctactccaaaggccaaggtgggaggattgcttgagcccaggagttcaaggctacagttagctatgatcacattccattgcactctagcctgggtgacagtgtgagaccctgtctgtaattcattctgtgcattttattgtctataaattgtgtttgaattttttaaaaattttaagttgtatttaaacaaagagaacctatggattaaaagactttaaaataatagcaaccaatggaaatacatgactggaattctgatgcaaacaccctattaaagaaattttttagagactattggagattgggcacagtagctcatgcctgtaattccagtactttcagaggccaaggtgggtggatagcttgaacccagcagttcgagactagcctgggcaacatagtgaaacccatctctattaaaaatacgaaaaaaaaaaaaaaagaagccaggcgtggttttgtacgtctgtggtcccagctatttggggggctgaggtgggaggattgattaagcctgggagacaggttgcggtgagcagagatcacgccactgcactccagcctgggtgacagagtgagatgccatatcaaaaaaaaagactattggagaaatttgaatactgactggattatgtgataatcatacttatctttttttaagatttgatagttttagcctcaatggtttgcattttttagagttcttttagggacatatactgaaatatttatggatgaaaatgattgaatctctagctgttgcttcaaaataatccagtgtgagtgggcagagggagttatcagggaaaccagatgttttctaatcattgttgaagctagtaatgggaagacaggagtttattaaactattatctacttttgtatctgttttatggtttcaataatagtcaaaactatcatgtatttgcatttaaaaagtcattgttggttattgaagaggaaaatgcttcgtacaagcatttctctacaaagagtgttctggcggccaggcacggtggctcacacctgtaatcccagaactttgggaggccgaggtaggtaggtggatcacttgaggtcaggagttcgtgaccagcctagccaacatagtaaaatcccgtctctactaaaaatacaaaaaacagctgggcgtggtggcgggcacttgtaatcccagctactcaggaggctgaagcaggagaatcacttgaacccgggaggtggaggttgcagtgagcagagatcgcgccactgcattccaggctgggcgacagagcgagactcaatctcaaaaaaaacaagagtgttctggcattcagtgattaactagtgagactttttggaggccgctgcaatattttctaagtaatgatgaatggacttggagaaggaaaaatgaagataaatgccctgctttatctactttgcttaaaataagtcaaaggcacattaggcatttcatatttgcagttaggggacatcaagtcacatagtgtgaaacgttgtttggaccgctgaattcagtattgtgtgtatgtgtgttgaggaggaagttggagttgtaaaggaatcgtccaggtagcccccatgtcccacagctaaaggagaaagcattgtgctgttgatttggggacaggggactgttcaccgaattaggaaatgtgagttctcgttcagctctgtggcctggggcaagtcctgaacctagctggccttcagaatccttagctggaagtctggaattaaaaattaggtgatatcccttgaggtcaggagtttgaggccaggctaaccaacatggtaaaactcagtctctactaaaaatacaaaaattagccaggcatggttgtgcacacctgtagccccagctacttgggaggctgaggcaggagaatcgcttgaacccgggaggcggaggttgcagtgaactgagatcacgccacagccctcactccagcctgggtgacagagcaagactctgtctcaaaaaaaaaaaaaaaaaaatttagatgatctctaatgccttacattgaattttttgccagctctcactcttttactatagcgtcattgttttaaaccagtcaaagtagaccacctgcatcagtgattcttgtaggtggtggggaatgtcagaaatgccatcacttggcccccatcccagaactgcagaatgatctcctggcagcatgttcctgggaatctgcattttagccaatgtcacaggtgattcttatgaagaatagaactcagagcagttttagggcttgttattcgttctttttcttcatattgcctcaaaatacaatcaacacttaagctgcttttcttctaagaatctaagagatttcagagctttactttgaaagggataaagttgtgatcacctgacattgtgagtagatttaaatgtttaatttttgttagtaatttataaagtataatttaggaaatactagagacaaaaagaaaaaagttatagtagcctgtgactctttagccttagcaaagcagtgttaaatgggtttcctgtatatccttccatgatttttctaatacatacatatgtaaatataattatttactaatgccagtaggcagcaatgagaacaaaacctcttttgtatttttttttcccatgagtcaaacaaaagacttcagattcagatcaattctggtgtgctagggcaggcctttcctacaaggggtggagaggccagcctttcttctcttggtgggaatggcctgagctgtgttgtggggcaggccgctgatttgtgtgatgtatcattagagggaataagcccattgatcttttctagtttccgttaaacttgaactgagaggccaggcacggttgctcacgcctctaaccccagcactttgggaggctgaggcgggtggatcacctgaggtcaggagttcgagtccaacctggccaacatggtgaaaccgagtctctactaaaaatacaaaaattagctaggcatggtggcacttgcctgtagccccagctactcgggaggctgaggcaggagaatcgcttaaaccgggaaggcgcaggttgcagtgagccaagatcgcaccactgcactgtagcctagcaacagagtaagactctgtctcgaaagaagaaaacttgaacggagacaaaaattaaaaataaggccaggcgtggtggctcatgcctataatcccaacgctttgggaggtcaaggcgggcagatttcctgaggtcacaagttcaagaccagcctggccaacatggtaaaaccccgtctctactaacaatacaaaaattagccaggcatggtggcaggtgcccataatcccagctactcgggaggctgaggcacaagaatctcttgaaccaagaaggcagaggttgcagtgagccaggattgctccactgcactccagcctgggcaacagcacaagacaagacactctctcaattaaaataaaaaattatttaccaaagtaggtttattttctccgtattattgtatgacctatttttaatacacatcatgctcatctatgttaatattctcctatatcaagatttgtaatggccatatagaattcctctgtataaatataccagtgcttatatggttgtttcttacaagcagactgtctgcctctttttactgttttaaacatggaaacaatagccttctgtgtctttttgtacatccttaggataaaacttttagacaattaagtgaaataatttttcatttttaaaagtgattttgaacacagttaacccatattcactatagaaaaaatggcaaatccaaggaaatttttttttttttattagagtctcgctctgccgcccaggctggagtgcagtgggacgatcttggctcactgcaacctctgcctcccgggttcaagtgattctcctacctcagcctcccgagcagctctggattacaggcactcaccaccatgcccagctaatttttgtatttttgtagagatggagtttcaccatgttggccaggctggtctcaaactcctgacctcaagtaatctacctgcctcagcctcccaaagtgctggaattacaggcatgagccaccacgcccaggctaatccagggaaaaattaaaactaccatagctgtttcatttagcacagagtcagataacttttcatgtgtgtgtgtgtgtgtgtgtgtgtgtgtgtgtgtgtatgtgtgtgtgtggtaatgtattttaataggatcacacaatacatggaattttattatctgcttttttcaattaaccatatattacaaacatttttccacatcacccacattgaaaattctacaatatatctgtaaaccaaaaataaaattctaagccccctaaccaacggaatagatccctcctgtcagccaggggattccatagtaaacctgaaaaactagttcaggccatgatgggaaggaagtgtcaaacatgcctcattataccctcctccctttggaattcaggcacaactgaccagcattaacattaaaacagagatcttaggagtgacaaacagactctttataccaataagataacaaattccaacctgactctcctatagcatcacatgacagcagaccctaaaagaaaatgaagtattttaccctaaaatatatttcttcgatgtattttgtctttttttgttttgtttcttttgttttcttgagatggagtctccctctgtcactctgtcacccaggctggagtgcaatggcacgatctaggcactacaacctccacctccgggttcgagccattctcctgcctcagcctcccaagtagctgggactacaggcaccccccaccatgcgtggctaatttttgtatttttagtagagacggggtttcaccgtgttgaccaggctggtctcggactcttgacctcaggtgatccacctgccttggcctcccaaagtgctggggttaacaggcatgagccactgctcccggcctcttcgatgtatattgaaatggccctgcaaggctgtctcttgtggggaatatctacattatgtagtgaatccccttacctgtccaggccttttcctgatccaggagagattcagagtctggtacctatttaggtctgaaaagagacatttaccatctatatagaggtctgaaaagtgacgtttaccatctatgtagatgaagcctgctacctggaggcttcatctacataataagaaccttggtcttcacaaccccttatcttaacccagacactcctttctgttgattgcaggcctttagataataagttaactttttcaaccatttgccaatcagagtatctttgaatctaccgaagacctggaagcccacccttatttgagttcttccacctttctaaactagtgtataccttacatgcattgatttgtgtttgcctgtaacttctagtccactaaaatgtataaaattaagctgtaacccagccaccttgggcacatgttgtcaggacctcgtgagattgtgcttttggccttggtcattcatacttggctcagagtaaacctcttttttacagagtttgactcttttcattgacatatctgtatacattaattacaaaatattatttaatccaaattgcttcggtcagtatacagattttaagtggctaacatatacaaaagcactctagtagatttgttaagagaaagttgatcagaactgtttgatgccctcaaaatatttaccatctacaagggagtctaaaaccatcatacaagtcatcttgtacattgtatcacagatccccaggagaaggtacaaaagatgggctgtgagagttcagggcaagaacattgttagtgaaggagatcagggaagggtctgaagaggcagtgatgggagggtgcggctgtgtgaagatgggggaagaaaggtattccaggtagtagaagggcataagctgaggcatgctgccaggaaacaagagacccgcatctctatacagcgagtcctggcacttaatgggatgcagtccctgtcccagtaaggacgacaggaggagtgggaaatgaagttgcgggggtcagccagtaccaggttatggatagtttagaatctctggctctgcagtgtggactacatttcctgagcagtgggtgctttttaggcgttgtcacattttgttttagctggaataatgatggcattggagctggctgggagtaatgctctgaagcattgtgccagagtggaagtagtaatggaagaggggcagtaaaatgctacttccatgactagaaaccaaggctatgacggtagcagccaaaacagagaaaagaagaggtgctgtggagttagaatgacgaggcccggcagtctgcctacgctaatgaaatcaggaaagctggagcgtcaaaggggcttctgagttttggtggctgggataatagtcccattttaaattatgagtggcaagaattgtttttgttgaagcctgctttttcagtcctagcatcacacactctgtacctttctttttcctgataggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaattgacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacatttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgccacctaggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaaaaaacttaaaaatggcaaaaaaaaatctctaaatgttattccagaatgtcataaaggccaattggtgaagccgaatgtcaccctcccaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatcacctgaggtcaggagttcaaaaccagcctggccaacatagtgaaaccccgtctccactaaaaatacaaaaattagctgggcctggtggtgcacacctgtagtcccagctactagggaggctgaggcaggaggattgcttgaatccaggaggcggaggttgcagtgagccaagatcatgccactgcactccagcctgggcgacagagcatgaccctgtctcaaaaaaaaaattagatatttgggttgaaataaaaatgattttcttcttgtgaccaatcgtaacttgttttttctcctttcaggtatgaattaagtgaaaagatgttgtctgcatgcaacttactgaaaaatactataaatgaccccaaagctttgaccagcaaagatatggtgagtctgacctgcaaacaccatccccagtgtgtacaaagtgcatgagtgggttcattgtcaaggccagctgtaggctgcccgagctgttgcttgcatgcttttctcctgaactgtttccagcatgagtgggctgggtaaacatcatgtggtcttgctccctggatcacactgccagcgtttccttgaggcccaacttcggacatcctttacccaccctggacttttcctggggtggaggcatctgtgaggcgtacacttgcagacagaaagcagggctaattgcagtcagtcgtcatctttctacatatttcatttctatttatagaacagtaagatccagggagcagcatccaagaattttttttttaagttagcatatgtttttaaaagaaacctatctgagccaaggtcagcattcctttcagttatgaaactgtatgttatgctctgatgtggaatgcaggcggccactatttttaaacataaaaataaccgcacttgtcatctcgcagtctaagaaattcagagcaaacagcaaagagtttgtggttgccttagtgatcatgaatggtacaacataggacacaagtatttctatggcaatggttaatgtgacaccatggccaagaatgacatattctcatgtgtcgaagttatgtgcacattctttcataggccagactaaccccctggttgacagctgtcttttttattagtgcattgagaaaatgtaggatcccctaaggataccgaaatgcacagatactcaagtcccttatgtaaaatggtgtagtatttgcatataaactatgcatctactttaaattctgccatatattttaaatcatttctatatcataatacctaatacagggccaggtgcagtggctgacacctatgatcccaacacttcgggaggccgatgcaggtggatcacatgaggtctggagttcgagacgagcttagccaacatggtgaaaccctttctctactaaaaatacaaaaagttagccaggcatggtggtacacccgtgtaatcccagttactcgggagtctgaggctggagaattgcttgcacccgggaggtggtggttgcagtgagccaagattgcacctctgcactcaagcctgggtgacagagtgagactccatctgaaaaaaagcctggagtgcagtggcgtgatctcggctcactgcaagctccgcctcccgggttcgggccattctcctgcctcaccctccccagtagctgggactaccggcgtccaccacaacgcccggctaatttttttgtatttttagtagagaccgggtttcaccgtgttagtcaggatggtctcgatctcctgacctcgtggtccgcccatcttggcctcccaaagtgctgggatttacaggcatgacccaccgcgcctggcctcaaaaacttaacacaatgtaaatgctatataaatagttgttatactgtattgttttgtattacatattttttaaatattttcactctgccagtggttgaatctatggaaatggaacctgtagatacagagggccagctgtactaaataaaattgctggtcaagtccaggcacagtggctcacacctgtaatcccagcactttgagaggccaaggcagtggatcacttgagcccaggagttcagtttgagaccagcctgggcaacatggcaaaaccctgtctctacaaaaattagccaggtatgatggcatgtacccatggtcctagctacttgggaggctgaggcaagaagatagctggaggcccaggaagttcaggctgcagtgctccatcatcatgccactgcactccagcctgggagacagagtgacaccctctcaaaaaaaaaaaaaattcctagtcaaggggaaacatagaactacatattgaaattcttggatttgtattcatgaaaatacctggctataccctggtcactagtaaaaccataaaatctcactgcagggtcagtatttcccatcaggtttaacctaaacttaaaactggtgccttacaaccccagattttatagccatagtacacttttctttcactgttctcaaaatactaggttacgtggcctttgggaaggattctgttttcctgcatcctccaaattgccgagcatggtgtcatccacacacactgtgatgggtacatctttttaactgaattttcatttggtgtgaaagtgtttaaagtattgtgttgtgaaaagtagtggacgagtaaacacaatgccagggctagataatcatgtcaggacaccagttatttagcagtaatagaattagaatgaccagaagacataatttcccttctttcagtgtgacaactccagagaaacaggaatgtgaatatatacagaaaaaaaaggacactcttcaagtgacccaaaatgtgattgaaatggttaaaactaaataatcagtagcaggatgataaagagatggaagctctataatcccaactctaccttttctacagaaagaggacttcttgggttctggtgcttctgacataggctgtctttctttgatatatttttaaacttttaaagagtaagcacagcagaaatgaatattaaactcatatgaaggcccattgaaaagacactgtagtcatcctcatcaccagtactgactgctcagtctccactgagcttcatgtgacccagggttgagttgatcatccacaaagcaagtgccttcttcatgtgtccacagcctaaggaagtcagagtggagctgatgagagaatgaaattagttccagacggggttcccttttattttccctttccgtggttgaacagttgtatttgggattggggtgggaattgggttggctatacacgtacggtctcccaacctagtgctgtgctgaggagttgaaggaggtgagtttggtctggataggaaggaagcagcataattcagtgtaggctagttaatttcttcctaatttctatgaaaattgtttgcaaggccagtatgattacatcatattaatagcttaataaatggagccaagcctgagtgtttattctcatcacagaaactatgaaagcatggtattatccagtttttcagatgaggaaacggaagcagaataacttccctcgggtcataaagcttttaggtagcagagcctgcatttgaaactcagtggtctggctccagagcctctgcttctgcatggtgctgtctggtctcctttatagacattagaatctacacgtcatttaaaatcaggagaaatgtcccagtttggtgtttgaagcttctcttagggctgttggtttttgagagcagattctaactgcatatatatactttgactataaaaggacaggttacttgtgctttcaactaggtctcagaaagtctataaatagaagaactaacgaccacttggtgttttggcagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccggtatgttggctgcccttccaccctctcttctctaacagtacttgggttgtgactcatctcagagaacctggttgagccactcctgaattctctgaccatgctaaaatcctttttattgcttttccacatgacatggcaagaattttcttgagtcattcataagaggcttgaagtttaaacaaaactgggtgacacagattctagatctgtttttgaaaggaggttttgaggatcttcttgctgcagttcagctgcattcaaaagtgagaggtgtatgcctggtaagaagcatgtctcacgttccctcctgagctgaatcatgcgggcttggccggtttgcactcaggaggcagagtgctgcttacaggcccagggtcacagccttggtgcgtgtggaccacttgatttgaccttactccatgactgctgtccttgcagaagtgtgtggttagtcaagatggggactaagcaaagccaccttaacagatggtcaaatgatcaccattctcaccaaaatatactgttattggggaaacagcatagagcaaagggcatgttattcttgtctctcaaccataatagaatagtagaaacttgttatcccagaatagagccagtggacatcttagacatgaagtgagggaggggcacatacacagatggtaccctcaagaaactgtgagctttcaacttcttgttcaaatggagcagcctgatgccacatagaccccaagtcttttaatttttgtaatacatatttttatttctagtatgtgacagagaagtcagagtatctcagtctgattaatgaggatgtagtgtgaaccttagaatatgcaatcatactgtccaattttctgaaattctgtcttcatccactgtccaatctcttctgctctgttttgggaacttggaattgatgcagagaagaaagccaagcagatttatccttcctttctcttataagtgtgtttgttccctctttttggagccatgttagggtataactgcttccatcttacaggaaggaatttcaagcccctcctcttcaggctttctagactataaacagagctggtgatacagtcagccagagtgattgtttaaacagaagtagataatatccagggaagctgaaaacaagatttcactatcactcctgacaggaacagcttagtatacccttagaagttgataaaacatcttggcaaattaaataattttaattccattgctggatggtttgggttaatcacttatcttaatggttactgctcccccttctaggctgagattctggctccataaggtgtagatctaggatgcttcagcatctatgcagagcagagtccgcaaagtccgaggtgctaaggagccccgaagcgcacacgaattcacctgcttctcctccacagggccttttattttctgcattaaaaacacccacttttaaaaacatgtccttagtatggagttgtttgggatcttaaggtaaatgttcatggtaccttttattttcctttatgatagaaacattctgaacattttaacttcatatttggtcccacataaaagctgctttctaacactcaccattccggtcatttcagagaaagtgccgaaggaacttttaaatgcccgaaggataattttatccctgaagactccttaagaattacaagaatagaaaaggtctggttcatcgattctgttaaggggacttaactgcatttgttctcgaccataaattctggagctggatgttatatgattggaattctgcttttcaggacccccgacaggccagagtagtaaattcagagtctcagaatgagtaatgtttggataagtaggtaccaccctgtccaacgttccatacgtaagcgtttgcaaacacttcgttcatgaatagctcactacctgcttcactttcctaaacacagctgagtgcctagattccaaaaatcgtttattctcaagagcaaccagtagaacaaccaccctgacttccaagccattgcatttcagccaccagttgcaaacaagatacgctgtggaagcttaccgttgtttctcttgcttcaggtgtcgtgaaatagggggaaaaaaagtttttggtttagtatgaaaacatctctcacatttccttctaagtcactcttggtctccagccacctggtaccatttcactgggctcctgtaaacaccatcccttcagtggcttcgtaagcggctgctattagaaggggctgcttcctaagagacttttttttttttttttttacagatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggttagtgcgcctggttcctgtgctcaggaatgcacccgtaaccagcagacaggactgcggtggccattctggcagagcaggcatagatgccacgcttccaccacagtgcacttgtttgcaggcctgccctgagtccatacactgcctggcactccttgctgaccaaacataccagggaaatatgggcttaaatttcacactggaaacttctccctcctttgccttgccttttgtccatttgcatagtttgcatggaaatactgttagttcccctacatataaatgattgcgcatccccatcagatgctcagtgactgttgcttcctgtctctgtgttgtactgtcttcatagcaaacagtgtcccaggtccagatgtgttcacagcttgacttttttttttttaagagacggtcttgctctgtcccccaggctggagtgcagtggcgggatcttggctcactgcaaccacccccggctccctggttgcagtgattctcctgccttagcctcccgagtagcagggactaacaggcacacaccaccacacctggcttttttttttttttttttgagactaagtctcattctgtcacccaggctggagtgcagtggtgcgatcttggctcactggaagctctgcctcccgggttcacaccattctcctgcctcagcctcccaagtagctgggactacaggcgcccacccccacgtccggcttattttttgtatttttagtagagacaaggtttcaccgtgttagccaggatggtcttgatctcctgacctcatgatccacctgactcagcctcctgaagtgctgggattacaggcgtgagctactgcgccagcccctggcttttttttaagtagagatggggtttcagtgttgcccaagctgctcttgaactcctgagctcagacaatctgcctgcctcagcctcccaaagtgctagggttacaggcgtgacccaccactccaggcccacagcttgacttttaaccaccacctgaacttccagccccttactctactgagacatcctccacgctaaaatgaagttggctccttactttatgcccttcctttgctcatagctcatgggaagctggtttctccctgcttgccaccacctgccccaagtagttccatcgccagttctttcccttctgtcaccacactcttccccctttccctagcacagccccactagaggccaccactgccagctcagtacgtacttctgaagtccttgtcatctcttcccataggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgtaagctgtctccattgggcctcctggccaggggtctgggggactctggacgggagctctgggagtgccttttggccaggagcgaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaattcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacaacatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttttgcgtgtctctaggccaaaggacaggagtggtgataggtagaaggtaggaactggcatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacatggaagctgcagctgtagcagattcccttcttcccctctgtgggagggagagcttctgaccgacttctttcttccagaagagtttgttagctgtgctgtggtttttgtttgattttacttctattatctttcaaagcttttgaggggaaggatcataagattaaaccaaagagaactgtgtcctgctgctgctgctgaccagagggaaatccgtatttcaagactagataggctgggcacagtgggtcactcctgtaattccagcaccttgggaggctgagacaggaggatcgctcgagcccaggagttcaagaccagcctgggcaacatagtgagactcccatctctacaaaaaaaaaattatctaggtgtggtggtatgcacctgtagtctcagataccgtggtggttgaggcaggagaatcacttgagccctggaggtcaaggctaccgtgatctgtgatcgtgccactgcactgcagcctgggagacaaaccctgtctcaaaaaacacactagacagaagacaagttgtgttgttctttcccttgatactcctttatatccatttaaatccctgaaatttaatggaaatcaagcagttaagtgaagcttttttcacccatatgtagtgtttcccctcttatttccagaagttggatctgtgcaacccactgggattgcgtgcttacacacagatgttacttgtagccttaaaccgaggtggtttagggttttaggatcacagtgccctctctaagaggaaaggtaaaagatctttggcaaattgcagagtctctaaacacacactactgctgcttgcctggtcattcataattaattagaagaaaaaaaaactttctatccccatcttctgcttccccctcctggtgggcagaatggttgagtaagataatcctcttaactgggacctctggagggtggaggcttgcctcattcatcttcacatcctcaggccttcacccttagaggtcccaaaaaagtttcccagaagaccgaacgagtagggatatttggggaaccttgccaattattggagggtgttttgttctgttacctttcggttgtctggaggtttgagaaacccaacatggcttgttctttccatcttatcttaaggatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctttt

SEQ ID NO: 258 - DNA, 137630 bp, Homo sapiens
attctcccgcctcagtctcctgagtagccgggactacaggcacccgctacaacgcccggctaattttttttgtatttccccttccttctttgctttcaaaatccaggcttaggggtacaaaaacctatattgtctgagacaggaagcactccgaagtttgaagaagagggcagcagcccaactcagaagaactggactccccagcactataaggagagagggtggtggttccaccagaggtgaggacttgctttctgctctctacagcaccccaaagagggatgcctagagaatccatactgagtaccacagccctgtcccaggggcttaatgggacagagagagagtgtgtgcctggtacagaggtaagtttatttttgatggacctggtatatcacaggaactgccactatggccttaacccaccctgtggattgagcaagtaggagtttgtgtatgatctaccgggaggagcaggggataaaggcccagaaaattaagtggcattttatgacctcccagtgctggttggggcaggctgtggaaaaaacaagccataattaatttgatttagaaaaattaagaagtttgttcttgtgcactcaagggttatggaacagctcaagccattctcaaaaaaccattgtccagtgttgcttgacccagttaaaatcaccaggtgtgtctaaaagtttctgactagtttcaatccaatgatatacggatttcttttctgtggtgcacaggttacattatgaacctggactaaaagggaatgagttgacccattatagagtattaacagaatgttaattctgtggcacttactcagacatcctcctggaagaaaagaactttttgaacgtagacttctcaatccacatgtcttaaaaacttgggctaggtgtgaaggagatcagctataattaagaaaaaatctgaattgtattgtgatgtacaagatagaatatttgttatttaaaatttgcatcaaagaaacataattcatttggtctaaagtatttccaagtcaagattcatctaagtctgctttatttgtagaaactacgccttattggttaagatccctaacttatacttaaaaagtaataccacaaaaacgtaaaatacagacaattatcctaagtaaattgatcctaagtaaactgctgatcttgaatattaatttaacaaaatgagaaacttgtacaaatgtaaatcataactcaacaaggttgagctgctgaaaaagggggagatgcaaatgagcagatcttccacagatgagagcaatagttactattttcatatgccaaggttttacctacaacataatagtaagagacaataactattgggctgggtgtggtggctcacgcctgtaatcccagcactttgggaggccgaggtgagctgatcacctgaggttgggagttcgagaccagcctgaccaacatggagaaacccgtctctactaaaagtacaaaaaattagctggctgtgatggtgcatgcctgtaatcccagctactcgggaggctgaggcaggagaatcacttgaacctgggagggggaggttgcggtgagccgagatcatgccattgcactccagcctgggcaacaagaatgaaactgtctcaaaaaaaaaaaatttatgaaatatgttccttattttgttctgtgtttcctatataagcatcaagtcaaagtagattacaaagcaccttacaatgcctactgaccacatgccacatggctaaatgactctacacctctatgaagtttccccagccttttttttttttttttgagatggagtcttgctctgttacccactggagtgcagtggcacaatctcggctcactgcaacctccgcctcctgggttcaagcaattctcctgcctcagccttccgagtaggtaggactacaggtgtgcgccaccatgcccagctaatttttgtatttttagtagagacggagtttcactacgttggttggccaggatggtctccatctcttgacctcgtgatccacctgcctcggcctcccaaagtgctgggattacaggcgtgagccaccgcgcccggcctccccaggttttctatcctcaatgatctctgatttttcagaacccttatcttatatagaactaaaaatatattcatatcgttatttatttatttatttatttttattatactttaagttctagggtacatgtgcacaacgtgcaggtttgttacatatgtatacatgtgccatgttggtgtgctgcacccattaactcatcatttacattaggtatatctcctaatgctatccctcccccctcccaccaccccacgacaggccccagtgtgtgatgttccccatcctgtgtccaagtgttctcattgttcaatttcccacctatgagtgagaacatgcagtgtttggttttctgtccttgagatagtttgctcagaatgatggtttccagcttcatccttgtccctacaaaggacatgaactcatcatttttatggctgcatagtattccattgtgtatatgtgccacattttcttaatctagtctatcattcacatcattatttgttttatgagtatatgacttgtttaattaaatggactctggactctatccagagtctgtaggaatttttcacttcacaaagaaataaagaaaataagacagaatattaaggttttaaaaaaggtttaattaattcaacctttgatttttttcctgagtgtatgtctttttttaatgttaaaatgacctttataaaatgataatttgagaaatacagaacaatctctctctttctccccatctcccaatgaagagactgaattcagagaggtgaagtaatgttgccaagggtaagctcaaactcaagtgcatcagtcagccatatgcaatagggtggctttgatttcaaggtggtagtcatggttctagatatcacaaggagacatgccagtgtttaacaacataagaagagatgctctctttctgtgttcaccttttgtaaaagtgaggaaatctttcccagaggacatccagtggacttctccctcatctcactggttaaaatgtgtcacatgttgagaaccagcccaatcactgtggcaaaatgaatggggcatccacctcccaattggcgaggaggtaccactgagttgggtgatagttactttctttgagggatagctaatggaacaaaagtgggttctgcaagcacaaaagaatggaggatttggttgtcaataaacagtcactgaggtcagctactccgggataattctaggggtctttgtactggacaaaatattggttgaatgaataaatagaagtatatatgtaggcgaaagatattaagaatataaattcaggccaggcgcggtggctcacgcctgtaatcccagcactttgggaggctgaggcgggcggatcatgaggtcaggagatcaagaccatcctggctaacatggtgaaaccccgtctccactaaaaatacaaaaaattaggcgggcatggtggcaggcgcctgtagtcccagctactcgggaggctgaggcaggagaatggcgtgaacccgggaggcggagcttgcagtgagctgagatcgcaccactgcactccagcctgggcgacagagcaagagactccacctcaaaaaaaaaaaaaaaaaaaaaaaagaatgtaaattcaggcattcaaagaaagaaaattaattccttacgtctttctttagaaccactaaataccttgataatttatggtaatgtccactcaaatgtactgtataaaaatttcttcctcattcatacttacagtgctataaaggcaagcgaactctaaagtcacactataaatatgtttttatcacgatattgattatttcaactctatctctaaagagttgtggaaatttaatagaaaagaaaaataaagctctaggagatgcatagaaaagccaaacaattgcacagatttttaaccagcatttttccccaaaatatgtgagagcagtataaatacatgaaaaaaatgttcagtttcatcagtaatcacagaaatgcaaattaccctgagaaacattttcatccatcaaactggcaattttttttcttatgtttagtattaaagttgatgagcatgtaaagaaataggcacgctcatatactgatggtgagaatgcacttcctgtggtctttctggttttcattttaacattgcatgacaaaggattgcttactttctgtctgctttcctacgcctcaggatcatttagtacagggactgtatttgtcccacttgagtattcctagtgccaagaccactgataattcaataaatgtataattaagttttacatatttattgaatggtcactaaatattaatgaaattgataagcaaatgattaaaaaagaaaacatagtctttaacccagcattaaggtttctaggaatataaataaaaaatatgagttatatgccaaaaattatctataaagatgttatcctatggtaagttgtaatatcaactaggaaaaaaaatgtcagtggaggaaataatgtttaggaataaaggattagctttctaaatgttagcatatttgggccaggcgcagcggctcacacctgcaatcccagcacttcaggaggccgaggggggcagattccatgagctcaggagtttgagaccagcctggccaacatggcaaaaccacatctctactaaaaatacaaaaattagctggatgtggtggctcacgcctgtagtcctagctagtcaggagtctgagtgggaggatcacttagggaggtcgaggctacagtgagctgtgatcgggccactgctcttaagcctggatgacagagtgagaccctgtctcaaaaaaaatttcaaaattatcccttttgctaaatacatggatatgtgtaaatgtttggaaaaaatgctgaaagaatatataacaaaatatgaacaatcattatttcactataatgagaaggtagctgatttttaagatgtttttctattcttaacgtgttgttttggggataagaaagagaataaattttcttttaagtgagtgatttggaaaaaaattcttttcatttgattactcctaatcaaatgtcattatttattttggtaaataatgatggcttgagcaagatatacactttatcaaacaaagtaagcacagagaaccaattagtcatattttttatgagagaccatgggatgtttttcctctgtgacttctgcagaaaagatatacgttttgaaataatattttaaagattattaaaaagagtcacatttctgtgtaaattgtggaaccacatctcttagagctgaccttcaaaatataatctattgtatctaaagttaatctttaaccttgtatagcccataagcaagaagaggaacttaatgtgtttcaaagctgcttgcctgcttctctctccttgccagtgctatttaaagatcagtgtaagtgcacttatcaataggatttatgagtcatatcaataattacaaactacagcaataattttcccaaagagatgcagcattcttttttttttttttgagatagagtctccctctgtcacctaggctagagtgtggtggcacgatctcggctcactgcaacctctgcctcctgggttcaagcgattctcctgccttggcctccccaagtagctgggactacaggcttgcactaccacgcccagctaatttttaaaaaatatttttagcagagacaagctttcaccatgttggccaggctgttctcaaactcttgacctcagttgatccgcccgcctcagcctcccaaagtgctgggattacaggcatgagccactgcacctgtccacagcattcttttaaaactctaagaaaaatggcatttgtcatgtgacaatgaaatcaggagtcgtttagaagcagtggggtcttttcttgttttctttggtcaatccatatcactgcaggtaagaaataaatcaagtgatttagtaagcataaaatgtgacattgttaacatgcttactatgttaacatttgatgcacatgatccaacttctctaacatgttttataaggccatgtgctctccgtggtagatatttaaatttttctactcatatcaagcctatgcttccaccacctaccctttaacacatgacttcaacacttcagcatcattcgggaaacagaaggcagcaggcagaaaatgactctactttgcaccaccgaccctgcaaacttaccaacctcagcactcaccaatccactcttctttctagggttaatttctctacttgtgctctggatctcatcttcccctgccttcttggggactttactccattaatgagtcccctctcctttatcttcaggttcttacttcaaccacaggcgtttcaataccctctcgagaagcatataaatagcattaataaaatggcaactcccattcactaagcatttagttcgtaccaaacatggtaggtactgaagcctcttaaatatattatttttctcaacctctttttacggttgatgttgttttctacattatgcacatgagggaaatgaaactccaaaaggataagcaccaaccaagattatgcaacatgcgtgtggcaaagcagggattcaaaccaaactctgtctgagcataagattctatcttggctgggcgcagtggctcacacctgtagtcccagcactttgggaagccaaagcgggtggatcacctgaggtcaggagttcaagaccagcctggccaacatggtgaatcccgtctctactaaaaatacaaaaattagctgggcgtggtggcaggcgcctgtaatcccagctactcgggaggctgaggcaggagaatcacttgaacccaggaggcggaggttgcagtgagctgagatcgcgccattgcactccagcctgggtgacaagagcgaaagtcagcctcaaaacaagaaaaaaagattctgtcttaatcattgtgttattctgcccttgtttgtctccaaaaagctccctctttaacccaatcattatctctctgcctcatcatagacaaacttcctgaaagacttgtatacacttgctatctccactgtactttgcacatctcaacgcatggaagcttggcatacacccagtgacatcactgaaactgctcttggcaacatcaccaattaccttcttgtttctaacgtcaaagaatctgagtccctttaataacttgacttagagcagccactgactctgttgacagccctctccttgaaacattgacttccatggactttcatgaaataccactttgctagtttttctcctattttataaatctctggggttgaagtttgcttctttttcactgtctaccccttatgtgttgagatagatcagacctgccttagatctcctcttctgattacaagtactgtcctgggatttcatccactcatacaactttacttccatttgctgatcaagcccacaattctacctggagcccaggtctctatcctgactttcagacatgagaatcttctgcctaattgacatctgattttacgtttctcacaggcatgggggcagagcagtgaaatgttgagagcatcttatttagactcagattgctgggctcaattcttggcatgagcagctagaactatgcatctctgggctctgggcattcatctctttgaaccttcctttcctcaactgtaagatggggaaaataatcattattatttgataggggcattctaagcattaaatgaaagaatacttggaaagtacttggcagaatgtcttgcacatagaaagttctctgttaaatgcagcctattattaatattgtaactctgcaactttatggaacggagagttaacgtatgtaatggaacacactatgtacacaagattactctttgtcttcctcttgcacttctttatctcttattttcattgcttttggaaaaaatgtatacatttacacacacacacacacacacacacacacacagacacctgagagaaacaaaagagtttataatgggatcaagagtaatcctttccatccaactttacagtctttctttttcactgatgacaatggaatcaggtgcctcccccatgtcttcaagattatccagcctttctatcatttcccttttttgtagtggccaccttccagaacctttactgtcctgctccaaggataagctctgcccagcaggtgggagtggggagaagaatccactttgacattttgggagatgtccatgacctttcagaactcttcttgaaaagcttttaaattctagaatttatgttttctaatcattattttctttgactgtgtattcatattttaagaaggcaccttctcgatctcaccaaagcagtatttataaattttttagaagttctcttttgttccctaattacttatctttcttcaaggcagttattcttcttgcttatctccccatgatcgagaatacttcccactctcagagctgtttgttttcttttttcttcccttttttttttttttttgagaccgagtcttgctctgttgcccaggctggagtgcagtggcgcgatctcggctcactgcaagctccgcctcccaggttcacgccattctcctgcctcagcctcccaaatagctgggactacaggcacccgccaccacacctggctaattttttgtatttttagtagagacatggtttcaccgtgttagccaggagggtcttgatctcctgaccttgtgatccgcctgccttggcctctcaaagtgctgggatgacaggcgtaagccaccatgcccggccttttttttttttttttttttttgagacagaatttcgctcttgttgcccaggctggagtgcaatggcgtgatctcagctcactgcagcctccatctcccgggttcaagcgattctcctgcctcagcctcccgagtagttgggaatacaggcatgcaccaccacgcccagctaattttgtatttttagtagagacaggatttctccatgttggtcaggctggtctcgaactctcgacctcaagtgatccacctgccttggctttccaaagtgctgggattataggtgtgagccactgcacccaacccagagctgttttacttgcttttccctgtgctgttgtgaaatagaacttgtgcagtttctaaataaatataatgaaacaaagaattcatttaattaaatttaatttagttaaaattgcatcaagcaattgttttgcgtgaaaaactctgattaagtagaagaggtccaaagacagtgagaagccagtgaggatacatttaaaaattgaaggctgtgctgccattaggtgagtggaacacttgagagtattgtaccatagttttgcagagaggaaaacaaggaccaagatctactaggacataccaaaaaggccaacctctagcaacaggaaaaaagaagagaaaacatggaaaagaaaagaacttttccaggctatatagtggaaaccacctatgccctttacctctttatttgtatcagccatggcaccttccttgtagctacaagagctattaacagcagtatcaaagaaagcaaagtgttaaatatcagagaagtttctgttgcaccacattttataacatagaagacactttataaattgcaaacgcctcagtattttatgtgtcaccaagaaagcaaaaaatgctgctactcaaactataatatgccattgatcataatttacactcagatttcagtgatgttaaaatgtgagacatatgtctttagaaccaatgagaaccagtggaatttagtatctgctctgtttgtcttgattgtggagaaatcaccaataatatgtagaaaaaagggctttaatttttaaaagagtgttgagaagtcttggtggaaagcacctagatgttggcacctgtcaaacaggctgccttcctagttacattagttacaaggtgtatgacatccactaaataagctccttgaaggagttttctttttttttaatttctaaaatgaagacagtgttgcttagtatgttgttatatgatggaggtggctaatgggttatgggaataatcagcctggctaatttttgtatttttagtagagatggggtttcaccatggtggtcaggctggtctcgaactcctgaccttgtgatccacccgcctcggcctcccaaagtgctgagattacaggcttgagccatcgcgcctggccctggtgatcagtcttatttggaaaccactggtgagcagggttttaacctccaaaatcataaaacagtgattaccttctttaaaacaaatgaatactatttttagggctgccgatattttatgtttgaatcctggatgatttgggagagaggactcaaaggattctttattaatggcattgatctagataaagactacatttaccagtctcctttgcagtgaggtgtggccatgtgcctaagttctgaccaaatggatgagagtggaaatgaagtgtgcaaactgcagtcttgcctttgaagcactggtttctggtggcttctgttccgtgggcttctttggcagcctggagaggccagagaaggatccttccttccttcattccttcctttcttccttccttccttcctttactccctccctccctccctcccttccttcctctctctctctctctttctttttctttgacaggatctcgctctgtcactcaggttggagtgcagtggcacgatcacgacacactgcaaccttgacctccccaggctcaagtgatcctcccgcctcagactcccaaagtgctgggattacaggcatgagccactgtgcttggctgattctttcttaaaaataacattttataggcataaaataaaatcatgtacttagaattaaaaatgacgccaactatatgatatattgttatcaaaatattaaaacaataaattaatgatatagtggtatcaatatttaccagcccattcaacaacaagatttagcagcaggtcaatggcagaattgtggggcactttggtttctctagcttctaaaattgaatgagtcttttccccatgttttctagaccctggaaagttctaactttgtccccatccaccccaatgtcctgatcctcccagttatttataaggaaaatatattatataatattacatagtagatatggcttttctatgattttggaaggtaaacgacaggttcaggaaatttgtttgtttgtttgtttgtttgagacagagtctcgctctgttgcccaggctggagtgcagtgccatgatctcggctcactgcaacctctgcctcctgggttcaagtgattctcctgcctcggcctcctgagtagctaggactagaggcatgtgccactacacccggctaattttttgtatttttagtacagacggggtttcaccatgttggccaggctggtctcgaactcctgacctcaggcaatccaaagtgatgggattacggacgtgagccactgcacctggccaggaatgtttttaaataaaggcagaccccttggagtattctgatctggctaaacacgatattttctttattatagttccaagtacttagtttgttcgtttatctgtccatgtattcatccacccatccaacagacattttttgagcatctgctatacaccagagactgtgccggtttagctaataaaggttaacaactcacagacttgccagatgttgagtagcagccatgaactgtagtgatagacacgtggcatctcagctttaaatctgattcacatgtgcttgccaactggaacaagataggaattataggaactaggatgacaacaagaactgtaaagggagactgagaacctggttagtcttttttttttttttttttgagacagggtctcattctgtcacctaggctggagtgcagcggcgcgatctcggctcactgcaacctctgcctcccggggtcaagtgattctcctacctcagcctcccaagtagctgggactacaggcacctgccaccaggcccagctaatttttgtaattttagtagagacggggtttcatcatgttggccaggctggtcttgagcgcctgacctcaggtgatccacctgactcagtctccgaaagtgttgggattacatgcgtgagccaccacacccggcagaacctggttagttttttctccctattcagatttgtcctttgactgcctgaccttttctgagagtatctggtgccatccttgagcaaattactagccgcgatagatcagctcagagagagaagacacagccattcctaggttacttcccagattaaaatattctccatgaccctcttgctccaaacttaccatctatctggctcaaaattattgggaagcctgttgcatcctagatttgtaattacttatgtcagagttggcatgatcttgttcacacagcatgacacttgctatatgtaatggactactaaacggagtagagtagaaattatattctgtttttaaaaataagtatttgaactaggttgaatcaaaaccagttttaaaaaaattaaatgggttgatgggaaaatagatctcttctgacatgaagaaacaaataaacaaaccaaaacagaaccaaaaggatctgaaagaaaatccttcctgggctgggcgcggtggctcacacctgtaatcccagcactttggaaggcggaggtgggcggatcatgaggtcaagcgattgagacaatcctggccaacatggtgaaaccctgtctctactaaaaagacaaaaattagttaggtgtggtggtgtgcgtctgtagtcccagctactcaggaggctgaggcaggagaatcgcttgaacccaggaggtggaggttgcagtgagccaagatcactccactgcactccagcctgggcgacagagagagactctgtctcaaaaaaaaaaaaaaaagaaagaaaatcagaaaatcttttctgggagaatcaacagtatgtctgtgggtttagttggtctttcctttcaagctagttcttggatattctctgatgttatctgtcttgtcgtgaggatcaaatgaaataatgcatgagactgggcactggctctactcttctatgcaaaaataaggtgttgtcactatgaactgatgacctaggaagttgtttcctccaaaagagattagattgttttccacattcagtttttatgtatctgtttatcttttacttttggccagtttgttctttttcttatctgttggaggctgtaaaccatttattagagaggactttgaagtctaccttaatcacctattttgcttagtggtttcatttgaaccagacttccaggttttcctgtttactggattttgttgttagttatccacgtcctcacagagaaagggcttatgataaatggcaaattatttcatatcaggatgagattaatacaagtggcaaaaaagtaaacattaaattagggttgtgttgctgcttccagacctattactatcatatttataaagctacctccatatcttagtgaaagtggcaagtgtgtttattcgttattctgtgttctcttctatactcacctcatatttcaagtaagtgattcaaataatggagtgatagagtgtggtggggtgggagtgtgttgggcagctttcttatcattcttctgaaaaattttctttacattggcaatatctttgctagttataatagtaataatgataatgattttaaaataactactatcatttttgagcacttgccacatgctaggcattttatagccattacctttgcaataataatggaagatagatactattattcacttcccaatgttgatatatatatgtaacatatatataatatcatgtaataaacatataatgtctgtgtaactagagtgaattatttgtattaagattttgacagctccttcagggagttctttgccagtcttcaagccagcacgaaaccatcacagtagtcctgtgagacaggctggcagccagcatctttatataagcagggcttgagcctgattcacttttctgactagcacctagcttatttttagaatgcaatacgtggtaataaaaataaaatagtgaatagcaatacaatcaaaaatatacaaatacacttctcagattgggtggagtctcactggagttttttttttagggtgtctgaagttatgtccttgcctggcaatgagagatggaataaaattactccaattttttctttcttttctttttttttttgacagagtttcgctgttttgcccaggctgaagtgaagtggcctgatctgggctcactgcaacctctgccccctgggttcaagtgattctcctgcctcagcctcctgaatagctgagattacaggcatgcgccaccacatcccgctaatttttgtatttttagtacagatggggttttgccatgttgactaggctggtcttgaaatcctgacctcaggttatccacctgccttggcctcccaaagtgctaggattacaggcgtgagccactgtgcccagtctctttcttttgattaaaaaaaatattcaaactttcaacagaatagaccagcagcctctctccatgagtaaaccagagaatgagccaggcacggctgcgttctccacgggctgtgcttcactcctcttggcatgttggccatggcatcctgagtttgctcgcctcactccacctccagacccgtggacatcctccaactgtttctacagtccaagttaggactcaatgggtgttgaatcacacataggataaggctggggagtcattcaagaaaaattacttgttgggacccacacagggttcatagtatctattgcagagtactttcacatcccatattctggccttcaatcttatagttccacagatgcagtattgccagggtcccaggatttcccaggtaaagggagaccgatgatgttcactttgctcacaacagattccatggaaagcccaaactgctagggtatttagctgaccacgagaaatgtaactgccccaatgactctctattagtgccatctatatgagaagctaaacattaaccagagggttgcttggtaagcatgaaggaagggcaggggagttaacagaatgagttgtgtatttaaagtcccaggttaggtcagacccgggccaggacactcaatcttgccaacaagatgagataagaccaacctttgagccagagaatttcatcccctggaagtttcccatcctggagatgacttgtgcttgccagacgttgttggatgggcattggaaatatttcccctggcctctgtcacctgcccccagcacaatgcactgagcagtcactgagagaaagttagacaataaacactcatagcctggagacacagaatcccttattctaaccctgcattcacattaggaggtcatcacctttctgaaataagatgccatgtggttttcctttattcatcatgaaggaatacaggtgaaagtaagccaaaaataaaaactaaaaagtgggcctctgttccaaatatctttcaatatcatttagtggcttatttatgtagttaagagctgttttacaaaacagatactaccaggaggtgtaagcccacctaatactcataacttagtgcatgtaaatgaagaagtttttggtgagatctaatgcttggcttacaaaaaagtgaccattaagaacattacataagaagcagctgagtcctactgagtctcaacatcttgctgaagtccacaccactggttagtggaagaggcaaagtctattcttgttctccttaacacttttataatgtattagtggccaaactccacttccacatgtatgtctgaggttgaaaaccactggtgtattgaaatagacatatgtgagcagatgcttagtgtgttgttatatgattgaggtggctaaagagttacaggaataacaaggcaggcaaccaatccagtctaaggcttggaaagggtccatgaagactttagagtgaaattgattcttgtgtgagctgagttgtgaagggtaagtttagagtttaattaggtaaaggatatggggaaaataatccaggcagataagagtccctggacaaacactcaggggtttccaattttttcatctgctatcttcacctcctatccttattcacaattttgccttaacccataacctccttccattggatgtacaccctgggatgtatacccatggaagaggatgcactagcagctgccatgtgtcaggcatttgagaaataagggagcaatagtcatcacaaggacagtgcaattggttggctgtggttaagttccactgatgccctaggaaaaggtagcaaagagctgagattgattaatcagccattaaataaattctaagtgggaaggccagagggcctccctggaaacacaccaagagactctcatctcttaatttggaaggggaaaggggttcaaataggaagatccaggccagaatttaattgtaagagtagctgaagtaggtctgctatgccaaaagcattgggaaaaatgggcacggacacagggaagggcacatctgtgttgacgcccctccctgccaagaatcttgagtctccagattgcccttgcattagaccattcttttgtagctatagagaaataccaaaggcagcgaactgaatgagcaagaacttatcaccaagggaatggtgctgagccatttatgagcatccacccccacgatccagtcacctcccaccaggccccatctccaacactgggaattacatttcaacatgagatttggaagggacaattacccaaattatatcagccctgaaccctctgagcctgcacaaatggcccacttctctttatggagggctagaaacacaccacgtgcacagacacacacacacacaaacacacacacatcaattccaaggcctctctacaagacatcatgtactctcttcagggtgtcacccatcttccctcctcactgctaggtcaataactagggttaagtcataaagtaactgtgtcaagaaaatgctcgactgctatgggaggaaaagaactatacccctttatattagtctgttttcatgctgctgataaagacatacccaagcctggaaagaaaaagatgtttaatggaattacgtttccacatggctgagaaggcttcacaatcatgacggaaggcaagaaggagcaagtcatatcttacatggatggtggcaggcaaagagacagagtttctgcacgggaactgctccttttaaaaccatcagatcttatgagactcattcactatcatgagaacagtgcaggaaatacctgcccctataatttaatcacctcccactgggttcctcctgtgacacatgggaattgtgcaagttacaattcaaaatgagatttgggtgggaacaaagccaaaccatgtctcacccttctaggtccaatttcaggattaactaactgggagaatatgcctgagagtggattctgagggtgcccaaccacggtggggtgcccaaccatggtgagtacaagaaagtttgaatacaaaagaatttaccaatatgagaacactctcccatgtcacaggatataataataccctggcagggacctgagggagggtgagtgcacactgtaggatggctcctaggaccatggaaaaaacaatgcctcataccagtgacaaaattgctgtgacagacagtagtacacagtgaagagagggaagacttgtttggcatgtcttctgtcctgcccaatttgatggtaaatgacaagtgcagatatcttagcctattttttaaatcatgtcatcactctgaagatttccaaatcagtcaagaggatgctgttggtgtcaagacctgtacccccaaaaatgccccataaagcactgctatggttgtccagaaacactgagagactcccagactattgaggttttactggaccctaagtagttatagtttctggagttccctcacctcccactactccaacactaatcagaacaatatccctgtacccgactaagttgtaagatttgtgactctggcttatgagacccccttatgctgggcagtttggatatttgcacttgactatgagatgggttccattaccgccaaggacaaagtgaaaccagggaagaaaaagaggcagttgggtatcccctgtgtaataatcaatttcaggtgaactattattcttctctggtaacaagaaataattttagttggccaggtgcagtggctcacacctataattccagcactttgggaggccgaggtgggtggatcacgaggtcaggagatcaagaccatcccggccaacatcgtgaaactctgtctctactaaaatacaaaaaaattagccagccatggtagtgcatgcctgtagtcccagctacttgggaggctgaggcaggggaatcgcttgaatccaggaggcggaggttgtagtgaaccgagatagcgccactgcactccagccaggtgacaaagcaagactctgtctaaaaaaaaaaaaaaaaaaaaaaataataataataataataataattttagcttaggaagcagtctctgagctttatttttcagtacttaatctatattatctattgatttgcaggttctagcaggtcagctattttattacatgaattcttttccattttaaaaatcagcaatgtgaatggttttgacactacttggacttccttgatctatgtgaactttgttctttgggaatgtcgagctggcaaggctcgattttagatcagcagagtgaccttagcccacatagcaattattccctgatcatttgttgcaaaatgccacagccttccatcattctgatttctcctgggcagagtagatgttcactctggttacaatgtaaggagaattgggaaagccctcttatttcttctcacataaactggcttcttagaaatattctcccaaacaatgctagaaattccactgtcatagaatactgctgtgaccctatgaatggggtcctctgtatgatgcagtgctgctttagtgcaaggttcaagatgtgagctgggagaacccactgtgcggactgaaacctatccccagtcctattatattggaatttgagctatcacaggagtgtgctatcatcaggttccaaggtttagcaatctgatcatctgggttacacattgaactctccctgtgtttctcatgtagtgtgtaagaacctatcagattctctacttcttgtgtaaagagtgaaaatcattggtgggacaaacatcgggaggatcatgaataagtgaattagtggagggagtagggaaagggaaggggcttggcaaatagggatgaacgccagttttgggctgaagtagtttcatcaaataaaagaccaaatagtgccatgaaatgggccttgaactacttgtcaaaggcccaagaaccttagagagctagtgtcatcttaaacatgacatttaatgtttatcacaattccttcatctgtaaaatgcaaggtactatgcctgctctaactagctccctgactgagggtgaaacctaaatttgtatttctgaaaactctccataaaacctactgtgctccaggaaggcctcccccgccaactttttttttttttcttagacagagttttgcacttgtcacccaggctggagtgcagtggtgtgatctcggctcactgcaacctctgcctcctgggttcaagagattctcctgccccagccacatgagtagctgggattacaggcgcccaccaccatgcccagctatttttttttatttttagtagagattggggtttcaccatgttggtcaggctggcctggaactcctgacctcaggtgatccacctgcctcagcctcccaaagtgctgggattacaggcgtgagccactgcacctggccggcacttgttttttatggtgttgtaagcctgcacagattctgcctcaaaatttattgggaaagaagttgggtaaaaaagagtacatagaattgaattaatacttgtgagccatatgaagaagtagaagagcttccacttgacaattttgcctggtggcagtcctggaactgttagtacagagctgactccagtcaaccaagctcctttgggcaaatcatggtactgggaaaagaagtggttggacatattggtcaatgatatgcaattaactcttcagtttcttcttggttacttccctgttgtgcaatattcctgtggaaccacaaggttctatagatcagggaagacaatgttagccaaatatagcctactccactcatttttttctctacatcaatatccacagttagctatttattggcgagatcaattcatttttacattcttacaaataagtacttttttttttaaccaaagatgaattaaagtatgattctgaacatcatggcctacgtacgtgtgtgtgtgtgtgtgtgtgtgcgttttcaatttcagtcaacgaaagtaatcacatgatcaaataataaaaaatagcaataatattttgagcacattttatattctagctactatgccaagaattatatgtgtactattttacttaattctaacagtgaaataaagtagccatttgtattctcatgctgagaaagtgggatttaagatgatgccacatgacaagatcacatagtcataagtagcagatccaggacccaaattcagctttgtctgattccaaatcccaggctcttattcgctttcctctcctatcttcacctaacggcatctattacgaggaaggtgtgctgcttactggagatagaagtatgaacaaagtagtatttctgtcctcgatcaagctcttgtgactttaagaatagttggcctggcgcggtgactcacgcctgtaatccagcactttgggaggccgaggtgggcagatcaggaggtcaggagatcaagatcatcctgggtagctgggattataggcaccccccactatgcctagctaattttcgtgtcttcagtggagacggggttttaccatgttggccgggctgctcttgaactcctgacgtcaggtgattgaccctccttggcctcccaaagtgctgggattacaggcatgagccaccacgcggggcctgcttgattctatgaccatagtttgacatttatttctctaacttcgggtattacaaatggcacctacattgatttagttctatctgtaaatctgtattgcaattaacttttttctttaaatcccatttttcagacttaaactcaattatttaagtagaaaactttacataaagccataaataagaaactagctataccaaatctataaaaggccagcaactcttactataaatagaagaaaaccatgaacataaatgtattatgaacaaaataatgttattgaattctagctagatactgtggcctatagaaagttctaactctgaggtctcttgtctcttttaaaaagataaattaacaaggctacagaaatgttaaatattttttataccaaactgagcctgtgtcctagatttaagaaggattaaaaattcaaatgcaaacaatgttctcattatgtgattatgtgaaattcaatattgcttaatgcagtgcctgggagatcagtcctgaagtacctgtcatctcacactttatcagttgttcatatagaatattttctagtatacactgtactattcttctaaattgccttaaaaaatagtagaatgatgaatctgatggggaaaaagagtcttagggcaatcaccaccattttcaaatcctggaagattgacatgtgagagaatactggtttattcttgtttgccccagaaagtgctacctagcacaaacagtgacattttcaaatgcaacttttggctcattaaaatatacatatgaggctgggcacggtggcttatgcctgtaatcccaggactttggtaggccgaggtgggcggatcacgaggtcaggagattgacaccatcctggctaacacagtgaaaccccatctctagtaaaaatacaaaaaattagccgggcatggtggcaggtgcctgtagtcccagctacccgggaggctgaggcaggagaatggcgtgaacccaggaggcggaacttgcagtgagtggagattgcgccattgcactccagccttggtccttggcagacagggtgagactccgtctcaaaaagaaaacaacaacaacaacaacaacaaaaacatacatatgaatattaaaactaacaaaggaaatgatcatcactcaaagaactaaactttctgcctctgaaaattaatagcagaccatcttccaagaataatacaaatgatttcattggggaattggagtgaaatttaagatcctttaaaatttaggatccttaaaaattaaaaaataaataaataaattaaaaaaaaaaaaaattaggatccttttctttttttctttttttttttttttttttttgagacggagtctcactctgtctgcccaggctggagtgcagtggtgccatctcagctcactgcaagctccacctcccgggttcacaccattctcctgcctcagcctcccgagtagctgggactacagtctcctgccaccacgcccggctaatttttttgtatttttagtagagatgggtttcactgtgttagccaggatggtctcgatctcctgaccttgtgatgtgcccgcctcagccttccaaagtgctgggattacaagcgtgagccaccgtgcctggccctaagatcctttttaactctacaattttctaagactctgtggtgcttctagaagctcaaagatcactgaacatttaagatcctataactgaggatcttaccccacactaaggttttcaatctcagcactattgacattttggactgaataactttgtggtgggaggctgtgctgctaaacatcttagatccctgtttttttcttattagatgccagtcataacccacccccccaccttcaactgttacaaccaaaattattttcagacattgccaagtgctccctggggagtgtaagaattaaataaagaggagagaaacacgaagggtggctctacagtcaacagagacaggtttattttaaacaagcctgagaaaggcttctggccgagttaggtcaacgccacactctcttacagactgagtttttaaggattcagggtgggagagtttatcagaggctgagactgcttctgtgtctctttgttgtgcttatatgggagggagagttgtgtatctgttcccatacatctgtctgcagctgcaggcatacccccgagtctgcttttggcttccctatcttagtgcacctgaaggagaaggaatgtgcttattaaggaccactgttttactggggcccattgtatgagggtgaagtttggcagttacccaagagacttcccaccacctccctctgtgcccaagctgttttatctgtgttttactgtctgctctttctggcggcttgtagttagaagagaagtgattgccttgaaacgcatgaggctagaaagggagctggaacttaaagtggtggtgtttgtccaagatgatggtgctcctgctctctcagggagcagaaccgctcttagttgaaaatcactgccccagaccaacttctctgtatgcatctactcttcttatgaggcaggaatcaatatttcttgcatacttctactgttgcacttaacacatctaacaatcatctattgagtgtctacagcatgccaggtactgcattaaacgctgtttccatagcagtaaaggagacagatctgctcctcacagagccccatgatgggtcgatggagtatgcaggagttgaagggggaagagacacctgcagacagtttatcacagccacatgtgtgcctgtcggtttctgccattatcttataagcttcttaaggataagagtcatgactttttaaaatctttcaatttctagggcttaacagaatacctggcatatacaaggcgctcaacaaatgttcatagactaaatgaatgagaaagtaagagattggggaaaggcgagaactggtaacagcacattaaacaacagtgacaacagcaacatcaatcatatttaattgactagggaaagagaataatttatgtaattaagtttttattgcatttatgaaacatctgtatcgttgtatctttccatgcatttcgtgttatattgtttttatggtcatagtccatcatcctaacacatctaagaatatctaaaaatatggacaaggcatgggctgctattcctctttcaagcactttaccttaaggttagcaagtaaaaatttgatgaacagaaatgatcaaagtagggctttttttatatgacttgttcgaaccaagcattttggtgtagttggtcaaatgcagctttactggattttgtaatcaattttaggatgacatgaggaatgggtaaaaattatacacattaatgataaaattgacattgttatattatatgttctgggccattaaaatatttctccattgaaatacatatatcaaaatgtcccatactgggaaatgaccgtaattagctaaaaggaagtacattccttatggcaccaaaatgttaaatgcctttcttctaagtcatggtgaccacacctctaacctgaatccatgtagtctgtagtctgagatctaagggaagagaagtctctaaataaaaatgggaagagtcattccaggccaagtgcagtagcttacacctgtaatcccagggctttgggaagttgaggcaggaggatcacttgaggacaagagttcgggaccagattgcatgcagtatagggagaccctcgcctctaataaaaaaaaatgctccattattcatttcatctttttacccttcctcctgtgattcttagtgtgagggcagggaatctcagttttatatcctacacaatgcatagcatcttactcataagaggcacaaaataaggttttgttttgagaggaaaatgaaagcatcttgcaataactatttaacttacatcatgtattctactatattttatcaatatttatgcgggttatatttctaattatatctgtgcctatcagttagttgtaggtaacttttaatcaaaagcctgtacctaccacaccctaataaaaacctgctgtttttgctgcccagcacccattcaccttcttctggacactatattccaagttctctagggaaccccgcgttccctaccctgagtgcctgtacttcctcacctacctgctccttaactaacagatggggcatgagacccagatcagagtgtcacatgtcaccttgccccggctataatgcttttgttattgttgttagggctgggcatatcagcctattgtggcaaataagatgatgagtttggtttttgtatttttctgaaacttttgggaaaggtcgcttcgctttttcttcacctgaatttgagagtataaagtctagagctgttgtcatcaccttgtgatcatgaggagggagacgtcagagaatggagtctgtgtggaagagagaaggagaagggaagagcgggaaaagaggaggaaagagggcagagagagaagttgggtgctgtagacagtgattgaacctacaacaaagctgcgctgccagaaagagtgtgaccatagatttttcattgttgttgttgttatgcaaaacaatatattcccattcccatttagactgcagagttttagctggtttttgattgattttgtaatcaatcttaggatgacatgaggaatgggtaaaaattatacatattaatgataaaattgatgttgtcatattatgtgttccgggccattaaaatatttctccattgaaataagtatagcaaaatgtcccatatctggaaatgactgtaattaactaaaaggaagtacatacctcacggcaccaaaatgttaaatgccattcttctaagtcatggtgaccacacctctgacctgaatccatgtagtctgtagtctgagatctaagggaagcaaagtctgtaaataaaagtgagaagagtcattccaggccaaacagtagcttacacctgtaatcccagggctttgggaagtcgaggcaggaggatcgcttgaggttttctgtcactttcagccttgtctgaacttacacatgctccaaatcccaatcacatgtttttcatttcatagcatattttggtaatatggacactatggcaattttaatgctccatgggggagaatgagtgattctgaactggagttttattatatataacttagcattaatttgtctaatattaatatttactgattccctattatatgccattccacaaagaattccaaaaacacaaaccacacttctaaaagcaataacaaaaattgcttctcagagatggtttcttccttcttattagggctggattcttctcacaactatagttagtgggttttgcattttatatggaagagtgttacataaatggtaaatttcatttatatataatattaaaaatcatccctttagaaatatacacaaaggaaggaagttttgacactcatttatagtttttcaaataagtttaattttacctatttaaataatattgtgagaattccttagaatttttttttccttaaaatcattgttatgacaatttaacttgagcttcagttggtttttactttctgtatgaaatttacacctatctaaagaggcactaattgtgtagcatctgtagggatgataatgtttggctttctgctagagtggagtccaatctcattatggtttccaggaacatggagtctaggaacatgcatgcaatgactctcagcacctcggctagcatgcattgttagctgaggtaagcgtcttttcactttagatccacggtcagctcaaaccagttaagctgcacattaataaccttgggaaaaaccaatccttctctgagatccccagaatgagagcctaataggattcatttcatgccctaggtctcagttatcaatgtggcacattagagatgtatagattcttctatctcaaagcagaaaagtggcaaagtagctcccaaaaatgtgtgaaatcatttcagtggcttcccgactctacttcaatattgatcaacttggagtcccaggatgcttaggaggattgttcaacaaattcaagctgtttcttgagtctctaacttttcacaaaggtttaacagaatttgtccaacttgagataggttgcatgggctaagtaaaatgttagacctgcatttgatttgaattatgtgaactcgacatgctagatagttcatgttcatcagaagttctgattggtagttattttggtctttgatgaatgagaagtggggaaatctttcatttaacagcttttattgagtttctgtcttgtactagttttcttgatacaatgtaaaacttaaggtatgtaagtagcaggaataaggaaatgaatccttgggaataaagaagtatggaaactggccgggtgcggtagctcatacctgtaatcctagcactttgggaggctgaggtgggcggatcatgaggtcaggagatcgagaccatcctgttagccaggtgtggtggtgggaacctgtagtcccagctactcgggaggctgaggcaggagaatggtgtgaactcgggaggcagagcttgcagtgagccgagatcgtgccactgaactccagcctgggcaacagagcaagactccatctcaaaaaaaaaaaagaagtacggaaccagtgatagcaggtgacctttcatcttgcagatgaagaaaccaaggcccaaagtagaatgactttgccaagatatcattggcttgtgactgagctggaataggaacctatagatattgattgtatgtattgcttatcccttgatagtaaaagtggaataccttttattttatttatttatttatttattgagacggagttttgctcttgttgcccaggctggagtgcaatggcgcgatcttggctcactgcaacctctgcctcctgggttcaagcgattctcctgcctcagccttcctgagtagctgggattacaggcatgtgccaccactcctgcataattttgtatgtttagtagagacagggtttctccatgttggtcaggctggtctcgaactcccgacctcagatgatccacctgcctcggcctcccaaagtgctggaattacaggcatgagccactgtacctggctagaatacctttataatccatgttggagcataaatgtacacaaaataacacaggtcaagaattttttttttttttttttgaggtggattttccctcttgttgcccaggctggagtgcaatggcgcgatctcggctcactgcaacctccgcctcccaggttcaagcgattctcctgcctcagcctcccgagtagctgggattacaggcatgcaccaccatgcccggctaattttgtatttttagtagagacagggtttctccatgttggccagcctggtctcgaactcctgacctcaggtgatacacctgcctaggcctcccaaagtgctgtgattacaggcatgagccaccacacccggcccaagaatatttgctttgagcttgctgtcatggtaggaagccggcatcagctaaattttactaacgtgctacctgatttgagggatcagcagtatgagtaggtgatggaaacagctgcctacatactacttaaaaccttccagccagaaaaatatctccctgcacctgtctggcataaaacctaagtcaagttgcaactcattcctctcgttctgttttccctttttctataaaattcaggtaaaatgtatgcatttctccaaacttaattgctattctaaaaagaagaggtagctttcctcttccctacttttctcatctacaaacttctaggctactatcttttgtcttttctatatttgaacttttctaaacaaaccacaagggtgctaatggtgataatatatctggatagtgagatacggtatttttaaatgttcaaatcttataaaataaacatatgccgatttttcaagagtaatataggagctatttaaaaataatagacttctggccagacgcagtggctcatgtctgtaatcccagcactttgggaggctgaggagaatggatcacttgaggccagaagttcgagaccagcctggttaccatggtgaaaccccatctctactaaaaacacaaacattacccgggtatggtagcaggtgcctgcagtctcagctactgggaaggctgaggcagaagaatcccttgagcctgggaggcagaggttgcagtgtgctgagatggtgtcaatgcactccagcctgggcaacagagtgagactctacctcaaaatactaataatattaacaatagacttctttaaaacaagtaatatcaaatagcatactagagcattgttatcaatgtgtcacttcagcatcaattgttaagtgccttgtattatattcgtatcacttaagatttgacatgtagtatatataataatacgacattcactaattatgctagggaaatgttacagtaatactatgaaagctattaatttctactcctagaggtggcagagagaaaatatattagttccatataggtaagacaatatctgtttcatacagtcatacccacagtgcttagcatggtgcctatcataatatagatgtccaataaatatttgttaagtgaacaaactgttaaagaatatttatagggactagcactatattctcataaaaatggacaaaatatgaattgagccatctctctattgtcagtaaatacagaggtgggatactcactggcataactacactatacagataaagtagttttggggggccgagggtgctgcctctatggataggcaaacctgggttctcacctaagaactggaaaatggagatcattatgatttgctatccattaaggcctcccactcagaagaacacacagttttaaaaggaacgcatttatcccatctcaaatttttggtgtatcttttttttttttttctctaaagcataacaagcttgtcagagtttccatggtgagcacagggcaccatggaaactgatagatttagctacatgaaaagaataaataaaataggcaggcatttatttcactgtacaatgacaacttctctcctagataagagaggaaaagtggcctctcatttaaactgcttccctgcactctctgtacctcatgaaaacctgagttattttcgatagcccattctactgacctacgctgattggattcctgtttttctcaaggcccattattccctttagttttactgcaggctagatctgagtgtcaccagcaactgttggaaaaccatgtacaatgtgaaagttgtagatgacagcccacagtgcagtggccaagtgagtcatggcaaaactgaatgaacaattcctgggagtttactgtgatgagacaatgtatgagaacaactggactcaagatccaagtccatcctatattaactgcacaggcaagccaacctccctgaaccccagtttccccatctgtggaatgtttaaaatacatcctcttcctattttatagggttgttgagaggctcaaaattagataatagaggagaaagccttttcaaacagtcaggttctatctagcaaaaaggactgactgactaagctacaggtataattacattcatgagatgagcaaaatgtcaaagctaatcatgctatggtctaggttttggcctcaggcaattggaggtttagaacacgatgatcccaccccagtagttggggaatttgggggctacttggctccatctgaaatagagaaaattgagattgtaagaaatgaagctttaaaatttttctctatgtctgaacattctcataaaatgttggaaaactaaataaatgaaataaaactcatccttaagttctagtcccaatgaattgttcaccattagcagacacccactatagcctcttaatttttatgactaaaatataggcactagagccatctcctgcaattcaatattcatataaatctattgagcacctcctagtgaccagggactgtgttaaggggatggatacacagaaagaaagaggacatggtccttcagaaaaacacatcttctttggggtatagatgagtaatggaacaattacagcacacccacaaactcaggggaggaacacttaacactctagagcagaaatgtaaagatatcctggataaaggtgagggggggttgggggttgggggagtgggtgggacaatgaggcagacatggtgtaaggtggtaaaagggcaccacaggcagagagaagagtgtgagcaaagcggattcatagcatatgggagagtggaggtagccaagcctgaagaagcagccagggaatattccatgccaaggcggggctctttttttctgaaggaagtgatatgtgggggtggagcactaatgatgcttgggctgtattttgagggtgaatatgaaagctctgtactccctctttcctccaaacctctgtagccaggagaatatttccctggggataccagaatgggagtcaaaattgcaggaggaccagcaatttaaaggagttgccacctccgagagtggagtctcaccctgttgcccacgctggagtgcagtggttcaatcctggctcactgcaatctctgcctcccgggttcaagcgattctcctgcttcagcctccctagtagctgggactacaggtgtgcgccaccacacttggataattttttatatttttggtagagacggggtttcaccatgttgactaggctggtctcgaactcctcacctcaagtgatccgccctcctcagcctcccaaagtgctgggattacagtcatgagccaccatgcctggctgggaagccaagacttctggcatgtggctgagccatgctgcctggcagtatagcacccagggcttctggatcctgggcccaggtacctacaacttgactgggaatggaagtggaactatgcattgctcaaaagagctaaaatttacctgaggagcactaatgccatgtcacctggaggttcatggccaatccttctgcttaagacgattaatttctttaaaagcatcataatgattattcatcctataaaccacatagtaacaacattaaaaaaatcaaaacaaaattctctacctagcaattccattatctcaacagaacaacacacattgtttgatgtaccttttcaattccagcaaatatgcttatagcttttcatggttttcatcgtagcatagaagctgttttttgtttgtttgttttgttttgtttttttgagaccgagtcttggtctgtcaccaggctggaatgcagtggcgtgatctcagctcactgcaacctccgcctccggggttcaagcaattttcctgcctcaccctcctgagtagctgggactacaggcacgcatcaccacacccagctaatttttgtatttttagtagagatggggtttcaccatgttggccaggatagtctcaatctcgacctcgtgatccacccgcctcggcctcccaaagtgttgggattacaggcgtgagccatcgtgcccagccagaagccatttttgaaagcttaacattgtggctatatatttctcctgttgtttttaataactgtataatgttctatcaagtagatatattctagttcataaaactagtctctattttttttttttgacatttaggttttcattaaaacctaatcatcaaaaaaattattaaccgtatctgttttaggaaagtaatacatctgttggaaacatctgattgaatcctatctcaaaagccattttcttcacctttctgtctgaggtttttgtgtatacaagggaatgttttcagtgtgctggctgtcggtactgccaggagggagtgcagttggcagaatcaggagaaagtgacaaggagcagggacaagtgtaatgacctcagctgcagagattcctaattctggatccctggtagggtgatcaaccatctgtgtgcatggttctgacggttttcctgaacggcctttcagtgctaaaaccaggaaagtgcctggtaaaccaggatttgttggtcaccttagacattggttatgggggagctgaaggaactgagaagggaacgaatcatttctataagccagccctgtgtcttaaaagcagcaattcagagaaaaactgctcacacactgcaatgaaaccctcaccctttatgtagttgtcaaaatagttatttgtctcaggttatggctctgctcacagaaaaaccatccattcatttattcaataaacatgtatggaacaccggcattgttctaggcataagacacattccctgctcctgtggtgcttctgttattggtgtgtgtatgtgtgtgtgtgtgtgtgtgtgtgtgtgtgtgtgtgtgtgtgtattggtgagagggaaacaggagtaaactaaaaaacacaaaataaagaagaatggacacaataaatgcaatggcagaaacaagatggattagtggagtagaaactgctgggagtccggtgccacttggtggtcaggaaaggtgactccgaagagcctgacatttgagacaaatcagtggtgagaagagctgccaagtaaagcgccacaagagggattaggggcagaaggaacagcacgttagagggccctgaatggaagccagctgggtttcatggaggaacttagtgaaggaccctgtggtcattgtgtagggtgggaacgctgaccctagttatgacccagtccaagctccattttcataagtggggatgataagcacactgaggcccacgtgtcttgtccacagtctcttgattcccaattcagcacccatggtaccattgctgcctatttgacttgagaacttaattttctccctttgtacaactggaagtaaataaaagagattcattcattttacacgagaaaaattggtattggaattgtttgcggacaaacacaagaaccaaaaacattagcctcaaggtgaagagaggaaccttggcgtccacaatgacacccagtttaggggtccccagagatgttcggtaagacatgcttccagaaccttccaggtgaggaccaatactaattctgcagtctacataaactaaaaatgaaactggtcataaggtaggcagccccagctgacctttcacctgtgcctgaactaatgcaagtacaggacctgagtgctacaggttgaagaagtaagtgatcctaggagttgaagggtcagaggagccaggctgacacaactcatagaaggtggaggaagctgatcttctgagcctcagctgtggttgatcttgataactcaaagagttaacacaaccaaaactaacgcaagggtggagagaaagaccacaccccacgggagcgcggagccaactcgcgggagaaaaatcctattggcattgaggaggtagggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaagtaagcaggcgcggggtcgagcgcactccgacgggcgggaggataggtgcaaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagagccgggagcaaggatgtcaccccccgctcccccgccccccgttccaatcctaagataccggcaataatcttcaatcttgcttaaatcatctttgtttccaacacctagcactgtgcctggcacaggaggctctccataaatgtggttgaatttattgtgaaagaaataagaggagggggtcatttgattgatgttgtttagcgtgtccagaacatagaataaatagaactgattacattcaccctatcattcaacagagataatatactaacgatgaaggttccacaacttgtaatactagaagggatggtccgaaagaaataattcatccatctcttttccttcctctctctctcttatacacacacgcgtacacacacacacacacacgcacgcacacacacacacacaccatagccatttgcatcaaagcaagcagttccattttaaggttcaaaatgtcttctttgaatgtatcttttacacttccttttccaaaatcaggatttctacaaatgacacaggtaacttgatgtctactatttactgttccatacacacatatagtgactatatcagccatggcctggcaagtttgataagtgaagccattccattttttagaacaaaaaaatgataaaataaatatggagatgggattttttgagctgttttccaactactggtttggttagcaaaagtacacatacttgtgatttgtcaagttgaagatactattcttgactaagatgctaccgagtcggtgacagttttgaatcgtgactcttacatttgggggtaactaaacactgttttctcatggtgctttaaaaaatactctttctatgcacgttcagggagcctgctgttgtgtttccaaggtgataaaactctcagagctctcccagggagattccggtaaaccctgagactgatgaacccatgcttggggacttggtcctcaagtttcagggaactcaggtttggggcaagtcccaggaagcaaaggaacggagattgctaaactggtgtaagattagaggtgttattttaatcacaagaagctgttcaactcttgggtttcttttttaaaaattaatttcccatatccagaattgtaattggtagggtaacaggcaactggttttaccagtggagaggaataagaaaaggaagtaataaaaataccttttctggtgcttgtacagaagaagaataaaagagtttcccaaacacacaattagtagttgagtcagggagtctattcctcactaaaaatcatactgaagttataaatttagaaaacatgcccttcccccacaagacaaaatgacttaggaattgaatacaaaggtgagttagtcagtggctggaatgtatggtacagagctcctgaaccagtggattgctaactgttgctctcctctcctcctaggtgcaaggcagttgatacctggctgtgtttaaagagagagcatgccatacatatttcaaaacttgacatcccccatttcaaaatggagagtatcttacttttagagttgctgggataaatatattatttatttaaacatttcaaggttcaaaaaagaaaataatacgcctttggaatacagaaatatgttgaattattatgatctgtaattttttttttggtttttttttgtttgtttttttttgagatggagtctcgctctgtcacccaggctggagtgtagtggcttgatcttggctcactgcaagctctgcctcccgggttcatgccattctcctgcctcagcctcccgagtagctgggactacaggcgccaccacgccccactgatttttttgtattttaagtagagttggggtttcaatgtgttaacaggatggtcttgatctcctgacctcgtgatccccctgcctcggcctcccaaagtgctgggattacaggcgtgagccaccgcgccggccaatgatctgtaaatttttactcctaaatttttaggagctcaaaccttgcaatgaatcagaaatatctaggggtgcttgataatatgctgatttctgggcatcatcctcagagactctgaatctatagacctggggtaggccccagaaagtggcattccaacaagcatcccaggagattcagacgcaggtagcgggtggattatagcagcgggtggattacattttgaataactgtaacacatagtttctgtgatgggacaagctgtgtgaagtatcaggagcttatttctccattgcaagtttagatctggggtagaatctcagcgagagggcacaaagcttactctgtccttctggtctcgcttttaaactttattccttattttgtataacttcgtttaggcccagagaatgccaatgactaactgctcttaatacattaaattaaagctcattcaaaagcaggttaattaaaagaaattatctagccaactttttggtataaagcaaaatacagagttatactttctgctcaagtagcatgtagcttttaagaatatagactctaatgattgccattctaactggtgtgagctgatatctcattgtggttttgatttgcatttctctgatggccagtgatgatgagcattttttcatgtgtcttttggctacataaatgtcttcttttgagaagtgtctgttcatatcctttgcccactttttgatggggttgtttgtttttttcttgtaaatttgtttgagttcattgtggattcttgatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccatggcttttggtgttttagacatgaagtccttgcccatgcctatgtcctgaatggtaatgcctaggttttcttctagggtttttatggttttaggtctaacgtttaagtctttaatccatcttgaattaatttttgcataaggtgtaaggaagggatccagtttcagctttctacatatggctagccagttttcctagcaccatttattaaatagggaatcctttccccattgcttgtttttctcaggtttgtcaaagatcagatagttgtagataggcggcattatttctgagggctctgttctgttccattgatgtatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaagtcattggtagcttgatggggagaaataggaatacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaattggaaactgtcgcaaggacaaaaaaccaaacactgcatgttctcactcatagatggaaattgaacaatgagaacacatggacacaggaaggggaacatcatactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataaaaaaaaaatatagactctaacatgtttaattcatttgcaaatatttaatcttgaggtaatgcatgctcaaatattactaagttgcctgattcttcccacatacatcagggtcaggttgacagtaaagatgcataaacatgccttgggccttttaatgcacacttacccagaaacaagagtgaggaagagattcattttgaggttgtgtcctggggtggcaggagcaagtccaatggaggaatagagacttgggttcaggtcagagtctctaccacttacctgtgctgagaccacaggtgagacctaacctgcctgagcctccgtttcctcatttgtagagtcagatttccttttgctatttattaaatgagataatgtatgaaaatgcctggcacttagtggatacttaacatgtaccatgttcattctattccctttgcctcctagcaaatccttaacctcttgctcactgtgatattttgcatgttttcacatggtgacatgccaagtggtagagaaggaagccacggcctgtgatgaactgtatggggtggtcacagaaccttagctttttattctcactgcttatgtcattgatcccctgggacccaaagatgcaccctggaagaaagatcaagaagcatttggtgctagattcactagcaagctatctttagtatctcttttagacttgacaatgtcattatttccactaacagatgaggaagttgagacttgagaagtcatgcattcagatacggtggtggtgtagctggattttgaattagtatggggcaaaggccatgttctctttactgtcgctgactgcttctctagggcacagtcctggacctcaaagaatctgcactttggcacgggagctaagacttgtagctgtaataaaagtgactcattcctgagccaaacactggggttttcaccggagataaattgatgaacaaagtatgcaaatactgccctgccctcttgaaactgatgatctagtaataaattaacagaatctgccatgacctatcagaacttgaactagttaggggaaggctttccctagcgtgaagtgacatcaaacttgcgatgtgaacaatgagaagttaagtaggtatattagtcaattttcacattggtgacaaaaacaacctgagactgggaagaaaaagaggtttaattggacttacagttccacatgactggggagcctcagaatcatggcaggaggtgaaagacacttcttacatggcggcagcaagagagaatgaggaagatgaaaaagcggaaactcctgataaacccatcagatctcgtgagacttattcactaccatgagaacagtatgggggaaactgcccccatgattcaagttatcgcccactgggttcctcccacaacatgtgggaattaggggagtacaattcaagatgagatttggatggaggcacatccaaaccataccaataggtaaggtggacagcattggaagtaaagaagagccttctaggttgagagaactgcctgtgactgcctgtgcaaaggtcctggggtaggaaggaatgaaacagtcaaggtagtcagagtccaaaggttgaggagaaggctaacacaggataaggcaggacaggtaggcagggctatgttatggagggcatcggggatggtgggattgtgtcatgattatattttgtggttataaaggtctaacttcaggataaatgcattgaagagaagttgagtgcaggcaaggaggtcagataggagcctgttgcagtatttaggtaaaatggaatgtggtttagatgagagaggcagtgtagttatcaactgagatatgaactcctaagagtacctctatcacttattacctatgtgaatttgatcaagttccttaccatttgtatctccaaatttctttatgcataaaataattactatggtctacctaatagggttgttgaaaggataaaatggattagtaagtgtaaaatatatagaataatgcctggcatgtagtacatgtccattagacttcagcggttattgtcagtaatgcagatggagaggtggatagaatcagtagctatttagatcaagttgactggatttgatgatagcttacatatgtaaggttggaaggtaagtgcatcaagagtgatcgcaaaatgtatgtaaatgtgtgtaaatagtacagtggggcacaagttgaccagtgataggaaaagcttcttgaaggaagtagtagctgaattggaccttttaggactggaacatgcaaaagaggattatatagccctggtgaaaagagtgacccaatgttcttcagttctgaagactgctgggaggaggaagagttctttctcacctgaggctactttaccagaagttctctcagtctaaatcacaaatcctagtgattgtgtatcatcctttcctccacttcctgccaagctcagcaactcaaaatatgctgttggtcctgagaaaggaaactgggctaatcccttccttctgaggctgctgaataggagcttggctttcatcagaaagatgctttcactcccaattattacaagatcatcttgcaaattcccattttctagaaggctgattgcttgttcagaatgctcatggcaaacactgttggttacccactcagcagtcatgacctctttttccttattaacacctgaatttgatcagtccatggtagactcagcctgtggatacatcatggtgtaagccagtcatggtaatcctatctccatttatcagatacttattcttccagcttcctggtagctgagggtgactagtgataatattctgacatacaggaagtttgctcagaagcttctaggatgtgggaagagaagccctgccttttttggatactctcatatgaagaaaagatacttggaactgctgctgccaccatgtgagactgtgaggaaaaggttaaggggatttcagagacaccatcccattttctaacatcactgagcagttgaactacccctacctggaactgtctactatcagacttctagacttccttttttttttttttttttttttttttgagatggagtttcactcttgttgcctaggctggggtgcagtggcgcgatcttagctcactgcaacatccgcctcctgggttcaagcgattctcctgcctcagcctcccgaggaggtgggattacgggcactcaccaccatggccagctaattttttgtatttttagtagagatggggtttcgccatgttgggcaggctggtcttgaactcctgacctcaggtgatccacccaccttggcctcccaaagtgttgggattacaggcgtgagccacggtagccagcccagacttcttttgtgagatatgaaatgtctttattgtctaaatctctgttagttgggtactgttcattgcagcccaatgcaccctcattactacactgcttttcaatgaacaatattttacactttacaagaataactaccttctccttcttctccttactggcctttccaggcacccatatcaatagtcaagcccagccaattttcctctgggatttctgtgtgcatattcacttccattgcccccatctaccctttagtgtctctgagctaaaatataacaggagacccttaactgttttctctcattctagtatttcccccacattactgaaaactcttttcttggaccatgggtagtatcatgtatctactcttctataaccatctatggctcactattgcctctaagtttcaaatgtcctggaagatgttctaggcatgacattatttggccccaacctgttctctaattctttctgttgcttcatttatctgtctggcaagtgggaataggattaccatgactgatttacaccatattgtatccatgagccaagggatgtctatccatgcaaatttctccctgttttccagcacatcatgtccttttatgcctccacattgttggcaccaatttctttgcctggaatagtcctcctttttatatccccatttccattttacttctatcaaaatgaaatcttgctcttcctttaaggcccagctctgatcttctctttttcacaaaggctttcacaaaggctttattcccaagttgaaataaattgccccttcctctgttcttccataaaatttttcatatatttcaaatcagtattttacaggtagttaagaacatggtttctagagtcagattatgtgaattcaaatcaaaactctgctacttactaggacaaattttctgacatagctgaacctcagcatcctcatttaaaaatgtggattaaggctgggtacagtggcccgcacctgtaatcctagcactttgggaggccgaggtgggctcatcacgaggtcaggagatcgagaccatcctggctaacatggtgaaactccatctctactaaaaatacaaaaaattagctgggtgtggtggcaggcgcctatagtcccagctactcgggaggctgaggcaggagaatcccttgaacccgggaggcagagcttgcagtgagctgagatcatgccactgcactccagcctgggcaacaagagcgaaactccgtctccaaaaaaaaaaaaaatgtggattaatagcaccttgatagagttgtgaggcaagtgagatagtgtgttgttattatttttctttctctgaagtagttattccaatttgcctttgattatacttagctttatagaatgttctcactcactgaaatgatttaaagtttttggaaaaagagagatgaactggagaaaaggtaacacttactaagtcatactgtatttcagacagtctgccaaatcccttacaaatcaacaaccttgagacaaggtaaggacaccatcatcatcatcatcatcatcatcatcatcatctctactttacaaatgaggaaacggaggctcggagagttacttggctgcagtcacagcaaataagtggcaaaggcaagactcagagccatgcctgtctgatgtccaaggtccgtgctctccaggagtctctgctgtcttctgtcatggagagggccaaaactctattgtcctaaggccccttcaacatttcatgttgttttagcacaaagtaggtggtcagtaaagtgtgttgaatgtgatgtgtaatacaaaaacgaggcaggcagatcacaagctcaggagttcaagaccagcctggccaacatggtgaaaccccgtctctactaaaaatacaaaaattagccaggcatgatggcaggtgcctgtaatcccagctactcaggaggctgagggggaagaactgcttgaaaccaggaggtggaggttgcagtgagccgaaattgtgccactgcactccagcctgggtgacagagtgagactccgtctcaaaaaaagaaaaagagaaaaaaaaatgagtgatagaacaaacctttctcagcaaaccccaccttaaaacccaactgtgtcaatatgagtttatttacagcccattgattcatgaattaaaaaaaaattgaaggccaaagcaatcacaaggtaattataatttaaagtgagttattctaaacttacatataatgatataagaattttaaaattccaagattctccagaagcttaaatggaaaaataaagtgcatcataatcatacattccccaccctcacacatgcacacccttatacactcatcaacaaaacacagttctggaagaagatattaaaataaaaacttaaataattacttttgtagattgggaatggagatttggagctatggaggataatttttatttttgtattgctagtttttaaaatttttgtcttgcttttataatttaaaaccaatttattttattttaaaatttgtattctttttcttaattgcagtaaaaaatgcataacttaaaattcaccattttaaagtatatgattcagtggcatttattgtattcagaatattgtacaactaccaccacactgaccatgatctagttcaagaatatattcatcagccgggcgcggtggctcatgcctataatcccagcactttcggaggccgaggcgggcggatcatgaggtcaggagatcgagaccatcctggccaacacggtaaaaccccgtctctactaaaaacaagaaaatatgaaaaaaaattagctgggcatggtggcgggcgcctgtagtcctagctactcggaagctgaggcaggagaatggccgaaacccgggaggcggagcttgcagtgagccgagatagcgctactgcactccagcctgggcaacagaacgagactctgtctcaaacaaaataaaacaaaacaaatatatatatatattcatcaccccaaagggaaactcattgcccattaagcagtcactccttatttcctctcttcacctctgcaacaatcactaatctgctttctctatccacttgcctattctggatatttcggatagatggacacatataatacataaccttttgtgtctggctttttagacttagcataatgtttttaaagctcatccatgttgtggcatgtgtcacaattcattcctttttatggctgaataatagtccattgtgtagatataccacattttgtttatcctttcatcagttgatggacatttgagttgtttctgccctttggctatttgtcagcagtgctgctataaatatttcatgcacatgtttaaaaaagcagctggttaaaaaaaatctttgtatggtttcccattgcctaaccgtgtgataaacccaggcctggccttgctgactgtttgcccaaccttccacgttgttaaattcctttgtgtctttgtccatgctcctttttcaccttccattcgctggatggatacacatttcaagactaaatttaggtgttacctcctcaatgaggtcattgctgacatagcttcctgccttccttccacaggcagagtgcagtggtacaatcttggctcactgcaatctccgcttcccaagttcaagcaattctccacccgccacctctcaagtagctgggactacaggtgtttgccactaattttttttttttttttgtatttttagtagagacaggatttcaccatgttggccaggccagtctcaaactcctgacctcaggtgatctgcccacctcggcctcccaaagtgctgggattataggcgtgagccaccgccccggcctgtgtcctactttctactcagtgcctccttacaactcttacttgatctcatgagtctccccaaaacctgagcttgaaggcaggttcacaactttatcacctttgtgttgacagcacttaacacatggtgggcactctgatgaatatttcttcaataactggtgcttggatttttttcaccacaggataaccaggttatcttccaaataaccagttgtttgaataagaactctggttttttctaatctagatgccaatgtatgtggttactgggagctgtaattagttttatgtcctggtgagtaattaagaaccctagaagagtacattttaattagaattctgagacctcatgaagttctcaaaggcctttaactctgactatgttaaggacttgcaataatgtagattataaaggcctgcttgcttcttttggttttgtattatggtttattaagtgtttgctttttcataagatggtaatttacttgaaatgttgcttgtaaatgccacttacaatttacagtcctggaacatggtagaccctccataagcaatagctcttgttatccatcgcctatccatcatagtactttacacagagcttttgcacaaaattagcattcaatgcatgcttttaaatgaaagaatgaatagaatgggtatatgctcttcacagagtagacaagaaatagttaatcaacattctcagatggttgtagccaatgtgcttgaagatgcaacacaagaagtaacatcgttggtgacttccacacactgatgcagagtttttctcctgagctatttaacctataaattgtttcctttcagcctgtgtagagtggtctcaggtaccctttaaccctttttggaaatgcaaaacacagaagccattcctggttcctagatgagtggggacacttgtgcctcctcaccttcctgcagagcgtggactcaatggtctgtggtgctactatgcttggagctcatgagagctgacaatagctgatggagagcaaggatctcaaggtcttagggataaaatggtaagcaaaagagatgcggttcctgccttatttgcactcggagtcaataatcaaattagtatggatcagtatacagtttctaaaaggaaaaaatgcagagtgctctggagatgcaaatcagaggacttggcttattttgaggagatgcttcaagaatgtaaccccaaagaagtcatgttggagctgagtctgaaggttaaatgggaattaactaggcagagagagggaggggaaaggcctatgcaaagacccagaggggaggaggaaccaggaaccaggtggcaaagaatggaggaggaggaggtggtggaactagatgagggcagagagaaacatagtcattcccgttagcccaagagccatggaaagcctacgaagggtgtcagaggaagataggtcagatttacaatttttttttttttttgagacagaatcttgctctgttgcccaggctggagtgcggtggcgtggtctcggcttactgcaagctccgcctcccgggttcacgccattctcctgcctcagcctccccagtagctgggactacaggcgcccgccaccacaaccagctaattttttgtatttttagtagagacagggtttcaccgtgctagccaggatggtctcgatctcctgacctcgtgatccgcccgcctcggcctcccaaagtgctgggattacaggcgtgagccaatgcgccctgacataggtcagatttacttctaaagaatatattaaaaataatttcagagtaaggagcagaatggagcagagcaagacttgctggaagagatgagttagaaaatgactgcagtggaccacaaaagagacaggtagatggtgatagacatggagagaaacagggagctctgtgagatgagaaggaggtaaatcaatgggatttgatgacaaaaatgggtacagaggaaagggaagagctttcctgggttttaggcttgtacaactggatggatatggtggctgtcactgagtttttgaagtcaaataaaacatagagacaaatctctgaaatgaaaacattttatttgggaagaaaaattgcaatttggggggcatgcacacagaccgactggccttcagtatgtcccatgaacaaagagaaagaagttttataaaaaagagaaatgttacatattgctctttgagaaagttcattggcattagtaaggtttgagggagctggcaagttttgattggtaagtgacagtaacaggtaaaattattcttttttttttttttggactgagtcttgctctgttgctcaggctggagtgcagtggcacgatctcggctcactgcaagctccacctcccgggttcacgccattctcctgcctcagcctccccagtagctgggactacaggtgcccgccaccatgcctggctaattttttgtatttttggtagagatggggtttcaccgtattagccaggatggtctccatctcctgaccttgtgatccacctgtgtgggcctcccaaagtgctgggattacaggcgtgagccaccatgcccggccaactattcttaaagtcacaggagattgtttcagcagctgttagataaaactgtttcaggtgcaggaggcagtttcaggtgcaggaggcagtttcagcagccaggcttgcatagaattacgttcttggagcaatgttttgttccctgagtgcttttactcctgacctctctgttttagttgggtatgacaagaatgacacatttgttgattaactttcacatagggaagagaagaagaggtccagccagggagggtggatccagaggtctgctttggtcatgctgagttgagatgcttttgtgacatctacatggagatttgaagcagatgttgacttgctggtctggagctcagaggagatatctgaacgggcgatataaaatgtagagtaaaggttgagaagacaacaggaactagactaattcctcttgttgagtttagagttaaagagaatgagtaggatgaggacaatccaaatatcagaggaagacaacgggagggtattgtcatagaaggcaagagatggggatacttcaagatggagggagcagtgcaggtgtcatgttactgagacataagaacaacactggaaaaatgtccagtggatttagaaacctcaggcaactgttgaccctaggaagcttatttcagcacagggagagggtggcaatcagcttgggttaggttttggaatgattggaagataaggacatgcagacagtaatcacagacaactcttttgagattaaaaaaatgtgtagtgttttatcatatgagaaaaataattgcttccaacagcaataaaatgtaaataagttacatacctgttattcccactgcttaagttatcagaggacttttatacaaacatttgcatttgtagcattctgaggaaaaaatgctctggctgggccgggcacagtggctcacgcctgtaatcccagcactttgggaggctgagtcaggcagatcatgaggtcaggagatcgagaccatcctggctaacatggtgaaaccctgtctctactaaaaatacaaaaaaaaaaaaattagctgggcgtggtggcgggcgcctgtagtcccagctactttggaggctgaggcaggagaatggcgtgaaaccgggaggcggagcttgcagtgagccaagatccagccactgcactccagcctgggctacagagcaagactccatctcaaaaaaaaaaaaaaaatgctctggctgtcctctggtcttcaaatactttgcttaggtttctgtgaatctttaaatttcaggtgacttaagtgcacattcaatctactgaatcacaattcacttgtgctcatattcctgtatttgtatgatttttcccagccttcctgtattgtatggtgaataacttctttccaaggacgtttcaaaagttaagaaagcatgctgctgttgcccatttacaaatatttaatttcaaaggatgccaaagcattggcaaatatatgtgtcagagcttagagttagttgcagccttcttaataatcattttactattttatttcagaaatataatctagcatttcagcgtcactggaaatcttggtaggtagtcagtatttttgtttggaagtacaggataccagcagtgaaacacttcattttattaacgtcaagcaagtaaggcattattttcctataaatgtgaggttgtttgaaatgaaaacaaacaaaaccaggtaagacgatagaagcagatgttttctctgtttaaaaatgcggttggtatgtgaggtatgtgtagggaatggctaaaaagaaaataaaaataaaatttaaaatgcaatttgggttgggcatggtgtctgatgcctgtaatcccagcactgtgggaggccgaggtgggcggatcatcggagatcaggagttcaagaccagcctggccaacatggtgaaaccccgtctctactaaaaatacaaaaattagccgggcatgatggcaggtgcctgtaatcccagctacttgggaggctgaggggggagaactgctcgaatccgggaggtggaggttgcagtgagctgagatcatgccattgcactccagcctgggtgacagagcaagactctgtctcaaaaaaaaaaaaaacaacaaaaaatgcggcttgttcctagttaagcattttaagatttcccccttccccaagggaagagagaaaatcttacccctccttctgttcttcccttctgggtgaatgactgtacaatgaagatttaatctagttgagaaaaacaacacataggtgactcacatacaacctttgtatgtatgaatggaggcttgtataatcatttgtttttcactgtcctgacaatcaagtgggaatgagaaaaataagatttatgctagatttatttcagttgcaattagaaggaaaactatccctgtgatctagacaggattggatgtttcaaaagtgccaaatcattgagcagatagagaaagtgagaagacaataagggaacaagatttggaaaggaaatgatttaacagttacgccagtgtcctcactcatatgcaggagttgaaaaagttgatcttatggagatagaaagcagaatgatagataccagagactgggaaggatgtgtgggtggggtgggggtgggggaatgaagagaggttagtcagtgggtagaagggcagctagatagaagttatcaacaacgtattctacatttcaaagtagctagaagacagaacttgaaatgttcccaacacatagaaataataaatactcaagatgagggatcaaataccctgacttgatcattacatattctatgcatgtaacaaatatcacatgtaccctataaatatgtaatatattatttataagtaaagaaacttaaaaatgtaattgtgccaatataaacttatgtatcaatttatatttgttcatgtcttttgacttctccacctttttgttcacactcttaatgcccttactctcttttctcgcctatatttaccatactcatcatttcctctagaaacaccttggttattctgtcctcaccaatttcctttttctcagagttttcatagatcagtccataatgccaatttggtgcttagaaacatatcattgtgcattgttctcgatttttcataggcagtaaattttattttctctaccagaaactaaattcttgacaggcaaagatgattttgaaactgacccaatagttccatagacaggtttttgttgttgttgttgttctgtttgtttgtttgtttttggataaacatagaaattgacgcttttggtcttaaagcctgaaacttacatttgttttatttgagttccttgtttaggaaatgacccccaggcctctcaaaagtatcaaagaactgaaactaaccagatattgcatccagacaatgaaatgccaggcctctcattcatcatgattgcttccttaacccctctggagttcctgttttctcatacctttcttccctgctatataaacccctcattttagtccatcagggagatagatttgagactgatctcccatctccttagctgcagcacctgattaaagccttcttccttgccaataatcgttgtctcagtggtgtttcggtaacaacttcttatatatttacctgaacccttagcagtttgatgagcatacatttaagaaataaaggattccttgaattgttatcagttgaaatgctgcatttctgaacatggcaaaaagtggtctaagaagcatagcttaagcaactttctgtccaccactggtttttctgcgcccagcctctgcctgcaatgtgtgattggcatacagcctctcacaggccctcagaatgtacaggtctaactttcacaaatgaacctggaagataatttgtaattttgtggaggtgtgtgttcaagagcagcacattggtgtgctaatcagtatcccttcaccagccagtgagccttgctgctcatcagcatcaatacctcagtgtaatgtcttgcccttatcatacatgcagaaactctcaagaagtagttgaaaaacaatcaaagcttagcattttagtaaaatgttacagtggttttgagaaaattgctgaccaaaggaagatgtgcacctatcaaagtagtaaatttttactagtgttgctgctgccataggctataagctccctgagagcagggattaggtcttactcacatcattccctagtgctggggtacatcacctgggagatagaatgtgctcagcatatatttgaggaatggctaaataaggaaatgattatttctaataaaaggaaaagattgggcagggtgaggtagcttgtgtctgtaatcccagcagattgggaggccaaagcaggaggatcacttgagcccaggagtttgagaccagcctgggcaacacagggagatccctctgtacaaaacaaacaaaaaaacacgagctgggcatagtggtgcgtgcctgtggtcccagctacgcaggaggcttaggtagagtacagcttgagcccaggaagctgcagtgaattgtgattgcaccactgcactccaaactgggcaacacactgagactttgtcttttttttttttttttttttttgagatagagtctcgctctcttgctgaggctggagtgcagtgatacgatctcagctcactgcaacctcttccttccaggttcaaatgattcttgtgtctcaaccacccaagtagctgggattacaggcatgcaccaccatgcccagctaatttttgtatttttagtagagttggttttgccatgttggccaggctggtctcagtctcctggctttaagtgatctgcccaccttggcctcccaaagtgctgataccctgtcttcaaacaaacaaatgaagaatgtatagcacttactatgtgccaggcactgctctaaatcttttacatatattaactcatttaatcattgcaacaaccctataaattaactattctttatctctatttttcagatgaggaaactgtgtcaccaacagtttgagtgccttgttgaaggtcacatagctggttactggtagagttatgatttataatccacatggtctgactttacatttaacagctctcatatggaataaattaaatgctatactgctattcagatatgtgggaagacatgaaagcctcaagatatagtcaccagcctctgttacaagcttgttgtttgtttttgcttttggctttttgtcttgccacggcaaactcctaagggattctggtaatttgttagcaaactttctaaacccttccaagactgccaaattgctaattcttaagcagttttcattgacactattacattgtttcatgtcagggctttagaagcaggtgaaatagatattggttttgggaagtgggggaaagctgactagtaattgatgaatggctagcatctttatacaggagaggaatttgcaaggcaagtaggtgggcttgttctgagtttcttttgttagtttcaggagttaggcttgttgaattaagtaaataaagctcacaatgtgctgatcatgtgaaacctaatgccaagtctatttctgagccactgtgaagaggacatagataaacaaggagggaggagtgtcaagtcacacaaaatatttcttactggacttggattttattttttaaatctattcttttggaaatagagccatgatctaacttaatgtggctactctgaatgcatgctttctccatgtccactctaatttctttgcaggttcgtataaattttgtaagtaggctttgtaaatcaaactgtggactaaatatcctggtgcgactctcaaattgctctctcaaattgcaggcacaaagtcttggaagttctgttgggcagaaacaaactggaccaacattttgcgtttctgttatcatccaacttcctatatgcagtcaatctgataacaaacaagctaatgagctcacactagaattagaaattataaaacatttggttttccaggggaactgggaatggttttgtaattaatgtgtcagaaggaaaactgaagcaaagaagttttcaattgcaccatatatgacagacaaaaaatgaaattaaatgcatccttcagctctgaggacagataatggtcctctgtatctaagcgtccaggaggaggtgttctctctattccatacatctgtgtcccagtgaccaaatgcaatgaagagagacaacttgtaaattaaacaaacacaatggggcataaagatttttcccctttaatattacgggatatgacaaagaagatcattttctggttgccgtaaaaatacaacagtaaagttgaattagacccgcagatttgattaatgaatgctgtgcttatgaaaacacataattattcctgagctcttggaatgaaccaagtgcggtagcttctggggcacttgtgcatattacttttaaagatagaatcctgcttggcaaaaatggctctcccagttctatataaaagatacagcaagaagcagtgaatgtatatatagacaaagagaaaaataaagctcatagctgtcttcataccagtatagatctttcttagcacataactagatttttgtggattttacaagttaaataatgtgaaaaatatatttgggcacaagccgggatcgctgagctatataaaagggattctatcactcagagagttgtgtgatcatgggctagtcagtatcctttgtcagtgggcctgtctccctcattcgtaaaatggatatggggaggcttactatttccttaccagccatttcaaatatatgtctcctgataacctttgcattttagagctcttcttttgttttcccatgagcaaatcagcaagagctacaagttagcaaacttttaaggagtgcttgctgtgtaccggcccatgataggtgataggggccacaaagatgaaggcgccttttctctctacccatgagatccagtgaggccaatgaattactattattgttgttgttgttgagataggccctcgctctgtcaccttggctgtagtgcagtggcgcgatcatagttcactgcagcctcaatcccctggggcacaagtgatcctcccacctcagcctcccaagtacctgggactacaggcgtgcaccaccatgcctagctaatttttgtatattttttagtgactgggttttgccacattgcccaggctggtctcaaacacctgagctctggcagtcctcccgcttcagcctcccaaagtgctgggattacaggcgtgagccaccatccaccgtgctctgggtcatttttttcagctctcttatagttcatatatactttctccggctattgtatattccatctgttaatcttgtcaaatctattgtatattccatctgttgaccttgctatagcaacaactataattttaattccttaagttccacttagttctttttcaaatttgcctgatcatttttgattgtctcttgttgcttattccattttatgattccattctttatttctttaagcataccatgtatatttgtgtatacttcgtatcagatcatctagactccttgagattctaaatctggactttgtagcttctgctagcctttacctgggatggtttgttccttttgattttggtgacctattttttatgggttcaattttggttaatcttaacctgggaaaatttggaggctgaaattaaagatgtgatcctccagaaaacattttttttttcctgttcagagatagtgaccattggggccaccatgcattttgtgtgggtttattgttcacggctcccatttcagcttagaatctctttttttcttcctcttttttcccctttaaccttcatattctcccttaggtcctgcaaagtgctacctaaaaggtcttgtacattataatgttattttataacttaaaggcccctcagggtatcttgcccaccatatttctaaaagtgaaattgctgatgttattgaatgcttaccctgtgccaagcattcttttgagcattttacttgtgttagctcatttaacactcacaacaacttcatgaggaaaagtaacattttttattctcatttcacaggtgaagaaattgaggtgcaatgcgattaagtaacaggttgccaatgttacacagctgatacatgctacatgagttgataatgttacacggcaaatagagctgggattgtaagaaacacctaaaaaatttatgcacatgataggaaattcaaagtgtacaaaaggctatatagtgaatagtaagtccttttctgttcctgtgccctagacatgccattgcccctcccaggaggcaattattaccagtttcttacgtatttttctaggggttgtgtacaaaacatacaatctaatatatatatatatataatagtatatcatatttattatacattatgtgtctgattttgctagaaaaatagaaataacaaaaagtaacatttcttgaatacttactctatgcttgttacttttcattcattatctcatttgttcttctgaggaattattagttttactttgtaagtgagaaattgagtattacaaaagttaagtaacttgcccaagaatttgcagatagtaagaagcagagctaggattcaaacctaggtcttcgtggttcttgggcctgcacactttggcttttcacagggagctgactaggggttgacatctttaactcctctgtagtggattaggacaagagttagagtaaaggctggggtttagggtttgcgctaggacctcctctctaacccctacaccatacctggatgtggcctgtgcaagtgtgttttaggattgctgcttcctggggaatgagatggagaacacaaaactcaaccttgcccatcttctctgcatctatatttgttagtttcatatgtttaaggataggcttttgttaaccaattactctattttgaaactccctcttctcttttcttctttttctaatttcttccttccttccaaccctcctgtaaacatttatttgagtgcctttatatgtctagcattctgtttggtgctggaaataccaagatacaagaacataactgtcttttgagaaggttgtactttagtggggagacaaataccctaactgcaaattataacacagtgagttaagtgtttgtactttcctatggctgccataacaaattattacaaacttggtggcttaagcaacacacgcagattctctcacatttctagaaatcagaaatttgaaatctgtttcactggtccaaaatcaaggtgtcaacagggctacagtctcctggaagctctagaggggaatctctagattctcctttgcttttccagtttctagagccacattccttttatgctgagttccaggaacttccctccatctccaaagccatgaatgcagcatcttgcgtaagtgatcacattgccttcttctggtgaaatactgctctgacttccccttcttttttttttttttttagatggagtctcgctgttgcccagcctggggtgcaatggtgcgatctcagctcactgcagcctctgcctcctgggttcaagtgattctccagcttcagcctcctgagtagctgggaatacaggcgtgtgccaccacgcccggctaatttttatatttttcggaggggcaggatttcaccatgttggctaggctggtctcaaactcctgacctcaagtgatccaaccgcctcagcctcccaaagtgctaggattacagacgtgagccaccaagcctagccctgacttccccttctaaggacacttgtgattgtatttagggtccaccctgctaatctgagataatcttcccatagccagatccataatttagctatgtctgcaaagtctcttttgccatataaggtaacattcacagatccctgacttttatagttctgttcttttgtcctcattttctcattctgtgagtgtgtgtgtgtgtatcctcaacagtttcctccagacctggtgtactagcaagttgtgtgggttcttcctcaaaataccacccatggggtatttctttttcttctctctctctgctcctctctacactggttgatgcccttattcagataaacattcaaatggtcagctaagggttctccctgtctctaagctctcctcccaacttaccttacaaccattgttccattaattgttctatgtgacccttgtttaaaaacttctagagaataaattctgaactccttagcatgacacttcaaggttctctggagttcaagacctatatcaacttcatttatttattcagcaggtgctcattaggatttctcatgtgttaagactgtgccaggcactgagagtatgatagtgggtaaaagtaggcatgtccacccttggggattttgctgtctaataggaaagacagatatgaataaaataataattatgaagaaatgtgaaattgcaactacaataaaacagcagctcagacttatgtaatgcctgccatccatctagcatcatcctaagaattttacatatactgtctcttgtaatcttcacagcttgttcataactgctacttcctactttatggatgagataacaggtgcagaaagtttaagtgattcaaattcacacagctggaaaggatttaagccaggtagcttggttctggattttgtgtatggaaccactgtcatattttgataaaagagaagtgcctggtgctatgaggatcgttaattgggagtgggaccagggtagaaagaagcacagagagaagcaaaactgcttcatgaatgatgtgttgaggaggtacacagcttgatggtaggccgggtctgttgggaactgttgaggttatatattgggaactgttgaggttatatatatatatatatagagagagagagagagagacagacagacagacagagacagagagacagagacagagtggggatggggaattggaaaagcttcctaaggaagggacagctaaactgaagttggaaatataccttggcattaattggacaggaagaaaggaaaagtgttccatccagagggaagatcatgtgtcaaggccgtatggaggcaaggagcagagtgcttagggggtctgaaatgggaccaggtggagccgagagagcaaaggcagagggaggagcaaggtataggatggctgcagtgggattaggctggggaggcaggtaggtgccaaatcacccaggaccctataggacatattataaaccattttctttatcctaaatgcaatgggaaaccattgccattgagtttttgttttgtttcatttttctgagatagggtctcactctgtcacccaggctggagtgcagtggtatgatcatagctcactgcagccttgaactcctgagctcaagcgatcttcctgcatcagccttccaaagtgctgggatcacaggggtgaaccaccacacccagccccattgaggttctattcagggggtacgacagagatgtgtcagaggtttctggattgtgccctgaattgatgtggtctcattctctggaacggaacccaggaaagagaacatgttcaggaataagatcatggactctgttttggacctgttgactttgagaaacacaaatgagatgtgaaggaaattttcaaatatttggatccagagttcatagaagatgtctgggctgggcctttaagtccagcccttgtgtcactgacttttggcaattgaaagatgaaccttttgaaggacttctatggtgctaaggagaattttaaattctacttgtgagactgcattaatcttttgttgtagatttgaatgtggggtgaaaatcagtcagagtgggaagaattaattttagagtccttccccactttctacttttacaacagaatacctttggataatcatttatccttcaataataggaactagtttttggaaattgtggtttgagtctgctataaggaaaccggcaagacaaaaaacaaataaccaaaaagctgtgtgagaaggcttcttaagactgcaatgtaacctcagtgttcaaggcaaaagggagtgtatttgttagctattgctgtataacaaattaccccaaaacttaggggcttgaaacaacaataaaaatgtattgtcctcacagtttctgtgcatccaggaatctgtgagcagtttagctgagtggcttgagctcaggaggtaagaggtcccaggcaagatgtcagtgagttcttcagtcattggaaagcttgactgaggttgtaggatccacttctgaggttaaaggtcattcacatgactgcaagctagtgttagctgttggcaggaatccttggtttcttgccacaagagcttctctcagagctacttgagtgttcttaccctatgactagaaagctccccctagacaacctaacagtgagagggccagatggaagccatcctttttatgagcgagtcttaaaagtcacacggtgtggtgaatgcttcattccaagcaagtcactatgtttggcccacctcaagggtgaaggagggaactcggctccaccttctgaagggaagagtgtcgaagattttgtgggcgtattttagaacaccacatgggtgtttgaaatctgagctgtggatagggcctcccctctcaccctgtgtaggaattaatttcgggtacagcatccctgacagatggtcattcagccctctgcttgccacttccaactacgaggagttcactacactgtgagtcagtgaattccacttatatccagtgttaattgttagaagctttttctgttcatgaaattgaaagctctattgtggatattccattattaaagctagttctgctactctagaatggcacttttacatgatggcttttccaatatttgcaactgtggtaatcttaacttttctcttctccagatgaaattttgtctgttccattcagagcttcctctcgtgttttaattccaggcttcttccacattctggtcacctccttgtgaaaacattctgattcagtttatccttccagaactgaaaacacactactaattctgtagcccgcgctaagtataaagggacacagcaagggtttcctcactttgcgtaatagtggaggactgaaaaatgactgtgaaacctgaaataatgcaaagtgatcctagtgggaaaaatgatgatcattctgagacctttataaactgcttttttttttttttttttttttttgagatggagtcttgcactgttgcctgggctggagtgcagtggcacgattgttgctcactgcaacctccacctcccgggttcacttcattcttctgcctcagcctcccaagtagctgggattacaggcacataccaccgcatggctaactttttgtatttttagtagagatggggtttcactatgttggccagactggtctcaaactcctgaccttgtgatccacccgcctcggcctcccaaagtgctgggattacaggcgtgagccaccgtgcctggacaaaacatctgtttttaaaactttaaaacttgttaaaattaaaaattttatttcaaatttaaatgcaaaaattagtaaaactagtgttcatttagtattcattagtattctgtaattaaaatattacatattacattaaagatatagagaatttaaaatacagaggattaaaatacttttgcaaaagaaaaaaaaacaaaaacatcaatagtagattgaacagtgcttgccaactccttcttcttgtataactaataatacagagtgagtatttttgcttcggcaaattgtcatcctgcttttaaaatttgtatcagctttcaacattatatcctttgagctttcagtattataaaacatctctgagagttcctttaatgtgaagttgtttttgctggtatcatttccttggagatacctttaatcactatccacatttatgttgacaagttcatctttgctaagttcctctggctgtagactttagagtctctgacagtggcagtgaccacattgctatggttagctgtataattacatttaggtccgattcccacctcgctactctgttgtcacttttcacttctttgctgtactttcatgtttcttgaccaattcactctcttcattatccattcttataaaatgccacatgggtttactgctgggaagcaaggaagcaacacagctacatgctttgatgtcaatgtgtgacctgaataatagatgcacagtgactagccacacatactttggaataaggagtgtggttggttactgatcatgatgcacgtctgttatgtatgtaatgatttgtggactacagaactagaaactaagtttgcactttattcaattactcacagttaatataccatggtaattgatatttgaaccatgttgttaggggactggtattatttaactaaatcatggtattggaaatttatgtacatcagattcatgcaaagcaaagtctgcctgtaggcttacgaattggtctggagttggaatcgatatttttttttttttttttttttgagatggagtttcactcttgttgcccaggctggagtgcaatggtgcaatctcggctcactgcaacctccacctcccgggttcaagcaattctcctgccctagcctcccgagtagctgggattacaggcatgtatcaccacgcctagctaatttttgtatttttagtagaggcagggtttcaccatgttggtcaggctggtctcgaactcctgacctcaggtgttctgcccgccttggcctcccaaagtgctgggattacaggcgtgagccaccgtacccagcctggaatcgatttttatgggcgactgttctgtgctgcttattttaagctcctggtcctcgctgtaatcaagtctcatatgtctttacctatgcatttgaattgtgtaaaatgtaagtgtaggattttacatacattccatttagcttgtggctgtatttttgacattttaaaaattttctgatacataatatttgtacatatatatggggtctctgcctttttaaagctggattgtgctatctagtaaacaaactgtcttctccaaattgttatccttttcacagtaagccattagcaagaacatggctggggccgagctcaatgatatgtttccagagttctctaagagctctccagccatacttccctcatcctattaatcaaccttttaagtaggaatatatagcagctatgaatttctccaactctgctgtcatccagcctgacgttttcgagcttgtccaacaaagttatctgtctggtgccatcagatgcctttctgaaatcaaagcatattgtatcagtagtggtgtcctgaaatgccactctggttaccctaccaaaaattaacactatgggtaataccttatgtttacagagaacttttacagttcactggagtgtttggcatatctctattttaaaatattttgtctatatagagttgaagggagatatggcagatatcattactttattttcaaaaatggtaaatcagagaggttaagggattggctcttgttcacagagctagtaaatagcagaatcttgatccttcagtaaatccagtgtgtttgaccatttcaaactatctcagatgaagtgactacaggcaagaaaaagggagtttctgcagtgttttcctgtcgatttattaggacagatcagtcttatgaccctcctcctatagggtctgtgctggtttcccagggctgctgtaatgaagtaccacaaacagggaggcttaaacaacagtaatttattgtcttagaattttgaagtccaagatcaaggaatcagcagagttggtttcttctgaggactttgagagaaggatctgttccaggcctgtcttctttgctcatagatggttgtcttccctctatgtctcttcaactcattttctttctatatgtgttcctgtgtccaaaaggacaccagtcatactgaattagggcctatcctaatgatttcattttaacttgattacctctgtaaagatgttatctctaaataaggtcacattctgaattactggcggggggggttaggactgtaacatattaaattggggtgggaggggaggttcaactcataccaggtcttcaaggcagatttcaagtttttttaaaaatggccatccgggcgcggtggctcacacctgtaatcccagcactttgggaggccaagaggagcggatcatgaggtcaggagtttgagaccagcctggtcaacatggtgaaaccccatctctactaaaaatacaaaaattttccaggcatggtggtgggtgcctgtaatcccagccactgaggaggctgaggcaagagaatcgcttgaacccgggaggcagaggttgcagtgagacaagactacgccactgcactccagcctgggcaacagagcaagagtccctctcaaaaaaaataaaaataacaaaggcccaaaggaataggcttgtgtagggagtacttttgtgtgtgcctgcatttttaaatcaatgtctgtgtatctgatacagtctattgagatcaactttatggtcaattgatactgcctttcagtttttcaaaagagagagagagtgagtgcttttcctaaattaattcttagttgtctacttgctgaatgtagtctctgaagatgtcttttgtgaggcagctgctgaaattatttgcttgtttgatgatttcaggattcaaatgtgtcatttaactttagagctgagatttatggtgaatttcactccgagcttggtgttaattttacacacatctaagcagtttccttcttccacaagttggttaagcatcagaggattctgaatttaggaaaaaaaaataaattaggcagtaacaatttgcatcccaaagtgattcacaagttttcaagtatattcaagggttgtttagcatattaccgactacttatcaaaacacgggactgattatgaccttgttttagattgctggtgttgaggtgctacaaatgtgagatctgtattattgtgtttcctcattgccttcgcttcttctgtggttttttccttttggtcactttgggtgttccacagattaccaatgtgtgcatttcacatgaaatagattttgattttttaaaaatagcatttattgtgagtagaaaatttggtttcactcatacatttttctggtgatctttgtgcattttacttatttttttgaagtgattcttctttttaattaactcattgggtaaagaaagtacagttctaatgtctatgtaaggtgtaatgaataaggatgtgatgaactgtggttatctttgaagctctatgtgttctcaatatccgttcccttcccttatcaccattatactaaattttatgcttatcatgtccttacttttacttatactttcacaattttttttgtgtgtgtcacttgttgcttaggctggagtgcagtggcgcgatcttggctcactgaaacctccacctcctgggttcaagcaattctctgcctcagcctccggagtaactgggattacaagcgcccgccaccatgcccagctaagttttgtatttttagtagagacggggtttcaccatcttggccaggcttgtcttgaacttctgacctcaggtgatccacccgccttggcctcccaaagtgctgggattacaggcgtgagccaccgcgcctggcctcactatcttttttcactttcttttttttcttttagtcagagtcttgctctgtcacctgggatggagcacagtggcgtgatggtagctcactgcaaccttgaactcccgggctcaagcaatcctcacatttcagcctcccaaagtgtgggattacaggtgtaagccactgcacccagcctatactttcactttttatatttgcgtttccaaataatatactgtttagtttttcagttaaaattttttatttttaattcattaaaaaatgattcaaaaagttacaagaatatacaaaataatgctgctatagacttcacccggattctcagtgctaatattttacaaaatttgcttcattattctctactctctctacatatataggtagacacacacatgcacgcacacacacacatttttctggactgagagtaagttatagacatgctgttggagtctaaatactttattttttttccctaaaaaataaggacactgccttacataatcatgaattattatctgggtcaggaaattaacataggtataattctaccacatgatctgtagacccattcaaactttgcccactggcccaataatgcccttggtggctatttcccctcctcttattcagaatccactccagaaccacaggctccatttatgtatcacattcctttagttgcctttcatctgtaatgggtctttagtgtttctttgtctttcatgctctggataattttcaagaatatagaagagtttctccttttttcaaactgtcccttaatttgggtttgtctgatgtttcctcatgattagattcaggtcgtgcatttttggcagggacatcggagaaatgatgctgtgctctcagtacatcatatcaggaggcacaggatgtggaattgtcccgttattggtgatgttaactttggtcactcggctgaggtggtgtgggccagctttctgcacttctctttgtaaaataaactttgtggggagatactttgataattatataaatatcctgtttctcaacaaattttcacccactagttttagtgttcattgatgatttttgcatgaatcatttttttatgatgatggatgccaaatgctcattttctaattgtgtaatttcttccacatatattagttggtattccactggaagaaagaactctccattctcactcatgtactcattcatttacttatcattgtggactcatggattcccatattattctttggattttaatttgttagtatttttatttattttgatgctcaaattggcccagatttacctagtgggagtttgtttagagtggcttctttgtccttttgactactttctgactatattctagcacttccttacttttggcacaaaattatgttctagattcatcttgtattttccttaccagagccctggaatgagccctggagtcacttggttctgttttgtggagaatggtatttagaaaccaagatctgagaactaggggtgctgattgcatctgggtttcattgtctctaggcctctcagcagataaagctagtatgtgtgtgcatgtaatgtatatgtatgtatgtaaatatatgtaaatatatattactcctatatgtaatcaatctcctgaccctggggactgtctcctcggctacagccttgcccattccacctgcctccttgacactgcacttctccaaccccagttcccctgaccctattagcattctcagccttgactgctcccttagccccaactacctctgcattcctggatccaccaggcccacctgctggggctatatgaatggaaggaaaaggaaaggaaaggcacaaagaaatagtttataaagaaaaaaagaaaaggaaaaggctgtttggtttttaaaatattacatgaaaaaatacataacgtagtgtctaatggccgttagcctgtaggcaactggggttcaaattcaggatttattacctgccagatgcgtaattttgggcaaggtacttaacatctctgtgcctcaattttatcctctgcaaaatggggctagtaatagtgcctcatagggttcttgtgaggtttaaacaagttaacacatgtaaagtatgtaggatggtgtttggcacataggaaatatattttaatctctttattattatcagacatcccatcattttagaatatgttgctttatatttctaataaaaatgtgttaaataccaatgatttattagtggtgtcttctacagagatcagaagagttattaaagttaccgtttttccttccatgagtattattttctttattcagatttgactgtctataccttataccactttgcaacataagcattacattaaattactattacaaatcttgaatctttgcacttatcttttaaaaatttaatttttagagaagttttaggttcacagcaaagttgagagaaaggttcagagctttcccatgtatcccctgccgggacacatgcacagccccctcattatcaatatcccccaccagaatgctacatttgcaacaactgataaacctacattgtcacatcattatcaaccaaagtccacagtttatactagggctcactcttggatttgtacattatgtggttttggacacttgtataatgatgtattgaccattatagtatcatagagagtgttttcactgtcctaaaattcttctgctctgcctattcatccttccccctccaacccttgacaactactgattttttattgtctccatagtttgccttttccagaatgtcatatagttgggatcatataatatgaagctctttcagatttgtgtctttcacttagtaatatgcatgtaagattctctatgtattttcgtggcttaatagctcatttatttttattactgaataatattccgttttctggatgtaccgcagtttatttatccattcttctactgaaggacatcttggttgcttcctaaaggtacatccttcatctatcaaggagtgtttgttttctactacagaatgatacttgtaagccaccagagtctgtactctgatcaaataccaagggcatttgatcagtccctgacgttaaagaaaaatgttaaatgttatttccatttggaagctaatcataaataaatataaagtttcagagaaatgctagtgaaagccactgggatggttttcaagttatataattttaatttacatgcatctttttaggagttcatatcagagcttggcaactataggccacaggccaaatccagctccctgactgagttatatggcctgtgagctaagtatggttttaaaatgattgaaaaaaagtgaagaagaagaggaagaagaagaagattttataacaaatgaaaattacataaaatgcaagtttcagttcctgtaaataaacttatattggaatatagccatagccatttgctactatattgtctatggttgattttgcaattcagcgacagatttaagtagttcaatagacacaatatggcccgcaaagcctaaaatatttactgtctcaccctttagggaaactgtgctgatccttggtttatactattacagaagcaatcataaagttttggaagaatctcggaagacatgtctagtttaggagatatggcttcccctgcaccttaggcatttaaaataacctggcctgtttctttctgaaatgagaatattggatctgaagatctaagtccctcatgcctcatgctattctttgatgcctttgtaacattattcgccccattgtactagtccgacggggttttttcccccactttggtttttattttaaggcaatctcacttcatctctcttttccattaatctgtttgacatgaactgagctaatacggcaatttttgtctctgttcaaaaacttcaagaaattttgagacctcatatttttatctggttttatttcccctcacagtgacgtaagagtggattttgtataatagattgaaatatgttcttttattttgttggatggctgagctatttcacagtggctcaaagagcagtttactttgttccatagcaacaagcctcttgcccaaatttgccatctggtgtttgaagcctgtatcttgcagcagtttttttcattagctgacagccattactcatctgcttttggctttagtattcccgacattctcattattgctcatcctaaatagtcccagtttcaagtaagaaagcacttggagttgtttgcttagcagaagggaatcaatttcatctggaaaacaaggggccagttgagaagatacctgccagctgggaccatgactttattatttgtgaaacttggtttttaatgacttgtgtatatgcttaacagcccacctagagtgtggcctgtgaaggggaagaccaattggccatggtgggtacccactagatggtgaatgagtgaacgggtttcctgcataaatccaggaaaccttgggatgaaaaagcagtagccccatgaagaaagcatcaatcatactttgtaattttgccacatttgctttccaaattttttttagagattacctgaaaataaatctcagggctgatccctggctacctctgatctgatcttctatcagtctttcttgtagtccttgtactgtatccccactagcctctctggtgtttcagaacctgccaagcacactcccattttggggtccttgctagatattccctctgcctggaatgctcttccccaaatgtctaagtggttcactctctccttttatgcaagtctctgcttaaacctcattcttcagagaaaccatcacactccacattttagtctatttacctctctttattttcaccataaccctcactatgaagtatatcttcatcaatttattgttcccagtctctggaataatcctgagcatacaggaagcactcaggaagtactttctgagtgaaaacatgaacaaaagcaagacaaaaatctattaaatacttgatttgtgaattaaggttttccccaacccaacacttccgtgttatttacagaatactcctgtctatttcacatcttgtagctttttgcctctttgctgctcctgttgttaccccttccatcccttttcccacaaccctggatacttaccaagtaccaagtcctaccaaccactgtccaagttctgccttttctttgaaatcttcgctgatcacacttattatctctccattggaacccacagggccattgcacttcctcatcctcccttctcatgtctaattcattttctacctctgcctgtcttaactcctaaaccttaagctctatgagtagagactatgcatatatattcctatttttcatactttgcattttcatatacacttaatgcatatttttagtacattggctagaataagacatttattattaacaactttgtatctaaaaaggagtaaagatgaaagtggagtcactctcaacttctttcctaaagagataagcactgtcattatttagacacctgctatggtttgaatgtttgtcctctcagaaactcatgttgaaactcaattgccattgtaatactattaagaggtggggcctttcagaagtgattaggccgtgaggacagagctctcataaatggattaatcttgttaccatagtagtggttatcttgacagtgagttgttataaaatgactctggcctcgagtgcttccctctttcacatgctcttgcctgcccttccacctttctgctgtatgatgactctggctagatgctggtgccatgctcttggaattcctagcctccaaaacggtgagccaaacccattttgctctttatacattaccaatctgtggtattctgttgtagcaggagaaaatgtactaagacagaaaattggtaccaacaccagggttgttggaataatagatacctgaaaatatgcaagtggctttggaactgggcaatgagtaaaggctggaagaatttggagaagcaggctagaaaaagcctagattgctgtaaatggagcattgaaagtgattctggtgaaggctcagaagaagagaagactggggaaagttttgaacttcttaaagattacctaagtggtcatgaccagaatgttgatagaaatatggacagtaaaggctgttctgatgagatctcagatggaactgagaaacaaggtattggaaactggggcaaaggccatccttgttataaagtagcaaagaacttggctgaaatgtgtctataactgagggctttgtgaaaggtggaatttaaaagtgatgaaataggatatctagctgaagacatatttaagcagcaaagcattcaggctgatgcatggttacttttaaccgcttatagtaagatgctagaggaaaggaatgatttaaagatggaatttataatgaaaaaggaagctatgtgaaaagatttggaaaatttgcagcctggccatgtaaacaacaaaaaagcattctagtgtggaaccaagagaccatttactgacgagattaacacagacagaagagagccaccatcaatacaatgggagatagaccctgaaagcatttcagagatctttgaggctgccctgctcatcacaggcccagagttctaagagggcagaatagtttgaggggttgggctaggagcaacctacacaggctccctgcccagaccgacctcacatctctgcttcctgcattccagcagagagctctttcactgctcccaccatggctcaagcaggtccatgtgtggctcaggccacaacttcagaagatgcaagtggcaaatcttggttgcatccatgtggtgttaagtttgcaggcatgcagaatgcaagatctatgggggcatggcttcatccacctagatttcaaagtatgttgcaaatagcctggagccccaggcagagacttgtcacagaagcagagccactgcagagagccccaactatggcaatactgcacaaaaatgtggggttggggttagtgccagagctgccacagagagtcctcactggggtaatgcctagtggagccctgggagcaggactggcactgagactccaggatcgtggagctactagcatgcaacctcagcctgggagagcagcaggcaggagactccaacctatgaagcatgggctgggtctaggaaagccataggagtggggctgccgaagacctgtgtgcccaggatgcagaaaatggagtcaaagattattctctaaattgagggcttaaagtgttttttcccattgggttttggacttaattggagtctgttactcttctctttttgcctatttttcccttttggtccaggactgtcaatcctatgcttgccccaccattgtattctggaagtagataacttatttgatttcacaggctcacagctgtaggaatatgcctatggatgaatcctgtctggtgtctcacccacatctgatacagaggagactctagacttttttttttttttttttttttttttttttggagacagggtttcactttgtcacacaggctggaactacagtggtgtgatgacagcttactgcagccttgacctcccaggcttaagtgatcctcccaccttagcctcctgaatagctggggttacaggcatgcatccccatacctggctaatttttttgatttttttagtagagatggggtcttgctatgctactggtctcaaactcctgggcgcaattgatcctcccacctcagcctcccaaagtgctgggattacaggcgtaagccaccacgcctgacctgagactctggacttttgaattgatgctggaacaaccacttaagacttttgggactactggaatgagatgaatctattttaggccaaatacagtggctcatgcctgtaattctagcactttgggaagccaaggcaggaagatcagttgagctcaggagttcgataccagcctgggcaacgtggtgaaaccccttctctaccaaaaatacaaaagttagccaggcgtggtggcacatacctgtggtcccagctactctggagacttagatgggaggatcatttgagcctgggaggtggaagttgcactgagccaaaatcatgcccactgcactccagcctgggtgacagagtaagaccccatctgaaaacaaaacaaaaaaaagaaatgaatatgttttgtacttgaaaaggacatgagttttgtaggaccagggcagaatgctatggtttgaatgtttgttttctctgaaactcatgttaatatttaattgccattgtaacagtattaagaggtagggcctttaaaaagtgactgggtcatagggatgaagctctaatcagtggattaatgccattatgaagggagtgggttagttattgtgagagtaggttgttaatgttttctttccttttcttgtttttttgtttgtttgtttttgttttgtttgagacaaagtctctgctgtgttgtgcaggctggagtgcagtggcatgatcttggctcactgcaacctccgcctcccaggtcaagcaattctcctgcctcagcctcccaagtagctgggactacaggcacctgccaccacgcctggctaatttttgtatttttagtagagatggggtttcaccatgttggccaggctggtctcgaattcctgacctcaagcaatctgctcgccttggcctcccaaagtgctgggattacaggcatgagccacttcaccccgccatgttttcttttctctagcttactttagtgaagaatacagtatataatacatataatatagaaaatatgtgttagttaactttatgttgattatgtcgattatgttattggtaagtctttggccaacagtaggctattagtagttaagtttctgggaagtcaaaagttatcgctcattttagactacggtgctcctaacccctgcattattcaaggggcaactgtaatccccttttcttcttgaattactaattctattctacttccctcacagactttttactaatgcaatatatttttatacttgaaagccttctgttgatcaaccattgtagtaaaatatctgtacatagatttaagcatttacagtggcccgggaatataagaaaattaaaaaaaaaaattgtattacacgttttgaaagtaatttgttaagtgtaaaaagtttttttcatccagtttgataatatatctatgaatgattgttagttgttggtagaataaaataaggggcagcatcaattttttcttattttccatttttatagatgtgagttttaggaataattttaacataaatcgagtagatgcgaatggaaaaagtttcattgtagcaatatcattcaattctttgaacttgttatgtgataaatttacatattaatcaatcaaaaatatctttaatgatctgtcaattgataagcaatgaggacttctatcattttattgacagttaaagaccacaatgctagagaaatatcgtagggtgccaggcagaagccttggtaggggcacatttgagcttggtgactatggctattccatctactgtgctgcgtgccttgttccagtactgcatggctactcaggtgcagcccagaaaaagggaaagtgggactcagttatttttaccagctgtatgttaagtaaaagacaatggaaatatgaaataatagatagtgaaatctaacctcgacaaggaaaatggaggaagaagatggctggtggactgggcaaaagtacagggagaaagtaaagggaaggctcttttttttttttttttgagacggagtcttgctcttttgcccaggccagactgcagtggtgctatcttggctcactgcaagctccgcctcccgggttcacgccattctcctgcctcagcctctggagtagcttgattcttttcgcttttgttgcccaggctggagtgcaatggcgcaatctcggctcactgcaacctccacctcctgggttcaagtgattcttttgcctcagcctcccagatagctgggattacaggtgtccaccaccacacccagctgattttttgtattttttagtagagatggggtttcaccatgttgaccaggctggccttgaactcctaacctcaggtgatccacccacctcggcctcccaaagtgctgggatgacaggcatgagccaccatgcctagccatgtttctttcctcttgctgcttttaggattctttctttatccttgatctttgagagtttgattactaaatgccttgaggtactcttctttcgattaagtgtgcttggtattctgttaccttcttgtacttggatattggtatctttctctaggtttggaatgttctttattatccctttgaataaactttccatccctatctcttttcctacctcctctttagaagcaaatctatgagttattgaatttgtgggtttttagatcctataggcttgcttcattgttttttattctttttatttttgtctcctctgactgtgtattttcaaatagccttttttttttttttttttttttttttttgagaacgagtctcactctgttgcccaggctggagtgcagtgtcgcgatctcggctcactgcaacttctgcctcccgggttcaaacaactctctgctcagcctcctgagtagctgggattacaggtgcccaccaccacgcccagctaatttttgtagttttagtagagacgggttttcaccaagttggccaggctggtcttgaactcctgacctcgtgattcacctgcctcggcctcccaaagtgctgggattacaggcatgagccactgtgcctggcctcaaatagcctattttcaagctcacaaattttttcttctgcttgatcaattctactattaaaacactctgggccgggcacattgcctcacacctgtaatcccagcactttgggaagccaaggcaggcagatcactaggtcaggagatcgagaccatcctggccaacattgtgaaaccccgtctctactaaaaatacaaaaattagctgggtgtggtggtgcaggcttgttatctcagctactcaggaggctgaggcacaggaatcacttgaacccacgaggtggaggttgcagtgagccgagatggtgccactgcactgtagcctggtgacagagtgagactccttctcaaaacaacaacaacaacaacaacaacaaacaacagtctgatgcattcttcattatgccaattgtatttttcagcttcaggatttttccttgattctttttaattatttcaatctctgttaaatttgtctgatagaattctgaattatttctctgtgttatcttgagtttctttgagtttcctcaaaacaagtattttaaagtctctttctgaaagattacatatctttctctctcctggattaatccctggtactttatttagttcatttggttaggtcattttttttttcctggaatgtcttgatacttgtagatgtttgtgcctgggcattgaagagttaggtatttattatacttgtcactatctgggcttgtttgtacctgtctttcttgggaaggctttccaggtatttgaaaggactttggtgttgtgatctaagctatatctgctttagggggcaccccaagcccagtaatagtgtggttcttgcagactcgtaaaggtagtgccttgatggtcctgaacaagatctggaagaattctctggtttaccaggcaaaaagactcttgttctcttcccttactatctcccaaacagtctctctctctgttcttaaccacctgaagctcggggtagagtgacacaagcacccttgtggccacaatcacccttatggccacaatcactatgactgtgctgggtcagacttgaagccagcacagcactgggtgttgtccacagctttctgtaatcactccctggctactgtctatgttcactcaaggccctggggctctacaatcagcaggtggtgaagccagccaggcttgtatccttcccttcaggatagtaagtcaccgcagttccctggcagttctagaggtgccgtcagggagctagcgattagagtcgaaagacttagaaagccacctggtgttctattgtactgtggctgggctgaactcaaaccacaagatacagtccttcccactcttccttcccctttttgaaggtggaggagccttaccttgtgtccactgccaccacaggtcccctggaagtcctgccagactactgcctatgttcccttaaagcccaaggattcttagtcaacttgtgaattctgcctggcctgggataaactcttcagagcagtgggcttccctttggcccagggcagatccataaatgctgtgtaagagccaagttctggaactggggactccaggagcctgcttgatgttttattcttctgtggccgaactggtacctaaagtgtaagacaaagtaccgtttaccctctgctttcctcaagcagaaggagtcttgccccatagccaccacagcttgggtgaatgtgctgagtttcacccaaggccctcaacatagtacctggtattgctgctggttattcagggcccaagggctcttcagttagcaggtgacgaatcctaccaggactgagtcttttccttcaaggcatcaggttcccttttggcccaaaatatgtctagaaatgctgtcaaggagctagggcctggaaagacagtctcacacccctgacaggtgccctatcctgctgtggctgacccggtatccaagatgcaagaaaaagtcctccccacccttccctctcctctcctcgagtggaaggaaggagtctcttttggagccatgagctgtgtggcctggagttaggggaggggtgatgccagcactcctgcagccaccccaatttgtgtctcaggaggttgtgttcccccccttcccggcccagtctattgtctctgggcccagttcagcactaggactcacacaaaagttgtagtccttgggacctagactggcttttaagtttattagggcctctgggcactttagcccactgtagtctgtggctaggcttgtggaaactcaagtcccaactgctgggatcagcaattcccctctggccaaggctggtttgaatgttccctctgtgggcagacatcagctaagtttggtccagttttctttctgctataacagaacagcactgagttcggtggctcataattgctatgctctccttccaccagtgcccagaaatgctctccacaccacatcaccacgccctggggggtagggaaggggtagcatatgcaattcaagactggtttttgtatctcttcagtgcctctttcagcaagataaagttaaaaccaagtaccatgactgctcacctgatttgtagttcttatgaaggtgctttttaatatagttgtcaaattggtgtccttgcagggggtgattggtgaagccttctattctgccatcttgctccgcctctccaattagccatttttaataccttgtatcttcaattgagaatttttgaagtctcagattgatattatggcagaaaaggaggaatcacacacagcttgtctttggatgaccaaaagcaaacacctgtcttttttttttttttttttgcctctaaactcaattccatttggtatcaaataccttttaactcagctatagtctcttttaagaatatttacatatttaataaaaaacaaatgactgtgactcactaatatgtgtttcttttcttttctttctttcttttaaagatagtgtttttagaagaagcatctcaacaggaaaaactggccaaagaatggtgcttcaagccgtgtgaaataagagaactgagccaccagtaagttgttacttcttcccttttactgggtgccactaataagcttaaattatagaaaacctgccttgagagacagagagactttaaaaaataatattaatttaacaataattattttgtattaattatttgttaagggaggagatgggaaggagaaggtatacaggaagctgaaggatggaaacttagagagctagaggctgccatcattcatcaatttctttagcatatatttgttgagcatgctatgtgcagtactggagggtctggaggtgaaaaagatcttcaaagtccttgtcctcacagggtttacagtccatggaggacaaagacagtaaacaagcaaacagatacctgcgcatgaccatagtagattgtgatagcttctataaggaaggaaacaaggtggggaggggtatgatagaggttaactattaagaagtagggaggaaagaaaatttgagaatcaattggttggggaagttcagaagcacacttgagctgtgatattatatttcatctacttttagtggtttttaatattcgttatatttcatatataatatatatttaatatatgttatacagttcttaaagaaatgattgggccagccaggcatggtgtctcatacctgtaatcctagcactttgggaggccgaggcgggtggatcacctgagatcaggagttcaagaccagcctggccaacgtggtgaaaccccgtctctactaaaaatacaaaaattagcctggcatggtggcgcatatgatgcctgtaatcccagctacctgggtggctgaggcaggagaatctcttgaagcccggggggcagaggttgcagtgagccaagatcatgccacttcactctagcctgggtgaaagagcaagactctgttaaaaaaaaaaaaaaaaagctcagtttcctcatagcctggttgatatgctttatggaaatgggaaaactttttttgattataatttttattttattttttgtttattttactttaagttctgggatacatgtgcagaacgtgcaggtttgttacacaggtatacatgtgccatggtggtttgctgcacctatcaacccgtcatctaggttttaagccccacatgcattagatatttgtcctaatgctctccctccccttgccccccaccccccaacagaccccggtgtgtgatgttcccttccctgtgtccatttgttattattgttcaactcccacttacgaatgagaacatgcggtgtttggttttctgttcctgtgttagtttgctgaaagtcatggcttctggcatcatctatgtccctgcaaaggacatgaatgggaagacttttttaaagctaaaatattttatcttgtttcaggccaagtaagttccaaggccaataaaattggtaccatttatattctgaaaacactttgataacttgggaattgactttcacgtaatatagagaaacactgtttcacgtaatagaggaacattgaactaggaatgaaaatacctggtttgaatccacagactgtactgtagctttgcagatgttaaaagtcaagcaagccactttccctctttgaggtcatctagactatgaagctcatccctggtcatagtccagagagacagagtgactatttataatgtttcactccacctgcagttttactcacatcccttgcctccttccctctccctgctgcctctctatgggcttggaagtgtgtgggcgctgggcatggaaatgaatatagtagcttctgctgttaccatctacttcctcttgctagattttcatgtaagaatctatgatgaggagcaactgacatttatagtctcctgcttgcgtgtctttgtgatgcaggattagaagaaggcttggaagcagttgaagtagaggctgagatgggatgagagaatggtggaaacggttggaggatggagaggagggtaaacataactgtgggtcttcacttccttttcttcctctttatgaggttgcttttgaaattaaatccatcagaaatgcagattctgggggtcgtatgtaagtactgcacacaaggaagtagtaaggtaagaaataatttaaattttagtagaagactgaagtctttgaagaaagattatatttaaaatgcagagattcttatatcaagcacacaagttatgtgcggttgaatttaagtcatgattaaaataccataaagggatgtctcagacagtttttaatagacttggcccaatacacagtgtatctacaggtctatctcagtactgtctggatttttagaaaagggaaatcacaactggagtaccatgggcagtgctgtggtaggagtgaatcagatggtggccatggaccctggacaggtttgcagggccaggattagggtgaggggagtgaggcattcacctcaggcacaaaatttaaaagcagcgggggaggggcaaaaactcagtaatcaagataaatacttttaagacaatattttaaaatataaaaagtaatgcatggctgggcgcggtggctcaccctgtaatcccagcactttgggaggccgaggcaggcggatcacttgaggtcaggagttcaagaccagcctggccaacatggtgaaacctgtctctactaaaaatacaaaaattagccaggtgtgggccgggtgcggtggctcacacctgtaatcccagcactttgggaggccgaggcaggcgcatcacgaggtcaggagatcgagactgtcctggctaacacggtgaaaccccatctctactaaaaatacaaaacattagccgggcatggtggtgggcccctgtagtcccagctactcgggaggctgatgcaggagaatggcttgaacctgggaggcagaggttgcagtgagccgagatcgcaccactgcactacagcctgagtgagactccatctcaaaaaaaaaaaaaaaattaatgcaaaaactcatgatgaacaaaataccaacattttaaataaagacaagatgttgtttgttttacagccatgcattttttttgtgcaatggaacagtcactttcaaataacatggattctcaggcccatgatgccattgcattactggtagggcaggctgatgatggtgatgatggtttgggtaatacacacatgtattgatatatacctgtattgttttctgattataaaactttattaatgtgttccatttggtgaaaagataggtggatgttctgataagcatatatagggggatatatatatatataaaattttttttgctcaggttatgatacagcttggccaacactgcagatttggaatacctgggggaagttgagattctctgaggaaattatgatgctgattaagtaaagtgagaagaggaaagctgaaaagaagggagaaaggagagcttttttaccttctgctgctgccttcagatctcttctctgctttgcctgcagctgggcttgtagtagctacaatttagccataagtgatgttgtgagtggagaaccgagtttgaatcctagctgagccaccaacaaattgcaagtcaaaaataaacttgcaatcccagaccttccttttgttctctctataaaatgagcaggtgggctcactgacctctaatctcatgtgcactctcacattccatgcttctgtgtgtaccaatattatctgtaattaatcctggactgtaaccttgattctgggaatctttttattaataatcatttcacgatgcttactatttccttaaaaggattgtaacttttctgggtaaaaaaatcacacttcagatgcaataaatccttgcgcttctgttgcctctgaagactttgtactctgaatcatctttcactctctcatctcagctacaatgaacatgctcatttctcctacatgaaaaacataaagtgacttgaactcttcttcatcctaactttcactaccaaatattttaaaagggcgctctccatctgcacaggactttctcaaacactctctttttagcacttagtgcagtaacaaaaacattctagagactcagtgactactttttaaaggaagagctaaatctttccaaaattgggggtcttaggattattcctgaggccatgcatttttgacccttgcagtttttggcactagtcactgccctgctccttcttgaatgtctcttctttactgtccctgacacctctctgtcctgggttccctctaccctcctgacaataactctgccaagattgatcctgatcttttctttctcagtcttactcctgaagtcgaaggtgctgcttaagatgttggtttgttcttccttccacagagaactctggcatcgccaacttctagagttacctatataagaccctcaaatctgaatcctttctttttttttttttttttttttgagatggagtctcgctctgtcacccaggctggagtgcagtggcatgatctctgctcacctcaagctccgcctcccgtgttcacgccattctcctgcctcagccgcccgagtagctgggactacaggcgcctgccaccacgcctggctaatttttgtatttttagtagagatggggtttcaccgtgttagccaggatggtctcgatctcctgacctcgtgatctgcccgccttggcctcccaaagtgctgggattacaggcgtgagccaccgtgcccagcctcctctccttcttttcttctgcctcttctcccttctccttcttcttccttttcttgctcttcttcttccctcctcctcttcctcctcctcctctttttctccttctcctcctcctttctcgtccttttcctcttctcctcctctcctttttctttctcctcatttttcttcctcctcctctctgtctccctcattcacccgtaacctcctcaactagattataaagtctttgacgacaatatgccttatttttctctggactctccacagggcttggcggtttcctaaatatagtagacattgggaaatattatttggttaaacaatttaactgcatgaggaagttacactgctattccgttttatgacgggagagaaagcaaagacccaaaggactgacattgtagagagatcagtgactgatacctgagagaaatccatattccaccctccctttcagagtgcttcccacattataggcccacttaatgctgccttcttgacgtccttaaaaatttgtcacagttctttatttccatagtcagtgaattaacaattccatcacgtggaacgtagtgaccgagagtactgaacctacagacaaactgcctgggtttgaatctcagcgccaaagctgactagttaacagttactttttttcaagctacataaattccctgagctttagcttacccttatgtaaaggagggtaacagtactctcatacttactaagtttcttgtgaacattacatcatcatcatcatcatccataacatttattgatgctttccattatctaggcattgttcttacacacactaaatacatcctcatgacagccctatgatgctactactatctccattttacataaggggaaactgagtcacacagaatttttttttttttttaatatgtcaaatatctaactgctgatttatggtcaaacctgatttcagatcttagcaggccaaaaccagaatgtatacactttaactcaactgctgcccacagatgagatgatgtatgtagaacgctgtgccagtgcctagtgaatgtacatattcaggaaacattagctgctgtcaccatcattattataataactgactacaaaaaagctagtcttttccatgcgatgtagaggctttcttgtagtcagacaagatcaagatgaccactgagtctgccattccttgctcttgttttaaaataaagcatttagagttactcatggctttatttggcttacagttaggtggtatgtatacatttgatttgatagcatgaggaattatttgtaatgttaggtttcaagttcaagttgcttatgtgattgaatacttacctaggataatggtggcagtagagggtcccatcttttggcaaatatctgtttggatgaggttggatacttaatagtgactgtggtgaactgcattagctctttagaaaagcatgaagtgtctgttagcaccatactgcctcaattctgtgggtagtgcctctgaacactttccaggactttctaattataagaattaatagaaatatgaatattaattggtggatcatggtggtagcattagtgatcacaagcatcctgagcatggttgtcacagcatcatatgtaactccctcttcgcttcactacttacaccactgcccgtttgtggtccatctcctgagatcgcctgtccctaaccagcttgctcttgctgcttctatttcagaactcagtttctgtaacacgtgggaaaagactaggtttcttgtagtcagacaagatcaagatgactgctgagtctaaaattgcagccagtctgtttctcacctttagttgcccttagtgactggtgtgcacattgctcagcacggctctagaagttttaaaggcctcctcttccattcttgatctctgacctacaactatcagttgtgagaacaaagtcatgggattaaatcagagttcccgtcctttcttgtgccaccactgctttgcttctgctcaatgctgtgtttttccctcccttcgtcatcactggttaaccccgaccagccattccaacctagaagctatatctctcctagcagagcttcatttttatgtcctgacctctaaataattggagaatttacagttgtctgattgcattacctataaacctgtgtgggtgaacagtgaaatcatgcttgggaaaaaatgtgatttaaaaatatgggaaatgactgaagatattattaaatacttttattctcatcttaatttccagtgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcgtaagtatcttgtgtgtgagtgtggtattctgtttggtcatctatagaaatatcagtttcctaggacagatttaaattataaagcataagcagttaagcctaagatgggccatagagaatttttaagtttctttttcacagtccagtgagtttgtgaccacctcacctacacagctagtcagtggcaaagagagaatttgaatccaagtttccaaaaccccaatctggtgggtttacgttactcttttactttctgtgttttactttaccaaatctgggtttaatgaatatgtgtatttccctactcctgctaatccataatgctgttctgaggaccatatggattcattatgtgacctttgcaaagttatgtgactcacttttcccatctgtaaaaaatagagatcatgatagtacctatttcacaggattctcatgataattaagcaagttaatatttgtgaagttcttagaatagtgcctagcacatggtgggagctctatttgtttgctttaaaaatgcccaaggaaatttaaaattaaatatttaaattactgttagaaggaatatcatgttattctgggagctttgcaaggaaggaaaataggatggtcccatattgcatggcacgtggtaatgtgacttgagcactgacaccactagagggaactctggggctagtacagtcattgaacagtggcagtagtgtgtaccagccatatgttgaaggctctgaaagtgtccttccttctcctctttcaggaaaatcagttcctttcttactccaatcctgtgcccagaaccagaatctactcaggaattagaaacagtttctgcagtaaaggagctaaagcgcaaatgctgccttgtctgatcattatgtcctggtgttcagcgcacttggtctgaacactcatggatttttgtgggacccattgattcctcctaaggtgttcactacatgtggtggtggcagtattataagccttccacatcaactgacctaaccatcttgccagtttttttggtcttgcatcattccagtcttagagagtaaaagcaagtgctttttttttttcttcttttttttggagacagagtctcactttgtcacccaagctggagtgcagtggcatgatctcggctcactgcaacctctgctgcccagattcaagtgattctcctgcctcagcctcccaagtagctgagattacaggcacctgccaccacacccagctaatttttctatttttagtagagacggggtttcaccatattgctcaggctggtcttgaactcctgacctcatgatccacccacctcggcctcccaaagtgtcaggattacaggcatgagccaccgcgcccggccgagcaagtgctaacatttatacacttgcctcacgtaattataaattcagtgcaattgtggatcttacatatttagcatgcaccacatgacactagaaaagctgagaaggactaaagctatgtataaagtagctggtgcattgtgttaatgaatggtgttaaccacaccaaatctttattctcaaaatttatttatgcctcacattgttctaaaaaagatgtgagatagctgaaaattgcgtagtatacaacaaaagaaaatgagtcatgatatcaaggcaaagaaaaaaaagggggaaggaaaagtaaaataaaaccaagaaaacaatgtctactgtgggggtccatgcatttgttagtttgtcatgaatttggctttagatttctagaacctgacccaaagagggaaatcagttctgaaatttacactgcttttatgattaaaaaacacatttgttaaggtaaagcatatctatgcttcatactgaaacttaagaaaattaatctcaatattccttagtgtggatagacactatgctgccaaaatatatattgtaaagattctatactatcaagaagtccagatagatcattcttttatgtttagagaggtagagtatcaaagactatatatttttcaggcagtactccatataaattatttctgacatcagagatttgtttaagtatttgatgtcaggccgagtgtgatggtggtttaagtatttgatgtcaggcctgtaatcctagcactttgggagaccaaggtgggtggatcacctgaagtcaggagtttgagaccagcctggccaacatggcaaaaccctgtctctactaaaaatacaaaaattagctgggtgtggtggcatgtgcctgtaatctcagctactcaggaggctgaggcatgagaatcgcctgaacccggaggaggaggttgtagtgagccaagatcaggccactacactctagcctgggtgacagagtgagactctgtctcaaaaaaaaaaaaaaaaaaaaaattgcggagcacatatcctatgttctttcttatgtgtctgataatgaatgagtgtgggcccacaaacttttaagttggaggcactgagggtatggctgacatctgtttaagggtgtggagatgtgttaactagccacgtagcctactcagtgggatgagctcagtgggaataaacagtagtagctttgggtttccttcctcccttccttcttccctttctcaggggtctccctgtcctgtccctttactgtaattagggcacttcctgaactttctagtgttttcagttcattctagttgtggaaagaaaaacttcacacaaattaaatttaacagagtaaattgagcaaagaacgattccagaatcaggcagctctcagaaccaggaaaggttcagaggactctgcccagcaaggtgggcaggcagcatttaagacagaaaatggaagtgaggtatagcaacagcttgattgttacagctctgggtttgccttattcaaacttgttctaatcacttggcacctgtgactggctagagctcagctgctgtgattggctgagactcagctatttgttacaaaagcatattactaatcaggctttcagtgagttgataaactaagttaggttgcagttccttataaactcaaagttgagaagcatgctcaggccaaatttagcttgctttaacacagtccaatttgaagtttcaatttctcattcactaaaatcttctcccatataagccctgtacctcctggtttgggcctgacactgaggaaggggcttactatcagtgtttgtgtagtgcttctaaataaccccagctttccgtttcaatttcatctttaagtcaagattgtagaaaggtgcttaaaattttgaaaatttagaaaaatttagattacatatccgttttaattttgagttttattttagtttggttagtaaatgtaatgtgtcatttttcttggggatagctgagatttatgacctaataaaaggttaatttttatgattattctgcgattttttaaaagaagactgcattttctctgttgatttgacatttttttctatctctatgagatgaagttgttaaaagtcttgaacacttctattcttttgctgcatattctcccatatggtaagacaagaacattttcattctgttcccttcttcatccctaccttttttgctacgtcctatgttatatcatctgagattttagttccatttttttttgccgtgtatactatatttaagataatatttaacttttaagtttaatttaaaaaaattatctcaatttaattccagttttttattttaacatctgcacttaatttaacaatgagggccgggcacggtggctcatgcctgtaatcccagcactttgagaggcctaggcggacggatcacctgaggtcaggagttcaagaccagcctggccaacatggtgagaccccgcctctactaaaaatacaaaaattagccaggcatggtggcgggtgcctgtaatcccagctactcaggaggctgaggtgggagaatctcttgaacccaggaggtggaggttgcagtgagccaaggtgcaccattgcactctagtctgggtgacagagtgagactccatctcaataataataattattataattataatttaacaatgagctttgctttttattttgctacttggatccctgtcttcattcatttttgttggaatatatcctctgacaattctttccaatcaggtgagtgataaacattctaaaacctagaattatcaaaaatggctttactttttttttttgactcttgaacaatgccttagctgtagagagaattctatttgaaattatttatctatcagcatccaatgtgctgacatcaatgtgattctcatttctttctagttaattttctggcctttgagatttttttcttcattcctgatattctgaaattgtaattgttgatcatcccaattcattctcagtttaattcttcaattcattctctttaatacatagttctttcaataagagaacttctgtcttccttctgtttctaggaattctgttatttctctttctctttctctctctttctgagtatattcctctcttcaatctattcttccttttgataattactattagaaaaatattgaaacttctgttctgttttcatgtctctaaacttttctttcacactacattcttaggaaatggtatgggccagttttgtaaatcattaactcactcttactatttataataacctgttcctctttcaagatatgacatcctgtcctattcatcaaaggatgctatttttcattcattttatgtctcttgttgttttagtaattctgcttcctcaggtgttcattcagtaaatatttactgagcacatcctagaacccatacacttttctagttgctggagattaaatttgatacctttgtcatggtattggctttccacctggatttgtgatggagagctcatccttgtctgtaattgacaggttctaaacatcctctgctggtggccagatctttttgttttacatgaaaattatcttaatatttggaaaaattgacaggtttccaaattcttttgacttttggggctaaccaatattactgagttctcatttgcttttttgaaacaattgactgggccaggtgtggtggctcatgcctataatcccaacaactttgggagtctgagggcaagaggatcacttggggccatgagttcaagaccagcctgggcaacatagcaagggcttgtcttaaaaaaaaaatagctaggcatggtggcatgcatctgtagtccctgctacttgggaggctgaggtggaaggctctcttgatccctagaattcaaggttacagtgagctgtgatgtgtgatggcacctctgcactccagagcaagaccctgtctcaaaaaacaaaacccaaaataacaacaacaacaaaaaatggaacacactggatctaattagaggctactgtctaaggtacggcatgttcatttctattatcctaactccaaactatttcaatcctgcagacacttgagcttctgatgtctgtactagtcaagaaaaccctgttttttcacaaaggaggaaacatggaatgtaagcaaccttctcaaggtcacgtagctaataacaggcaaaacgtaagcaagagccactgtctggagggttttcctctgcatttaaaagcttctgctaaagatatgccccaaagtattcaatccactagtcctttttccaagtgctcagacaggtcaggcaatatccgttccattttctttcttgaagatcttctcacctcctcccattctcttgtttctggtcagcattctctgtagcactactgtaatcttggcattctctttgcctctttcctgcgtttaatgcccactccctggatccaggaattactttggattactcttgtgttttactaaaagacagtttctaaaagcttcctaagaaagagttcatggagagtaaaattttcaagtccttcggtacttaatcatatttctatgctaccttcacacttgattgataatttaccaaggtataaaattatatgttaaaaataactcctgttgtgacaaacaacttatatgtacttgtgggaagacctcctttttaattgctagaacatgagcattgcattttttgcaagtacttaattgtctgtgtatcactgtggcccttagaaaattttctaaagtacttagaaaatagaaacctatataatagagcgttttctattttctaagtactttaattatttacttaggatttttggttacagaatgatatatatgagttgaatttgaaggcattgttctgcttccagcattgttagtgagaaatccaatgtcgttgtgagtcctgtcatttatctgtgaccagtttttttttttttcctggagtttttagcatcttttctgtacttacgaacttaatatctcacaattatatgccttactttgggttctctttttattccctgtgctgacaattctatgaggattttaattttggagatgaatattatttttcatatttttgtcccttccatttatttaaaaaaatttagatttcttattctaaatgttggattgcctagattgagcctaattttcttatgttctcacctttgattttcatcttttccttttcctgagcaattctcttgtaatttatcctacaaccctcctactggcttccacatttcatttataatatttttacttttggagagctcctgcattctgattttcatagcattctgttcttgttttgtgggtgcaatagtgtgttttatttctttgaggatgtgagtcatagttgttttttttaactgagcttttttctgaccttatagattatgtttcctctaagattttttccagattctttctccccctccttatctttttgataatagattccctccaatgcctatcaaaccctggacatacattcatactgtgatgctataaggtgctgactggaatttctgggtggaggtatcacttgttgatggtaacttcattataggatgagtagtgaaggcagtgaatttgggtcccaaacgtcactgtgaagacatctttcttttagagccattcattttctctagaaaataatcgtttagtcccctgccaggagttgtgggagtagtacacgtggtattctggggaaaatgactgagtgcccttgaggtcagccagattttcacttaaacctctgctttaccttctcttttggagcttgtaccctctaaatactatccaggttctataaagagtaaatctctcttataaggaagaagttaagggtggttggctgatttcaacaaggttcctgccagggtttaatcatacctgcatagacttccagccagtcccctgctaaaacccacacacttctctccttctttccaagttgcttccaggttctcgtccatgttttttgtcttccaagaagatattgaaatgttttctctgctcatgtctctcctctcatgttcttcttgtgggttaataacgtttgtactcctttactgtcatgtttgttgtagtttgcgaaggaaaggagatagatatatgtgattaaccttccaggttgagctaaagtctggctgaatatttttattctgtagtagaagaaaaacttatttatgtactcccagatgcaataaaatttggatatccttaaacaatcctaagaaagaaggaattcattagtatcacattttaatgaattctgaagcacagaactgtgtgaatcgagaaaaaatcagaagtatcagcttctcctccagctaacttttggaatataaataccttttgccatttacctaactgtactctacatcaagatggcatacctttaaataaaaacattttaaaattaaaaactaaaattctgttttcctctggatgtaccatgtgacttttctgagcacacgtgattcgcggtttttgtgatttatttttagaggagaacactaaagaatggaacaaccacagcttgttactttgcaacaattcacactgactcatctctgctccttgccgacattacaggtgagcaaatgaagcatgatttatgggcacctcaagcaaagacagccagaccatcgtggcaaacaacttatatgtacttttgggcagacctgccttttaattgctagaacatgagcattacattttttgcaagtaattacgtgtctatatgtcactgtggcccttaggaaattttctaaagtacttagaaaatagaaaactgtatcatagagtgttttctattttctaagtactctgattatttacttacaatttttggttacagaatgatatatatgagtctgaattttgtgtattaatttagggctttttagggaaactttactaattctagttgtggtaatagtttcttatatcagcagatacatggtggctattggctagagtcagggcactgtgctagatgctggaaacgcaatgagataaaaaatagtctctgcccttgagaagccagacagaatacctacaccattgatcactaaccttagtaacaactatggtgctgttactagacgtctagcattgtgcaaagcactctggaagaattagttcagcagcaaacagccttctgaagtggttactgatgtcctcatgttacagatggttagactgacgctcagagaggataagtaacatgcccagggttgcacagctagtaagaagagctgattctggattcgggttgatgattccaaaacttgtacccagcacagtacctggcacatagcaggtgctcagtaaatactgttggctgatacactgatgccactgtttgcttatgcaaaagacctgacctaatgggtgactctgaaaatagatactacagtcttcagagaaggcaaagagaacccagaactacgacatctgggaaggctttatgaaagggtcctttaaactgggctttgaagtaaagacaagatgaggagaggacaaactgtcttctagataggggaaggacacaggtatgggaacaggagtgtcaatagtggatgcagggaccacagtagtttaactagaggagtggattcatcgcctgggggcagtgggagaagagggtaggcagatgggagggttcacattgtagaagagctcaaatatgcaccaaagactcaaaaaaggttctgagtccaggtgtgagtgatgtgatgaaagtggtattttaaggaagattaatctaatggccagttatctaaatgaattacaggggaaggagagaggcagaaaggtttttaaaaatctcttatgacagagatggagacactgtaaaaacaattaccattgtcccatatagcctcagctttcttgctgaaatagaattcttccagcacctttgatgaggactaggttctagtgctgagagctgctagtaagactgcgtaaaattcctcacagataatattggcattgtttcagttaagaatagtatggccaggcgcggtggttaatgcctgtaatcctggcactttcggaggccgaggcgggcggatcatgaggtcgggagattgagaccatcctggctaacatggtgaaaccctgtctctactaaaaatacaaaaaattaaccaagcgtagtggtgggcgcctgtagtcccagctactcaggaggctgaggcaggagaatgacgtgaacccaggaggcagagctttcagtgagctgagattgtgccactgcactccagcctgggcgacagagtgagacgccaccttaaaaaaaaaaaagaatagtagcagtatgttgcctagataaccacatgcctgacaccttatatatattattgcatgtattcctcacaaccctacacatagcagagaacactgtacatatataggtttagaccttaaccaaataatatccaccacctggagtaatcagaggaataaggaatcagtccaaatctttccaattccagtgctcatgttcttatccctcagccattctgtgttttgtctagaagaggaccatgatagagagagggagagagagagatccaagggatggtggtagagtaggagacaggagggagattgtaagttggggtagaagaagctgagtgtaggtatgccaatgactaagagagtctttctttaggacctgagactgtttgctcctttaccatgtgataaaatgagagcaaagatagttacatatttaatgaaaatatagacacactggataagcaaagggaaaaactgaataataacttaaaaacacccagccaagcacagtggctcacgcctgcaatcccagcactttgggaggcccaggcaggcagatcacaaggtcaggagatcgaaccatcctggccaacatggtgaaacactgtctctactaaaaatacaaaaattagctgggcacagtggtgcgtgcctgtaatccaagctactcaggaggctgaagcaggagaatcacttgaaccagggagttggaggttgcagtgagcccagatcacgccactgcactccaggctggtgacagagtgagactccgtctcaaaaacaaaacaaacaaacaaacaaaaaaaccaaaaaacccacctgacagcctgagaatggggatgggggaggtagtgggttaaagtgatgaatagaaaaacttttactgtttactgaatatagtagggaatttgtggtggttcttgttcttaagtggtgtgatggtggatgatcttttacattttcatttatgttttccatatatgattttaatttaaaaattactgttgaaagcttagaaaaagtactgttttggccgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggcatgaacctgggaggcggagcttgcagtgagccgagattgcgccactgcaatctggcctgggctaaacagcgggactccgtctcaaaaaaaaaaaaaaaaagaaaaagaaaaagtactgtttcagaaacaaacatgccttcatattctttttgtgtatactttacagataaatttggacagcgggcatttgtgggcaaagtttgcatggatttgaatgacacttttccagaatacaaggagaccactgaggaatcgatcaaggaaactgagaggtaaaaggcccatttgtcttgatttgtcttacaggtgaattcctgtgctgcactgatggagttagagatggaaaaaggaaacaggatactgttatcacccagttgggatgtgcacatagtgactcagaatgttctgtttaatgcaatgggtcggttagtctacagtgaatttgatcaaacactcgataatcattaatgatttacaaagagctttcctttgtagtgccacacttgatcctcatagaaatctccatgaagcatctgtctttttatttattttttatttatttttattttttttttttgagacggagtctcactctgtcatccaggctggagtgcaatggcgtggtctcagctcactgcaaccttcagctcactgcaacctctgcctcctgggttcaagcgattcttccacctcagcctcctgagtagctgggactataggtgcatgccaccacactcagctaatttttgtatttttagtagagacggggtttcactatgttggctgggctggtctcgaactcctgacctcgtgatctgcccgcctcggcctcccaaagtgctgagattacaggcgtgagccaccacgcccagcccacatctgtcttttatgataaggaagctgagtctgacataggctaagaggcttgctcacagtcatacagcttttaagtagtggagccagaattcaaaaccagggtctatgactctaaattcaaagttcttttttttttttcttttcttttctttttttgagacagactgtcactctgtcacccaggctggagtgcaatggcgcgatctcagctcactgaaacctccacctcctgtgttcaagagattctcctgcctcagcctcccgagtagctgggattacaggcacgtgccaccacacccagctaatttttgtatttttagtagagacgtggtttcaccaggttggccaggctggtcttgaactcctgacctcaggtgatccacctgccttggccacccaaagcactgggattacaggcatgagccactgtgcccggctcaaagttctttctctcatgatatagatcacacctcatattcaatgtaagtaaagagaataaaagagagagaaacagagggtatgcaagaatacttgctatggcatgtgttaatttaaaaatgatgatggaagtgaataattatttgtgaaataaaatagtatacaagaagttaggaaaaatgagttatagttacaggttaatgaaagactttcactacaaaaggatttttttaaaagataccaaagtaatatgtgtttccatggtccagaacttagagaaacacaaaaaggtataaagaagaatttttttttgtaatgaaaccaccaaaagttaccataatagggtatcttttattgttttctcaaggtggtatatgcatccttcactactatttcgtcctaccttgggaacaggaaagttgttctggatgtatgctgtaatggccataacaggctaatatagggatctagaatatcccctctccacaaaggtgacctgaaagaacatctctgcaagctgaaatgcaggcatacaggagggaagatgtggttcctttttctgctttggttctacatctgtgctcctagggaatagggcctcactctactacctgtaataaaagctctgaggatgttatgtggtgacacaggctagagagagaccatgggagggaccaaggcccactctgctgctgctggacattgagctggattcccaaagattgtggacagcctactttggaaagatttccacctcaaagaataggataccatatgcagatagaatcataaaaagtaaagatgtgcaaggaaaatgaaaacatgtttccacgtaaagacttgcaggtaaatgttcatagtgacatcatttatagaagacaaatgcagagcaggttcactgcacataggtatcaatcccaggggaggactctaaacacctcaccaatactgcacaccacttgcatgaatctggtgagacagcacacttatacaacaagttaagcaaagcaagtttattatgcacagataggtagcaagggacaatagaagccttggtgaactgatcctccacggctcaggaaagttgcccaagagtctcatatgtgcatgccccacatcacatcatagctgagggaccctgtgagcatgctctacctgtggttttatacccagatgaaactggtctcactgagctaaaacattgcagaacatcctgttctaggagaaatgggaacagaacccaggctgttctgaccagtttctccatatctcagggtggttgcatttccagcacattctacagttattctgataactacaagtaagaaaaggggaaaaactgggtcaccaaggccatatgagaacttgtcctgcaccaaatagtggaaacaaccaaaatgttcataactggtgaatggataaacaaaatgtggtatacaatggaatattattcagccataaaaaggaatgaagcactgatacatactacaacatggatggtttttaaaaacactgtgctaagacaaagaaaccaaacacaaaaggccacacattgtatgatttaattgatatgaaatgtatagaaaatgcaaattcatggagacagaacaccagcgattgcctggggctggaagtaggaaaaactattttttttttttttgagacggaatcttgctttgttgcccaggctggagtgcagtggcacattcttggctcactgcaagctctgcctcacaggttcatgccattctcctgcctcagcctcccaagtagctgcgactacaggcgcccgccaccacgcccagctaattttttgtatttttagtagagacagggtttcactgtgttagccaggatgctctcgatctcctgacctcgtgatccacccacctcagcctcccaaagtgctgggattacaggtgtgagccaccgtgcccggcccaggaatagctattaactaaatgggcccaaggaatctaactggggtgatgagaatgttcaaaaactaggttatgatggtggttgtaaaacgcaataaatctactaaaaatcatggatttgtgcacttaaatcaggtgaattttatggtatgtaaattatacttcaatataaatagtttttaaaaatagcagtatgtgggtgagattgtgttcatgtacatttgtgttttctagttcacatccactttagataagagttgagtagaaagtgattagatttttttaaaaggaagattttgtacagaataaatagctgtgagcatatttgcagagactccagctctctgtgattttctcctgtggtacagtagtgcttctcttgatgcttctagcattcttcccctcacttttctcccttaatcacacattgttgaagccaaaaccaaaaaacgcctgagaagctcaagatgtattaacacactgcgtcgaattaaagttgaaagatgattaatgcactgaggcattcttcctatttgccaaggtcactgtgtgggtttgtccaacttgaatgtcaatattatttttgtgtaacaaattatatttaaagcctgcaggaacttgctataggagtcctagggtaaatcctcttgtaaaatgaagtaaatcatttaccctctccctaccctttattatagaccagggcttctcctgtagattggatttgcttttaagtacatatggcctgctcattaaattacttttggttgtgggtcatactatggcttgagattatgaattttcattatgttctttttcatacaacattgggagattctactgaccatataaatacttttcttatattttaaaatggcatttctatagtaccttaaggatttgacaagaaattgtattggtttatttatttatttttattttctattttttattttttttttagatggagtcttcttctgtagcccaggctggagtgcagtggcacggtctcagctcactgcagcctcccactcccgggtttaaacaattatcatatctcagcctccctagtagctcggattacaggcccctgccaccatgcccagctaatttttatgtttttagtagagatgaggttttgctacattggccaggctgatcttgaactcctgacctcaagtgagccgcctgcttcagcctcccaaagtgctgagattacaggcgtgagccactgcacctggccaaaatgtaattttattctgttcaacatctaagagatacagaagaaaatgctttagatacaaatctttgccaagaccaaacatattctgatgcaggttttagaagttcagctttttttctgttccccagacccctttccccttaaaagtgtcctctgaaaagggagcagaggggctgcttacatgctcacagagaggaggaagtacccgccttcctttagcatcagcctatcccagcttatctattaatccatttttgtggtgatagtaaaccttaattctcattttgttctgaaacaaaggaatgccagaaggcagaaaactacagctgcctagggagggcagaaagagccatttcatagtctttacagttgccaccatccctgcaggcataaactggtgggatcactaccatcccattccccatgcacctcacaaccaactctcgccttttccttctgctttactccaaggttcatccccaagagaactctacccttgtaaataaatggtgatgttgtgggaacaagtagcttccactttaggagaattcgaagtaaagagcttcatggcttctaaaagcctccaagtgcataggacttcatgactctaacaaccgtagagcataatatattgcaacatttctccaaacggagcttgagctagtagaacagcttgagtgctgtgggaatatttgagaacagcccgaccgatgctagatgataacattacgtttccctgtgattttgcactccatctctggctgcaagtaaaaaagcagagtaattactacttgttaatctttaattagtggtggtggaacatgtgcagcattagaaatgtttgcatgaaaatcaggatatgtaagaatcatgtttttatctttttaaaatgtttatttgaaaatggtcggccggtcgcggtggttcacgcctgtaatcccagcactttgggaagccgaggagggcggatcaccaggtcaggagatcaagaccatcctggctaacacgctgaaaccccgtctctactaaaaatacaaaaattagctggacgtggtggcgggtgcctgtagtcccagctactcgggaggctgaggcaggagaacggcgtgaacccgggaggcggagcttgcagtgagccgagatcgcaccacttcactccagcctgggcgacagagccagactctgtctgaagaaaaaaataataataaagaaaagaaaaaaagaaaatgctcaagttttctaacccatttgttgctttatttcagatttgtgtcagaaatgctccaaaagaacgtgagtaactttgttcagagctcgcttttagattgcctttgcattagctgtaggattcataaagttgcttgatagtgattagtctgtgtacgactggcttatctcatgcatgtagaagtatttacctagagcctgatgtgtcactgtggactgtcactgtcagctcagtgaagtcagacatttttaaaaaattatcttaaaatatttaattgacaaaaattgaatccactcaaggtgtacaatgtgatgatttgatatatttatacattgtttattgattattagaatcaaatttgttaacacatctattcccacacacgctgtacactagatcctcagaacttgttcatgttataactgaaaatttgtaccctttgaccatcatctccccacataagccagcaatcccacttttgggtgtatatccaaaagatgcaaaataagcatcttgaaaagatatctgcacttctatattcattgcagtatcattcagaatagccaagatatggaaacaacttaagtgtctgtagacagacaaataaagaaaatgcagtgtatatgtctatatacaaacacaatggaatattattcaaccataaaaaggaaggaaatcatgccatttgtgacaatgtggatgaacctacagcccattacaataagtgaaataagccagccccagaaagacaatactgcatgatctcacttatttgtgaaatctaaaaaaagtcaaacttatagaaacagaggtcaggcattttttgctttcttgggggcagctctgtacctagccctctgtgttttgttttaaatacattttgaaataatgaaatattaatgattttagtggatttgtttagatatcgttcacatatgtacaaacatcaaacttgctttattcttaaaattgtgtgtacttttcttggctcccaaaccccatgcctacatgcaacagaaaaactaaatttcgtcaggcaggtaaacttcgtcttaagttcactaagcttttagttgatccaatttttattaggacaatctcagtcactgctcaggttagagttaccgtctcagggtaggtttttcttcctcagtggttttccttacccccctctgggatcttctgatttcacaggattggtttctggcaagcagggacagggcttgatgggcgtgggctgactggtggcacctggaagttggggactgcttggtggccacctcaacattggctctggccacttgtgcccttggtctgctctgtaacacaggcagtgtctagtcctatgcccctgccactggctgtcttggtccctatgtgtgtgacacctcacatggcctgcaggcatgcagcaggcaccccctattgtggtcccctggtgttggtgagcctgtggagacaatgctgtttcctgcctccacccctaacaggctggcatgtggctctgtcaagcaatctcttagactggcaagcctgacccttccctgatcatcttttggggcctgataggaaatcataagaaatctcaaaatttctttccatctaactttgggagatttagatgaaactttgtagatccttatcctcactacccctctatgagtccttctctcctgcctggccactcacctcaggtgccaccagagccaatcctacaactgaatagtgctcaggaaggctgtaaccagcacacctggacaagatgtattcccaaaatggaatcggctatcacctcacttttagtctccccagcactcttttaaaacttcagcctccacttttcttcataaaggctacccagtctagccttcatcagagccttaatgtggtggcagaggagcatctgtcatttgggataggatcttttgttgaacttgggtgctgaagaagataccctcctttattctccactttgagctgttttcatgaaaccccgtacttccaccgactgttagaatggaggactgctccccaaaatgaagacacaaaatcatcttgctgtatgatatgcattttggggtacccttcacattcatgatatccatagtttcctttttttgaaaaaacttttaagttcaggggtacatatgcaggtttgtttacacaagtaaatgtgtgtcataggggtttgttgtgcagattatttcatcacccaggtattaagcctactacccattagttatttttcctgatgctctccctccttccatcctctacctgccgataggccccagtgtttgttgttcccctctatgggtccatgtgttctcatcagttagctcctacttataagtgagaacatgcaatatttgactttcccttcctgcgttagtttgctaagaataatggccttcagcttcatccatgtccctgcaaatggcatgatctcattctctttttatggctgcatagtattccatggtgtatatgtaccacattttctttatccagtctatcattgatgggcatttaggttgattccatgcctttgctattgtgaatagtgctacagtgagtgtatgtgtgcatgtgtctttataacagaatgatttatttccttttggtatataccctgtaatgggattgttgagtcaaatggtatttctgtctctaggtatttgcagaatcaccacattgtctttcacaatggttgaagtaatttacactcttaccaacagtctataagcatttctttttctccacaacctcaccagtatctgctatttttctgactttttaataatatccattctgactggtatgagatggtatcttattacagttttgatttgtatttctctaatgatcagtgatgttgagcttttttttcatgtgattgttggctgcatcaatcatatgtaaaacagtgaaaagtgtctgttcatgtgctttgcccactttttaattgggttgtttttttcttataaatttgtctaagttccttatagatgctggatattagacttttgtcagatgcatagtttgcagaaactttctcccattctgttggttgtctgtttactctgttggtggtttcacttgctgtgcagaagctctttagtttaattacatcccatttatcaatttttacttttgttgcaattgcttctggtgtctttgtcatgaaatcttttcccatgcctatgtcctgaatggtattgcctaggttgtcttccaaggttgtttttttgttgttgtttggttggttttttgtttttttttgagactgagtttctcttttgttgtctagactggagtgcaatggtgagatctcggctcaccacaacctccgcctcctaggttcaagcagttcccttgcctcagcctcccgagtagctgggattacaggcatgcgccaccacgcccagctaattttgtattttttagcagagacagggtttctccatgttggtcaggctggtctcgaactcccggccctcaggtgatccacctgccttggcctctcaaagtgctgggattacaggtgtgagccaccacacctggcccttccagggtttttatagttttcggttttacatttatgtctttaatccatcttgagttaatttttgtatatgatgtaaggaagaggtatcaattgtttttaattatctccagtattctagagtgaagcccatagtgacaccacgtttttccctctcctgctctgagactttgatgggtgaactgggcaacattgctaaaacccgtgatttgcacattcaggtgggtattcttcttctctttatgcctctatgcagacctgcaagatttctcagcacccttaaatcatcatttccaataatctgtagttgttttactgagtaatctgtttcttcaactgagatatcctagagtcacagcataacaggagagaaaggacccctgtagatatcacctaatccaattctttcattttgcagataagaaacctgaagttccttataccctcaatgttttctgatcagtcttctaaagacaagaaaatcgttttaagtagtggcaagatcaataacagactgtgatctgttctctgtaggatacatttaatgcatttatttcctacttctctttcacttgatactttctcagtgtgttctgtaccttcattcttagagaaaccagctattatttgaaaagcaaaaagagcctaatttccaccttacaaaatagcatttaaaatcccttttgttctgagtttcttaatttaaaatcagaacaaaaaagtataccttgctttgtcattaaattgttgcaatttaggaataaaacacttttttaaagcttatatctgggttaaaattgagagttccccttctcccatccaagcttaattacatactgtactaaaatttctcctcttaggagttgacggtcttataagaaaggtcagatcagggcagagacaacacattgattctttaccatttgtaaatcagtgtttttttggtttttgtttcccaaatctattttcttaggaaccattaaccgctctcaccttccctattattgttattattatttgcagcctataatttttgaatttttaattcagtcccacacatttctctgctggagataaaattcaaaacttacctgatgtttctgctttgcaaacaaaatgcttctgtcgccgacaaaataaaatacacatgaacatttaaaaatacatgaaaaataagatgagaagaacacacaacaaaatcaagtttatccttgctagagagatgcatgtggatgtatgcacatttactcacatttatccaaatgactcgaatcatcagattgtcctttcttctgttgctgtccatgcatttcatcggtggtctgggacttcctcaaggccagggatggagttcattgtctgagtaaaacacgtgttttcagaacattgctatttttttcttttaaaaatttagctacgcatattctaaatggcattgccattcttggaagtattaattatgccctcttagattttgtggtgccctagagaaaggtcttaggggcctttttcagtgtgggggcataggacttattgttttgcttgcatgtggattcttatgggctgtttcttgatgaccgtggaattttctagctcagctattttcaaactcttttttggagaactcattctggaaactaacaaagggcacagaatggagacagggtcccagagtctcaatcctgctgcatccggaggggcagtgcttttatgccttctatatattgggtttctgtgaatttttatatgaataatatattcagtgccgagagaatttggaaaatcactcatctagcccaacccttttttttttttttttttgaaagatgggaaaattgctgtccaaagaaaagaatgactttctctaggacacatagctgtcagaacttgggccaaacccagctctctttactcaaattccagtgttcatataagtgaaccccactgtctgcttttttatgaacactgagctcttttcttaaacggccagtatggccagtcacggtggctcacgcctgtaatcccagcactttgagaggctgagcccggcagattacttgaggtcaggagtttgagaccagcctggccaacatggtgaaaccccatctctactaaatatacaaaattagccaggcatggtgacacatgcctgtaatcccagctactcaggaggctaagacaggagactcacttgaacctgggaggcagaggttgcagtgagtggagattgtgccactacactccagcctgggcgacagagccagaccctatctcaaaacaaaagaaaggccagcaccagaagaggcaggttgctagggtcctgactatcttcaaggaggacttcatatttgttccagctggaggtcagaatttgaaaagactttgttggaaaaatttgtcttgatattatacatacacatacacacccacacccacatccacacacacacactacatgttcataatattcagtttctttgtcatatacattatattatctatgatgaatataattgtttctaacaaaatgcatgtgtaatcttcattgcctttctatgtggtcccttaaataggcaagtagaaaaccattcacaccattttgaggtaggaagtgtaatttctaatggtattttacagaagaaaaatgaaaatattatttttttcttgtagagccatataagtgaaaatcgtgatgaagttgaagctgtgaaaaacttataccccagttataaaaactacacatctgtgtatgataaaaacaatcttttgacaaataaggtaagttttatatcatgacataatctgtttaaaggagggcatatttatctcaattttaaaatctcaatagtaatcttcagatttctgatatgaatacatttctttaaaaattttttttaaagttttaatttttgtgggtacacagaaagtttatatatctatggggtacatgtgtatacatttcttaaattagagtaaagcctagtgtgtgtgtgtgtgtgtgtgtgtgtgcgtgtgtgtgtgtgtgtgtagttaaaaatggacccgaagtttcatcttagtgaattaaatgtaaaggcttcattgaagatgggaatgtcatttggtccaaggacattttaacagtatctattagaatgtaaacctacatttctttgagtcagcagatgcatttctaagaattcactctaagtaatatgaatagggatgctaattttatattaaagtttaaaaattgttatcggtgagggattaaattacagagcatacataggattttatccagcattcacaaagaaagaggtatgcaggcttacaaggaagaatgtttgtgtaatattatttgatgtgtatgtacatatgtatagatgcatgcttacttagaaaaaaactgtctgaaagacacaacttgagtattaaaaatgactcttcctgagggacaaaccagaaggactttctgctttttatttttaaatactctgagagtgcttttaaaaaatgagtatgcattactcctataattaaaattaatatgtgtgaagagacctcattacaataatgtactacttggccttggccttcaatgaaatgtacaaaccgcatggagagtttaccatagcaaataatttcttagtgactgtgtgaatggagatatgaatataactgatttaaaaggttaatactttgcataaatcatgtaaaagctacaccatagttttcattctttatatattttccatatgattaataaattaaccttccatttgcatgttaattttatttgaacagagattgggaaagttatattttaataataattctgtagtcactgggccgggcctggtggctcatgtctgtaatcccagcactttgggaggcagaggcaggcagatcacgaggtcaggagatcgagaccatcctggctaacacggtgaaaccccgtctctactaaaaatacaaaaaaattagccaggcgtggtggcaggcgcctgtagtcccagctactcgggaagctgagataggagaatggcgtgaacccaggaggcggagcttgcagagagtcgagattgcgccactgcactccagcctgggcgacagagtgagactctgtctcagaaaaataataattctgtagtcactgaaccgtgcctctcaaaggggaaagcaagttgggtacaggttttgtactgagagaaaaataattttgaaagagtaaagtcttatttaagaaaatctacaaataaatactaccaacattaaaaatttagagaggtctcatgtgtgtgcagtgcctgctttcttggatcaattttactttctgaattaatgattataagatgttaaatttcctagtttttatgaaaatataaacgtaggtgagttaaaagtttatttagttgaaaatatcaaggccattggcacttacattgaagctaggagcagaaataaagaacagcgctttgcaggattactctcacagctttcacatactgagaagggacttttagttctagaaagtttttttagaattggagcaagcacaacactaccagttgcttcccatataaacttagaaaagaaagtaacttgacagtcttctaaagtagagatgagaaaatcatgttatcttccatctggatggatattctgtgctgtagatcacctggaccaaaccctcattactttatagatcaacaaaaagaatctaagtaaactccacaaatttcctgagactttcgtaagacaatgtgtttacaggccttttctaaggtataacttgtacctagcaactttgtacatatagatcatcataaatgttcttgtgaagatgctaacagccaagctacagcttcggtctctctctaaaataccttgtgagtgagtacccacttaatcatttgtgagcggtaaactccacgtagggcactcttctctccagacagtgatggcacacggctgctacctctctgcagaagaactgaacgtattccatgaacgaggagcatccatcgcacactgtcccaattctaatttatcgtaagtagacaatgattgtttggtagattacgaatgattgggttgcagattagcagccaaatgcctttgtttcctctgtcattcctccaggatctcccctctattctgtgtttggcaggacccagatagatagacatttactcgtgctgttgaggagtaaaagagaacacgtaagaggacatttatctcagaggacacgtgaagagcacagcatcttctgaaatctctgagtttgtacaaaaaaaggacaatagggaatacaacataaaaaatttacagtgaaagtactgaaagaacccatatgtcagccaggaaatccagaagagggtagtcactcccattactgtttgtgctgtagtgtgagaaggaaacacagcaataccaaagcaaatgcactatgatgtatgttaccctgttggacctgacggaatgccagcccacacaggcaagcccaggaggaccttgtcctattataattccccagaatacagaggtgttatttattaactggttcttaaccttttgaaaggtgatggatccgtaaatgaataaaatgaaagttattgcctgggcgcagtggctcacatctgtaatcctagcactttgggaagcagaggcaggcagatcacttgaggtcaggagttcaagaccaccctgaccaacatggtgaaaccccatcagtattaaacatataaaaattagctgggcatggtggcaggcacctgtaatcccaaccactcaggaggctgaggcaagagaatcgtttgaacccgggaggcggaggttgcagtgagccaagattgcaccactgcactccagcctgggtgacagagtgagactctgtctcagaaaaataaataagttatagcctgtaatttcaggggaaaaaagcccatggatattacaagtgttgcatctaatttcagggaattcatagatctcatgatgccagtccatggatgctaggttaaaaacccatgcttgtggctgtaatctcagaaaacaacttcaggggtcgggcgtggtggctcacacctctaatcccagcactttgggaggccaaggtgggcggatcacgaggtcaggagatcgagaccatcccggctaacacggtgaaacccagtctctactaaaaaaaaaaaaaaaaaaaaaaaaaaaatattagccgggcatggtggcgggcgcctgtagtcccagctactcgtgaggctgaggcaggagaatggcatgaacccgagaggcggagcttgcagtgagccgagatcgcgccactgcactccaacctgggcgacagagcaagactccatctcaaaaacaaaacaaaacaaacaaacaaacaaacaaaaccttcagggaagtaaaacagggaagggaaagaagtcagtgaagatcgtatcatcacggaagttaccactgtgggctcccggagtttaatccttctatttaatagaaaactcaggtaaccagtgtccaaaacagaactcaaagttatcctgcccaagaagtgagggagctggctgtgacagtaatacccaaatgcttatgggttgttgttgagggctcctgggcagagtggagaagagtattaattccctggaacttctggccgtccccaaacaagggcagagcaggctctagcacaggagagagctgagaaagctcctaggcaaagagctggaggcattcacagttggaaatctagggactttgcaaattacaaagatatatgtcagtgtcattatgggaagggtgctgagagccacagtgacatatttctggagtgctttagggaccccagaggttctgagttttcagacttaaaggagtgacacagggaatcttgtctatgtacagcttagtgactataattagggtctagttacttgatagtggaaggatttaacacccattgggtgttaatatcctctaaattaaagcataatctagctttgcaaattgagttttgaagttaaatttctttaggacacatttctgtttaaatggtcactgctgttctttctccagcaactgagagatttattatgtatgcaccagggctttcaaaattagagttatgtgcatcttccagcaaaccactttgacctttgcaactttttagaattctaaggatcaccttagttttcctttgtctctttagaaaggcagcacatggtgggcatggtggctcatgcctgcagtcccagcactttgggaggccaaagtgggaggatcacctgaggtcaagagttcgagaccagcctgaccaacatggcgaaaccctgtttctactaaaagtagagactggacatgctggcgggcacctgtaatcccagctactcgggaggctgatgtaggagaatcgcttgaacctaccttgaaggagatggttgcagtgagctgagattgtgccattgtactccagcctggatgacagagacagactctgtctcaaaaaaaaaaaatatatatatatatatatatggctggcacatctctttagctcagagtcacaaggtcccaaattcagcccaggaaccatctatcctactttctctgtcttcagaggcagcgtttgaacagtcaggtcctgactttttaggctgcacccctttttctagttgtactcccctttttcgatcttaaagtcactactcattcagggtaacaaattattccaggcagagagaataggtaatgctttataatttctgcttcctaacataaaaagatgtgttggttagaaaatattaaagacagataaaagacttttgtattaattgcaaagtttgatttcttcatttttttcccatacaaacgatcccctgcttttccttctggctcttgctgctttgtgcccacctgagattaaccttggcccaaggattaggctattttatgatcctgtttactccaggacttggatggtctgatttgactaatatgtttgtgtcaacattagagccgatatattgggaagcacaattttcagtggcatcaccgtcattgttattagtgttcatcttttattggaaccacatggatctccttgttctgacatctcctctctctacaggctcagcagtggatttctaaatgtgctagaagtcctgaaacatgaagtcaagatagggctgggtacaggttagtagttcaccatttggagctatggcaaagtggttgattactgtgtaattttctaatgtgactaatttgcaggtgactgttctgtttaaaaaaaaaaaaaattagttttgggccgggcacggtagctcacgtctgtaatcccagcactttgggaggctgaggcgggtggatcatgaggtcaggagttcaagaccagcctgggaaacctcgtctctactaaaatacaaaaaaatagccaggtgtggcagtgtgcgcctgtagtctcagctactcgggaggctgaggcaggagaatggtgtgaacccgggaggcggagcttgtagtgagctgagactgcgccactgcacttcagcgtgggtgacagagcgagactctgtctcaaaaaaaaaaaaaggaaattgtatgcaaagggagaagttttgatgatactgacctcctgaaagctgttatccctgtttattattcaaagattaggctataaaggatgattaattccttctgacgtgtttcagaggtattctaaaaagtccttgacttttgttttgttttgttcttctggctaggttttaatggtttggatttctatatttttagttttcaataactgtcattacaaatgctgtctcaaaagaaatttttttgtccttgccatagtgagcacagattcaatctatgacagaattgagaattcggatgtatgttaagaattggttttgcttttaagcaacgtttagccaaatgagacctctccatatccacaggcagtctgcttgtctactaggctgagggatgttctaagtgcatatgaattagtgacggattagtgatgtttcctttcttcacagtacattttaattgtgtttcttgagagtgtgcaagcgttgcttgcttcgaaagtgtgagtcaggcccaaatttctaggtgtcctctgtgaggcttcttttatgactgaatgactgaattaaaaatttttttaatgggtatggggcaggaggacgtgttttctgttcttgatgcctttatcttcctcatatttaagagcatcaggctgtatgcatgttgacactggtggttttcatcactttctgcaggaactcaagtctcagtttgttatagtgagacattttacaaagtaattaactggtaagacacaataatacgcataatgattttactgatattttgaaagaggtatatattagattagaagtttttccctattttatgggaatcaaagtaatcaagattttgaaaattctaatttaagcctgaaatcatcaagattgtgataattctacataaagtcacaggtgttaaaggaggaaaccagtgattttatgttcacaaaaaagcttcaagggataagaaaaaaatggccaagagttttggttacacactatagtcagttaatatgaaaaatttagcagacacataaaaatcagtcagatattgttttcagatattctaggattttggtctccataatttaagttcatcacatgacttccttttcttgactttggattgtttagtgatggtctataaagttcaagttgagttctagctgtcacttattatctgtaagaccttgagaaaattaattttctagtagtttttagtcaaggattcatttcctgatttctacaacaatagtaactagcaattacaactatgtctatcttacaagctgtttagagaattaaactttaaaatgcatgcaaattggttagcacagtgcctgcctggcacatgacacaaatcaatcaagattggcttaaaaaggaaagggcgaagttggtgtattgaccaaacgtttgaataaatatgacctattagcttatttactcagaggatggtgtttcatttttacctagtcctttttgcaatttagtcaccctctactctactatttcctaaacgtgacttttgtgtatcaatttacccttcaatttgtaaactttagaagattattatacctcatactatgaatagagagcaagtccaagagcaattcacacaccctgtctataacaagtgcaggcagatcttgacttgcacaaatattaggtagaagaaacccacatgaaatttaacagaaatatagcaaaacaagataaagtgatatcacaaacaataagaatgtgaacaaatatctgaaaatgatctgctttaggatccagaagaaaatttcagaaaattgccttcatccctggagtacaggaaatcatggttctatgaaaagattgtggtagaaattttagaaatcaaggaagaaaactgaaaaaaatcagattaaaaagcacatagactctcatacactgatggaaggagagtggatggtacaactactttggagaatgttttgggagtttcttctaaagttaaatatacgtctacatatgacccagcaattttactcttgggtatttaccctagagaaataaacatatatgtttgcagaaatagttgtatgaggcccaggtgcagtggctcatacctgtaatcccaccaccctggaaggccacggcaggaggattgcttgagctcaggtgtttgagatcagccttggcaacatggcaaaaccctgtctttacaaaaaatacaaaacttagctgggcatggtgacatgcacttgtaatcccagctacttgggtggctgaggcaggaggatcgcttgagcttgggaggtcaaggctgcagtgagccatgttcatgccactgcactccagtctgggtgacagagtgagaccctgtccctaaattaataaataaatgaaagaattgtatgaggatgtttatatcagctttatttataatagccccaaaccagaaacaatccaaacatctatcagcaggaggatggataagcaagttgaggtatattcatataatgaaatattatttagcagtaaaaaacacactacagatatatgcaaaatgtgggtaaatatatgccagtgtgtgggcttaaagagcacacactgcatgattccatctgtatgaaactcacagaccaacagaactaactgatattggtagaaatcagaaagtggttgccaaatgttgtaggtaagaatttggggaattgacaggaaaaggccatgagggaatttgctggggtgatggaaatgtttaatatcttagtttttttgcaaaatagttaatgctatataattgttaacattctccaaactgaacatctaagttatatatgtattatgatattttagttatacctcagttaaaaaaatgacaaacccaccaaccctgtaggaagctatgagaagcagaattattgttacagaaaatcaaatcagtgatgtgagaataaaatcaaccaaagatgatagaaggtgtttgaggatgatcgatgtgaagcccagaaaccacagagccaacacatggggtttttttctgatggagcacccagaacaaatgggacagatgcaatagtcagagctttgaagggtaaatcttttctgagcttaagaaagaactgccttgcaagtgcttaccctgttttacgctaaatcgtaactgaacatgttgtgacaaaatattttaattacaataaaaaaatttctacaatattgacacaaggaaaaaagtcaattatcaacaaaacaattaaaaaccagtttgctttcagatgtttttgttggcacacaaaataccaaaaggcaagaaaagagtttggagacaaagcagtgttagccaagaataatatatctggccaaattctcctttatgtaggaaggcaacaaaattctcagctatacaaaaacttggaaaatattttccttaggaaccctttgaaaaacttacttgaaaatctacatcattcaatgaaagatgaggcaaatgaagggccatggggggaaataatggcacaatatgatgtcatggaaagctaacatcaatcagaataagaagatcaaagaattgtaaaggagtttaaaaaatgaaagtaaaagccaaaaatatatctcaagagagaataggcacaatgttaaaaacctatcagaatggtaacataaatcaggaagatgtttccctcaggctggaaagaggttcctgggaccgaaatacatggcacttattttaaaaactgagtgttaggtccttgagttttggttttatgctttccttatgtcatttgaatgtcttcagtattttatcacaaaattttaaaaaataatatatgctctgccaaggaagaattttccaagtataatacataattctgtcttataattttattaacaaaacccaagaagttgtagtttatgtgtaaggctgagaggaggatgtatttggcaagtggccaacatggtgaaacacatttctactaaaaatacaaaaattagctgggtgtggtagcatgtgcctgtagtcccagctacatgggaggctgaggcagtagaattgcttgaacccaggaggtgaaggttgcagtgagccgagattgcaccactgcactccagcctgggtgacagagagagactcaaaaaaaaaaaaattccttgtctcagaaaaaagagaattgcacatattttacttttgacttttcagtataaaaatattagagataactacttgaagaattttaaagataggatacctcctatgtgaaatatgaaaaaaaccataaaaacaaagaaaacatagcaaataaccaaaaacactcatctgaaggaaaaatttaaacatatagaacaagtttactaaacaagacctataaactcattaaaacaagcaacatacatggagccagtgcctcacttttcagtgacaattccctatcctaacttacttcttccattattccaaaaacaacagctctttgatctcttgtagactctagtccaatgactccatgctttctcaaaatccattattctaattcgaattcttagatgtcagagtacatcactataatcatttccttggaaacattctcgcttttcatattcccctcattttctttgtattcacattgcaaaagctccacccttgattatctcaaaagtccccttctcagtgcctgcagtggagcatctggaggttgctggagaaaatcctccagtgggctttcattttaaattttgttctcaaatcccaaatggcccaccgcttggggattagagacagttattagtctgtaataagcgtatatctcctttttccaagacagcgttttctcatttcttcttaaactttctaccccaacttctagtttaaggcctccctcatatcataagttattgagaaatagaaacgaccagaaatccttccctcaatctcccaccacgaaattcacacacctttctgcatctgctgggattttctcttctttgccctgttgcagcaaaaacaacaacaacaaaacccttcttccaatcaaaggcaaaaataccaaaataccccgacgtgtgttctgtattctttccctctcccagcatctcaataaactaattcctttggccatagaccgtcctgtatcatcagtgtctccttcctgctggatcattcctgctggtacacaaacatctctagtatcttcttttaagcaaagaaacaaaaccactcctatttttttttttttttttttttgagatggagtatcattctgtctcccaagctggagtgcagtggcacgatctcagccctctgcaacctcagcctccagggttcaagtgattctcctgcctcagcctcccgagtagctgagattacaggcgtgcaccaccacatccagctaatttttgtatttttagtagagacagggtttcaacatgttggtcagtctggtcttgaactcctgacctcaggtaatccacctgccttggcctcccacagtgctgggattgcaggcataagccaccacgcctggcacaaaaccccttcttaatcagacatccccctcatgctcctgctccacctgtctgcctcccttcatggcaaagcttcttcaaagagtggggatccacactggcaccactttctaggcccttttcccttcctccaccaacttcagtctggattcttgccccaccctccgtgacaactgcttttgcttttttctcctgtgggtattaccactggaatttctgctgccaactccaaaggatgccattctgtcctcatccaatgggacttgtcagcagtatttgccatgattgactgttctctccattgtccaagtaatcttatcttgaatcctatgaagcaccttcgttcttcccttctttctcttctctgaaggctgattctcttcctctgggccatttgaaagcttgcttcaagggtcagtctttggcagtctctttgactttacacattcttcttaggaggtgccatccacaaccatggcttcatgtgatttaatatactcagatgacacacaggttcttatatccagcccagacttctctgaattctaaacctatgttttcaactgactacattctcccttctcttagacccctcctgaaggaacccccgaacttcattctatcccaaaacacatttaaacctagttctctaaaatagctctcctttttagagaattcatttttgctaactggaaacttgatcattatctttgggaccttcttctccctcacttcttccccagcacaatgcccaacctcatgactccttagtatctccttgaaccatcccctttcccctcattggtcactaccacctgatgcaagctgccatcgtttcctgctgaactgctgcaccagcttcctaatgggtctcataccatcctaggcccttccagtccattgtgatttacaaaagaatcacaatgaaaatctgatcatgtcacccccttgtgctcgtcacccttcaatgcgattttgagtgtgtaaggctcattacaaggcccacaaagctctgcaatggtttgacacccatccactgcccagcctcatctcacactactctctcctcctcaccctggctatcttttatgaatagatatggcttttatgaataacctgactatcctctctataaatcatactcccttctctcaaaagtcctgtatgcattgtttctctgtctgaatgcccttttggcctctgtttatatggctgagttcttctcatccttgttgtagtttaaatgtcattgccttaaagaggtcttccctcaccatcctatcaaaatgggcccttcatctccattttctttatcactaaagtgaaaacaacttattgttaatatatgtctgtttatatgattcttttctttctccccaacaagatagttaacttgctcatgtgggaagcccataggttttatttacaagtgcttaagtaaatcaagcacatgcaaggagtgtagtaaatgattgctgaataagtgaatgaatgcataggaaatgagcacatacctatgaaatcattttttaatctttccattgtcctctggcttaagtttttgctcttgcataattttgttagagtcttcttgtaaataatagtgtccaaatgttggctctgacgagcaagtaatgataccatcttcattgtgatggtcctgggggagtagtggggtaagggggcagatcttctgagaaaatgcttcaattttccttcctcctccacacagtttccaccctttggtcctcattcttcagcacttcagttatgtaactgaattttctctgcaattattaagatatgtgatgttatttctattttctgagaaaattgagattcacaggtcctaagtaactgatcaaaggtccgcaaagcaaaaagttccatgcgcacagtttaaaaccaggtctgtaaaatgtagatattcgtgatttctctttctatcctaccacagtgcctctagccatatgacaaagtagggattccacctacattaaatgtgttgtagatggaaggggaaaactacaaagctaatccagtcgggaagaatcggcaagttactgtcacagtggaaatccctggaaaaaaaggcttgactcttactaaataccatgaaattatgcagcccagagttctttctttgatgagcacaaaattgttttttggtttacagttattttactgacataacattggcaaccagaagaatataggatgattaaatcaacatcataaggcatctctcaatttttttccagtaaattgcatagcattatttcctaatttatacttattctttctgtaaggttaattttgagtaggtatttaggaaaatgctactttctgttatattttataccttatttttaaaactgcaggtatttaagtcttccatattcataccatcccaactgcattgctttcatttctctatgtttacttccagtcgttacccatatattataaaatatagttagtctttacatattttataccacatagtgatataatttttattccacctttatttatatttaacatttttgttgttttagcaataaagaaggaagcagcagacagactatttcaaagcttaatgtgtgtagttcccaaattgtatttgttttcttagtatttgttttcctagctatgataaaaatgaagatttaagggatggttactacatattaacacagactagtaacttaagtagatgtaatgaaattttttagagagctgggtgattctctaatttaaatacaagtttaaggacatgtaggatagttgaacataaaattgagctacaatctagaattactactaaataggcaattattttgttttggcaacatatatagaggcactaacaattacatatgtctacctagaaatgacagaaggaacacttgaaatatgaagcttactttattagctataagtgtgtttttctttaataaaacatactaacttacttgaaatttatttatacaaactcacttaactccatgttcattcttgttaaaggtagtatttcatttgattatgattagggactttatttaaatcactaaaatttcattcttcatttaatgatgcctaccaaaatatagagctgtctacattagcactgctcatttattacactaatttcccaaaatatacaagtttattctaaaagctcttcataaaaattacaaagaagtggctttttaatttcccaaagttctcatctggattagaacaaggttaggataaatttttagtgaatagaaccatgagcttattttaaaccacatattatctaaattatctttataactatgcaggcatatttcaacaatttctgtgagagttcatggactcttcagagataagagtttcttttggctctttaaaccatttgagtattgtggtgggttgaattgtgggtccctaaaagatgtctatcagaatctgtaaatgtgacctcatttggaataaaggtctttgtagatataattaaggaagagatctcaagatgagattattctaaaatagagtgggtcctaaatccagtgatcaatacccttagaagagacaggaaaagagagacaaatagaagacacagggagaagagaagaaggctatttgaggatggaggcagagattggagtgatgctgccacaagccaaagaatgccaggagccaccaggagccaccagaagctgggagaagcaaaggagaattctcccttagagctcttgtggggatcatggccctgccaacactttaatttcagacttctgacctccacattgtgagagaataaatttctgctgttttaagctagaaaatttgtgataattagttgcagcagctgtaggaaactaatacaagtatgcatttgacactaattacagattttgaattgctttaaatcttagtctacgactatcttgtgtttatagttaagagctttttaaaaaaagtatattaaggactgaatatctgtcataaaaacaatgttatatatgtattattccatttatcctcacaaggttactgttttggttttattttacctactgcagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaaggtaatgactcttacatttttctctcacacaatatacaaccatgctgatcggtgtctttggatgtagtatgaagatgcatgattggtattaggaaaatccaatatttgtgatgatcacatctcatgtaacatacccagaactcagccagtaaagtgaagttcactgaaggaggaatcattccttagtgaattcactgtctttggtagaatagatgtctgagacacagttatcatattaattgttttaatgggtattacattggttacatggatatgagtgctttaaaataatccattcttaggccaggtacctaagaatcacagtaacttacgtctgtaatcccagcactttgggaagctgaggcaggcagattgcttgagcccaggagtttgagaccagcctgggcaatgtgacaaaaccccgtctctacaaaaaaatacaaaaattagctgggcttggtgaagtgtccctgtagttctggctacttgggaggctgaggtgggaggatcatctgaacccggggaggtagaggctgcagtgagcagtgattgtgccactacacttcagcgtgggcaacagagtgagaccttgtctccaaataaataaattaaagaatccatttttccactaagtcaagtaacttgctctccagtggcctaagtgatgatcataatagtaaaatagtagccaaggcttacttaagctcttcccctgtgataagaatcataccacatactttatatgtgttgttatttaatcctcaccaccactgttattcatttcgttttacaaacaagaagcctgagtgaggcttacacagctgtcaagccacagtgtgctatgatttgaatccacctaatctgatgccagcatgcagatttcttaccttctgcccttccactacagtatcttcctgtataaatccctgccaagaccatgcatttggttcatatacttaagtacactaattactctttaaaaggataaagatgtaaaaatttagttggttgatatgcaaatattgctcatcaacttttcccaattctcacgtgtaactgtattgttacggaaaaaaataaaaattggtcactgtatttctttaagtcactttagaattatacatgtaatcagaatggatgatagtgaaacacagcatgaaaccataggtagctagtgagaaattaaaatgtagatatagatttagaaacatattgggtgtagatttatgatagataccctgagtcttacaaatgaaggatgaccgaagccaagattatcctgggaagagaaacttctcagatgttctctgagtgttggggactatgatgaacaccataagcacatttcaagaaaagcaaatacaatgttgttttttgtttttgttttgttttgttttgtgatttcccaaagtattatggttcattttccaaaatcccaagtttcaaatcacccactattttaataattgttacaacctttcacccacaccaccattgtcttttcacatctgaatctgagtttgagtagttattctaccatctatgtttgtggtacaaacgagttgtatttaaagagtgctttttgaattctagggctctctgtaagttacttcatcaggatcctgtttctttgatcaagtcagcatgggtgcctaccaaatcatttctactttgctgtgtagcttttaaatctattttctgggtcactgggcttactcatggaatttcttttccttagtttgtttctctactatagtcagagtaaaatgagatgaatggatctgtatttaaagtgtggcattttcccagaactgccatggcctttacattcattctcaagaagatcaagatgagcagaaatgatcttcacagaaccaacatttactccaaaggcatcaaaactctatttcctgaaatgcatttgagtcacttaccagcccagtgggatctctgtgcaacaatttgaatttatatcagtttacaaattcactgaaaagaattgtgtcttttttggttagttcattcctgaagtctccaggctctactgaataacccagttggtttatatataccatcaaacttgcctaaaccctagtcactgcacctggttatctggcctattaaatgcacagtcagtaattcagtttaattcagttgaattcagtcattaaaaactcatacttgacatgtttctttgtcaagggcaaaaagaagtcaagtaatcagtgaaggaggagagaatttccagtgattttctgttacattcagtcctttcccatacaattagtagaagtcacctggctccttttaacattttggattattttcatacccctgtcttgctaaagagagtactttagctaaaaagccatttttcttttctgagaataaaagagttgccctttaaagaatcttttaagaacaagtaagatttctgagtcagtgtttagagaaatgccacaacttctggatacctataggtagaaatataatgtattagatattgcctaacaaaggtagtcgattcaatattttcacatgaaactttatcttagcggtgatagaatgcaacaaatacatgtgaaaattgaaataaggctgagcacagtggctcacgcctgtaatcccagcactttgggagtccgaggtgggcagttcgcgaggttaggagatcgagaccatcctggctaacacggtgaaaccccatctctactaaaaatacacaaaaaattagccgggcgtggtggtgggtgcctgtagtcctagctactcgggaggctgaggcaggagaatggtgtgaacccaggaggcacagcttgcagtgagctgaaattgcgccactgcactccagcctaggcgacagagcaagactccgtctcaaaaaaaaaaaaaagaaagaaagaaaattgaaataaataatactgcactccagttaaccttccatgcttccatttgtgaccccagtttacaccttcctcagattacaggctttaaggaactttagagccaatacctctgttggcgaagaaagccaactacccccatctttctgaaactaaatcataataatgagagatgttcttccttgatatccaataatcttggaacatgaattgtagctatgagatgagccaagtcaatagatattattggcctgtgctctattttagaagaccattcttctctggtgaccagaaaacctttgaggttgcaaagagattggtctgttttcaaaagcattgagacttttgagttatgagaatctgttcattttgagaagtgaggttttttttccattcaaaggatttaaactaaggaatttctgatggatatgcctgcattgacaaatatgcaaaaggataattattttttatttattcaaggttcatttcactgccatgaaaataaatcttgtcagctatttcatggaacagaaagaacaaaaaaaagcaaggcaaggagttggagtgttgggggagaatagaagggaaaaagaataaaggtattatgttaatcatcatgttgcttagagggataaatgaaaagcatagaccagctgggctatgaagtgcactgatagagctgaaatagagacataccagagttatgatacagtaatgaagggaattgttttcattctcagattttgctttcctgtgcttactccactttatgtaagtagaagtcttgtgacctgttagaatgagagtgattttctgtctcactgttaagatactaatttttttttttctcctagcgacatgttggcaaaatctgtccttacaaactgagacattagtgtggtctgatggcttgcaatcctgactgtttattcacttgttctcaatagccctggggctggatggtgagattggaaactttgaagtgggcaaggaatttgatgccatcctgatcaaccccaaagcatccgactctcccattgacctgttttatggggacttttttggtgatatttctgaggtaagtaaaagaaagttaatcaaaaggcatttatttcataaagtcgtcataatagcttccctgtagaaaagaaaatagaaaccgaaactttttaatggaatgcaggaaaatcttaaaatggacgctagagccctttgataattattataattttatgacagcaatgttaagaataatggtgttaacaaaacttttatattttgaatgtgtttgtgtatttgaatgtatttggctacaaacagccataatgtaactagcactcattgaacacttgctatgtgctgggtaggcatgggattaggcacttccatacctaattttgttcgatcatcagagcaactctaagagagtaggtactattaatattgccatgttaatttataggggcagtgaggcttaaggaaggctaagtgatttacgtaaagactcatagccagtgattagtaggtagagtttggattcacacctgggactttctgactacgagaggcgaggctcttgagcactatgctatgtcaatgtttttaattttataagaaaatgaactttgtttctcttattataaaatgtttttctatggataaaataaactagttcatcttacctgaaaaataattccttgtaagatattgagttcttcctaaaaaaagaattaagtattgccatttctaaattgatctacttgtgagagtaattgcgataataaatatgttaaagattttaaaagaaaaattctgtattatatgaagtttgtaccatttgttattataaaagaggaaaaatatatttttctctacccatcttagggtcaaggctgaggtcactataacaagagacagatttaacaggagaaaggcatacacatttatttaatataaatttttttgagacggagttttgctcttgtcgcccaggctggagtgcaatggcatgatctcagctcactgcaaccactgcctcctgggttcaagcagctctcctgtctcagcctcccaggtagctgggattacaggcgcccaccaccacacccacctaatttttgtatttttggtagagacagggtttcaccatgttggccaagctggtcttgaactcctgacctcaggtaatccacctgccttggcctcccaaagtgttgggattataggcgtgagccactgtacccggcctatttaatataaattttatgtgacataggtgccttcataaggaagtgaagaacccaagaaacaggtaaacttggatatttttatgctaggtttgatgaagagtggaaagttgtagagaaatatgataggacaaagagtgtggtccagtggtaataagctagagagaacttagcaaggcctgcttgttcagattcttctctgtgatcctttagcttcagagatcaggtatagggagggcaccccttacgtgatggtcttatgacctgcattggggtaaggggtaaggggagggtcagagtgaccttcctgtgtttgatttgagggtagcgtgtcctgaccccctcattattttcatattgcttattcttttactctctgattagagtaaatttctaagaatagggctctagggaatagtcctagtgatttttcttatatcaggggtgtccaagggagttcttagtttctgtttcaggttgtgccagtaaagccccctccctcatccctcttttctgcttatcagtagagacagaaactaaaaaccatggcttcaggctgctaaaagcctaaaacaaaacataacaaaacagaacaacaacaacaaaataaggcaggttggatgagcttgtcttacatcatacccgtcttgaaatatttgaattattttactaaattaatttctttaatttatataataccttttctctgatgactcaaaattcacatacccagaactttcacacaataggtaaacttctgttaattgccagtgggttattttttgttctgggaggtttttataaagcacatagccacttcttttttaattaatagaagtagattttgccattgagaaacaaattcgtatttctgggctttgtcaaccactatcagctgtgaatttacttttctaaatgcacaaatgagtctttcttattacttttattttccattttaggctgttatccagaagttcctctatctaggtaggtagatgcatgtctctatgctaaatattaaatagaacctttccctgtctttttcttgggtatggctctatgtatttatcctaccatatattaaactctgtggatgataatttgctttgattcattatttttttaacagtctgaagcatcaagcccattggtggcacattatttaaaggttctatttgaaatgcacatgactccctctagtcataaattctaagctgaggaatggaaggccaaaggtgaagagatcttcatgttcaaccctcttgtactcattcggtatctgacatactgccctgccatgtttttgtgacaaatgtatagtagagtctcaccacacgtgctggtgatgtactcacattcaattccattcactgagagagagagaaacagtaatgcagaatattctacactgcctcccattctgttcagtgagcccaggactgagtgaactcaagatggaaagatgcatgtgttacttcttgtggagctgattctggagcgtaaagagtagtatttctttctcagtgggggcaaaatgtaaaccaaccacttcagctgagaaaggacagctatagggggttgattcaactttatgtgatttctgcctctggtgcagaattcagaccctaatcatcaaattagctatggcattttctactagtcatatcttcctgttcagattataaacaatctgagggttgggggaaagcagcttttagtatttcctctcctagaagtatctttaaaaaaaatctctcccaatggcaaggaagatacttattgacacaaaaggattttatacatgattccttgatttttctttcaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta
